United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 6

SEQ ID NO: 15093 - DNA, 618 bp, Triticum aestivum
  Clone ID: PAT_TA_15093
attcggacgagggccgtgcagtcctgtgtaggaaaggaacagcggtggtgatttcaaaggatcacaggccgacatatgacgcagagcgtcaaagggttatcgagtgtggtggatacattgaggatggctacctcaacggtgtactctctgtgacccgggctttaggggactgggatatgaaactgccccaaggctctccatcgcctcttatcgctgagccagagatacactggaccaccctgacagaggaagatgagttcctcatcattggctgcgatggcatatgggacgtgatgagcagccagcacgcggtgagcacggtccgaaaggggctccggaggcacgatgaccctgagcggtgtgctcgggagcttgccatggaagcgaagaggcttgagacctttgacaacctcactgtgatcatcgtgtgctttgtccctgacctcgcgggggctgcctcagcagctgcgccttcttcagagcaggctccggctcccgctggaaggatcaggtgctgcaagagcctgtcgccggaggcactctgcaagctgaggagatggcttgagtctgaccattagacgctgctgtagagagaggcctgtgtttctgtgctgtggc

SEQ ID NO: 15094 - DNA, 1570 bp, Triticum aestivum
  Clone ID: PAT_TA_15094
gcaagggtagcggaagagtcccccccttcctccgattaacatctcccctcccattccaccgaccggttccccttccgtctccattcctacacaccaaacgcctcttccgatctcggcaacgacctcctcgtcgtacagggggccaccagcggcggcggaggccaatggaggccatccgtaagcaggcatccaagctccgagagcaggtcgcccggcagcagcaggccgtgctgaagcagttcgggggcgggtacgcggacagcgtgttcgcggacgagggcgaggcgcagcagcactcgaagctcgagaagctctacatctccacgcgcgccgccaagcacttccaaagggatatagttcgtggggtcgagggctacatcgtcacaggctcgaagcaagtcgaattaggcaataagttatgtgacgatggcaagaagtatggtgttgagaatacctgtaccagtgggagtacattgtcgagggcagcgttgagttttgcgaaggcgcgatccctgatggagaaggaacgggcaaacctgctgaaagcgtttggcacccaggtaacagagccactgagagccatggtgatgggagctcctttggaagatgctcgtcaccttgcccaaagatatgacagaatgcgtcaagaagctgaagcacaggccattgaagtttcaaagcgccaaatgaaattaagagagacatctggaaatggtgatatgatttcaaggttagaggctgctgagtcgaagctgcaagagttaaaatcaaatatggggactctaggcaaagaagctgttgcagcaatgactgctgttgaagcccaacaacaaaggctgacattacaacgacttatcgcgatggttgaatctgagagaagttaccaccaaagggtcctacagattctggatcaacttgaaagagagatggtatctgagcgacaaagaattgaaggagcacctcctccagtcattgagaattctatgccaccgccacccgcatatgaagaagttaacggtatattcatgaggactccaacagttgcagaattggtggagacagtggagcacttcctggctgaggcaatccagtcataccgagctgagagtgaaactgagctcaacctgtcaactggcgactacatagttgtccggaaggtgtcaaacaatgggtgggctgaaggtgagtgcagggggaaagctggctggttcccttccgagttcatcgaaaaacgggaccgtgtactggcgagcaaagtcgcccaggtcttctagaagttcattgagccatacatgtccctggcgttgtacaatgtgcattatgatgttctatcgtctccaaagacgttgatcagtgaagagctcgtggaaattcctttggttctatatatgttctttttgtcgagacatgtccctgtcggatggcttgttggtgcctcagggctcgctgtgtccactgttgttcatcttcatcctcccctcaaatatgacactgacttgaccatttttttgagaattttttgtgcggggacccaaagtatatatatatatatgtcaaggaggaatccatc

SEQ ID NO: 15095 - DNA, 520 bp, Triticum aestivum
  unsure (1)..(520): unsure at all n locations
  Clone ID: PAT_TA_15095
gatatgaaagcaaatatttgctcggttaaatataatcctggatcaaacttctacgttgcagttggatctgctgatcaccatattcattactttgacttacgtaatccaagtgcgcctgtccatatttttggtggccacaagaaagcagtatcgtatgtgaaattcttatctaacaatgagcttgcatctgcatcaacagatagcacattacgcttatgggatgtcaaggataattgtccggtacggacgttcagagggcacaaaaatgaaaagaacttcgttgggttgtctgtgaacaatgagtatattngcttgtggaagtgaaacaaagtgaggtttttgtttatcacaaggctatctcaaaaccggcagcaagccatagatttgtatcctctgacctggatgatgccgatgatgatcctggttcttatttcattagtgctgtctgctggaagagtgatagccctaccatgttaaccgctaacagtcagggaaccataaaagttcttgtacttgctcc

SEQ ID NO: 15096 - DNA, 839 bp, Triticum aestivum
  Clone ID: PAT_TA_15096
gggagctttccccttcctgttcctgtcgcctccgacatccgaccgcctcctcctcctcgttctactcgccgccccttctaggatcatccagaggcgtgccggtgaaacgcgagagcggtgaggcatggcgacgcagacgggggtcgcggcctccaaggtcctcatcctcgtcggtgcagggatgacgggctcgatcctgctgcggaatggccgcttatctgatgtgttgggggagctccaggagattatgaagggtgtaaatcaaggaactgcttcgggtccctatgacattgcacttattcaagctcagattcggaatttagcccaagaagtcagagatttgacattgtcaaagcccattaccattctgaatggcaaatctgactcaggaggcggtttatcatcctacatactgccagcagcagcagttggagcaatgggttattgctacatgtggtggaaggggttgtctctctcagatgtcatgtttgtcacaaaacacaacatggcaaatgctgttaagagcatgtcaaagcagttggagcaagtttcatcagcactagctgcaacaaaaagacatctaactcaacggcttgagaatttggatggcaaaatggatgaacaagtagaggtctccaaagctattagaaatgaggtcaatgatgttaaagatgacctgtctcaaattggatttgatgtcgaatcaattcagaaaatggttgctggattggagggaaagatcgagttacttgagaacaaacaggacgtggctaatactgggtatctggtactctgccaagtacaagcggtttaaaagatggaataaacacaaggttttc

SEQ ID NO: 15097 - DNA, 517 bp, Triticum aestivum
  Clone ID: PAT_TA_15097
caaatatgcttgtctacatactgcaaacaccttctgatgcacttagtttgcctgaagttctgtttttgtatcttgtatcagcaatggttcaaaagtttgacttgaccatcttttgacagtcacatggaattgtgatgtaggttttatctatcatcttgtctgctgcttaattttgaccagtctatctaaagttgatacgagtataacagccctggcattcattatttttcgtttgtttgtttgtttgctttgttttctcctctttttcccccctttctgagtaacagggttctgcctcagaagccagtgtaagtgactgatgtgaggcaattgatccgttattcgagtggtgtgccttgatatctccagagataagctgtgaatcttgaaacaattgcattgttacatctttctattttgcttcactttatgcttttgtcagcactgtttgttgcaccttacgtccttacacttgtgactggtgttgtcatactggaaaacctgtgcaggtttttca

SEQ ID NO: 15098 - DNA, 579 bp, Triticum aestivum
  Clone ID: PAT_TA_15098
gcggatttgtatgagactgaagacgagatttcacggctactatcagagggcaaggtgcccgttgcggtcggggagaatacaaagataagcaactgcatcatcgacatgaacgcgagggtcggaagaaacgtctctataacaaacaccgagggcgtccaagaagctgaccggccggagctaggatactacatcaggtctgggatcgtggtgatcctgaagaacgcaaccatcaaggacggcaccgtcatatagagacaatctacccatggtgcagtgcaaggctacaggttctcatcactcgtcgtcttgagagttagtttgaggcgcccaaccttgacttgagcttagggacaagaatagaggaagaagatgggctggtgccggatgcaatggaagacaagagaaatggtttgatgctatatcatcggttccagtagctcttcctgatgttatatgtagctgagtagtgtgaacagtgcaataagctgggcgagcaaagccgcagcaacttttggggatcgttggtgcatcttgtaaataaactcggacacaacaaatggaacttgcccgtcatctcca

SEQ ID NO: 15099 - DNA, 176 bp, Triticum aestivum
  Clone ID: PAT_TA_15099
gattcggacgagggttcaggatgtgacgattctggtgagctgggcgaatatggatgctctttcaccagaatttagtcaggcaagaaggatggatgctaaaacgcatctggaaatgtaaattgtggcaccttgtttgattttagaactgaaataatgtaaataattgcttgtaagtc

SEQ ID NO: 15100 - DNA, 705 bp, Triticum aestivum
  Clone ID: PAT_TA_15100
gagaggaactagttcgagttttttttttttttttttttcactatcaacaaaatatgctgtattatcagcactttaccagtgcctgcggcctgcctgaagagaaattgcagccgacagcttgacagtattagtgtattacagaaaatagtacccaccacaaagtacagaaaactgtagcctgacgctacaggtggatcacatagcctgccttattatgtacataaacctagatgttgagccagtatagccagggaggcacaaggttcagttgagcacaagacaaacgagcgcatacgcacattttattagttgccgtctgccgcacctaaattactgaaggtccttccctgcgataaggttcagttttgtaccaagtggtacacagtaacagttgagcaagctacgagcaccaaggcgaggaccagctactgtggctggtcaattgcaagcggcacggtcttcgccagctcgcggaacttcaatatgtagaacatctcaaggtagcgccttgtctcccgcctctcaagcttggacacatacttccagaaaccatagaccccggccaatgtcatcaacctctcagagtatatcttccatgtgtacttttcgtatatgcgcttaagtcctgcttcagatattttcacccagtgattcctcgtgccgaattcggcacgagggagagaactagtctcgagggggggcccg

SEQ ID NO: 15101 - DNA, 678 bp, Triticum aestivum
  Clone ID: PAT_TA_15101
ttcggcacgaggctctaatcatggaaaccaattcaatatagcactagctttcatgcaggtaactagctattaatgcatgtgttctacaatttggtcttgggttctaaattgtgagaattattaagaactactcggttatctcttcagggccagtaacacttctagactcactagaaatagatatattatctcttcacggcactactgtgttcttttctaattgagcatctaaaatagaagaaattatgcctatgtaccttttctatatacagtgaaataggttttgatagcaaaaatatgcttgcagtactacataaatagcgatattgcagaaatggtgcatttcaaatggcaaattacataccattttaatagtgattttagtttatccgtttgaaaagctcttggatatctgattcagtcacctgataagtttgccgcctcgcattcgctgttgatgaattggttcttttcatgtgtgctttccctcatcagtcacaattcttggtgtagtttccaggaacttttcagaaaaaacagtgatatccaatgtgttttataacacgctacgatgtacatgcatcttccattttgtgttttgtgattcttaggactgtcctgaggtagatcattgaaccgactagattcttttatgtttttgaaatgcacttacctggc

SEQ ID NO: 15102 - DNA, 537 bp, Triticum aestivum
  Clone ID: PAT_TA_15102
ttggaaagccttagcagccatgtccgcaccgtagttgcaactctggggggcaagcaaggagcagccagcagattcgacagatggcagtaccttcattctgggttcacggtatggctatcggtatctgatgcaagtgacgaagctactgcaagagaagaagcccgaagaagcgtgagcagtggaagcgtgtcttacgccaaggcggacgtggcggtgaagcttggcgggtgggacccacagtacacgcgagctgttgcgcagggctgcctcgtcgccctcaagcagctaaccttagcagacgagaagctggcagggaagaagagcctctacatcacgcttgggtgcatgaggcgattggcccaacatcgagcctccaggctgggaccctgaatccgacgccccaccaaccaacatctgaaccatcctcctctgcctccgcgcagttgtattctgacgacaataatgtaacaagaattctctgcatcaccattttgggtgtaataataaatataagagagaggctgtcggttgatgcat

SEQ ID NO: 15103 - DNA, 655 bp, Triticum aestivum
  unsure (1)..(655): unsure at all n locations
  Clone ID: PAT_TA_15103
cggtgatcgcctcacccgcgccgccaaggtactggagcagctgagtggtcagtcaccggtattctccaaggcaaggtacactgtgaggtcgtttgggatccggcgcaatgagaagatcgcatgctatgtgacggtgcggggtgagaaggcaatgcagctgctggagagtggcttgaaggtgaaggagtacgagctgctgaggaggaacttcagtgacactggctgctttggatttggcatccaagagcacattgatcttggcatcaagtatgatccatctactggtatctacggcatggacttctacgtcgtccttgagccgtgccgggtaccgtgtcgcccgtcgccgcaggtgcaangtcccgtgttgggatccagcacagggtcaccaaggaggacgccatgaaagtggttccaggtcaagtacgagggtgtgatcctcaacaaggcccaagccaacacctcctaagcctcacctcacgttagttgtccctccccctggcgctccgtgctcatgttgtgggtgtggctggcgggggtgtgttacaagaatcatcggttcctttgcctgcggtccccggttctgggcctactggggtgggccccatgtgtgtgcgcgcgccccatcttaaaaacttctggggcgcactttggc

SEQ ID NO: 15104 - DNA, 916 bp, Triticum aestivum
  Clone ID: PAT_TA_15104
ttttttttttttttttttttttttttttttcttcaaaacctcaaagatataaacatcactcatacagcaacaaaagcatagtacatctactctggcaaacagtgctattacacaaccatgtccttcataagggagtttatctattattacaatagaactgcctggttcaacatgtttcagatagcaagaaactagtgcatgttcttcatcaggccaaccatctttattataacaacacattcaggcatttcggtgatgagatcaaccttcggtgcttgatgacttgacgacggtgacagggcaggttgcgttgttcacgacatagtcgctgacacttcccaaaagcaccctcttgagcttgccaaggcccctgcttcctataaccaagcagctcaacggggtgtcatggataacttgacagagcttctcacgtggatctccccaccggactttcacaaccaccataatctccttctgggtagctgtagtgttcaggatgtccaaggtttctatgtccggctttgctccatatttcttcgcgataatagggtcagagaattccgagaggggaatcaacggggagccggtggattcccagaggatggcctcgctctgctcgtagtcgggctccttgatgacgtgcagcagcagcaggtggtcgccggctcgcagcaggttggccgccgcccaccgcagcgccgcccggctcccctccggagaagtccgttgctagccccacccacctctcgccctcggcgccggccatctcctccccaagctcctcttcctctcctctgcaggttcttaggttctagatcttgtggagttgtggtggtggcttcgcgtggaggtcaggtcactgtattggactgctgatggcggtggcctatggatgccaagccaaaggacacttgtc

SEQ ID NO: 15105 - DNA, 773 bp, Triticum aestivum
  Clone ID: PAT_TA_15105
attcggacgagggttgttttgctggctattgcatttcatttgaggtgcaatgtgctgcctcttcgttccaaacgactatatatgttttgtttttgtaatacattgtttttactatatatgtaggcatagtgtatatctaaatgtatatagaaaaataggtaagaggaagtaagtttgtttgcacgtgcctcactgaaattagagcaggtggaggtaaacccatgctgccggcagaacaaactgagggtgttttgcagggagaaaggaatccagctctgcgcctactctccattgggtggcaagggagcaccatgggccaacaattctgtcatgaacagccctctcctcaggcagattgcccttacaaagggtaaaaccgtcgcccaggtgtgcattaggtgggtgtacgagcagggcgattgcgtgatagctaaaagcttcaacgagaagaggatgcgagagaacctcgacatctttgagtggcaactcacggaagacgagtgtcgcaggattagcaccctcccagaatcgaggggaacctacgatttcttcgtccatgaatctggcccgtacaaaactgcccaagagttttgggatggtgagattgtggctggccaggctaacaatgatgctttgagtttggatcctaccaattgagaccagcatgctaggttactactagtcaagaaaactctatgctttcattccgtttacaaggcatcctgcactatgtttttttatattttgcgtatccttttaatcttggatatatg

SEQ ID NO: 15106 - DNA, 714 bp, Triticum aestivum
  Clone ID: PAT_TA_15106
tcggcacgagggtgcaaatgtgggatgcctttgtgtatttgtgaagcaccaaaaccagaacctgcacctacacctgtaaagaatatcagcaccgttccctcaaccacacagtcgaatccaaagccaaagaagcctgctaacacccaacagaaggcttcagctacttccagtaacaactcaagctcgttcttaaatattggattgatgagcaacgatagcaatgataagggtctttctgactatgaagttagtggggagggactcagagaagcaattaaaggcggggatgttaagggtgtaaagaaacttcttacacagggagtggattgcaactactgtgacaaacaaggatttactttgctgcatttggctgcattgtttaaccagacggagattgctcttattctcatggaccatggcgcaaatgttgaaagcaaaaatgggcaaggggaaactcctttggactgcgctccaacaatgctgcagtacaagatgcgacagcggatggaagaacttgcggcttcaaggagaccactagagtgaacggcattcatgctatttactggtgtttttcctattccagtttgtgtcaaacgtggtgtcaacgaataaagcagttaagtgagctgaaagcttcttgctggtgggataggtgtttggtccaccagtatactatccagaaacgttcgaatgccagtcacgactcacgcgtat

SEQ ID NO: 15107 - DNA, 1125 bp, Triticum aestivum
  Clone ID: PAT_TA_15107
gggtggtgcagctctttatgtgctgtaccaaagttccatgcagctcgaactgaccaaatttggccaattactaagcagttcataaaaacatcatcagtggaatggagtggtccgttggatggcaattcatcctgcatggctgatgcttgcaatgaaattagttcctgcaatgcttcacccatggaatacagtggcaattctgattctgatactgaaattttccaagtcaagcgcacttccagcatattaggaagatctgctcctgacacggatacaacaaacatgtctgaacattctgttctgaaaaggctgaagaacgcatccccagaaacacaacatgacaataagcgacctgaagaagactctgagcgtacttcagttccctcagttagtatgaggcacaataagtcaaattctgcctcttctgacgaagattatactaaaatggttcccattgcctgaaccttgaagcggcggcagctggaagctcaacaaggcgataccagttatgcggcgcagcagtcgaaggtgtatccatctaccagcagctgttcccagcagcagtctgcggttgtaactctgaccggattctcttcgtcagagcggacatactgggtgtagaggctctagcctcgtaatacgagcaggatattcgcctggataaggaaacaagtgctaatgtctcgtataagcaagctgcgatttctgatattggtgtctatcatggtccatcagttgggactaaccaggacataagcaacagtgaagcaaacttgctagaagcaaatgctgctgacggtggaaagagctctcctgcaacttcaacgttgacatcttttgcacatcgtgatgggtctctgcctgcagaaccaaaggtccatgcagctcgaaccgaccaaatttggtcaattactaagctgtccgtaaaaacatcgtcagtggatggaaatggtggcaattcatcctgcatggctgatgcttgcaatgaaattagttcctgcaatgcttcacccatggaatatagtggcaattctgattctgattctgaaatcttccgagtcaagcgcagatccagcatattaggaagacctgctcctgacacagagacaacaaacttctctgaac

SEQ ID NO: 15108 - DNA, 780 bp, Triticum aestivum
  Clone ID: PAT_TA_15108
aaagaataattcatatgggagatttggtcaaacttaaaaaagattgactggcacggattctaggaattgaagctttcagggacagagggagtagttagcaagcattcatcgccttaatagtgtggaggaggctactgcagatgttgagtggaaacttgaaggaaatgggccatggaacataggaacagattttgaatttatccatacgccaggccataccccaggctcggtgtgcttgtattacaaaccgccaaaggtgctgttctccggcgcgcgggttgcaaagtcagaagaatcagacgacctgaatctctttctgatgtacagcaaacagtcagtgagccttcagctggaaagcataaggaaactattggaggtagagttcgaatggcttttacctgggcatggctatcgaattaggtacaaagatgtgcaggccaagaatgcagccatggagtccctcctagctaactacttaagctaggccgcctaggagcattagtgctcaaaataaggattgcaggaggctgaatgttgatgctatatttccagagaatagtgtgcatgaactcttgaatgtgcatttgttaccagagaatgcaatgcttttgtactcccgccgtataggatttagatatcgttttggacaaagtttaggtcaaacattagaaatataaatcatcaataactttaaaattattgagtttgtaaatgtgaaaattatatgaatagatctgtcttaaaaatgctttaaaaaaaaaaaaaaaaaaaaaactcgag

SEQ ID NO: 15109 - DNA, 590 bp, Triticum aestivum
  Clone ID: PAT_TA_15109
ttcggcacgaggcaaactcaatcctgtctggtgttctgaaggtcactggctttgtcacaagcaccgtgttgaactccaaaccagcacaaaagtttttcaagttaatgcctggcgaagttattcttgcttcacttgatggatttgggaaagtatgggatgctgtggaagtgtctggcaaaaatgtgatgcagacatcctcagttgtcaccacttctgttgtaacacacagatacggtgaacaagcaggggaagccacacacaattacctccacgctacaggaaatgctctcggagctgcgtgggctgtattcaagattaggaaagcactcgaccctaagggtaatttgaagaagtcatctttcgtcagccaagcagcgcaccctgtagctaaagaatcaattgcgaggcaaaagaagaagtgacctggcctggccgtgggcccctggacccccgttagttagtcggtggcgcttgttgtgcgttagcggtcggttccggggggctagagctggtgggtttgtgactgttgtcttggggtgttggtctcctctccccttcgtttctcgcgcggtggtcattttgttgtacta

SEQ ID NO: 15110 - DNA, 704 bp, Triticum aestivum
  Clone ID: PAT_TA_15110
gttatgaagagcgaaggtgttaacttaataggggagaatttcatgtctgggcttaaggttgtgtttgatcgagagaggaaggtcttgggttggaaaaaatttaattgttacagcgtggacaactcaagcaaccttccagtgaacccaaatccttctggtgttcccccgaaacctgccttgggaccgaacagttacactcctgaagctaccaagggtacctcgcccaatggcacccaagtcaatgtattgcagccttctgcaggtttttcgctgaagctgcattgcaacagaaacgtctttgtcgccgctgctctgctattgctcgtgatcctttgatcacctctactccccatgacagtcttttcaaaacaaaatcgccagatatgataggtttagtcaacacttgatcaccctgtattgatttacgtatagtgctataggatcacattcttttggcttgtgtccacagttccagtaggagataggatagaacacgggatgagtccatagcctcataggccatttttgttccatttttacacgttcataatgtaccttgtgataatttactccacccagagtttgtgtggtggtggccctggtgtgtgtacatattagagatgacttcaggatgtattgaccttatagactaagggaataatgatgctcacttatagaggtatacttcaaaaaaaaaaaaaaaa

SEQ ID NO: 15111 - DNA, 684 bp, Triticum aestivum
  Clone ID: PAT_TA_15111
gattcggacgagggccttctaaccaaattgggggagaaaaatggcagaatttccattggatccaccactttccaagatgctactagccagtgttgaccttggatgcagtgatgagatactgaccatcatagctatgattcaaacagggaatatattctacaggccacgagagaaacaggctcaagctgatcaaaagagggccaaattttttcagccagagggagaccatcttactctacttgctgtatatgaggcctggaaggcaaagaacttttcagggccctggtgttttgagaactttgttcaatcaagatcattgaggagagcccaggatgtgaggaaacaacttctcacaatcatggacagatataaacttgatgttgtatccgctgggaaaaacttcacaaagataaggaaagcgatcactgcaggcttctttttccacgccgccaggaaggatccccaggaaggatacagaaccttggtcgaaaatcagccagtgtacatccaccctagcagcgcattgttccagcgccagccagactgggtcatctatcatgagcttgtgatgacaacaaaggagtacatgagggaggtgaccgtgatcgatccaaaatggcttgttgagctggcgccaaggttttataagggtgctgaccccaccaagatgagcaagaggaaaag

SEQ ID NO: 15112 - DNA, 701 bp, Triticum aestivum
  Clone ID: PAT_TA_15112
aaaacactaaaatggcgatggcggcggcgaggagagcgctcctggcccacctccgcgtgccggtggtccaccctgcagcggcggcagcgaccatccccgcggcagggcggctcctgtcgtcgacgacggagacaaaggggtcgttcctcgacaagggcgaggtcgctgaccgtgtcgtctccgtcgtcaagaacttccagaaggttgaaccctcaaaggtgacacctagtgctcattttcaagaaggaccttgggacttgatagcttggtacactgtggagatcgtgatggcgtttgaggaagaatttcccttttgagatgcctgtacaacgatgcagagaagatggactccatcaaagacagcggttgatttcagtgcttcgcatcctcgaagcaaaataagaggattcctttctttatcctaattcaaagtgtgttttgcacttttgcaccaagaactttttccgccacgggacgagtttgacccagctcgccgcagtagataggagtcattcttacttcccagccccttctacaacgatctgtgtctgttggcatccaacctgcaccatccgtgtctctgcgctcgtgcccccatgtgatgcgtgtgaactgtggaacacacggtgcatggaaaccctcattagtaaactaatccagaggtccattttgggatttcttcgaaaaaaaaaaaaaaaaaa

SEQ ID NO: 15113 - DNA, 618 bp, Triticum aestivum
  Clone ID: PAT_TA_15113
caaatgtgttaatcccggccccttgtcgtgcgtgcgtgcaggtgcgcgtgccgctgccgattgggttcgcggtgttcgtggttcacctggcgaccattcccatcaccggcaccggcatcaacccggccaggagcctcggcgccgccgtcgtgcacgcagcatggaaagaccattggatcttctgggttgggccgctgatcggggcgacggtggcggcgttgtaccacaagctcgtgctgcgcggggaggccgtcaaggcgctcggctccttcaggagcaccagcgccacggtgtgagagtgagagcatctaattctgcttcctgcctgcagcgtataaacgtgcatatgaagcgcgaagctgttgatttgcctgaacaagattggcgccctccgtgtgtgtagttcctccaactgattcccaattcgttgtcgatcgtctccttcaatatatgcaatatgctacggggtgcttattacacgaacagtatgtatgcacgcttgtccgtgccatttcttttttttgtttgggaactacgaggtcgtccatgtatataaacctatgttctgcttgattagttatctatacacatgttgttaccaaaaaaaaaaaaaaaaaa

SEQ ID NO: 15114 - DNA, 554 bp, Triticum aestivum
  Clone ID: PAT_TA_15114
ccctcgcgtccgtccccgacctcgcctcccgtcggatcgccgccggccccgcccgccgtggctgtccccgtcctcaccgcctccatccaagccggctccggatccaggccgctcagtccccgcccgcgcccccacacgtcaatctccgccgcctccggccccgcccgtcacgacctccccgcgtgcagatccacagtcgtcgacctacccggcccccgatctgcccggcccgcgctcctccccgtccacagcatagaaagagggaacccaggaacccctgtacggcctcagcttggtcataagtatttcgagaaaccccaagaaatctgaagaaacccggagggagggacaccacagaggaggccggacaagatgatcggcgtggggaaggcgaaacagtacgcaaacgtgctcgacaagcctctcggtcgtgggagacaggaggtcagtttgagtgcttttgcattcctgttctcggaattgggtcaatacaaccagacacaagttgacaacatcgctgagctggaacgaaggctggagggacctggtatgct

SEQ ID NO: 15115 - DNA, 1113 bp, Triticum aestivum
  unsure (1)..(1113): unsure at all n locations
  Clone ID: PAT_TA_15115
cccctcgcgtccgcgctgtgttcttcctcatcgacccactgcgcttcccggctgttcccggcgacggtcggggacattcccagggacgagagagcctggattctgaagtgcaggcagatccacaccgtcggctcctgctcctccgacggccgcttctcctcccgcaaagtccagcgccgccactggagctgtggacgacaaaagctaccttacttctagagttgcagcgaagaaatagtgaagcctggaaccccttctaaacggagtcagcgtgtgtagtattccaataattctgaacatacaccaagggaagatacccagaggaggtgtggcaacatgatcagagttgggaagccgaggcagtatgcaaacatgctcgacaaggccatcagccgaggcagagagaaggtcatttacagtgcactcgcattatggatataggaggtcggtcagtgtgcctagacacaacttgacaaccttgctgatctggacagtaagctgaagggcgcaagatatgctgttggtgccagagtgcttgaactgatgtgtcacatggtgtaggggcaagaacgcttgactcgattgctggggagtttaacatgcattcacagcactgtatggaaagtactgttcggaaaggtggctgactcgcttgagaaaggaacagaacatgaggatgaatacatgattagtgaaaaggagcttcttgttaaccggttcatttccgtgccgaaagacatgggggcattcaacttgtggagcttttgttgcagggattgtaaggggcgtattggacaatgctggttttcccagcggtagttacggcacattttgtgccaattgaaggccagcagaggcccaggacaacaatcttgattaaatttgctgaagaggttttacgtcgggaatcaagacttggctgaaatgcacaccaggctatttcttctgttctgattgtaagatgaatccatttcaaatatgttttgttcttgatttatgtaatactaatatacgggtaattttccatcgaaaaggtatactggtaatttttgagaatatagcaatacctcatttaagagtgtccgacacaaggatacaacaatttttggcana

SEQ ID NO: 15116 - DNA, 705 bp, Triticum aestivum
  Clone ID: PAT_TA_15116
ttcggcacgaggactcaaggttcactttgtgatttgatggttattctttctcctttgttgccatatgtgccgctttggtactgtatgacgttgtatttggacatgaatacctggtgcagattttgtcagctatttctgtctgatatggtcttgtatatggtcattccactccatactcgttgagttgtggcatctgtgttactgaatagtgcctgattcttgttcaaaaaagaaagaaaagtgcctgtctgcctgatgcatattgttggtgctatctctagggcaaggtgacaatcaccgccaagtctggagtgaagttggagattccagatggagctgtacttgagaacaaggtataagcaacatctcatcgatatgacattcccaattgctgtgctttggtttgccctgacacatggtttctgctcgctccaggatgtcaatggccctgaggatctttaagcgatgcttgacgtcaccagtttttcccaaggacatgtcacaggagctggcaaccctaatcacccccactgagctctatcttttgtaattttcttgtgcattccgcttccgttgtgagggttctgtgagcccgctagagaataattgtgatctttggtgcgtctgtacttctgtttttggtgcaccagggacgtatattttgctgaaatgatctttgctgtatggcgtcttaccgggagtccg

SEQ ID NO: 15117 - DNA, 686 bp, Triticum aestivum
  Clone ID: PAT_TA_15117
gcacgagggttgcacttgcagcgatggggaaggactccaagccgaaggacgccaaggggaaggacgccaaggggaagggcaagcaggcggccggctcctccggcggtgacgacggcggcggcaagggaggcaagggcaagggcggcaagtccgctgacggactcggcacctgcacctacgtcaaagctaggcacgtattgtgtgagaagcagggaaagatcaatgaagcttataagaagttgcaggatggatggctggactcgggcgacgaagtccctcctgctgagtttgctaaggtagcacaagagtattctgaatgcccatcagggaagaaaggtggagatcttggttggtttccgcgtggcaagatggctggccctttccaggaggttgctttcaacacacctgtgggagcttgtagcgcaccattcaagtccacgcatgggtatcactttatcctctgcgaaggaaggaagaactgatccagaagtgtgattcaggttggggagactgcatcatcatgctgtattatgcaaactactcgtcttctctaataagcgctggacatgtgtactttgtgttgggctattcgcatcccggccctaaggacttgccaaaacaaaagaatgtgtgttttgctgtaattaacatatgatactggtaatctgatatggcatacctatccg

SEQ ID NO: 15118 - DNA, 707 bp, Triticum aestivum
  Clone ID: PAT_TA_15118
ggggcgatccccgctaacccgaacatgaaggctatacaggaatcgctggaggatatttcctacttgttgaggataccacagaggaagccatacggttccatggagagcgatgtgaagaagtccatgaaaatagcaatggacaacaaggaggcgatccttggaagcattcctgcagagcataaagaagagggtgccaagctatatacttcactactcgaagagaagggtggtttccagactctcttgaaatatatcaaggagaatgatcctgacaaactttctatagcacttgcttcgtcacttgatattgttgctgaattggagctgttacaggcccctggtctgtccttcctcctgccccagcagtacttagaatatccaaggctaacaggaagaggagttgttgaattcacagttgaaaaaggtgacggttcaacattctttccaactggtggcggtgaaccgaaaagtgttgctacgattcaggtcattatttgatgggtactctgccccactgactgctggaaactttgcaaaaatggtcttggatggggcatatgacggggtaacacttaaatgtgcaagccaggcaattattgccgataatgagactggaaaaaatgggtatactgttccattagaggtcaagccagcaggacaattcgaaccattgtacagaactccgctaagcattcaggatggagaat

SEQ ID NO: 15119 - DNA, 1917 bp, Triticum aestivum
  Clone ID: PAT_TA_15119
tccgccacgagcctagacctgccgccgaacgggccccagccaccgcccgcccctcccgcccgcgctcgacgtctccgccccacatcgccgcgcctccgcccccgccccgtccgcagcctttccgtccctgatccgcctccgatctgttccgcgacaggcgctgctgctttccttgtaggacgagcaggagccgggggacgaggaagcggaccccctgccttctagggcacggccgaagcagatgggggcgccgaagcagaagtcgaccgcggaggaggaggcggcgcgcaaggccggggcaggcgagccctgggccggggaataaccagacatgctcaccgacccagagttcggcagcgtcgtgggcggccgcgctcacgtccgcgtcaggcacgaatggcgccgcgtaattgtccccctgactcaaggaccccgtgttcagcaacatcctgcgctaccgctctaacgttgacctcaaggacaagtggcggaacatgaatgtcacggtgaacgcgtcgggcactcgcgacaaagtgaggacgacgaccacgacgacacccacggctaagaagccgaggtctgctccgaagcaggaaaaccacccgacggcgatcaccaccatcacctccgacggcgatgatgacgtcatcgacgtcgaagcctatcataaagcctatcgtgacgtttactacaggttcacgggaataattcgctatccgaagctaagaaaatatcatactggtaggctcttgaacactttgaatgaccctacaggttcatacaaaccagcgttgctaattagcattgaggaacattaatggtcaccccctgattttcttttgtatatcggcgaaccgaaaaagtgccgctgctgggtaatgttaaagaggacccaaccaaggtagagaaggtagagcgggatggctttaccgcccacactaaatctcaggtagatgctgaacttgcacggatgagaaacatgagcgcagaagaggctgcagctgcagcagctcgtgcggttgctgaggcagacgctatcatggcggaagctgaagccgcagtgagggaagcggaggctgcagaagctgatgctgtagctgcacaagcctttgcggaagcagcaatgttgacattaaaaaacaggagttccgcaaaattgatcattcgaggttgagacatcttgtgggagctgcttcagcgtccgctttcctctgaccttgttgtgcgcgcgtgcatccctgctgaattccagcgcaaactaactgatgctttggtgttactggagccatcgagctgatggcaatgctgatctgttattttaatccatgcaagctcatcccagattcaagcagcgcaaacttgcttggttttctgacttgcaccttgaagctagttacctttctccctcatgccggtttgccgagggatggaggaagacaaactcatatttaactcccacattacagagacgtaaatgcgatctgcacgggctgtgggatgatgagaagctgaataaatacagatgatggtcattccatctttctggacccttgttgctgtcatggtttaggtcactgccatgttggaattttattcaccatgtgttggattaccttaccttccttttgcggcgaatcttccgaatgaacggtgcctttcagtttgccgcttgtctgtctggtctgccccaggccaaggtatttggtacagaataatcacagcgtctatagaattcattcatgttttcagtctgtataagtttgccaagccaaaatagttggcaacataacatgttttgggcaggccgaattcacccaatatttatcttggtattgtaccggtgcttgggaaaaaacgcagttgtacatttggtgatccaacgtctaccaatctttgatataaaaaaaaaaaaaaaaa

SEQ ID NO: 15120 - DNA, 620 bp, Triticum aestivum
  Clone ID: PAT_TA_15120
gattcggcacgaggcgacggcggcgaagtcctcaagatgccatccccggtgggcatgcgcatgcgcagcttgaaggtcccggccgaagccctctgcgagcgcctaccggcggcggcggctgctgctgccggcgtcgacgaccctgctgctggcgccgccgtcagggtgaagctggtgatcagcaagcaggagctgaagaagatgctcgacaaggagggcatgtcgctggacgacatggtgtctctcatgcgcaaggaggcgagtggccgagaacaggaggaggagttctgctgtggagggtggcgaccggcgctggagagcataccggaaggcagcgatctctagcacgtacgttatactgcctggcatcgttcttcgatcatcgatcagattcttgtgaaagtcacaggatcagtgatcgtgcctacactacatacatacaagaagttacacaagatactttttggaataagcgtaagcaaagcatatgtatgttgggtatagcatatatacacatgtagattattatatatagaaagagatatagtatagatatagatggtaggagttttgagatagggattctcttcatcttttcttgttggttacatgctttgtaa

SEQ ID NO: 15121 - DNA, 440 bp, Triticum aestivum
  Clone ID: PAT_TA_15121
ctttcattggaaagagatgcagaagaggaggctggctccagggcaaagatgaaagagcaggcaaatgcacctgaggatttgcccccacaacttctctttgctcatcagggccagaaagacttgaaagaactgcactggcacccacagataccgtcgatgatcatatcaacggcaattgatggattcaacgtgctgatgcctagcaacattgatacaaccattcctggcaacactgatacagcaatggcatctgctgagccataaggcgtttctggtagcacggctcccagtttgtaattccaggtttatgcagtggtgtatcctgagtgtagttcgtatttgtgttaagtgttatgctgttgtgttcaagcatgatgagaaaattttggttggctgacattctatgagatataagatttaataaaaaaaaaaaaaaaaaa

SEQ ID NO: 15122 - DNA, 872 bp, Triticum aestivum
  Clone ID: PAT_TA_15122
gtcatggctgacttcgatacgtcccgcaacgatatcgttgaggaggaggagtttgtgcaggggatgaagaaatggctcaacgagttcaagcgcaacatgcccgcgggtggcgccttctccagcaagttcaatgaataccacgagaggacacggcaggagcacgaccagctgattgacaggtccgatgaggcggtggagagcgtggagaaccctgggtggtgcatcaccaaggctgtggcactgcggctactgggtgctgccatcgcggccgcgttcgcagacccgctcgtggacgctgttcacaacttctccaacgccacacacatcccgtccttcttcatctcgttcatcgccctcccgcttgcgaccaactccagcgaggccgtctccgccatcatcttcgccagcaggaagaagcagaggacctgctccctgaccttctccgaggtgtatggcggggtgacgatgaacaacacgctgtgcctcggtgtgttcctggcgctcatctacttcaggaacctgacgtgggacttctcatcggaggtgctcatcatcctgctggtctgcgtcgtcatggccctcttcaccagcttccggacgacgttcccgctctggacctgcctcgtcgcctacatgctctatccgttctcgctggtcatcgtctacatcctcgactatgtctttggctggtcataggctcctcgagtgaacacgacctgattggaacacctggtttttaacagccgccggtgtttctgtttgaccttcttgtaattttgactcctgtgaagctatctgtccagactttctcatgtgatgtaatcatgttctacttgttctgtttccttgagtatccaaagcacgtacttcgt

SEQ ID NO: 15123 - DNA, 1502 bp, Triticum aestivum
  unsure (1)..(1502): unsure at all n locations
  Clone ID: PAT_TA_15123
cctctcttccccctcaactcccacgcgcaccggcacctccccttttcttgcggaggagcagcgttagggtttcggaaagctaagccatggcggagcagccgcacgccgaggacgccggccacaagccggagaccctgatggagaagatcgccgacaagctccacgtcggcggcggcgaccactcctcctcctcgtcggactccgacaaggaggaacacccgcgcccctcgccgccgcccgcccgctcccgcccccgcccccgccccctccgaggtcaccaccgcctccttcgccgcctccgcctccgcggcggcggccgatgccaagaacaagatgttccgcctcttcggccgcgagcagcccatccacaaggtcctcggcggaggcaaacctgctgatgtgtttatgtggaggaacaagcacatctctgctggagtactaggtggtgcaactgcaatctggatcctttttgaattgcttggctaccatcttctggctttccttggccacgtgctctcatattctctctgggtgttctctttctctggtctaatgcctcatcattcattaacaagtctcccccaaaggattcccgaggtgatcattcctgaagatctggttgtcaacattgcgctatctacacgtcatgagatcaacagagccttcgcaaaccttcgtcagattgctcttggccgcgacataaagaagttccttattgtgattgctggtctatggctgctttccattctcggtagttgctgcaacttcttgacgctgttctacattgtttttgtggttctgcacacagttccagtaatctacgagaagtatgaagatcagattgatacctatggtgagaaggggtggattgaggttaagaaacagtatgctgtgtttgatgccaagggttctgagcaaagtgccgaggggccccttgaaagacaagaagaactagaaacgagtggtaccgtgtggaatggaatgatggcgactggttcgtggctgcccttgtggtatgagcaccaaatttctcaccagttgtcttgtgttatgtaaggctgttttcgatgtttgcgactttgatgagagtagccccgggtagcttaccctccaacagtaatgcagaggcagcacttgttttgctgtaccgctgtttgatttttgatctgttaaggtgtcgcatgggtacggtttctggacgctgattttgctacttgcattgctgcagtttggagtattgatgatgtttatcaactcgttgggctttagatgtcatgtactcgtttctattgtactactgctatcattgttgcaaaacaactttttgtgctattaaagcccanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaannaaggggcggccggttttaaagaatccaagtttacttacccgtgcttgc

SEQ ID NO: 15124 - DNA, 816 bp, Triticum aestivum
  Clone ID: PAT_TA_15124
tcggcacgaggcaagggctgcacgggttgatggtgatagccaacgtcgagcatctgttgtttctccgtcttacttcagtaatgggtctggttccagatctagacctcccagtgttcctcctctgatgcctcaattcatgagggctcatggcagcatcagcgaacagtaccaacagaattcatcctcgagcctatttgctggggcgcataggtcaggaggcatgcgacctgccccaacacctctaccagagaaccctaccttttccttgttcccgccgggttcatctggccatagctcgatggagactgatgatgtgggaggaagccggttctacgcctgggagcgtgaccgattcgccccatacccgttgatgcctgtggactgcgagacaagctggtggacctcacagcagcagtctcatagcacatcagagcctacatccgcgccaaggaggctgtttgggcaatggctcggcgtcggcaggtcgtcccctgaacatagatcgcccgaggggtcttcgtatcggcaaatgcactcaccgcggatgtagaccctcgctgctgagctgagaatccaagttaatttggaatccgagttgcttgtaagaaacgatgggaaacccattgtattaaagttaagccgggctgcgccgtaaaactttgggacaatgttcgaggggccagaaacaggaaatgatccggctgagaggatattttgatttggtttatgtgaattccatctcgtacatatttgaaatcaagttgggatgttcggagcttcgaaatgtgacatgatttgttatgctgcaaaaaaaaa

SEQ ID NO: 15125 - DNA, 765 bp, Triticum aestivum
  Clone ID: PAT_TA_15125
gaggggtgcgcaagccggcgcacctgttccttgacgagctgggcgtcgcctacgacgaggccgaggactacgtggtcatcaagcacgccgcgctcttcacgtccaccgtcatgagccgcctcctggcgcgccccaacgtgaagctgttcaacgccgtcgccgtggaggacctgatcgtcaagggagggcgcgtcggcggcgtcgtcaccaactgggcgctcgtgtccatgaaccacgacacgcagtcgtgcatggacccaaacgtgatggaggccaaggtggtggtcagctcctgcggccacgacgggccgttcggggccaccggcgtcaagaggctgcaggacatcggcatgatcagcgacgtgcccgggatgaaggcactcgacatgaacaccgccgaggacgagatcgtgcgcctcacgcgcgaggtcgtgccaggcatgatcgtcaccggcatggaggtcgccgagattgacggcgccccgaggatgggcccgacgttcggcgccatgatgatctccgggcagaaggcggcgcacctggcgctgaaggcgctggggaggcccaacgccgtggacgggaccatcaaggtggtgtcgccggcgttgcgtcaggagttcgtgattgcgtccaaggacgatgaggtcgtggacgcgtgagcgctgggaggagcttagcgcgcgctctggcttcgttttttggactttgccttgttgatgactttgtccgaatgaattccctttcagttaaaaaaaaaaaaaaaaa

SEQ ID NO: 15126 - DNA, 960 bp, Triticum aestivum
  Clone ID: PAT_TA_15126
attcggacgaggggacccctgtcgcgcggcgacgtagccctcctcctgctcgtgctgtccccgccaccctctgcttatcgtgcacctgggattagatctatttctggtatccgagagatcgagcgaaatcgatctagccaaggtgcggcggacgcggcttattctcaataattcttctgcgttgtttggaaagcagccatggacgagtggattcgccaagcggaggtgtgggtgcgccaagccgagagctggatccgccagcagcccccggagcagatctatgtcgcggccgcggtggttgccgtcacaatcctggtgcttatcggagcatcttgtctgaaatcctctaaactaaacaccatagtgctatccgggcttagtggcagtggcaaaaccactcttttctaccagcttcgggacggatcatcacatcaaggaactgtgacttctatggaagaaaacagtgatacctttgtgctgcattcggagcaagaaaagaaaggcaaagtgaaacctgtgcatattgttgatgttcctggtcatgccaggctcaaacccaagcttgatgaagtcctgcctaaagctgctggggttgtttttgttgttgatgctcaagatttcttgtctagcatgcaagctgctgcagagtacctgtatgacattctgacaaaggcaaccgtagtgaagaaaaaggttcctgtgcttatattctgcaacaagacagataaagttacagcccactcgaaggaattcatcaagaagcagttggagaaagaattgaacaagctccgggaatcaaggaccgccatatcctcagctgacatctctgatgaagtccagctcggggtccctggagaggctttcaacttcagccagtgccagaacaaggtggctgttgcggagggcgccggttccgctggtaatgttttggccgtggagcaattcatccgtgagcatgtg

SEQ ID NO: 15127 - DNA, 1002 bp, Triticum aestivum
  unsure (1)..(1002): unsure at all n locations
  Clone ID: PAT_TA_15127
ttcggcacgagggctaactacatttaatgaagttgacatgaccaatttgatgaaacttcaggtctgattataaagattaatttgtcacaaaggatggtggcaaattggacctaatgtcttgctttgacaaggctgctgtttcggcacttcaaaaccaaccgattgtcaatgctgtcattgatggtgacgatatcatatacagagactatgtggacgtcagtgttactgttggcacatccaagggccttgtggttcctgttatccgggatgctgataccatgaactttgctgacattgagaaagggataaacaaccttgcaaagaaggcaactgagggggcactctcaattgatgacatggcaggaggaacatttaccatctccaacggtggtgtctatggaagcctcctcagcacacctatcatcaaccccccacagtcggctattctggggatgcattccattgtgcaacgccctgtggttgtgaatggtgacatcctcgcgaggccaatgatgtacctcgcgctgacttacgaccacaggctgatcgacggcagagaggctgtcttcttcctgcggcgcatcaaggatgttgtcgaggaccccaggaggttgctgcttgacatataaattcatgcaccagcgctgcgctgccctgccggactgttttgtgcaattgtgcntatctggaaataatgccatggaaattttgactgatgaaaaagaattactcctcaagaaagacgaaatctgagctgaggataccgaggtttccccaanataanccttnaagacaaatcaatcaacatgagncatgtttaatttcggtttgaaatntccattanggatnaattccaaaaanatcatttattaanatcaagacaaaaacngccgaatttgttgtggtcaaaaaaaangggggccgtncaatccccaaatgatcttanccccanggctctttaantctacggaaactggtncaantancctgaaaanccttcca

SEQ ID NO: 15128 - DNA, 1006 bp, Triticum aestivum
  Clone ID: PAT_TA_15128
ggcacgagaggaaatcaatgttcatctctgatgaatcaagaaagcttactgcctaccatgaaagtgggcatgctattgttgcactcaataccaagggtgctcatcccattcacaaggcaactatcctgcctcgtggatctgcccttggaatggttacacaacttccctcacaggatgagacttctatcagcaagaaacaactcctggcacgtcttgatgtttgcatgggcggaagggttgctgaagagcttatatttggggaagaaaatgttactactggtgccagaaatgatcttcatactgcaacagagctcgctcagtatatggtatcaaactgtgggatgagtaatgctattggtcctgtgcatgtaaaagaacgaccaagtgttgacatgcaatcaagaatagatgcaggggtgggcagactcctaagagaagcttatgaacgggtgacacatttactgaagaagcatgagaagcaattacatgctttagcgaatgctctgctggagcgtgaaactctgacggaagatgagatcaacaaagtagttcatccctaccaagaagaaccacagcttcccttccaagaagaagcctttgcgctaacttagacatattaccttttgttgcatcaaggtggtagtttccactgtaaatccgtgtacagtaattggaaagtcattactcaccattttgcgaaggggggtaaacttgggtgcatttccttctcagcaccattaggctggcatgcaggaaattggaaaagattgagattatcatggggggtggcacgattgtgtgctgtgcccattgccctgtcgcggcgtgcctcgccggcgcccgcctcttgccccccgggttgcctccgacttggggcccccgtcctgcgtgggtgagctaggctggctttacagatgtgacattgcatattttggattctagattatttcttcttttcaattctatgcctcgccattgtttaaaggaaatcgtacatataactgtc

SEQ ID NO: 15129 - DNA, 535 bp, Triticum aestivum
  Clone ID: PAT_TA_15129
agccatgggctcatgggtccttttttggagggatagttaccttctcaggatcacgaggagaaacatcaattgttgcaagaatcacgcctactgaaccatgtggcattggtccctataacatctatagaaccaaaatggcatattgttttatacacagatgatgaagcagactctgcgcttctatccccagatgatactgcatactgggcaagaagcaactcaactgaatacgaacttggctgccaatccgaccacaacatgaaccactaatcagccttaagtacggtaccacaataaaaatacaaggcagctcctcctaaccttttccaccattccatgtgcacttaccacatcctcgtttctactttatttactgcactacccacttataagcctccttgtattatataatatttcgacccatccttatcactatcgcatctaccatgtatctggccttccatgcatttttcttctatgtaacaatctatctacctatgaaatttcatcgttgaactaaaaaaaaaaaaaaaaa

SEQ ID NO: 15130 - DNA, 745 bp, Triticum aestivum
  unsure (1)..(745): unsure at all n locations
  Clone ID: PAT_TA_15130
ctcgtccgcggacgcgtgggctcgggcagcccagtcgtcgtcgcgaccgaggaccagacaccagacgcgggcggggagctcgaggcggcctgcgggacagcagcatcggcggcggcgagtcggggcagggccagcagcgatggggttcgtctccttcgtcgggagggtgctcttcgcctccgtcttcctcctctccgcctaccaagagttcagtgagtttggaacggatggaggaccagcagcaaagtctctgaagcccaagttcaacctgtttgtcaagcaggtgtccgccggcattgggatggcggtgccacacattgacatcaagtctgtcattgcctttaccatgtttcttaaagcctttggtggtctccttttcatcatcagcagctcgttcggagcgctcgtactgcttgtttacttggcattcataacccctgtcgtgtacgacttctacaactacgagatggagtcacagcaatttgccaagctcttcaccatgttttcacagaacctggccctcttcggtgcgctgctcttcttcctgggaatgaagaactccatcccaaggaggcactcgaagagaaggactgcanaggccaagacaacctggaagccagcaagggggattgtggtaggaggggaaagctatcaatatggaaactccgtcgtgttttatgcatacttttggagcagtacatgtcccgctttttgcccattaggatcgtgagcttgngacctgcag

SEQ ID NO: 15131 - DNA, 1067 bp, Triticum aestivum
  Clone ID: PAT_TA_15131
cccccactccgcttcccctctccgcgggctcccccgtcgtcgtcccccccgtcgtcccctccccccgggcacccccgtcgacctcgcggcggcgggcgggacatccagggcgcgggcggggagctcgagccggcccacgggcgagggggatcggcggcggcgaggcggggcagggcctcgcccgcgggtgcccgctctccgccgaccgggagttgctgtgcgtttggaacggatggaggaccacctgcgaaggtttctgtggccctggttcggcctggtcgccaagccaccaagagttcaggagaggtttggaacctgatggaaggaccagcagcaaagtctctcaagcccaagttcaacctgtttgtcaagcaggtgtccgccggcattgggatggcggtgccacacatcgatatcaagtctgtcattgccttcaccatgtttcttaaagcctttggtggtctccttttcatcatcagcagctcgttcggagcgctcgtcctgcttgtttacctggcattcataacccctgtcgtgtacgacttctacaactacgacatggagtcccagcaatttgccaagctcttcaccatgttttcacagaacctggccctattcggcgcgctgctcttcttcctggggatgaagaactccatcccaaggaggcactccaagagaagggccgcaaaggccaagacaacctgaagccagccaaccaagccaagggatcgtggtaggagggaaagctatcaatatggaaactcgtcgtgttttacgcatacttttggagcagtacatgtcccgccttttgcccataggatccgtgagctggggacctgcagaattcgattcgatatgtaggagttttaagccgtcttgctcagttctgttttccggttttatcgcggtgggttttatgccttggtatggtagtcttgtgttttgctacagaagaaaactgcttgtctccattcaggatcaaaggatacattcttggctgccgttgatatctatggttgatccttcgatccataaatgcaaagatgttttttttttgcgcgggggga

SEQ ID NO: 15132 - DNA, 620 bp, Triticum aestivum
  unsure (1)..(620): unsure at all n locations
  Clone ID: PAT_TA_15132
gcacgaggtacatcggcgatttcttccggcgattggcgccgcggcggggggcgcgcgacgcccgccgggcgcctcccggcggcccggcgcccggcggcggcggccggcggccgcccggcggggggaggcggcggcgaggatgcggccggcgggagggaggcggcggccggcaggagctgttccggcgaattgggagctcctcctgcacgtccagggcaccgtccggcaccacgcgcgcgcgcatgccgcgtccgggagtgcgagcagcgtggcgctgccggtcgcccccgccacccacatcctggcgcggcggcctggtcggcggggacccgttcgtggcgtcgcgttgccgggtcgcgcgggtgcggcggcgaggatgtgggatggctgcatcgggcggccacgtagccggcagatatggaggcggccgcgacactcgaggagagggagcggctagcgatggggccgagggctgggtgctcccgtcgtcgcacacggtcgctcaggggagccgccggctatggaggacgtcgagtggcggtggcggtcgctcccgcttctgttttcttgtgcagccgctcccgcttttgctccgagtgccgtcgtcagccgttgatcnn

SEQ ID NO: 15133 - DNA, 607 bp, Triticum aestivum
  unsure (1)..(607): unsure at all n locations
  Clone ID: PAT_TA_15133
tcggcacgagggttcttgcgattcagcgcgttgcctcctgcctccaatcggaatgcgagataaaaaacaactgcaatttgatgtcactggcttgctccaaggagatgtgctttcacttcccttggtcatcagatatgactgcattggcatgcgatacgaacttaacttctttcagccaacaaaatgtgccggcctgtctaagcggcaatggcgcctttgcttatgggatctacaagggagcccttcctgttatctccagcaattcacttgctgtcaaaattctctatcccatattctggggcctcatgaccctcagtacttttggcaatgatcttgagcccacgagcaactggcttgaggtgatcttcaagcatcatcaatgtactcagcgggctgatgctcttcacgctactcatcggaaacatacaggtattcttgcacgccgtgctggcgaaggaaagcggaagatgcaagctgcgggttccgggacatgggagtggtggatgaaggggggcggcaagctgccgtccccggctgccgggcagccggggtccgcaaagtaccanccgcgaagcggtggggcgggcatcaccggcgaacgangaan

SEQ ID NO: 15134 - DNA, 628 bp, Triticum aestivum
  Clone ID: PAT_TA_15134
gatcctcgccgacggcatccaggacgactgcggcaacgtgacccggttcgtgatgctggccagggagcccatcgtgccgcgcacggaccggccgttcaagaccagcatcgtgttcgcgcacgacaaggagggcacctccgtgctcttcaaggtgctctccgccttcgccttccgcgacatcacgctgaccaagatcgagagccggccgcaccgccaccgccccatccgcctggtggacgacgccaaccgcggcacggcgaagcatttcgagtacatgttctacgtcgacttccaggcgtccctggcggagccgcgggcgcagaacgcgctggccgaggtccaggagttcacgtcgttcctgcgggtgctcgggagctacccgatggacatgaccccgatgaccgccggctcctcctccaccgtcacatcgtccgactcgtagctccctagaggtatcgaggagcagtaggggagtcggttaatttgtggtcatgtcgtcggcccgctcctccctcgttggcagctggggtaattagttttgttcctcatgtttcttgtcataatacatgtaaaatcgtgccatttgagccagttaagttaatacgcagtggaatataccctgtgagat

SEQ ID NO: 15135 - DNA, 783 bp, Triticum aestivum
  unsure (1)..(783): unsure at all n locations
  Clone ID: PAT_TA_15135
cccacgcgtccgcaaggagaacatcacccgcgtgatcagccacccgcaggcgctggcgcagtgcgagcacaccatcacccgcatgggcctcaacgtcgtccgcgaggccttcgacgacaccgccggcgccgccgagtacgtggccaacaacggcctccgcgacacggccgccatcgcgtcgtcccgcgccgccgagctgtacggcatggagatcctcgccgacggcatccaggacgactgcggcaacgtgacccggttcgtgatgctggccagggagcccatcgtgccgcgcacggaccggccgttcaagaccagcatcgtgttcgcgcacgacaaggagggcacctctgtgctcttcaaggtgctctccgccttcgccttccgtgacatcacgctgaccaagatcgagagccggccgcaccggcaccatccgcctggtggacgacgccaaccgcggcaccgccccgaagcatttcgagtacatgttctacgtggacttcaggcgtccctggcggagccgcgcgcgcagaacgcacttgctgaggtgcaggagttgacgttattcttgcgggtgctcgggagctaccccatggacatgaccccgatgaccggcggcgttgcctcactcgattccttgtcggcttattcgtgagcttccttgattggatttgatagaggtattttaggagcaagaggggggggtggggtttgtttgggggggcatgggggtggggncccggttctttccctggttgggcaacctgggggtgaatgagggtttgg

SEQ ID NO: 15136 - DNA, 1639 bp, Triticum aestivum
  Clone ID: PAT_TA_15136
cgcttactcgactacctaccactcaactttctactagttttagtttctcgtttatttacctttagttacccggcgccatcggcatccttcatacagtactgccaggcagatttccaagccaagaaacggaccaacagcttgctaatcggcgccgttactggtcatggccgccgcgagtttcatcaaggcgcccgccgggcaggaatcccaggctggcaatccacgctccgggggggggcgcgcccgcgtggtccaaggtgctcgcttggcgcgggccgctccgcggccggaccgagtggctcaggcacctgtgccgtcctctccagcaaggttcggccgcgctcggcccccactccgtcggagcggccacgccgcgcccgtcgccggcccccaacggggcggtgctagatttgatcccgcgtcgagcggtgttaacggcggctccccaagaacctgccggcgccgctgcggatcgccgacgtgtccccggcgccgatgcacggctcggagctgcgcgtggcggcccgcgggcgggcccggcgcgtacagcgagaaggcggcgcggcaaggcctacccgggctgcgacgccataccctgcgaccagttcgaggtggcgttccaggccgtggagctctggatcgcggaccgggccgtgctccccgtggagaactcgctcggcggcggcatccaccgcaactacggcctccggttcccgtgcaccactgactcctcgctctcccgggcgttcgcaaggagaccatcacccgcgtgatcagccacccgcaggcgctggcgcagtgccagcacaccatcacccgcatgggcctcgacgtcgtccgcgaggccttcgacgacaccgccggcgccgccgagtacgtggccaacaacggcctccgcgacacggccgccatcgcgtcgtcccgcgccgccgagctgtacggcatggagagcctcgccgacggcatccaggacgactgcggcaacgtgacccggttcgtgatgctggccagggagcccatcgtgccgcgcacggaccggccgttcaagaccagcatcgtgttcgcgcacgacaaggagggcccctccgtgctctgcaaggtgccctccgccggcgcctcccgccactgctcgccgacctggtccccgagccggccgcaccgccaccgccccatccgcctggtggacgacgccaaccgcggcacggcgaagcatttcgagtacacgtcccccgccgcggcacggcgaagcatttcgagtacatgttctacgtgaacttccaggcgtccctggcggagccgcgggcgcagaacgcgctggccgaggtccaggagttcacgtcgttcctgcgggtgctcgggagctacccgatggacatgacccctatgaccgccggctcctcctccaccgtcacatcgtccgactcgtagctccctagaggtatcgaggagaatcggtggagcagtagggacgtcggttaatttgtggtcatgtcgtcccactcctccctcgttggcagctggggtaattagttttgttctttatgttcctgttgtcataatacatgtaaaatcgtgccgtttgagccagttaatacgcagtggaatataccctgtgagatacaacaaaaaaaaaaaaaaa

SEQ ID NO: 15137 - DNA, 595 bp, Triticum aestivum
  Clone ID: PAT_TA_15137
acggcggcgacaacccgcagcagcaggagcagccgcagcggacgatctacaccggcggcacggtggggtacatggacccggagtactacaggctgcagcacctgacgcgccacggcgacgtgtacagcttcggcgtggtgctcctggagctcatgtccggctgccgcgtcgtgcagcggtacgccgagagcgtgacccccaagaacgtggtggacttcaccgtgccgcacatcctcgccgacgacgtcgcgcgcgtgctcgacccgcgcctccccgcgccgacgccgcacgaggccgaggcgctggcctacgtcggctacctcgccgccgactgcgtgggccccgtcggctgcgagcgcccgtccatgaccgaggtggtggacgccctggagcgcgcgctcgcggcctgctcgacggcgccggtctcccgctccgggaccgcccgccgcgtgctgtcccgctccggcacggaccagtttgacctcactgacaccgactagcgaggccggccgccattgaccgccacgcacccccccccgctcccgccgcggctggtgccatgtctggatccgcattgcgtcagcagccactcgag

SEQ ID NO: 15138 - DNA, 589 bp, Triticum aestivum
  Clone ID: PAT_TA_15138
cggcacgaggtaaccgtaaaaacaagtagcgcaaggaaggacgacaaaatctgttcaccaccttgccgcttgtggtctctcgctcctcccgtgtgcgtgcggcgttgcgtcactcatccatccatcctcacccccgcttacccatcctgcttctgcctcactcgattcagttcaagtgtccagcaccggccaccgggaagcagcggggcgcgcagtgggaaagaaggaacgccgcaagagaagagaagggcgctgcgaccgcgctgctcgccgcggcagagatccggcggcggcgcccgaatcgacggccatgatgaggcacagagctcgctcttcccccagctcccctctcaccccatcctccagcacgaggtgacctatccatttcctcagctcttcttcttcctccgggcttttcttcgccggttcttgtgacggaatcgctgcaagcaaatttacatgtgaattcgctggaagttctcactagagccgcggccatggaattcctggtgatggctggaccaggtttagaaagcttttatactgtttatttatttgccaccttgaatatacgagctagtacttagaa

SEQ ID NO: 15139 - DNA, 687 bp, Triticum aestivum
  unsure (1)..(687): unsure at all n locations
  Clone ID: PAT_TA_15139
cggcatgaggcaatttgtatattccatttggttccattgtgtggaatacaacgagcggcaccgagccgagcgacaacctcgagcatctgcaaggctgggaatcatgtagcggcacctgcccgactccggccggacagcagacgcacgcttggtgttcgatgaaattaccaaggaccattgtatacacgaagctccgtgcaacaaatagtataaaaagaatggcggttaaatagaaaacatatcaatcacggtgatgcgatacatcatgcacgcattacagctgcttcgtcttgtgcaagatctgctcggacgtggtcgccaccgctttccgccaaagaagcaccagcagcagcagccatgctagtggcctcctcaccgtccccgccgtcgaaaccagagacagctgcggccgtgacggcgacgacgacctcctcctcctcctcctcctcctcggtgatgtcaccctctttcggccgacgagttccattgccattgccttccgttgtagagcctcaacangttggccaagtccggcnaacgaaggagtagaccgagcccggaanggaaatcaacaagcgactggtanttcctgttccgctcaancccgcctcgtcttcaattcaaggcccatcnctcannccgcgtcncggttaaccgggggccnacccggntgaccgggnaaaatat

SEQ ID NO: 15140 - DNA, 743 bp, Triticum aestivum
  Clone ID: PAT_TA_15140
gacggcttctccgtctacgacgccggcggcgagctggccttccgcgtcgacaactactcccgccgccggaagatcttcgccggcgagctcacgctcatggacggccgcggcgcgccgctcctctccctcaggccgcagatcatcagcatgcacgaccaatggaactgctacaaagcaccagaagaaggccaagcaaagagggcaagatcacagcagctcttctcggtgaggaaatgctcggtcctgcagaacaaccgtgaagcagaagtttacatgtcttcagccgccccctccaccaccgacgcatcagcatcagaccatggcagcactggccaccagtcccccggcttctggatcgagggctgcttccggaggagaaactgcaagatccgcagggcccacgacggcaaagaggtggcgaggatcgcgaggaagaaggcgaggacagccgcgacgcctgacacggcgcctctgacgctcggcgaggacgtcttcagcctcgtggtgcaaccggacgctgattgcacgatgatcatggccctcgtcgtcgttctggaccggatctgctggaggccgtacacgccgttgatatgttcttcgtagcccgcgctgagtcggcgatcgatgaacctctgttcgttttacacgggggaaatgtagatgccttttctttcttcagttcttcaagtgactgtcgcctgaagcaagtaagagccagtggagatgaagtgctgttcagttag

SEQ ID NO: 15141 - DNA, 1331 bp, Triticum aestivum
  Clone ID: PAT_TA_15141
cgcgggcatggcgggcatgggtctttgccggtgaagagaacagagtaggcctcgcacgccaatggcaggtgcaccacccaccgggtgggaacgtgctggggctgagggaacatccggtctatcacctttcaaaccagcatctggtcacagcactaggaacgtcgtcgaagcgtctggtactgctaaacctcgactatccatcgccgctatggtcggtcaggtatcctttacggtgaacttgcgagtatttgtcttgcgcctgctcggactccgaacaaagtcaaagaaaggccgcgttcagggcgctgaggcccctgcattcgagggacctggccagcagctttttgaggcaccaaaagctgccaacaactcatgggacaatgtttggggaaactaagacgacctgcccttttatgtgccgttgaacttatagaaacatacagttagccaaggaaagattatgaaagcatgcatgtgagcaatcaatcagaaagcgaagaagagtgcccagtcggaggaaattatctgttgtagttagcgaaagaacacaagggctgctctttctgattttcatggtcttaatctgccgtcgagcctgaggatttcgagtttgcttcgctggaggatgcaatggtgctttcagttattttgggcgagtttcatttcgcgttgtaaaaaacacacaagccttctattttttcattactgctatgttgcagctctttgatcggtctggaatgctttacggtgagcttgcgagatttgtcttacgcctgctcggagtccgaacaaagtcaaagaaaggccgcgttcagggtgctgaggcccctgcattcgagggacctggccagcagctttttgaggcaccaaaagccggcaacaactcatgggacaatgtttggggaaactaagacgccttgcccttttatgtgccgttcaacttatagaaacatacagttagcgaaggaaagattatgaaaggcatgcatgtcagcaatcaatcttaaagcgaagaagagcgcccagtcggaggaattgtctgttgtagttagcgaaagaacacaagggctgctctttctgattttcatggcttaatctgctgtgagcctaatgatgtccagtttgctttgctcgaggatgcagtgttgtttaagtatttctgttgtttgtatctttctgggggtaatctgctccgggcctaatgatgtccagtttgctttgctggaggatgcagtgttgttcaagtatttctgttgtttgtatctatgtggggtaaataataccttttatcttgaaaagaatgaagcgaagtgttattgtgttgtcatcct

SEQ ID NO: 15142 - DNA, 565 bp, Triticum aestivum
  Clone ID: PAT_TA_15142
ttcggcaccagatcacatcgtagtactagctagagctagctaggtctcctcgacggctcgaccccagtctcagtagtttctcttcaagaatcaagatgtcgcagaggccggggaggcaccagaggagggcgtcgcagagcgtgttctcgctgccggagaacttcgccagcctggaggacgtgccggccgacggcgtcggcgagcagcggaagcccgccgcggcgggggcggacgcctccgagcagcagcccgcgagggcgccggcggggcgccaccggcgggcaatgtcgatggccgtgccctccagggacctggacatgatcgcggaggacatgggaagctacaagtacggcgcctgattagtagctgtgtagttcacgtttgtgtgtacgtacgtacgagttcttccctggctgttgggtagtgtcctgttctgttcgccgtttggtagtgttgttctgtgctttgtttttcgtgcttctctgaatgtgtactccttccttaatttgcttgcctgaccagagtaaagaaatcccgctgttgcaaaaaaaaaaaaaaaaaaaaa

SEQ ID NO: 15143 - DNA, 1833 bp, Triticum aestivum
  unsure (1)..(1833): unsure at all n locations
  Clone ID: PAT_TA_15143
gaattcggcacgagggggctcgagcctccaaccctagctagcgacgagcggacgcggggcgagcagtagccggcgatagtggttagctttgccggcggtaagcagcagcccatgccctgcgccccacggcaagcagcagccaagccccacgcgccaacgacaagcagcagcagctgttgggcggcggaccctaggcgcctagcgtcgggattcggaagcagcagtcggcacccgcgccaggagccagtcgccacgagcacgccgcccacgagctagcggcatccagcaaaatcaagcttcaagcttcttccggttccagcgtcgcgcccccttggccccgcgcgccccggagggtccgcccccgagcgccggggcccgccaccactcgccggcgatggagagggtcgtggtggtctccgaggacgccgccgcctcggtctcctccggcccgtcctcctccttcgcggaaaccagggtcatctgccgcgtatgtcagaagcagttcgcgcagtacacttgtccacgctgcaactcccgctactgctcgcttacgtgctacaaggggcatagtgtgcaatgcactgagtcatttatgcgtgagaatgttacggaggagcttaagcaaattcagcctgaagatgaatcaaaaaggaagatgcttgatatactcagacggttccacttggaagaagaaatggagtccgatggtgaagatgagtcaatgttgtcagaggagcttattcagaaagccatctctggtgacgaaatcaagcttgaggacctctctgatgatgaaatcaaacgatttcgtcaagctctggcctctggtgaactcagcaagatgattgaaccatggactccatggtggaaaaatccttcagctaaatcgatctctcttagtcatgcgtccggccagcttatcagacagataagtacagacgatactactctatcagatccaatgactgcgtcagagtctatcatcaatgaaataccagaagggccagaatatcctctcccatcactcaaacagctaaccagggcagagccatctcctctgctcactgttcacttggttgatattctctacagttactgcttcacgcttcgcctctacaatggtgactggcagtctgatcctttgggtgcttcaactgttgccttgtctatgtcgaaagtcatgggggacggcgctaagcctgagacagtatctgaagcgctcacaacatgcatagaggagacatgctccccagcttacaggcacaccggaggtttcaggtttgctattggacttgtggatgatatcgtcacaatcctctccttaggaggcaatgcagcggcttgcgcattgtgtgacttccacaggctcatccaagcttgtgagagcatcctcaaggaagacaaaatgggcgagacggaaaaggcacagagcttcaaaaagctccatgccgcgggtaggaagctgttcttcatgacatgctgggctcatgagcagccaagtgaggcctggccatcgttggctcgcatcgttgaggtgcagaaagcggcttttgaggagctggacagtggaagcggactgaggaaggcaggtagaaagaacaaccctcagtccaaggttcttatcgaggaggtgtaagcatatcaacgcagtactgctggaataaccacactgttttctcaccacccttttggtatctctcagctgtatcacttgatccttgtgccctgctatatcttcaagtgcagtggcttaaatgtataaattgtcatcctttggaagatgtgatagtttacatttctgaagttnctgatattaaagcgacctggttaatc

SEQ ID NO: 15144 - DNA, 1092 bp, Triticum aestivum
  Clone ID: PAT_TA_15144
gcgacaccccacgcagacacagctccgctccgccctcacccggccacctcctcccacccaccgccgccgccggcgccacggagctcgccggtgcggccttcccggtcggcgtggtgatctccgcgaggacgaccctcggggaggagttcgggggccagatcgtctccttcgaccgcccgagcaacctcctcgtcatacaggagggcgtgggcagggcggagaggggcgagcggcggaacgtgagggtgctcaaggccaaatacagccaggagttctccgtcgtcggaaagtacgacgacccgctcgacccggctggccgtgtgctcgacctcgccgcaatccacgccacggaggaggccgcccccaggcaagctgagattgaagctgagagaattggtgttggtgtcaccccagaagctcaaagattatttgatgcattgtcgaagacgctcccagttcattgggacaagaccgacattgttgtaatgaatggaggttcgtggtatgcagtccctaactgcctgaatatgtgagcggcggaacatcagctgctaatgaacgggttaagaaagtgctggactttgagaggaaaagacaacatgtgcgtgtacctggccaattctaacttattcgacttgacaatttttcacctcaactcctgctgtgatttgtttctaaatccgaccttattcgtccattttcatcagttgaattttctaaaaatctgtttcagcatgccgttctcacaaactaccacactagcaagcttattgatattctgctattagatgccgtatgtggtggtgaataattgcagcacgccgtgctgataattctgtggctgatagtgaaaggttgtgtggctgaagcaaactaaggaaagaaaatagattggtggcactgaaataataggaagttgtattaacaactaagaaaagatgcggagcaaagccaaaactgaaaattagtctctcagactttgtattactcttcctggtggaataatatttccagcttgtgatgttgtatgcaataatatttcccagcttgtgctcttgttttcaaaaaaaaaaactcgagactagttctctc

SEQ ID NO: 15145 - DNA, 610 bp, Triticum aestivum
  Clone ID: PAT_TA_15145
gaggtgcgataagatgcccgcctccacgcgttgataagatccctatggtctaccatttttacacaggtatgagagttagagaacaaaaaaagtatgtacaaatcacttaggtagatgttgatacaacatctatgaaaccaacacggggaacatctatgaagtcaggttactataacgattaatttgcatactataggtattcagaaaaacccaagagtagtcagcaaaatcacgcttaaatacttaccggtctttgaaagggatggctgattatcctcttgtaacctggccatatcctcctcttttttcttccgataagattcacgcctctatgcgttgaactgctcccttgtttcgccaacgtttttttcctcattacatacagctactgttgcatgctgctcggaagtttttgtcatctgcattacgttaagcgtaaaaaccacaaagcccattaagctcatccgggaaaatggactaaacctctccgatccgctaccggagatgtcgatttggaagctgtataagcatgcctgtgaatacctggtgcacccccccgtcgctcaccctttccccccttactcggccctcgttgcgatggaatcccgtc

SEQ ID NO: 15146 - DNA, 693 bp, Triticum aestivum
  unsure (1)..(693): unsure at all n locations
  Clone ID: PAT_TA_15146
ggaaggtgaaggtggactcttcaaatatatagaaaagcggctgaaggagaatggccatatggtcattgtcgttgccgggcgtgcaggacagaaacttattgccgaaaacatgaaggaaatggggcaagatgcttctggcaacgcactgcttcttgatgttggtctttggttgtctcagaagataaatgagcatttcaagaaaaacaagacaaccataaatctgaagtacatagatcctacatacatgatacgtgccatccctagcaacgcatcagataatgtctattgcacactactggctcacagcgtggtccatggagccatggctggatacaccggtttcaccgtcggccaagtaaacggcagacactgctacattcccttctacaggatcacggagaagcagaacaaggtctcgataaccgacaggatgtgggcaaggcttctctcctccaccaaccagccaagcttcctgagcaagcaagacgtcgatgatgccaaggtcgaagacgagaggacggccaagctattggacggctctccttccaaccccaaggtcgaagataaggtcgtgccttccaattccaatggcgtgaagtgaggccgccatgcaggttgatagctatgtccgcatcgattagtacccgccattgggggtctcctgggcaatcncncttattagtctccatnaan

SEQ ID NO: 15147 - DNA, 770 bp, Triticum aestivum
  Clone ID: PAT_TA_15147
cgtccgcccacgcgtccgctacgatcggctgctgcgcaccgatcgatctcagagtccacgaggcatgggctagagctagaggagggcagagctcagggatagagtgcagatagagagatagagagagggagggagatctcctggacgatccgtcgaacatgtatcatggcggcccgggcatgtctcctgctgccgccggcggtcgtggcggcacggccaggaaggtcgcgccatggatcctcgcctgcggcttcctgctctgctcgtccgtccttttcctgggagctgaaggcgccattggtgtgaactacggcatgatcgccaacaacctgccgacgccggacaaggtgatcgccatgtacaaggccaacaaaatcagctacgtccgcctcttccacccggacacgaccgtcctcaccgcgctccggggcacgggcatcggcgtcgtcctcggcacgctcaacgaggacctcgcccacctcgcctccgacgagtccttcgcggcctcgtgggtggcctcctacgtcaagcccttcgccggcgccgtgacgttccggtacatcacggccggcaacgaggtcatcccgggcgaccttggcacgcacgtcctcctcgccattaggaacatcgagaccgcgctcaaggcggcgggcgtcaccggcgtcccggtcacgacggccgtggccacgtccgtgctcggcgtctcgtacccgccgtcgcaggccacgttctccgaggcctcggcgccggtgatggcgccgctggtggcg

SEQ ID NO: 15148 - DNA, 502 bp, Triticum aestivum
  Clone ID: PAT_TA_15148
cgtccgtgcaactctcggaggctgccagaaaaatagctgaggtacaacgagaatgcaaattggacgtaaatgtggaggaatacgttgaatcaacttgtaaaccctatctgatggatgtcatatactgctggtcaaagggcgcgacctttggagaggtgatagaaatgactgacatttttgaaggaagcatcatacggctagttaggaggctggatgaatttctaaatcagctaaaagctgctgctgaagccgttggggaggtaaaccttgagaagaagtttgggttggcgagcgagagcttgcgccggggtatcatgtttgccaactcattgtacctgtgatcagtggagccccagcagttgtaccatacagtatatgttagcatatcaaacgtagctgttttgttttttgtttttgacagcccttatctgtgggagtgtaggttgtagccttgtaccctggtaacccctaggtaatttattttggaaattcttatcccggc

SEQ ID NO: 15149 - DNA, 1382 bp, Triticum aestivum
  unsure (1)..(1382): unsure at all n locations
  Clone ID: PAT_TA_15149
gcgagaatcggggataagttactgcattccaacacatggtctaatcagtactacaaagcgcatttcgaaacccgatctttctcccatatccatctcaccatccctgactttttcagtgcctcaaaacaaactacagagcacagagtacatccatccatatcaccataagttagagaggggaatgaaagccaggaaccacatcaagagccttggcgatgagcgcttcgagttcgagacagttacatgccgcgggtcaaccagttcagcctttgtagtgaagctgggactgcaggatctggttgtcctccagcagccggtcgtactcgaggagcagctcttcagattgcttctgcagggcattgacatgggcctctgcatcagacgctttcctctggtgatcttcggactcggatttcagcttcttcatgtcctcgctcagcttggccatgtcctgctgaagcttcttcatctcgctggctgacttctcctccttctcgcgcaaggaccggttctccatttggagcttctcaacctcctcccttgaggtgttggctgacttcctcagggtgatgagcttccgaaggtagtggtgcaaccggtcgatgacaaatgcgaggaatagtgtgtatccgatgagggatgcctcgaggaggtgcgtccgccagagcacctggtccatggggctgacgttgccgatcttgtggcccctgtcctggatcctgacgatggcggngacgctggacatgaggatgacggagcgcccccccccccgcgtcttgacggtggcggggcccttgccggtcttgacctgctccacgccccgcatcgccagctcccgcagcggcccgatcttgaccatgagcagcagcgccaccgccccctccgcgaacagcaccaggaacagaagcgggatcatggcctccttttctttacctttccgaccgaccgaccggatgccgggtctctttggattccgcccggggacttaaggaacgacccctttgctccacggcgcgaggattaattggcggaggtcggtccgccgcgcgagtacggcggggggtccttttccggcggaggaaaaagatggcggattgggtcggcggacggggagattcaacttcaactcggaggcggagtggacaagaacccgccaccaccacctttccttccccctggctgtcctcgtctctgccaagaaccaatcctcctccgaggagcggacacggagcggccgagaaccggcggccggcggatcaggggaggagggtggggaatgaaacctccaggaaaaaggctacggggagcacgcggaatagcgcggacgcgttnnnnnnnnnnnnnnnnnnnnnnnnnnnnnnnnnnnnnnnnnnnnnnnnnng

SEQ ID NO: 15150 - DNA, 725 bp, Triticum aestivum
  Clone ID: PAT_TA_15150
ccgccgtggagagcaaacagcggtgtacttctacgtgtctagggggctcgacggaggcctccataccagcttctgccaagacgagttacggtcgtcacgggccaaggacgtgacgaagcgggtgattgggagcatggtgccggtgctcgacggcgaggctttctcgatgagggtgctcgtggaccactccatcgtgcagggcttcgcgatgggcgggaggaccacaatgacgtcgcgggtgtacccgatggaggcctatcaggaggcaaaagtatacttgttcaacaatgccaccggtgccagcgtcacggcggaaaggatcgtcgtgcacgagatggactcagcacacaaccagctctccaatatggacgatcactcgtatgttcaatgaagctcttgcatctcatcagtaataagctacattggatcaaagacgcgcaccaaggaaggccaaggcatatgtaaatgattctgcacagcctcgcttgcagaattgaaacatctatccttgggtcatgttctgcattgatgtcactatgaactatattactttgttgggcgtagaatcgatatagtttgggtgggtggaattttgtttgtttacatagtgaaccgatgcggtttctgtaataagcttatgtgcttgtttagaaaacttgtgaactattgttgtttgggagagtggactcgtgtttctttaaaaggtgaatggttgtcatttgcgt

SEQ ID NO: 15151 - DNA, 744 bp, Triticum aestivum
  unsure (1)..(744): unsure at all n locations
  Clone ID: PAT_TA_15151
cccacgcgtccgagtggtacgacatcctaggggtcctctcgggctctatgacggtgctacccaatggcacggtcatcatgatctacacgggggccaccaacgcctccgccgttgaggtgcagtgcatcgccacccccgccgaccccaacgaccccttcctccgccgctggaccaagcaccccgccaaccctgtcatctggtcgccgccggggatcggcaccaaggattttcgagacccgatgaccgcttggtacgatgaatctgatgacacatggcgcaccctccttgggtccaaggacgaccatgacggccaccacgatgggatcgccatgatgtacaagaccaaggacttccttaactatgagctcatcccgggcatcttgcatcgagtccagcgcaccggcgagtgggagtgcattgacttctaccctgtcggccacagaaccagcgacaactcatcggagatgttgcacgtgttgaaggcgagcatggacgacgaacgacacgactactactcgctaggcacgtacgactcggcagcaaacacgtggacgccgattgacccggagctcgacttgnggatcgggctgagatacgactggggtaagtnttatgcgtccacctcgttctatgatccggcgaagaagcggcgcgtgctgatggggtatgtcggcgaggtcgactccaagcgggctgatgtcgtgaagggatgggcctcgattcagtcagttccaagacaattgc

SEQ ID NO: 15152 - DNA, 2667 bp, Triticum aestivum
  Clone ID: PAT_TA_15152
atccggccgggctagggttggagataaatcacaatataccaaactctggtcgagttcacgagaggcgctgcgatggggtcacacggcaagccaccgctaccgtccgcgcacaagccactgccctccgccgcagaaggcacctaggccggatggactagatcccgcgagtccaccgtaggggtgagggccgcaggcaaggtggtgccgggagtgggggccacggtgctgatagggttgcgggaggaccagttcatggccgcggggccgctcggcgggcctgcgtagggcagggcggagttgtactgcgggtggacaaccagcagcccgtccgaagagcgcagcagcacagccgataacccctccctgggatgtaccagcgtcgccggatccaccggttccccctgtagatccgtgatctggccgactgggggcgtcggcagcagggacttccgggacccgagcagcgcttggtacgatgaatctgaggacacatggcgcaccctccccgggtccgaggacgacaacaaggggcaccacgatggcatcgccatgatgtacaagacgaaggacttccttaactacgagctcatcccgggcatcttgcgtccggtcgagcgcaccggcgagtgggagtgcatcgacttctaccctgtcggtcgccgcaccagcgacaactcatcggagatgttgcacgtgttgaaggcgagcatggacgacgaacggcatgactactactcgctaggcacgtacgactctgcagcaaacacgtggacgccgatcgacccggagctcgacttggggatcgggttgagatacgactggggtaagttttaggcgtccacctcgttctatgatccggcgaagaagcggcgcgtgctgatggggtacgtcggcgaggtcgactccaagcgggctgatgtcgtgaagggatgggcctcaattcagtcagttccaaggacaattgctctcgacgagaagacccggacgaacctcctcctctggcccgtggcaggagattgagaccctccgcctcaacgccaccgaacttagcgacgtcacccttaacaccggctccgtcatccatatcccgctccgccaaggcactcagctcgacatcgaggccactttccaccttgatgcttctgccgtcgctgccctcaatgaggccgatgtgggctacaactgcagcagcagcggcggtgctgttaaccgcggcgcgctaggccccttcggcctcctcgtcctcgctgccggtgaccgccgtggcgagcaaacggcggtgtacttctacgtgtccagggggctcgacggaggcctccataccagcttctgccaagacgagttacggatcgtcacgggcccaaggacgtgacgaacgcgagtgattgggagcacggtgccggtgctcgacggcgaggcttttctcgatgagggtgctcgtggaccactccatcgtgcaaggcttcgcgatgggcgggaggaccacgatgacgtcacgggtgtacccgatggaggcctatcaggaggcaaaagtgtacttgttcaacaatgccaccggtgccagcgtcacggcggaaagggctcgtcgtgcacgagatggactcagcgcacaaccagctctccaatatggacgatctctcgtatgttcaatgaagctacattggatcaaagaagctccccaaggaaggtcaagaaatatgtaaatttttcagcacaacttcgcttgcagcacagaaacctctatacggggatcatgttgttccgtgaggacctcgtggactccatgcgtgtgtccgacgtggagtctatcaagaaggcaaaagtgtacattttcaacagtgcaagccgtgccccgcttttggcggacatgctcagcgtacatgcgttcgacacggaccacaaccagttctccaatagggacaattactggtcggtgcaatgaacctcttgcagctcatcagtaagaagatgcttctgatcaaccacgctcaccgagcagggccaagacataggtgaacgattccgcataacctcgcttgtagaattgaaacatccatccttgggtgaagaactgcattggtttcacagtgagctatattactttgttaggtggagaatcgatgtagtttgcgtgattggctcattgtttgtttacatagtgaacctggtgtggtctgcgtaagtagaataagggttttttatgtaatcaataataagctacattggatcaaagacgcgcaccaaggaaggccaagacatatgtaaatgattccgcacagcctcgcttgcagaattgaaacatctatccttgggtcatgttctgcattgatgtcactgtgaactacagtatattactttgttgggcgtagaatcgatatagtttgggtgggtggaattttgtttgtttacatagtgaaccggtgtggtctgcgtaataagcttatgtgtttgtttacaaaatgaactattgttgtttgggagagtggacccgtgtttctttatatagtgaatggttgtcatttgcgtagtggatttctattttcgtttatacagtgagctgttgtagttttgcatggaaggactccttgtttacatagtgacttttattgctctggttttataaaaaaaaaaaaaaaaaaaaaaaaaaaaaaaaaaaaaaggccccta

SEQ ID NO: 15153 - DNA, 670 bp, Triticum aestivum
  Clone ID: PAT_TA_15153
ccacgcgtccgcagttcccaagggtggctgagaatctgaggtctgtacagttgacaatttcgttaaccacatccgcatccgtgaagagcctggtccagaggaaacggctgcaaagttacgccctaaatcacaaagaaaacctggcagggcttcatccaaggctgttgggactagtgatgatcatgcagcagctaatctaaaggatatcaatgctagtgttgatatagactctcaagatgggctgataaatcctcatactgatgatactcaaccgatctttggagaaccctcagctgaagctgctgctacatttctacttgatcttggaaagaaaaagggcaaaggcaaatcagtaacatttgttctaccagatgattatgagggggtcgctgcaacagataccaaccataatgacatacgctctgatgaaaatttgaacaccttgcctcagcaagcacctcaaaagcattgtcttactgaagaacattcagacgatcaggaatatactgatagggagagccagtaccatgagggggagcgatcagatcatggtgttgaacaacaatccaaattggatgttggaaaacaagaattatcaatgaagttgagaagcaggacagagattcagaaagttgggttatctgagcatattgttgatgatcatcttgat

SEQ ID NO: 15154 - DNA, 1032 bp, Triticum aestivum
  Clone ID: PAT_TA_15154
cctcgccggcgccgccgcggcctccctctccctccctcccccgatgccgcccatctccctcctccccctcctcctcctcctcgccggcgcggcggcggcggcgccggccgattccccgacccccccgactcccgcggcgaagaacaagaccatctacgagctcctcccgctcttcggcctccccggcgggcgtcttccccgccaacgtcaccgccttctcgctcgccggcaacggcagcctcgccgtcgacctcgcgggcccctgctacgtccacttcgagtacctcacctacttcgagccccgcgtcacgggcctgctccgctacggctccctcacccagctggagggcgtgcaggtccgccgcttcctcgtctggttcagcgtcgtccgcgtcaaggtcgacctgcccccgcccccgcgcttcgtctacctcgacatcggctggatcacccgcaagctgcccgccgccgatccagtccgtccacgcctgcgaggccggcaagaggcggaggcggtgccgcctctcctccgcgctcgccgccgccgccgcttggttccaggacttctttgcccaattttaggggatgcagaaggtctaattttgtggcagcatcacacgagcttacagccttccgcgtcctaaaggaattgaagcactacactcccatttgttgattgttacacacggtgtatgtctacgggtactcgacgctgctgtctgagctctacatttgttcgagagacgcgcgatctttaagaaagatttctattggttatttttgtccaaactgatgatgtgcatcaatacaatagcacttctgtagtggcatgtaacatcattttgttgcaactttaaaaagtctccgcagaagttccctccttgtgtgtcaatagcagcaaccattctgctgcgcaacaagtgaacctgtctgtataaaactcaagaactaagtcctgagattctcagcaggaatacattttgtgctcggaaactaaaaacagaactacatggtaaaaaaaaaaaaaaaaaa

SEQ ID NO: 15155 - DNA, 769 bp, Triticum aestivum
  Clone ID: PAT_TA_15155
ccacgcgtccggtgaggagggggcgctggggggcgcggcggttgcttctcgtggaagcttcggggggcgcggcacggcccgatccggtttggtctgggagcaggcggcggcaatgtcggccgcgggggaggacatagtgcagcacgtccggtcgaattccaacccgtcctcgtccaagctcgccaagctcgaggcgcgcatggccggcaaggccgtctcggtgccgcccccgtcgccgccgcaccacccggtggtcgcccccgcctcggcccccaccttcatggaccaggaggagctgcccgagtcctcctcctcttcggatgatgataatggcgaggagttcttgatacagaagaacacactgaagcgtccgagatccccggatgatgaccatggcctagctcttggaaattttgagggatcagctaatgcggcagcaaaagtattagatgtcatggacacacgactcccttcggaaaacccaagcagaaaaaggcagggccgtggaaggggacgtggtggaacaggacgagggcgtggctcaaagacggttgatcaaacgcgccatacttcggcttcttcagtaactgtctcaaatggtcaacatgacaaattaaccgacgtggattcccgaacaagtgttctacctgggaatgatgacaggactgctttacacgaagaattatcactgttacgtggtaaagttgcatttttggaggaggagcttaataaatcgcgtcaagaagcaacggagcatcaccaacttagt

SEQ ID NO: 15156 - DNA, 618 bp, Triticum aestivum
  Clone ID: PAT_TA_15156
cggcacgaggtagtttaggtaactatgacgggctaaatccttaagctgggacatacaacaaaatacttattttattggaggagtttatggaactgggtagtgctcatcaggatgctcttgcagcaattgacacaatcgatgtggctaatgaaccaaatagttgttgcaacggggaagagcatttctgcaatagcaagatatcaggacccaatgggcataggccgaaccaaccaccatcactattgcttcaggattagatagccaacttccactcatgagcctgtcgagtcaagtttcagacgatcatgtatccccttgatattcactggatggaatcctctattttactcagactgaaccttctacaaacatcgggaaaagcaacagtaataaagatggacagaaattccaaaaataaggtgtttttttatggatgtacctggttgcgatgaagctaaacaggaaataatgctatcacttattacctttgtccttcaaatttgagtataggcctgcgaaataatgaatatttgtgtctcattgctccagcatggtcaataaagatatgttgacccaggaaatgggggggatggagcattgaggatttcaggcttgggg

SEQ ID NO: 15157 - DNA, 802 bp, Triticum aestivum
  unsure (1)..(802): unsure at all n locations
  Clone ID: PAT_TA_15157
tttttngtggattgatgataaattcattaattanaacttcaggggtaaacaggcaggtcaatatatgtcggatcncaaaaatgattgnttaccatgacggatatccgtgcttgtagaacatcatttctcgtgttgacattgtctgtggacgattgagaacntgacgttgatgctcctttctgtgtttttttttgttttgcttctggtcgggcttgatctattcccagcctcggtccacatgcaatccaacccgcaacgctcatccatacaggctcagtctctgtccgccgccccggagttcagaacatcgaaacagtagccatcacagcatcaggaacagcagcgtcaggagatcaccctttgttcaccagcacatcagcgctcagcgggcgtgtcacattggtacacgaaccgcctgaggactcgcatcagctcgtcggccgcctcgccgaacggctgacggacggagaagccatgctgctgcccctcgatctcgactagctcgacgtctttccccatgtccttgagcctcgccgcgtaccccagcgcgcggtcacggagcacgtcgcccaacggcgccaccactagagccggcgggagctccaccggcgcgaggctggggctctccggaccgaaagggttcgccaccgggtggtcccggctcgccccgaccggaagcgacatgtgccagagctggtcggacagctccagcggcaggaacacgtccgacctcgtgccgaattcggcacgagcggttacaaccctgacaaggttcccttcgttcccatctctggggtcgagg

SEQ ID NO: 15158 - DNA, 718 bp, Triticum aestivum
  Clone ID: PAT_TA_15158
attcggcacgagacgatggggaagtttgacgatggtctcttagggaacgtttggatctcaggcaagcgctcgcctagcctggcccagcaaggaagcgaagcatttggtttctgggcgagcacgcctcgttaccagcggttttcagcttttttcgcgtttcatcgagcgagccgattcggctcgcctccgtcggcaaggctggccctgcctagcgaggcaatcaggcgaggcatccaaacgttcccttagggactaagggtgacgaggggtgggtcgcctggacttcgtggttgttgagaggcgcggtagcctgggcaaagcccgcagccaaggctcgtaatccgcaccaacgaagtccaccggcccggatcgacagcgggtggagcccaccgctcaggcgaagacagacaagaaaagggaggacactaccaacactgctggctgctcctgcacacgctgctcgtactgtaagaagaaagatccaacaagtcgtcaacagcagcagcccaagcccagccctgctcagcagcagaaacccgcaaaaaaaggttagctcttgctccggcctctatgttttctttgagaatttctcggcgggttccatttcttcaggtttaccttgcgcagagtaactttctatcctttcatgctgcgtggaaagggtgaacagtgaaaacggtggcgtgaatcaggttgtcaattttatgcttcgccgatc

SEQ ID NO: 15159 - DNA, 508 bp, Triticum aestivum
  Clone ID: PAT_TA_15159
gagctgggatggtcacggcgtgcatcaccatggtcatcgcggcgctcgtggaagccaagcgcctccgcgttgccaaggacgcgggcctgctcgaccggccggacgtggcggtgcctatgagcctatgctggctggtaccgcagtacgtccttatcggcctcgcggaggtgttcagctacatcggactggaggaattcttctacgaccaggtgcccgaggcgctccgtagtgtggggctggcgctatgcctgagcatcttcggcgtggggagctatgccagcggcatgctcgtgtgggcgatcgactgggccacgaagaggggcgggggagagagttggttctccgacaacctcaatcgcgcgcacctcgattacttctactggatcctggctggcctcggcgctttagaggtggtcgtgttcttgtactttgcaaaacagtatgtctaccgagacaaacctgagtaatgatccgtacaccctccatcagtttcacgaaaaaaaaaaaa

SEQ ID NO: 15160 - DNA, 1359 bp, Triticum aestivum
  Clone ID: PAT_TA_15160
ccccgcagcaagtaattccactcccgccgccgcagccagccagcctccggcgctctctcggacgctcccgcatacgtacaagcaaaagcaaccagagccagccatgtgccccggggcgccggtcgcggcggcggcgtcggacaagagcgtgtgcgtgatggacgcgtccggcccgctgggccacgcgctcgtgcaccgcctcctccgccggggctacaccgtccacgccgccacctacggccactcgctcgacgcgctcgcgctgctcgccgccgccggccacgacgaggaccggctcaagctcttccgcgccgaccccttcgactaccacaccatcgccgacgccgtccgcggctgctccggcctcttctgcatgttcaacacccacgaggaccaggcgggctgcgacgaggttatggtggacggtggacggtccgggcggcgcagaacgtgctggaggcgtgcgcgcagacggtgaccatggagagggtggtcttcacctcctccgtcaccgccgtcgtctggaaggacgaccacaagctggtcgacgcctttgacgagaggaactggagcgacctcaacctctgcaggaaacgcaagttgtggcacgctctggccaagacgctgtcggagaagacggcctgggccttggccatggacagaggggtggacatggtggccatcaacgccggcctgctcaccgggccggggctctcctccgcccacccctgcctcaagggggtcccggagatgtacgagcacggcgtcctcgtcaccgtcgacgccgacttcctcgccgacgcccacgtggctgcctacgagtgccccacggcgttcggccgctacctctgcttcaacaatgtcgtgtgcaggcctgaggacgccctccagttcgctcagatgctcaccccgtccgctccatgctacccgccaagtgacgagctgaaggtgatcccgcagaggattcagaacaagaagctgaacaacctgatggtggagtttgccagtgccatatacggggacttggattagggattccattattcattcgtttacctcacaagggcagctagggttgtattctttatgtacctaaatatctgtattctttttcctcctgaaaagggaaatatggttggtcagatgtacaaatctgtacgaggccaagcatgccgcatgtattccactcttaccaggctggtaagagcatttgagccagtgcttagcaaggtagtaatccttaggtccaccaaaagggaaaataagtctgcagttatgttactgccttgtacagcagcaatatatgaatatatgatggtgaacaaatgttgaaggttaaaaaaaaaaaaaaaaaaaaaa

SEQ ID NO: 15161 - DNA, 1009 bp, Triticum aestivum
  Clone ID: PAT_TA_15161
cgtccgctgactcgtcatccaacaccgggcagcatatatcttagagtgcatgataattgggcgcgggctaatccacacctatacctaatgcacttggctgctgcgccgaaagcgacgatcgtgataccaccacagcatgctcaaggctggccactgctatggccccttcgaccctgtctccaacatcatcatcaacactatctggtataacaccgtctccccgccgagccaaaaacttgagcttgatatgatcagtaccatgagtctgttacgcattgaggctcgctccttctatggccttgtttctttcctctgcacttcgggcaagaaactctatgaagccatgcgcttcttgctcatctctgcttccactttgggaaagactcagcccttttcgaaccctttgtctgactttggggatgaaaacaaaaaatttcatgccttcagggctgccggtgtggctgcttggcaccccgaccctgtcgcgcaagcagaatttatttccaaacgcagtcatacattaatccgtcataagattaatgctccactcgactctgctgatgttgaccgcatcaccagaaagatgtttcaaggacctcccacccctggcaactcactgcagcatcaatccgatcccatgcccaagctatataaaattccggatgagcatacaagagtctctaagaaagtcaaagcagcgctggcctcatatgcactggagaacagagaatccacgtatgatcttcatgttatttgtggcgtcaaccataatgtgtctggccctgagtactgtatggatgttgacaaacccattttcatatatcatcacattcatgttaattttctggcaagtcaaggaggtggagatccaaaactcttcttcgctgaacttagcaatgacgatgcagaggacggaggtcggaaggtcttgtgttgtcctgtgaattttcccaaaccacgccaagaacaaatccgctgcatgtactgtgattatgaagggactaaaatt

SEQ ID NO: 15162 - DNA, 1318 bp, Triticum aestivum
  Clone ID: PAT_TA_15162
ccacgcgtccgagcccctgccaagcccgtctctctccccttggcacacttctccaccggcgacgcccgcaacctttccgccgccgccccgccgcctccaatttctctccggtaggagaactggatcccccacgagtacagcaccagagtaagaagcaatagagacgccacccgtcatggcagactacgagcaggaacaggagatggagttggaggccctgcaggccatcctcatggacgacatcaaggagatcgaccccagcgaaagcgggattgacaccaactcccgctgcttcgagatcctgctatcccctcaggatgatgatttcgacgaggcagctcatgtaccagttcaaatggctctggtttttgcacacactgagaagtacccagatgagcctccacttgtgaatatcaaaagtgtacggggtattaaaccagacgacctcacatccttgaaagaaaagcttgaccaagaggcaactgagaatcttggtatggctatgatatatactcttctcgactcggctaaagaatggttaactgaaaaatatggtcaaaatgctggagatgaggaacctgacgaaactgaagaaccagcagaggaggtcattataccccatggtgaagctgttactgtagagagctttatggcctggagggaacgttttgaagctgaattggcgctgcagcgtgctaagcttatgccagagtcagctcttactgccccaaaggaaaagaaactctctggaagacagtattttgaaagtggaaggcatataacgaaaggagcaggtacagttgctgaagaagatgaggaagaggaggaggatatcgaattcgatgacgattttgaagatgatgaggaggacatgctccgagcattttttagcagaacagacggggaaatcgtcagcttaggcttggacactgtaaaagggaacatcatgctgcgcaaaatctattttaggggaagcccgatgtgttgacatatatcatagagctcactatctttgtgtgttttccccatcattcagttgcctcgtggcgactgacgacgtagctgcataaatatctaaaagccgaggtagcagtgggtctctctcactgatcaaatttgaggcgttgagcatggaactgcatctgtgtaatgtacttcgtcgtgtaatttatcgtgtttttcgtccggtgaacatgtatgctttgcagagaatgttataacttccgttctgtacgtgaatattgtcaacgtgatacttcaatccaagtttaaactagcaataataaaaaaaaactcgagactagttctctcctcgtgc

SEQ ID NO: 15163 - DNA, 812 bp, Triticum aestivum
  Clone ID: PAT_TA_15163
cggacgcgtgggtggcgctagccggcgccgccaacgccaccttccggccccgcctggtcaccgccgccgctgacacctccgacactaatactcgccgccgacactggaaggccggcgagttcccattccccaccacctccccctcctccggcacgcagcagcgccggagaccccggaccacggagcgcccgcccccacctccaccgtccaagggggaagacccggaggggagagggcgccagaggcactggaaggcgggggaggacccggaggggggagggcgccagaggcactggagggcgggggagttcccggcggcggccgagtcccaatcccagtccgggaggaggggccgcgctcgcacccctatcaagaacgtccagaagaggctcgacgcgcgcgccgatgccaaggcctgggcctgcaccgtcaccgaggccctcgccgaccgcatcgccgccaagaactggcgggaggcgcttcaggtcttcgagatgctcaaggagcaaactttctactatcccaaagagggcacctacatgaaactcctcctgttgctggggagatcaggccagccttctctagcacaagaccttttcaccgagatgcagcagcaaggatgccagccaacacccgagctttacacggccttgatcggagcctactgccggaacggcctcctagacgaggcactcaagcttcttgaagacatgaaagccgccccgctgtgccagcctgatgtctacacctatagtatcctcatcaaggccttcgtggacgcctcaaggttcgacctcgttgatgctatgtac

SEQ ID NO: 15164 - DNA, 608 bp, Triticum aestivum
  Clone ID: PAT_TA_15164
cggcgcctggcgccccggcggcggccaacccgccgacgacatccaccgggccggccccgtcgccaaggccctcgacccctcggccgcctgcgccgacgccctcctcgcccgggccggcgccgtggtcgccttcctcggcctctcccccgcccacgtctgcggccagggctgcgccccctcgccctgcaggtcgcccgcgccgccgtcccaccccccgacccccacggggcccccccccgccgcccccatcccgcagccgcccgccatctggcccgcccccccccgctccgcccagccgggggaccggcgggtctgctcctgcctgccgcgcccgtgcctgggcccgcgcccgcgcccgctcggccgccggtccgcccccgcccccacccgcccgggcttcgccggccgctccgccacctcggccatcctcctcggcgccgcgctcgcccgcctcgccggcggggtcctgcccgggggtggcggagccgctgaacagcacggggccgtaccccgccgggccgatcccgcagcaggcggtcatcaggagcgcccttgcccgcatggccaagccggtgtacctgctggacttcaccttcctgtcgcagctg

SEQ ID NO: 15165 - DNA, 672 bp, Triticum aestivum
  Clone ID: PAT_TA_15165
ggtcgacccacgcgtccggcagataggtccctccccctcaccgtctccggcgatgctgctccgcctccgcccgccggccgccgccgcgggcctctcatccttcctcccctccgcgcccttcacccgccccctctcctcgccgtcctggcgcccgcgcccgcgccgcccccgcctctccaccgccgccgccacaggaggagggctggactcgctgcgggagcggtacgacgtcatcggggtcggaacgcgtccggccggctgcgaggccgcgctcgcgtccgcccgcctcggtgcccgtaccctcctcctcaccctcaacatcgaccggatcgcctggcagccttgtaatccagctgttggtggtcccgcaaagtctcaacttgtccatgaggtagatgcccttggtggtgatattggaaagattgcagataggtgctatttgcaaaagcgtgtgctgaacagctcaaaaggtcctgctgaccgtgcactgcgtgctcagaccgataagagggagtatgcaatggagatgaggaaagttgtagaaagcacacaaaatcttttcattagagaggcaatggctacagaagttatgataggcaagaatgatagtgttgagggtgttcgcactttcttcggcatggacttttacgcaccatctgttgtacttaccac

SEQ ID NO: 15166 - DNA, 1484 bp, Triticum aestivum
  Clone ID: PAT_TA_15166
cgtccgggcacaggtttaggtcctacgatggagttctatacgttgataagtcatgagtttcagaagtctggtttaggcatgtggaggggtgagcttccttgtgaagctggcactgacaatactcacattggtccccggactgtggtcgcacctaatggactgtttcctcgaccatggtctgcttctgtagattgtgcttccttcttggaagtaaataaaaggtttcacctccttggtcaggttcttgcaaaggcaattaaggatggcagaattctcgacattccattttccaaagcattttacaagcttatcctaggacaggagcttaatatatatgatatcaattcatttgatcctgaactcgcaatgacccttatggagtttaaagcgcttacttgtcaaaggaaatatttagaatcatgttcgacaaaggaatgcccagagcacatccggattggccttatccgtgggttggtaaaattgaggatcttgttattgactttgctgtcccagggtatccagaatatgtgctttcttcagagggtacttcagacaatgtaactggtgagaatttggaagaatatgtttcttttgttgtcgaggcaacagttaaaaggggacccacaggaccggggggggccgttgcctcggcattcaggcaggcatcctccctattcacgcgggccgcgggcgcctgcgatgtgctcgacggattactctccggtgggcatgggggccgggattttgtgaaacttgtggatcacataaaatttgatcatggctacacctccagcagtcctgcagtccttaatttgttagagatcatacaagagtttggatgccatgaacgcagagctttcttgcaatttataacgggttcacctcggctccctccaggcggtctggctgcactgaatccaaatttgacagttgtcaggaagcatagcaacaacgatgctgatgatgatctgccaagtgtgatgacttgcgctaactatcttaagttacctgcctactgctctaaggaaaggatgagggagaagctactctacgcgattactgaggggcaggggtccttccacctgtcctgactggaaaccgatactgacactggctgcccgcgccacacgcaggagaaactcgcgcgtggttttgtaagtatatcatgtagggaaacaagatacgtaggtgtgggcggctcgctaaacttacgacatgattgggtgtggagctgatgataggaggggaagaagcagagggttccccgtcacccagccttatctatccttgcctgtacatactggtcttagaagccttttaggtgtgctctcgagtgttggcgaacatggcgaccatcgacttagatcgctgctatttatgtggcctggtcttttgctgtacatacacattggctgcaagtgccattgctatctatctatctatatatcgttcttagccggtgtttgcctgctgcaaaaaaaaaa

SEQ ID NO: 15167 - DNA, 592 bp, Triticum aestivum
  Clone ID: PAT_TA_15167
cggcacgagcaaagtcgcacaacgccacaacccaaagcacaaggccgcacccacctttccccgttcttctccggcgccgaccatggccgtcgacctcatgggttgcggctacgccccgtatggccacgcggccgaggccgaggagcagttccaggaggccgctgccgcggggctccgcagcctcgagctcgtcatctcctccttctccttcggcgccggctgcacgccgcccctcggagagatggccgaccaggcggtgtccaggttccgccgggtcatcaacatcctcgaccgcaccggccacgcccgcttccgccgcggccctgttggagatgccgccgactcgttgactccccctcctgaatcctctgctcctcctccgatgccggcccaggcaccggcaccggcaccggctgtctcgccgcagctggcgccgcagaaaagcatgacgctggacttcacgaagcctttgaaggcgccggcggcggcctcggctgccgcgccttcggtgacgtcgacttctttcttctcgtccgtgacggcggggggcgagggcagcgtgtcgaagggctggagccagctggtgtcctcc

SEQ ID NO: 15168 - DNA, 2007 bp, Triticum aestivum
  Clone ID: PAT_TA_15168
gaggaattcggcacgagggtccgccccgtctcgccgccgcccagctcgtccccggcctccggctcgcctccgcccagagtcctcccattttagtcccgacgtctcttcatagtgatttgaccggcagagatttgagctgtgggctttactatacttctggtagctgattctcttcaccaattttcatcaggtctgtactctgagagttacttccatttgcgttgaaagctctgcgggtcactttgacagggtttgtgcaattaccctgaacagacttggcagaagtgtgcttgtgaggtcttgtgtttctcttctcgtataagagccaactgtgggcaagaagtcttcttgattgagggatgccgacaagaaaaaaaggacctgcaagaaatgcaactgttgagcatgttaatacgaaaactagtagacaacctggaagatccactcagtcggcagctcctgataagaaagtcaatgatctaattacttcttcctccaaaaagcagaaacctgccgaagaccctctgaagaagaaccaagttctcagtggtggaagaaaattaacatctctatgtgattctgatactgaaaatggagttgctgatgtgccaagtagtagtatgcttgatcacaagctgtctcacggaaatgatgatgaaccatgtgagaacatattttctcaaccattccaccatcataatgaagacggcagtgatggcttgagcaaagttcctgcgcaatcaaggggtggtaatacaaagcgcgcagatgatgagtacagcgaattgggtagtctttctcccgaagtgtctgctatatatcttgcaatgcagcactctaagctggagtgtattgatgaacaaagtcaagattctatctcaacagatggcgggtgcgctgatcctgatgagactgaggagcttgatgagtttgacccttataccttcataaaggatttgcctgagttatctatggttgtacccaagtttcgacccgttcttcttccaaagcaaactcggagctgccctcgaaccacccttgtccttgatctggatgagacactggtgcattctactcttgagccgtgtgaagattctgatttcactttcccagttcattttaatctcagagatcacacaatctatgtacggtgccgtccatatctgaaagatttcctggagagagtagccagcatgtttgagataatcatcttcacggctagtcaaagtatctatgcagaacaactacttaatgttcttgatcccaaaagaaggttgttccgtcatcgagtttatcgtgagtcttgtgtctatgtggagggcaactacttaaaggatctatctgttcttgggcgtgacttgtctcgtgttgtcatagttgacaattctccgcaggcctttgggttccaactagacaacggcataccgatcgagagctggttcgacgacccaaacgacaaggagctcctagcactgctgccattcttggaaagcctggttggggtggaagatgtccggccattcatcgcaaccaagttcaacctccgccagaaggttgccagcgcgacttcccttgcgatgcacttctttcccaacgcggagcgtgccaactgaagcgctcccacagaaaacaggcaatcaagtgttcgaaaggatatctgaaattcaggatcctttgttgtcgtggtacactcatgtgtcatttaatttcgaaccgccaggcagacagacggatgtataatttgggctgttgtatgtttctgaaaaccggtaatcttttagggaacccttgtacaagcagtagccagaccccagaagagggttgtcagtcgtgaccgcgttgcgcgatggtcatgcgcagaactgccaagcattgtaataggtcagcggatatttgtcggaatttgttgtgctcactgaagttgtgttgcagcatgtagtttccaagtagagtacacaagtcagtcagtaggattacggcccttgtcgttgagcctttcaaaaaaaa

SEQ ID NO: 15169 - DNA, 883 bp, Triticum aestivum
  Clone ID: PAT_TA_15169
gaggttgagcaatgtgccccgtccaagttcccatccaatgttgaacattcaattttgtcatgttgaatactataccgctgagtgctattctcaggcagttcttgctgccgtccttcccgcccctgggctgccctttctccctcccgctggttcgagctgcaccagctgctgcgcctgcagtgccgccggctgtgggcggggccggtggccacatgtcccctatggtgcttgtgcgggtgctgccccttctgagtgcgtcaccgcctcctccggccttgctgagctctgggcggtgtccggggaaaaatatttgtcaggtttttggtggccaagtgttattgatatggagatgaataactatgcggatgcactcctgctgtttttgcatctccttcgcgacgacctattgcgtgcccatgaacaaaagagcaaagcccgcctgtagcctgagctattcatcgcctcgtctcaatggatcagagttcatggaaaaaaaatgtttggcatcctgtagtagttatagtccttaagttacaacagttcgatcatgaaaaaaacatcagtacaaaaagtatggagcttctaacgttgtagcgatttcgtgtgaacacaaggatccttcctggaaggtagttggtgggttgtgtgcacgctctacatacgtccatgctagcctatcctgctgtgtgcgtgcgtccgtcttgcgcgctcctgttcgtgccggggtccggtcttgcctgggcggcctggacaatctgtcgtgtgcgtcggtgtggtgggggctttccatgagagtgctgctaatttctagtgttgctgtttgttttctctacaaggaaaaattagctggctgctgttctgaagtttcaggaaaaaaaaaaaa

SEQ ID NO: 15170 - DNA, 1261 bp, Triticum aestivum
  Clone ID: PAT_TA_15170
aaataaatagaagtgtcatgatcatcattaatagagcattgtcccaaaaaaagagaacgctccgacgcgccgtgggtgcagaacgtcaatgcagctttctccaagttcagctcaagcaccgaggagaagagtgcaatggaaagcttcatcccgcattccgatttccccacaagacgccggccgcagctccccaccaacctcctgagcgagagccaagaactctctccgtcgatcgtatggtgcccatggtcaccgaggcgtggacgctcgccgggtgcggcggggcggcggcgtccaagcctttgccggctcaggaggtccccgtgctaccgcatcctaccgccaagaaacccgcctcgtcgagaggggtggccgtggcgaggagcgcaggccaggacggccggcgcgatgccgccgtcgtcgggaggcgccggggcatcgcgtcgtgcctgctggccgcgctcgcgctggccggctcctcctcaggcggcgccgctcgggccgccatcctggaggcggacgacgacctggagctgctggagcgcgtcaaggaggacaagaagaagcggctccagaagcaggggatcatcagctcctccgccgcggagacagggtacctgcaggacctggtgtacaagctgagcaaggtggggcaggccattgacaaggacgacctcgccgccgccggcgacgtcctcggccccgcccccgacgcgccgtgggtgcagaacgtcaatgcagctttctccaagttcagctcgagcagtgaggagaagagcgcggtcgacagcttcaactcctcgctgtcctccttattcacatcagtgagcaagagcgacatcaactcgtccaagtcggcgttcgtgtcgtcggcgacggcgctggagaaatgggtggagctggccgggctcaccggcaagctcaagggcttctgaattttctgagatgagtgaattgttgctgtctgacgagtacatacctacctacctggagatgatgttttccttcaagcgctggcttgatgatgttctccatgcaactgatacatgtgttgattctatcgtaaccacggtttcgacgggaaaacaatctgttagagtcacaattccctctgtttttcttccccttgttgagatgtaaaagacattttttgtgtcaagaaattatttgcagtgtattaggatcttgaggaagaaaaagtaagttcatccgtgtacgtctagtgcttgtttgcaagaaattcatgcgagttcttgcactc

SEQ ID NO: 15171 - DNA, 632 bp, Triticum aestivum
  unsure (1)..(632): unsure at all n locations
  Clone ID: PAT_TA_15171
tcgccgcgcgaggaagctagcagctagctctagccaaatcaagacacgtcgacatgaatcacgccaaggagaaggtgaaggacgccgcgagcgcggccaaggccaaggccaagatcacgcaggccaaggtggccgagaagacggaggcggccacggcgaggtcgcacgacgagcgttgcgcctggcgcacgagcggggcaaggccaaggtcgccgccgccgaggccgagctgcaccaggccaaggtcacccaccgcgaggaggccatggagcaccgcctccacaagcgcgcccgcaccgggcacaagcacggcgcttggccactgatgtgcatgaaggagccggacggccggccgccggctagaaagatgtaccgtgcacgcatagttcatgctaccaccccggcctgtacttgtttccatctctttttccattatcttttgacccccagacgtagtgtgtgtcctctgacttcgggcttaatttggagagatgacagctcccaccctgactcctctaagtgtatatgtctgtattttggattcttgaccaataggccgcaaacgactaaccaaacacgcggatccccatcgatgggagtaggaacgcttcattaaaaaaaataananaaan

SEQ ID NO: 15172 - DNA, 1074 bp, Triticum aestivum
  Clone ID: PAT_TA_15172
cgacccccccggcccggccgcgcccttgcttgccccccgcccgcgtcgcctccccgccctcgccccgcgatccagatctgaggtggagtgattggctgggcggtggcctcggggtcggaactcggaaccgtccatgttttgacctcgcccgggtcgcctcctcgtcctcgccccgcgatccagatctgaggtggagttctagattgactggtcagaggaatttggtgccgtcatgctgcccaagatgccgtcggtccggtggatctcggcttccctgctggtcattctcctgagcctgcaccccatcgccgacgccttctacctcccgggcactttcatgcacacctacgaagccggtgaagagatcgcggccaaggtcaactcgctcacgtccatcgagaccgagctgcccttcagctactacagccttccctactgcaagcccccggaaggtgtcaagaagagcgccgagaacctcggcgaggttctcatgggtgaccagatcgacaactcgccgtaccacttccacgtcaacgtcaacgagtcgctgtacctttgcaccaccgacccgctcaccaaagagcacgccgagctgttgaagaaccgggcgcggaatctgtaccaggtcaacatgatcctcgacaatctgccggtcatgaggttcactgagcagaatgggatgacaatccagtggaccgggtacccggtcgggtacaacccgatgggtagcagcgaggattatatcattaaccatctcaagttcagggttttggtccacccctaccaggcacaaggtgatgttgtggtcacgaagtgaggatggtgttgccatggttgagtctgaccgcaagagtggcttccagattgttggttttgaggttgttccttgcagtgtgaagcgtgatcctgcagccatggccaagctcaagatgtatgagaagggtgactctgtgtactgcccgttggagctcgagaaatctcaggtgatccgtgaaaaggagcagattacatttacctatgaggttgagtatgtcaagagcaacatcaagtggccgtcaaggtgggatgcatacc

SEQ ID NO: 15173 - DNA, 642 bp, Triticum aestivum
  Clone ID: PAT_TA_15173
gaggggagctggggctcccgccgagggacggcgtctccaacctccgcttctcgaagcacagcaaccgcctcctcgtctcctcatgggagaaggctggcctttagtttccaaaactagttatcgctggggaacccatgatggtccagttcgctgtgtggagtactccgatactacaggtcaagtaatcactggaagctgggataggactataaacggttgggatcaaagaggtgcgactgggccagaatatacacttattgggacacacacccaacctgaacgtgtatacgcactttcattagcaggacataagttggttgttgcaacagcaggagagcatgtgaatgtttatgatttgcgtaatatgtctgagcctcagcaaaggaagtcttatctgaattctcaaacacgctgtgttgagtgttacccaaataaaactggatttgctttgggtactacagacggacgagttgcaatggacttctttgaccaatctgagtctagtctcgaaaagaggtatggtttcaagtgccatcgattgaccgagggcagagtgagggttgcatatcctgttaatgcaattgcattccactcagtgcaccggacgtttgccacgggcgggatggatggatttgtgtgcac

SEQ ID NO: 15174 - DNA, 1190 bp, Triticum aestivum
  Clone ID: PAT_TA_15174
cccacgcgtccgattaaaaagacaaacaaatggaagctcttgtcgataagctttgcaataggtttgctggtgtaaatgatgttaggcagtgggagtatatctcttactgcctctctcagctaaccttcactgagaaaggtctgaagaaactcatcgataatttcaagatgtttgagcatgcattatgtgaagattctgtgctgaaccacttcagaagcgtgatagcaaagtgtaagaagtttgcgaagccagatctcaaagcttgcattgaggaatttgaggagaaagttagcaaagttcacgaggcggcgcgagaacaagaagccacggcaagaaatgcggaggcacataagcagaaaattgattctcttgataaaatcctactcgctaaggaagctgggcagaatgacagaaactctgctgacgaggaaaccagtgaggtcattgatccttcagtggaaggcaatgctgaagacaaggagacagaggaaactagtgaggttactgatccgtcagtggatagcaatgctgaaaataagggggcagaggaaggtactggggacattgacccttcagtggatagcaatgctgaaaataaggagacagaggaagctactgaggttactgatccttcagtgggtagcaatgctgaaaatgaggagacagaggaaggtaccaaggttactggtccgtcagtggatagcagtgctgaaaatgaggagacagatgaagctactgaggatattgatccttccgcggatagcgctgctgaaaataaggagaacaggacaaaaggcagcggcaacatttgttccggaaaaagtcagacatcatccacggttacagaatcagaagatgatagcacagaggttcaatcatccaaaactgttcgcagtcgcaaaggttcgacacgatcgactgtaaagaagatcagagaacctatcttggaagactctgcagacgttgctcctccagtcaggcgttccacccgctcgagtagaagacaatgaagctgatgccgcggggtgctcccggctgcgccccggcgccggctgccgccctcggcgtgtggccatcgggtgcctaccccttctcggcgccgccggccggtcgcccctggggatcgtggtggtgttcggcctcctccgggccgccttcccggcgccggtgcctaccggcggtgttaactg

SEQ ID NO: 15175 - DNA, 955 bp, Triticum aestivum
  Clone ID: PAT_TA_15175
ccccggcccgcgggtccctcgcccggaggtgcggtccggcggggaggttttcaccatcctctacgccgggctggtgcccgccggcctggcgttcgcgctgcagatttggtgcatcgaccgcggcggcccgctcttcaccgccgtgttccagcccgtgcagaccgtcgccgtcgccgtcatgcccgccgtcatcctcggcgacccagctttacaccgggagggatcatcggcgcccgtgctgatcgtcatcgggctctacttcgtgctgtggggcaagagcgaggagaagaagacgaggagccaggacccggagatggcgaggcacctgctcggggaagacggctgcgcggcggacaaagatcagcaagtgagcaccactgtgctggcgtgacagctgctgctggatcgatattccttggagatgtgtgtgctgatgtgggtgtttgtacctacgtttttaactagtgtttcaagcgtgcgttacgaccaagaagaagaagacccgtactagttgacgatgtgaactgccaaacacactcagtcatttttggtacctactgtgtatagccccctgtcttcgagttgtgggtctaggtcgcggtaaagaagacatgctcccaagattcccgagatggcgaggcacctgctgggggaagacggcggcgaggctgacaaagatcagcaagtgagcaccgctgtgctggcgtgaaagctgctagctgctggatatcccttggagatgtgtgtactgatgtgggtgtttgaacgtactcctacctttttaactactagtgtttcaagcgtgcgatgcgaccaagaagaagaagacccgtactagttgacgatgtgaactgccaaacacactcagacatatttggtacctactgtgtatagccccttgtcttcgagttgtgtgtgtctataaatacactatgctccctaattttgaagctct

SEQ ID NO: 15176 - DNA, 917 bp, Triticum aestivum
  Clone ID: PAT_TA_15176
tcggcacgagctcgagaaataacaaaaaagttgatgatgctcctgctacttctaaatatccacccatggttcttggtcagcagaatacaccaggcatctccagtgagccaaaaataaaaaccgctggcgttatcattagtagttctatacttcctgctgaaaacaccgtgcttactgttggaagtataaccgtgggtggtatttcatttggatcttttaaccaggagcgcctgaaattaccagaggaagctcagagcactgcaaatagccgcccaaaacctcagcaagcaaaaggatcaaaaaagattcaacatgctatccgacctgtcgagaagccacatgggaatgagagtgttgtctgggcaccagttaagccatcagggtggaatgaaccatctgaggaagctaacgtagcagtagcagccaggcctaagccaattggaaagggcaccaccgatggggagaatgtcacacgaactaagagagctgaaatggaaagatatgtgcctaagccactgtccaaagagcttcaacagcagaatttggaacaaaatttacctgtagaaaaatcctctgtggagaacaagagtaatgataatgagaagttaaccgctgctaaagagcccaagaaatgggaggacagaaaaactagtaaagggcatgggaagtctcattcttcttggcgcagaaggaatacagatgactcatcttcggtggtaccaataccttctgagcgagcagacagctatcaagaatcacacgaagttcagaggccttctgacaagcatccgcagcttgaacctgacaagcaagcagattatgctgccgggaatagtttggctccagctgaagcagttgagttacctgccagcgccgcaaaagaacatgcggcagctaacaggcaaaggaggcagcat

SEQ ID NO: 15177 - DNA, 988 bp, Triticum aestivum
  Clone ID: PAT_TA_15177
ggtgtccacatcaatatcgggaaataaatcacttttactccagccatacctatttcaggtttcacgatcaaaatattagtactatgttgagacttggtcaagctactgatgttaagatccaccattcaaggatctccaagctgcacgcctccaataatgtggccggtatcatggctctccacggtgtgaaattgttgtgaggaatctcctgaagaaactcaggttgcagttatgggccatactaaaatacagttttcatgtaagaattattacgtatggattgaaccagtaggaatcagggaaaagggccaaagttggattcctgaatcaggctcacagtgattttgcttgcgtggaaggaacatccattcctgcaagaatcgactgccaaggagggtgatggattgacttgcaaccagtccacggagtatctgaagccatgcaaggaagaagaagaagaagaaacactgcccaggctagaagaagcatagcctgcagctagttggtatatctgaagcccatcatcagccttgtgatgccgctcagaataaaattgcttcgatgagtacaccattcacattcatactgtgtgtgcgatgaaacaaccagactgcatcttctgaagaaatcaacacttgtcatgctgttaactgaagaaatcgacacccggcggttggcgcggtggcctcgtcgtcgaccgtctgatcttcatctaatggcagcctaccgctttgtcctgagttacgacacaccaccacccctcatcacgcatcgaacggctctgaagacaggagccgtcgctatttgaattacctttcactgcttccttccttgttcaccagctttactttagcattgaagttagctttcactggttgtaatgggtaaaaatgcctggatctatatgagatccctggagctcatcttcctattactgggggtaaacccgtagccgccgtgccctgggtggcgtaaacgtgcatcccta

SEQ ID NO: 15178 - DNA, 605 bp, Triticum aestivum
  Clone ID: PAT_TA_15178
cgtccgaaaggagtatcatcgagtcatcgactagctcgtccgccgctggcctcccctccctcgccccgttcctccagttcgtctcccctcccttagcgtaggcacgcgcgcagcttgcgcggcggccgacggccgacggccagcgcaaggaaggagcaaggccggaagggcaggaggtggtggaacttctttcttggatctgttaaagcaatgggattgtcaagtaactgtgctaagacaatcaaggtccagcagtgtgtgaaagtggctgattccaactatcttcacatcgacgatgagctcgctgggtgctttggtaccgaagatcatggtgatgggcggacggccctcgttctcaacccgttcggcaagaatgtctggcctgtcaaggtcgaccgagacgccaaaggggcattcctgggtgatgggtgccctcgccaggtggtggaacttctttcttggatctgttaaagcaatgggattgtcaagtaactgtgctaagacaatcaaggtccagcagtgtgtgaaattgtctgattccaactatcttcacatcaacgatgagctcgctgggtgctttggtaccgaagatcatggtgatgggc

SEQ ID NO: 15179 - DNA, 782 bp, Triticum aestivum
  Clone ID: PAT_TA_15179
gttcttttttataaagaacatttcattaattgatatatcaaggtgatacaacgtcattgaaaaaaatgctcggcctctgcatagcatgatgcacacagccaccaagtaccctaaaataaagatcgtcctccagcacagctgcgtccgtcctcctccgggccgggcccttccccgcccatgcctcccccgccgcccccgtggggcgctcgccggcctgcttcgctgcgccggccccgcagccgccgccgattgtggggccccgccctcccgccgccgcccgccgcgcccccggcgtcgcccccgccctcgcccgcgtcttcctccgcgtctgcctcccgcagggctgcgacgcgtcggtactccttacggggaacaacagtgagcaggcgttggggcccaacctgacgctccggccgatggcgctcaagctcatcgacgatatccacgccggcgtcgaagccacctgcccccggactgtctcctgtgccgatgtcaccgtcctcgccaccagggacgccctcctgcaggtatatatacttggctgccacaaacacacggacatgagagatgaaaccaacccggcgtcggcggacctcgtcttggctctaccagcgccatcctttgatgtgcccaccctcatcagctccttcggcaaccggagccttggtgtggccgacctggtggcgctctccggcgcgcacacctttggtgtcgcccattgcccctccttctccgaccgcttcatgccgatcatcgacgccaacccggccatcggccccaag

SEQ ID NO: 15180 - DNA, 1207 bp, Triticum aestivum
  Clone ID: PAT_TA_15180
gattcggacgaggcttttactggtgatgttggggcttttttaactgagatgtgaaagatgcatcttatcccctgagaaatattgcctttcatttgttgatttgtttcctgacatgctaatttagagctagatatgcatgattcatcacacacattacagtcaattatccattggagtcttttgtccatagaggtgattttgtttggaccactggtctaggtagtgacattttgatcgataaggcacaagtttattttctttttcactcagggctacactaaagtaagcatcaccgtcagtgaaaataaggcataaaaatcaagaagtttttgccttggttgtgcgccgcatttagttgtcacttatttatttctatgaagttattcaattctcaccgagctttccttatgctttcaattgctaaataagaaatttaatatgcaatatttttaatgtctgaggaggccggacgagaagaaaagggtctgtaaggtcggacttaggtgcatctctggccagagatggctggatccatccgacgctcttccaaacagagcgtgaagatttgctgactggtgctatgtcctggccgtgcctgccctaccggctctttccgtctcttagtccctgccctgttgtgcgtctctgtgcccgcttcaagactgctgcgggcaccttatgcgtggccgcccgcccgcttggctggctggcccctcggacggggcgggcgaccagtccctccttcctgttcgtgtgtcagcatcggtgtgcccgccgcgtggccgctgggccaggttggtggtacgaaaattggttctgtataatggtaatatgtgttgtggagttggagctcgatttttttgaagttggagtggctatgttgtctatacatatatgccgcccactaaattcagatttcagtatactgtttagaataggtgtggatcattgtgttgtgttcagaatagagctagagagaagggaagagttgccaccgtaacatttatttgtactacattgtcccactgtcaattttcttaaagtacattacactcttcttcttcgaagaatagattgatgctctctacctcaggtttaacaatgcatgtaggttggccggtgtactaattttgatgcttcttgatcagtgtttggaagccaggggcttttgtgtatttgcataagcttcctttgtttttattatttt

SEQ ID NO: 15181 - DNA, 747 bp, Triticum aestivum
  Clone ID: PAT_TA_15181
tcggcacgaggcgtccccttggcaatcgatttctccatcaggaatggttcatgtccagagaaaggccagcatccgcctccggactatgcttgtgtcagtggcaacagctcatgttcaaacgcgactagtggcctgggctatgtctgcaagtgttgggaccattacgatggcaacccttacatcgtcaatggatgccaagacatcaatgagtgcgagctccacgatttgtatccttgctccgctgacggggtatgcaaaaataagttaggaggctatgactttccatgtaaaccaggaatgaaaggcgacggcataaaaggaacctgcacagataaattccccgcaacagcacgggtgattttgggtggaataggtggtgtttttatcatagcagccatatcattccttattcttcttcgcaaagagaaaaagaaaactagacaattttatgagaagaacggtgggcgtacattagagaaggcaaaattcataaaattgtttgaaaaggagaagctcaagccaatttttaagagtagcaattttattgggaaaggtggctttggtgaagtttacaagggaattcttgataatgaaccagtcgcagtgaagaagccgattagtggtagtgtgctagagaatgaacagtttgcaaatgaagtcatcattcaatctcaagtcatccacaagaacatcgttaggctcataggttgttgcctagaagtcgaagccccgattctagtctatgag

SEQ ID NO: 15182 - DNA, 710 bp, Triticum aestivum
  Clone ID: PAT_TA_15182
cggtcgaccacgcgtacgcccacgcgtccgaaaaaacccctctctgcccttggctcctcgtgcacgccgtccgcgcatacgcacagcaaagccggcttcccgcgagctccttctcctcacatccatggccgctactcaaggtgccagtgatgtcttgtccattgacaaagttgattttctcaagctacaaaatggcagtgatattcgtggtgttgctattgctggggttgaaggtgagcctgtcaatcttacggagcttgttgctgaagctatagctgctgcatttgctgcatggttattaaacaagaagaaagcggatggcttgagacgtttaagaatctctgttggacatgattcacgaatttctgctcataaattgcagaatgcaattactcatggaatcactgctgccggacatgatgttctacagtttggattggcttcaacaccggcaatgttcaacagtacacttaccaaagatgcgataaatcattgcccagcagatggaggcataatgataacagcgagccatttaccctacaatcggaatggtttcaagttttttacaagtgatggtggtctaaataagactgatattaaagatatattggagcgggcttctagagtttacgaggaatctgcacattgtggcaaacaagaacagaccggtgtcgtgactcatgtggactacatgtcaatttatgcttctg

SEQ ID NO: 15183 - DNA, 1121 bp, Triticum aestivum
  Clone ID: PAT_TA_15183
ccctgccctgccttcctccccgcagaaaaaaccccctctctgccctccacacctcgtgcacgctgcccgcccttccgcacagcaaagccggcttcccgcgagctcctcctcctcacatccatggccgcattatcagcgaaggtcatacaaaatgcattcttggcacaagatggtccacggactaggcacaatccaagatatacctgtgacttttgtgccctcaatacccgcagcatgcattccgtccaggggtgtagattatcattggctgatacttcagccaagtggttaaataccacatcaacagcatggattagcttcgggaaacaaggaaatattagctgcaatgctactcaaggtgccagtgatgtcttgtccattgacaaagttgattttctcaagctacaaaatggcagtgatattcgtggtgttgctattgctggggttgaaggtgagcctgtcaatctcacggagcttgttgctgaagctatagctgctgcatttgctgcatggttattaaacaagaaggaagcggatggcttgagacgtttaagaatctctgttggacatgattcacgaatttctgctcataaattgcagaatgcaattactcatggaatcactgctgccggacatgatgttctacagtttggattggcttcaacaccggcaatgttcaacagtacacttaccgaagatgcgataaatcattgcccagcagatggaggcataatgataacagcgagccatttaccctacaatcggaatggtttcaagttttttacaagtgatggtggtctaaataagactgatattaaagatatattggagcgggcttctagagtttacgaggaatctgcacattgtggcaaacaagaacagaccggtgtcgtgactcatgtggactacatgtcaatttatgcttctgatctagtgcaagcagttcttaaatctgctggaaacaaagagaaaccattggagggactgcacatagttgttgatgcagggaatggagcaggtggcttttttgtggataaggtactaaaaccattaggagctgttactgatgggagccaattcctggagcctgatggtttgtttcccatcatattccgatcctg

SEQ ID NO: 15184 - DNA, 508 bp, Triticum aestivum
  Clone ID: PAT_TA_15184
tgaacttcctttattcgatgcatttgcaaaatagagaagtgtggctgttccacttgtataaactcattatcgaatcaaattaacaaactctctaatcagcaacatctctacacaatgtacctgtatggctggctccgttcttgccatgaaacgttatcggcggaattcactcgtaaatttcttatcatgacatcatcaatcatcacgaagaggatgcatcatctcactctactcaccaccagcagccacctcgcaaaggagaagtcacacctcccgaaggccgcatcgtgcagcactatacctggccatacctcgggccgccccccgcctagccaagcccgacgcaaaaaacccaggcccaggcccggcccggtatatgcagcacacacatcatcaatcggcgaatggttggaaaaagttttgctcatgatcgatgcgacttgcttcagtgcatcaggatcttggccgtgcacgagaaaagatgccccccatgatggaggcggcgaat

SEQ ID NO: 15185 - DNA, 459 bp, Triticum aestivum
  Clone ID: PAT_TA_15185
gtcaacagggatccctatagtaagtcgtgctacagtttccgttgggggatgatgaaaccatgtgtggctactcgatgcctaatctcacagaattctcttgatgaacgctctcctagtgtcagtactgctgtatcttgtggatgctaacaacgattttcagtacatggtactgttgtccgggtcgaggaaggtttacgcccagcggacctagatgtgctggatgttttagactgtagaagacgacgcgttgcgtgctgaatgaatgttgctgagactctactatcgcagtgtgttgacgacgccgacttgcttgggctcccgttgttaaatttgttacgctacaaagaaaaaaaaaaaaaaaaactattgatagagatggttttcttgttgaatttggatcttgctggggttgtaatttcatcatgagaggaaatatctgcatcagttttttgctagtag

SEQ ID NO: 15186 - DNA, 986 bp, Triticum aestivum
  Clone ID: PAT_TA_15186
ttcccgggtcgacgggggtaccgggatgatcatcggggcagagattctagaaggcgaagtcggagtcggagtggagatagatatggacgtgacaggtacagagagagggaccatcatcgtcgtagcaggagtcgtagcactagtcctgatgattacaagaggcgtggcagagacagaagtcctagtcgtagcaggagccgcagctacagtcctgatgatgacaggaagggtggcagagacagtttgtcgcccgcacgcagaagcactagtcgctcccctcgcaagacaccacctcctcgcaagacaccacctccttgcgaggggtctcctgctaagcgcaatgatgaccgttctcctgttaggcgcaatgatgaccgttctcctgttaggcgcaatgatgaccggtctccaggctctcgtagcccttcaacatgagctgaatgtcaaacaactgcagatgaagccctcagagctgctcataccgttgcctacccagtcgtgattggcggaactgtcagaaggctgaaggaaggtgatggggacaggaagaagcggttgatggtggccgccgtcttgctggccctgctgccgctggtggtctttaccatcatggatggccggcaagcaacctccatgccagtacaaatggccttggagtggagacgaggtctcttgtgcacctgtgtatagagaaccggccgcatcatggcaggggagggagcaaaccaaatcgggactgaggcgcagagagcagacctttaggacacgacgccgaggacggccaggacccacaaccggggcacgcatgaatccaagcctcccggcaccagccacgggccaacgccatggatctcagcgacgggcgtgacggtggcggtaccgggtcatgcatgcctgatccgaggccagtgaggcgcctatcggatctggtcggagcgatgcgagccccttgctgcgtggtgccgtgtgtcaccgatgaacggacg

SEQ ID NO: 15187 - DNA, 1112 bp, Triticum aestivum
  Clone ID: PAT_TA_15187
cgtccgtcaatcttgtctattagcaccaagtattactatttcctttccagtgttgggcacttactataaatggtaatttgcacctttctagttacatgatgtggtgaagtagtacatatagttctaacaagtatccagaccttcatttgcctaatataagtgtaatctaactgctcagagctcaagataacctgtgatatgacatgctacggtactaattggaacatttctgatgcctgggagccacccgtccttagtttctgctttggttactcgctgtgctttgtgattaagtgagctgttgtaatctccgtactagcttacaagttggaatgcaaaattgcttgtgtcaatgctatgtgtagttgtgtcgtgtgtactactttgaaacgtcggtctatggttgtagaagctctactttatgctaatacttgcttggtccttcatatcaaagcttgcatgtactgtagaagctctactttatgctacttgcttctagtttcatggcttacttccaaatggacaagtagtgtgactcgtcaacgatgatgttggccacaggcagaagacgctttggtgaacagaccagagcagatctcccctgtgggcagcgaggactccacgatccaacccgttggcatacgatgattggatgattccttgtgagaggccttgcttctgctacaacaacgacgccggtcgccgcggctttctgatgtccgtgcgagatcttctccaacaaccacaggtatttttaccatgacgcctacttgacgacttgccgctcatctatgatgatctaccgctggtcttctacacatcggggctggtgctgattctctcaagcccggaactgctaccacagagaatagcagtcaagatccagggaactcccctctctttactcttgtctctgtgatgtctagtttctctcttgaatgccaaggatcacatatctagtagaatcaagttgttctcacttaaattcaatcacttaccatgtgacactgattttttgttaatacactgtccaagtcatgaatttgttgaactggtgcatgtatatattttgggtgctactcaactagagaatgtctgagataccatgtttg

SEQ ID NO: 15188 - DNA, 1044 bp, Triticum aestivum
  Clone ID: PAT_TA_15188
gggagtaacattgaacatattccatacccatccaagtaaaaaaaagcatattccaaaaccagcatttacatagagaaactgatactacacattgcatgactgataatatattacaaaaggtgtggaattcaccttcccaaaagagaaagaaaactatacactcaaaaaaagcaaagcaacccatcactcaagcagctggacaagatgccgtcaaatgggcatccatcacctatcctagcagcaccaagtggtacaatccattcctagcacaacacaccaataatccgcatctatatgcataggtggtggtaggcacaagaatctgcgttgaaagctctggtaagccatctcacgatgcaactagcacggaagcaagaactggcgaacacattcctttcagaagaagaaagctcagctggcaagctgatcggtgggttgaacttcaacagttggtcgtaagttatttgtggcagaagaactctctgctcgaggctgttcagcaatcgttaagttactcgcaccagaactttctgcaggcagttcttcaacggtcggcaagctcctcccaacaggactgctgacgcctgagtccgcaaggctggcgctggcttggatgctgttaccaaaggagcgatcggtaggagtcaccatttcaccgtcctcctgttgccgcgatccgttgagagcattgcagtgaggacagtagtatgtaacgaacgcgaagtcctctttcctcgcaagaccgttatgcatatggcaattgccacatattagcgcaaagcattgtgttggatcctcccctacaagcagagcggccacccgtgcgagccatccgccatcattgccagcatggcctctaaagtgctcaacagtccgatttgcagtggggctttcgttaccagcatatatactcgagccgtctgatggctcagaggcatgggtcggtccagagacatggcctgagtgggctggttttctttgcctcataccagaagcctgtccgtgctgatcattacttttacttccatccatgttcaactcatc

SEQ ID NO: 15189 - DNA, 2856 bp, Triticum aestivum
  Clone ID: PAT_TA_15189
gcccacctctcgccgcccgccggttcccccaacccgccccccccccctctccaccccccgccccccccgcctccacccgggccctccacccctccgtgcgagggggcacgccgcgcttcctccagcccgccgccgagccgagacacgtactccgtcctgcctacttcacaaccacctccgaccgcggcaccaccgccgttccgttcgcttcgactgatatggcggggacgtcgatattcacctccgcagcgttcccacgcatgactacacttgggcacttgcgtaatggagatgtacagaattgaagacgatgaccccaaggctgttgatactcctcgcacgggtgggttctgtgggtggtgaggagcatggggctcctttgtccaaggggcgacccgagcaccgagctggctaaagcaaagacgaatcattcgaagcagtcacgaaggtaatggctccagccaaacgcagtccgagaggtgggggttaggatgatgatcgtcggggcagagattctagaaggcgaagtcggagtcggagtggtgatagatatggacgtgacaggtacagagggaaggatcatcatcgtcgtagcaggagtcgtagcactagccctgatgattacaggaggcgtggcagagacagaagtcctagtcgtagcaggagccgcagctgcagccctgatgatgacaggaagggtggcagagacagtttgtcgcctgcacgcagaagcactagtcgctcccctcgcaagacaccacctcctcgcgaggggtctcctgctaagcgcaatgatgatcgatctcctgctaagcgcaatgatgaccgttctcctgttaggcgcaatgatgaccgttctactgttagacgcaatgatggccgttctccccctacacgaagagttgaccggtctccagactcgcatacaccgtcaagatcagctgaatgtcaaacctgtgcggatccattgtgcatagctgcccatagctgaggcttttaagtcgctttttcttggacaatcgatatttaaagataaagctaataatggttctcaatctcggttcctgcttcaagttagatgtcctgctttctgcaccactcgatattgcttatgagtacatataatatctctttttcttcccattcgttcttgtcctattagcactaagtttcacctcttccattgtggtgttgggttcagactgtagatggtcaagtgtagcttgctatttacatgatggtatgaagatattgttggtgatagcggaggaaatcacaggtgctaagctaggaaccttgaaaatgggcagcacccggcctgccctcatctgccaggggatgtccggggagctggtagtcatgatcgcagatccaacagccgcaatcgcgagctctgatgcgagggctaggacgttgtgggcggagctgcgggaggcgcgggtgcggcggttgtgtcgggttgtgtccgtcgaacttatgaatatcttgaattggtgcttgtagaaatttgggttatactaatatttggaatgtctttgatatcaaatttgtcatgtattgtagagtagctgtaccgatgcaatacttgcttgtgtacttattgacttggcatacgcctttcatgacaagctccaagtctgcacatatcattgttattttaggagcagatctctcatccttgtttgcataagaaacctgaacttgcttaaaagccaatttagttgtgtattaccagttcaagttgtttagtatctatcatgttctgttttgctaccgaacaccttcaacttaaatgttgaattgccttggtacacataattgtttttaatctaaggggaagcccttaatagtcagctgaccttatgaaccgtataaatatatcaaaatcatgtgttgttaaattgagcttattgtcaattggcaacctcgtattgtagtagctagaccatcttgcaccatccctctaataaagaataaatcatgatgtttctgctgccataacttgttttcttgtttaccatccaggtacaatgggaccaagctcatcctcctcgtccctagctactacacgactgccgtcctgcatactccctcctgttcatggagcatctggacctcttcatggaggtttgaagcatctgtcagtcaaattttgaagcaggccaattggaagcggcaccaattggcagtgagaggcagaagaggaattgtgacaccgtgttccatgctccttcagacatggagtccaggcgggcgcggttccgtcaccccgcggactccattggaggaggccccaccccgcgtgtggccgacttggagttggagggcttcctaccccacgccccttgtctgctctgacgatgggttcctcctggccgtgatgatgcctgagaccggccgctacacccacaagaaggacgacggcatctgtaacaacgtctgcaacaaggtaaaatggggccaagctcatcctcctcgtccctagctactacacaactgccatcctgtatattccctccagttcatggagcatatgaacctcttacttttgtagctggtgaatgaggctttcaaatgttgaaggaggaggacaataggaacttctattatgtcttatcgtctaaatttctgttctaattgtctttttcttagaatagttttgtttggcacttactgttcctgggatgtaaagtatgtattgctagaatgaatgcttgtaatattagcaatatcatattttgggctcctataacattgcacgttgctttgaaaatgcatcagaactgggctaggcccaagatagcttgcggtgtgatgtgttgtaatgtcaatggtataataatttttttggattgg

SEQ ID NO: 15190 - DNA, 774 bp, Triticum aestivum
  Clone ID: PAT_TA_15190
taccggtccggattcctgggtcgtccgcggacgcgtgggttcgatctcaaagtcttttgaacacactagagataatgccttcttattaagacatgtctcactgataattaacaaagaagagctagagaaactgggagatgctccaaaggtggttctagcatccatgtcaagtttggaggttggcttttctcatgacatttttgttgagatggcaaatgaagctaaaaatctagtgctttttactgagaagggtcagtttgggacacttgctcgcatgcttcaagtggatccaccccccaaagccgtaaaagtcactatgagcaagcgagttcctttagttggtgatgagctgaaagcttatgaagaggaacaagaacggataaaaaaggaagaagtgctaaaggctagcatcagcaaggagaaggagctaaaggcttctcatgaatcaaatgcaaaggcttctgaccccatggttgttgatgcaagctcgtctcgtaaatcatccaatgctggctcacatgttggcgggagtgtggatattctaattgatggatttgtctctccggtgaccagcatcgctccaatgtttcctttctttgaaaatactgctgactgggatgacttcggcgaggttatcaatcctgatgattatatgatgaaacaagatgaaatggatagtaatatgatgctcggtgctggagatggcatggatggtaagctcgatgagagctcaacacgccttcttcttgaattcagcaccgtcaaaagttattt

SEQ ID NO: 15191 - DNA, 603 bp, Triticum aestivum
  unsure (1)..(603): unsure at all n locations
  Clone ID: PAT_TA_15191
gcccccccccntttttttttccggcatcaacatcgttgttgccctttgccatctcctttacaaacttcgcggcacggcataaatcgacaaaggacacaccctgcaataaggccgctctagctttactatccttatttatttcatcctacttaacttgttgaatatagcacgtacggtcatctccaaatgcttgtatccaaagtctagaagccccgagcttccacatgctgatgtaaggactacatacggattcggtgcgtagctctgtggataaccttgtcatgtcagaaatatgctattcaaaaacgcatatccagcaaccaccccaccttcatttagtgaagctgctttggtcctcaacaaataaccgcactgatcatttataatgaccttgtcgttgttcctaaggtaggctccaaatattccaaactcagaaacaacattatccctaacaaaagttccctcgcggacaagatagctgggagatgctggtgggaatatcctttgcattaagatgtatgctgcagtttcattgcttccatccttccgaaggcgaatcaatgtttcacgtagattatccccgtaaatgttgttccctccacc

SEQ ID NO: 15192 - DNA, 825 bp, Triticum aestivum
  unsure (1)..(825): unsure at all n locations
  Clone ID: PAT_TA_15192
ggggtaaggcanntncggaaatcggtngaattaacntcnntgttgaatgcaggtgnaagtaatnaaaggnnttttgaacgccggagaaaccggttatttatatatggttgatttgaaaagtaacccctcttgctccatcgtttctccgggcttgcggagaattcagcgcaatcttgacatgcaacatgtacagaaacattcagactttcagagccttgtgacgcgctctgcaactgaaatcctcgctctttttcccggagagtcgacgggcagggggatgggggtgactgactgatgcctggcatcaggcatagttgccagactgactaattaacactattaccacagggtacttacttactgaaccggccctcctcctcatctttttattatggaccggtgccaccaaacccagctgcatcccatgtcgtcctcagggtctctactgcgccgcggccgcgatcgacgacgatgaccggctgggccacgctgagggcggcctccaggaggccgtctgctgttgcttgcgcctcttggggtcctcgagctccgacgtcagcatctcgaacatcacctgcacgtccttgtatccacaggtctgcacgtcctcatgaagcttcagtatgctgcctccaccgcctgtcttgcgggagcggacgcgggtggagacggcggcgagcgcgcggcgcgcggggaagacgacctcctgccgcctccggcccgtcatcgcgcgcacgggcgccggtatcctcgcggcggcggccagcctcgacgcccacctctctcgctcttgctgggtatgggattttgatctcgaatcgaatt

SEQ ID NO: 15193 - DNA, 1599 bp, Triticum aestivum
  unsure (1)..(1599): unsure at all n locations
  Clone ID: PAT_TA_15193
gcccggggcccgtccccgcggcgccgcccgccgacgcccccctcgtcgggcgcgccccctgcggcccccctcccccgcggcggccgccccgccgccgcccggcccccgccccgccccccccccccccgccccctcccctcctgtgttcgatcttctaagaagttgcagacccctccgagtgacccacccgtcttcacccccccaccgatggcgagcgctcgatcgcgtttgatcatcctgctcgtcttcctcgccgctgcctcgtctccggcctcggcgtgcgaccggtgcgtgcgccggtccacggcggcgtaccgcgcctcctcgcccgccctccacaatgccggctcctgcgggtacggctccctggcggcgaccttcaacggcgggctcctcgccgccgcgcgccccgcgctgtacaggggcggcgtcggctgcggcgcgtgctaccaggtccggtgcacggacgccgcgctctgcagcgccgcgggcgccacggtggtcgtcacgggccgcgcgcgcggcgcggccacggaccgcgccgacctcgtcctggccggcgcggcgtgcgcggccatggccctgggcggcgggggcgcggccgccgcgcggcggctgagggagcggcgcgccgtgggcgtggagtacaagcgggtgccctgcgagtacgcgcgccgccgcaacctgtcggtgcgcgtggaggagggcgcgccaccgggcggcctgacgatcaggttcctgtaccagggcgggcagacggacatcgtggcggtggacgtcgcggcggccgggtcgtcgagctggaggtccatgacgcgggagcgcggcgggccggcgtggagcacgggccaggcgccggcggggccgctgcagctccggatggtggtcaccggcgggtacgacgggaagtgggtgtgggcagaaggggaggtcctcccgcggcggtgggccgccggccgggtgtacgacaccggggtgcagatcgccgacgtcgcgctggaggggtgctccccctgcgacgcccgggagtggaagtgacagtgcagacacgaatcccgcttgtacagtagagtcttttgcttttgatcttactactcgtgctaatcccccctctcctttcttcttggataacgattaacgaagcgaaacgaattggtgggttggaagagtcagacgtgcggttgcaactgggtccggccttgctgattgagctctccccacttggtggtggtggcgggcagctagctgagcctgcgggagcagatggggagtagggtgcaagatgtgcggcgcgtcttcggtcaccggtgcgtgccaactttgcgatagtgtatgcattgcacgacgacggccctggtcgtcaacggccggtgccgtgcttcccctttcgcgcgtctcggttctcggatgcgcgttgcattttctgtactgggcaatggtgacggccccaaagctaggcgcgtttcgtgtgattcccccggcgtgacgcccgtgaaagatttggtttaagcgtttctactccacgagggagcagcgtcgtatgtatttatattgaggccgnnngagccttgccgtagcgtacaagtccagnnngagaat

SEQ ID NO: 15194 - DNA, 713 bp, Triticum aestivum
  unsure (1)..(713): unsure at all n locations
  Clone ID: PAT_TA_15194
cggcacgagggggttctgcatcaacacggcgacgggcgattgcttcctggtgtacgagtacgtggagaacgggtccctggacctgtgcctgctggaccgcggccgcgcgcggcggctggactggcgcacgcgcctccacatcgcgctggacctcgcccacggcctccagtacatccacgagcacacctggccgcgcgtggtgcacaaggacgtcaagagcagcaacgtcctcctcgacgcccgcatgcgcgccaagatcgccaacttcggcctcgccaagaccggccacaacgcggtcaccacccacatcgtgggcacgcagggctacatcgcgcccgagtacctcgtcgacggcctcgtcaccaccaagatggacgtcttcgcctacggcgtcgtcctgctcgagctcgtgtccggccgcgaaggccgccggcgacggcggcggcggcgacctgctgctggccgacgcggaggagagggtgttccgcggccgggaggacaggctggaggcgcgcgcggccgcgtggatggacccgtgctcgccgaccaaaactgcccgccggggagcntggcaaccgtgatggcgtggcaaggcgtcctgcaacgggacccggcnaacggccnacatgggggacgtggctanacctgtccaaggnggacnatatttncgggatatccngggaaacttccntggtggaacggnatttcccngg

SEQ ID NO: 15195 - DNA, 761 bp, Triticum aestivum
  Clone ID: PAT_TA_15195
tcccaaaccccttccggcggcgaagcaacacaccctcccttctccccctcccgaagcagcgatggcccccaaggcggagaagaagccggcggcgaagaagcctgcggaggaggagcccgcggcggagaaggccgagaaggcccctgctgggaagaagccgagggccgagaagcgggttccggcgggcaagaccgcctccaaggagggcggcgagaagaggggcaggaagaagggcaagaagagcgtcgagacctacaagatctacatcttcaaggtgctgaagcaggtgcaccctgacatcggcatctcctccaaggccatgtccatcatgaactccttcatcaacgacatcttcgagaagctcgccggggaggctgccaagctcgcccgctacaacaagaagcccaccatcacctccagggagatccagacctccgtacgcctcgtcctccctggggagctcgccaagcacgccgtctccgagggcaccaaggccgtcaccaagtttacctcctcttagatcgcgtcgcctgtatctagtagcaaatgtagttccttgctgttggcttagtgcttgtctgtggactctggttatctgcaagtaatattagtcctactgttggatgaaaattgctgaatcattgcaaatggtttgttggctcgttggccacctgcaagaagtgagttatgtccgctggtctattggccaatgaagatttcggaaaaaaaaaaaaattgctgaaaaaaaaaaaagcggccgc

SEQ ID NO: 15196 - DNA, 966 bp, Triticum aestivum
  Clone ID: PAT_TA_15196
ccaatactctccacctcctgctccttctcttttgcccgccacctgtatgagatattgctgctttgcctgtccacctctttctttctcccaccgcttgccgtcgattcagtttagttcagcttgatcgatcgatcgatcgatcgtagtaattgatgactaacccaaggacttgcgatgactcctttcccgttgccatgcttgtgatttcaatagcaatctgtaaacaactcactctgaactgcagatgtccttcgaaataggagtatctttattagcaatacaatgtgcatctttctggttgcgtgtaaccgcatttccacattgacaccagtaccaagttggctaatcactttacgtacgtgcgtgcgttgcacccgcacccgcggcgctctctatgtgtgtaggtaccgggccatcaccagcgcctactaccggggcgccgtgggcgcgctcgtggtgtacgacgtgacgcgccacatcacgttcgagaacgcggagcggtggctgacggagctccgcgaccacacggacgccaacatcgtggtgatgctggtcgggaacaaggcggacctgcgccacctcagggccgtctcgcccgaggaggccagggccttcgcggagcgccaccgcaccttctccatggagacgtccgcgctggaggccaccaacgtggaggacgccttcaccgaggtgctcggcgagatctaccgcgtcgtcagcaagaaggccctcgacatcggcgacgaccccgccgcgccgcccaggggcaagaccatcgacgtcggcggcaaggacgacgtcaccccggtgaacacgggcggctgctgctcggcctagtcaaactctctccctctctatctctctctgccggagacggtggtaggtgatgccgtgtgtgtgcgtgctagggtgtaacaggcatgtcgcgaccgtgatgattattgattattggtcaaaaaaaaaaaa

SEQ ID NO: 15197 - DNA, 904 bp, Triticum aestivum
  unsure (1)..(904): unsure at all n locations
  Clone ID: PAT_TA_15197
agtcttgatgaggttgctagtatggtttgtgctactgtatctgttttcgacacgaaggttcagaatacttttcgtgattttgaggaatgcaacattcttcgtccatttatgggtgacactataaaagaaatagctaaggcttgtcagaccctcgaggggaaggattcatctccaactgctgttaaaatgttgcatgcccttcattctgaaatgacaaagctctacattcttcgactttgttcttggccgcgcgtcccatccaaggaagtatcaaaacatgagacttgggttactttgtcaacccttgagagaaacaagtctccgtatgcaatttcatgcctgcccttggagttccgtgaaatcacaatttccgcaatggaccggattgaattaatgatctttaatctcaggaatgagactgccaagtcttacgacattactcgacagcttcaggaaatccatgagtctgttagacttgcatttctaaattcttttcgggattttgcaggttatctggggacatttggagcggaactagctcagaatagatcaaataaagaaaacaatcatgtgcaaaatgggtatatgaatggtactgatagagaatcatctgctagcatggatggaaacttgcacaagaagctattggttgttttgagtaacattggatattgtaaagcagaactttcagatcaactgtataacaaatataggcacatttggtctccgatcagggataatgatgaacgtagtgctgatatgcgagatcttgtgacatccttctctggacttgnnnataaagtcctcgaccaatatacttttgcaaagtcaaacgtgatcagaaatgctgcacagaactatctgttggattctgggattcantnnngggcagcacctgtagngn

SEQ ID NO: 15198 - DNA, 668 bp, Triticum aestivum
  Clone ID: PAT_TA_15198
cgtccgcccacgcgtccgggcgagaaagatgccgagggccgtcaggatccgcggcgacgagccggagacggagcggagagcgaagaggcgaaacgtggcaggggaggaggaggaggaagggacagctctccgctccacgagccctagatctcccggcgaccgcgtggatcggaggaggaggaggaggaggaggaggaagggagctgttcggacttcccacccagagatgctcttcgcggtcttcgagcctgacaaagatcaatcagaaggaaaacaagatcgtgtgtacgatgtggacgagtcggtgacggaggaatcctccgatccgcccagccctacgatctacgaaccctacatccccgacgagctggttgatgatccggacatactcgctgccttccactacgccaaggccaattacgaagcagaaaagtctcgtcgagctaacctcttcactatggatcactacggttatgaagcaccttcttgcttgttcgatgaccatcgctttctacctattcgtgaacgggcaacgggtgcagtacttcttgctgctaaatcagtcgttttactatcatcatttatagggagtcggccactcaacaagtgttgtggtttgtggtttcaaaggaacgatcatagcaaaaccgcccatgttctcacgtctg

SEQ ID NO: 15199 - DNA, 741 bp, Triticum aestivum
  unsure (1)..(741): unsure at all n locations
  Clone ID: PAT_TA_15199
atcctctggtgcctgaggggacagacgcctgaaggacgtaagtcctcggagccgccctcggcggcgtgcgtagctggtggtcaacgaggacaccgtgcacctctcaatcccctcatgttattcctcgcgctgccacgcttcgctcatggccgccgtcgccgctgcctcgacgacgttgacgcccttcgccggtcaagcttctgtacgccgccgccacctaatccgtggacgccgcctcttcgtgcaggcacggatctagccacctcgcacggactccatctgctcgcgcctgcactatggtggcgctggcctgcatgctattgcggcagtctggtcagcgcacctatgtgcatcctgagggctacatttaccagcagcggcgttctttggcactggccgtcggttccgtcggcggtgcaacgcatccgcatcccgggcagtatgttgtgaccngcggccttgtgcgtcccgctccagctttccccggcaaacctcaaccaagcctgggctgggcttgacgcatagcctgcagcggcgcagcctgcacacggcgacggaagcgacggcaaacccgcagcagccggcagtggttgcctccggtgggcggcgcacggtcctcctggtcagcgttgcagtcagcaagcgagcctgcaaagtggcgtgggtggagcagtcctcctgatcattgtgttttccctttctaatagttctgcatgaaaagtattgatttatctcaaattc

SEQ ID NO: 15200 - DNA, 844 bp, Triticum aestivum
  unsure (1)..(844): unsure at all n locations
  Clone ID: PAT_TA_15200
cggcacgagcccttgcctgctctggcggcgggctcctcctcgccgccacgatgcccgaggccggccgctacacccacaagaaggacgacggcatctgcaacagcgtctgcggcgagcccacctcaaaggcagttatggccatgtcaaggctcaagtgtgcgcttcgggggtttgatttcagggtaattctggctctcttgattggtgtgccactggtaatgttaatgatatatgcgcatggtcagaaggtcacatacttcctccggccaatctgggaatctcctccggagcccttcaagataatccctcactactacaatgagaatgtcactatggagaacctctgcaagctacatgggtggaaagtcagggagaccccacgccgtgttttcgatgctgtcctcttcagcaatgagcttgatatccttgaactccgttggaatgaactgagcccctatgtgtcagagttcatcctgctcgagtccaactcaactttcactggtgtgataaagcccctctacttcaaggaaaaccgcgatcgatttagatttgctgaatcgcggctgacctatggcacatatgggggaagattcatgaagggggaaaatccatttgttgaaggagtcatttcagagggttgccctggacaagctcattangattgcaagattgaagatgacacatatgatcatgtaaatgttgatgaaaatcccaagtggccacacatcaaactcctganaaggggtgacgacactcctaagatacncaanctcaagctcaggaatnnccngtactcatttgagttttttccggatganaaaattggaggggtnaattcacaggg

SEQ ID NO: 15201 - DNA, 1011 bp, Triticum aestivum
  unsure (1)..(1011): unsure at all n locations
  Clone ID: PAT_TA_15201
gaaccacccgcccctcgtcatcgtccttccctcctcccctcccccacgagcaattcccaccacccatcctgagcgccgccagcctcccactccccggcgagctgccccatcccgagcgccgccagccttccactccctggcgagctgccccatccctagcgccgccagcctcccccaacctccggtgcctcccggatccgccacctccacgcggtggcagctcctccaccagatcacgccacgtgtagccatacccacagtcccgccggcgccagcggcccaacccaggtggcgcttcgacggacctcctcccggcgaggcccgacgccaacaccggggatctccaggagcggtcgtcccctgctacggatcgcgccgccgccgtccctagcgcttctatacaaccttcgccgaccgccgccaccaatcttctgatgcgccgccccggcagatccgacgcgtctccttgacctcccaggcgacgccaccggcaaatctaggttggggccatccatctcctctcgccccccggcaaggctcccccatcaccacgcagccaagctgccgcatcaaactggccattcaacaacgccgtcttgggacgttcaatgacgtggccccatggcgtttgctgtcgcagcgcctggatcacattgtcaccatgcttcacgaggccgagatatttccattcttcattcatcgacatcagattgaactgagaagtcagcgcagacgcaatttgagcttccctctctctctgatacgggttcgcaagtgtcatgttcggctgttcgccgcagcagcccggaggtgctcctgcagccgaccaagaacagggctgggacaaggatatttttgttctcaaacacgtcgctgcgtatgtgtgtatatgaacattttactccatgttgntcctttacattttgncatctcctataganttatgatgcataatgactaatgggatgggatattggtcaagtgaatgaatgcatttgtctctcaaaacaa

SEQ ID NO: 15202 - DNA, 1212 bp, Triticum aestivum
  unsure (1)..(1212): unsure at all n locations
  Clone ID: PAT_TA_15202
cgggctgcgggcctctgatgccgcctcgcgcgacagttccccgcgccgatggccgccggagaggacgccgccgccgcctgtcgccgcacggccatatccgactaccgcaagaaactgctcaactgcagcaaagtcgagggacagatcgcagcggcgatggccgacggagaggacgccgccgccgcccgccgccgcacggccatatccgactaccgcaagaaactgctcaactgcagggagcttgaatcgcgcgtcggcactgtgagggaaaaccttaaaattgctaggaaagatttcgcaaagactgaagatgacttgaagtcactgcaaagtgttggacaaataataggagaggtcctccgtcctcttgataatgaacgctttattgttaaggctagcagtggtccaagatatgtcgtcggttgccggagtaaagtggacaaggaaaagttaacttctggaactcgtgttgtgctggacatgacaactttgacaatcatgcgcactctgccaagggaggtggatcctgtggtgtataacatgctacacgaagatccaggcaatgtcagttactcggctgtaggtggcttgtctgatcaaatcagggaactcagggaatcaatcgagctgcctttaatgaaccctgaattgtttctcagggttggaattaaacctccccagggtgttctactctatggcccaccaggaactgggaagacattattagcgagggctattgccagtaatattgatgctaactttttgaagattgtgtcaagtgctataattgacaaatatatcggagaaagtgctcgtttaatcaagagaaatgttcggctatgcacgcgatcaccaaccgtgcattatcttcatgggatgaaattgatgcaattggtgggagaagattaagtgagggaaccagtgccgaccgtnagattcaacggacgtcatgggacttccttaaccatttagatggatttgatgacttggcaaggcaagatgatcatgggaacaaacgacctgacttcttgacctcgctcctgcncctgncctcctcgacagaaagattganntcccctaccaaacnacaaccaagacagattcttaaatncatcaaccggtaccccaanctgggaatanntnaaccgtnttaacggctgaagatcacggggcgantccaagttgccnaacggattttnatncccaacggaa

SEQ ID NO: 15203 - DNA, 756 bp, Triticum aestivum
  Clone ID: PAT_TA_15203
cggcacgaggcgctgtttatgcgccggtagatccccgacgcgacgcgtcccgcggaggaggagctaggccgagatgaactcgacggcgtactcgcggccgtccaagctgccggccggcgccggcgacaggaggccgcccacgcgcctccggggcttcgcctccaagatcgagcccaagaagctcggcgccggcctcctcgccggctgctgcctcgcgctcctcacctacgtctccctcgccaagctcttcgccatctactcccccgtcttcgctagcacggccaacacgtccggcctgctccagaacaccccgccggcgtcgtcgtcgtcgtccgtcccggagacgacggatgccatcccggccgaagacaccacattcatcggccgcgagaacggcaacgccgtggatcccgtcgatttcccagaggaggggccggcggcggccggctctcaagagcccggcgtgccggaggtgctctcgagaaaggaggacgaagccgagaaggcggcggaggcggcgacgacctccgtgccaaagccatctgaggacggcggcgccggtgcggcaccggcggcgttagcccacctcaactgcgacgcggacgaggggtgccaccactccccgcccgcgccgccggccctctgcgtgctctccggcgtcctccggacccgcccctcgcggcagaccttggtcccccacctcatgtcgacgcagttaatttgcttcagattagttggaaatgtccgagatctgcc

SEQ ID NO: 15204 - DNA, 1440 bp, Triticum aestivum
  unsure (1)..(1440): unsure at all n locations
  Clone ID: PAT_TA_15204
gccattagctgccggcgaccatgtcctacatgtagaagtataaatcacgcagagtctacgctcgtagtcgtactccattaattccatctcctcccccgtccgctggcccgagcttcccagggcgaggaacgacgatgaagctgctctgcatcctcacggtggtcctcgccctcgcgtccgtggagcccgccgtctcgtcatccccccggcgctacgaatccatcatcaccttcggcgactccttcaccgacaccggaaacgccatcgtcgtcctggcggagaaatcgcgcttcgaccctacggtgcagcctccctacggcatgacgttcttcggccgccccacgggccgctactccaacggccgcctcatcatcgacttcatcgcggagaagctcgatctgccgttcgtcccgccgttcctctcgcacaacggcagcttccgcgagggcgtcaacttcgccgtggccggcgccaccgctctcaacgccagtttcttcagagacatcccgctcgtaggctcgttggctctccactccgccccctgcgggcggctgccgtggcgcccgtcgcccgccccgtcccggggcagccctgcccaagagtgcccgggcttcttccacaagacgctcttcttcatgggcgaaattggcctcaacgactacagcttcgcgatcttcggaatgaccctgccacagctccgatccatggtcccagacgtcgtcaaaaccatcgccgcggccactgaggtgctgctcaggcagggcgcgaagaccgtggtggtgcccgggatcccgccgctgggatgcatgccgccgaatctggtcttcttccccagcaacgagtcggcgggctacgagcctagcaccggatgcctgaagggcctcaacgacatcgccaggcaccacaactcggagctgcagaaggccctcgacaaggtcccgggcaaaccacccaaatgccctggtcatctacgccgatttcttcaccccggtcatcgagatggtggagtctcctcacaaattcgggcttaccacggacgttctgagctgctgctgcggtggaggtggcaagtacaacttcaacatcagcgctggctgtggcatgccaggcgccaccgtgtgcgacgacccctctcaatatctgtactgggacggccattccaccgaggccgcccgccgctatattgccaaaggctggctaaacagcataaacagttgcaaaccctgctagtagctggtttcccggattcgtatttctttcttctttttcttcgtctccgagccactcgaggaattctgtgttttaaggttgcaattcgtaaaaagtttnatgnaggagggatganaatctaaactatagcgntgatanggtgaaagtgnatatnggngaaaaactgntattgnagngtgagnagcaattgtanttgtgaaaaaaaaaaaa

SEQ ID NO: 15205 - DNA, 759 bp, Triticum aestivum
  Clone ID: PAT_TA_15205
cccacctcatccgtgccgcgtgcacctgcaggcgatggcgcaacgtaatcgcggcccgcggcggcggcttcctccgccggttcggctctctccacggcgcgtcggccgaccacgttgtcggccactaccgcgtcaacgagcgccacggccacccgcgtccgcctggccttaaccccgtattcgtcccgtcctcctcctcttcctcgccgtgggcggacgccgtcgccgctcggaacctcgcactcgacttcctcccgcggggcgagtttggcgattgcggctgggagctcgccgacatccggggcggccttctgctcctcttccactcggagctggcgccaggcctcctcatctgcgatcccctgaggcgatgctacagggaaatccctcgctcggcgtggttccacggctgccacatgctgggcgctttcctcctcgacggcgaggacaaggacgcggccgcgggcatcagcatgtcaaacttcagggtgacgtgcgcgctctttcgctttggggaccgcaacgccagggcctgcgccttctcgtctgccgcccgcggcttggacctccggggccgcacgtagcagcacatcagtctgccgcgacagggagttggcccccatctatttcgcaggaagcagcaaggggaagaggttcgcctcttggacggtcggggccaacgttgttcttgctctggacaaggacaccgccgagctcttatctggtgtggtgccggacgacgcacagtacgccgtgctc

SEQ ID NO: 15206 - DNA, 998 bp, Triticum aestivum
  Clone ID: PAT_TA_15206
cgtccgcggacgcgtgggcggacgcgtgggtctggctatcatttgcccctgtcattatcgtcctgcttgtgggcactgagctgcagcatgttgtggctcagttggcactggaggttgttgaggcaacagccacaaatgttggaacacaactgaaactgcgggatgatctcttctggtttggaaaacctcgggttctgtggtggcttatacagttcatctcgttccagaatgcctttgagatggcgacattcttatggtctctgtgggaactgagtgcaaattcttgcttcatgaagaaccagtacatggttgttattcgcttggcttctgggctgcttgttcaaatttggtgcagctacagtacactgcctcttaacgtgattagtctcccagtatgggttccaagttcaagaagtcactggtctccgagagcgtgagggactccctccacagctggtgcaagaggatcaaagacaggaggcacaacccgctcttcatgcggaacgggacactcacgtcgaggtcggtctgctccctcgacacgaccatctacgagaccgaccacgagaccaacacggtgtgcacgctgtcgaggactgtgtcggcgtcctccctggacgaggcgctgactgtggtcactgttgatgacgacgaggagatctctcacatcgagcaagatattccacacccttagttactgaggttagccctgttcttcgccgggataaatatgtgcagccaaaactctgctgaacttgagaatccgtgcccatccctgccctagctttgtagtacctgcggaaaaggacccgcggattacacagtatatacgtgggtgactgtctagtcattgctcctcatggctcatggccactctgtgcaaagtaatcttgtgtcaataggacgccttcgcttcaagatgatactaccatctttgtattgacttataacattgcactaaatcatcagaattcacaactacacaaaagcgagcaaga

SEQ ID NO: 15207 - DNA, 1021 bp, Triticum aestivum
  unsure (1)..(1021): unsure at all n locations
  Clone ID: PAT_TA_15207
taaattccaagcaaggctacactatncaagacttgaggaccacagtcatagcagaaggcgcggaagataatactagatttcccaagatctttgttgatggccctttcggcgcaccagctcaaaattacaagaaatacgacatcctttttcttattggccttggaatcggtgcaactcctttcatcagcatactgaaggatctcctgcacaacataaagtctaataatgagcagcaaagcatgaatgacgaggaggcaggcagcagcttcaagagcaacgggccaagccgagcttacttctattgggttaccagggaacaaggctcctttgaatggttcaaaggtgtcatgaatgaagttgctgaatgtgatagcgataatgcaatagagatgcacaactacctaaccagtgtgtacgaggaaggagatgcgaggtcagctctgattgccatggttcaatcgctccaacacgcaaaaaatggtgtggatatcgtctccggcagcaagatccggacacattttgcaaggccaaactggagaaaggtgtactctgatttggcaaatacccacaagaatgctcgtataggtgttttctattgtggatctccgacgcttacaaaaacactcagggaacttgcaatagaattcagccacacgacaacaacacggttccatttccacaaggagaacttctaacttgtgaggtcagcgcaacaaaaatttcggtagcatcgggtagcagttctagctctgcaggtgccagagggagctggggcatatattagtgtacaaactacatggagtgaaaagcatgtagcgttagttatagctgctgccacacatagatagggggaggaaagccatgtatttatattttcattcgtcagtgagactgcttcttagaataattcagaccttgaacaggcgattggctcggttcaaaattgataggatcgagtttggagttggctcaaaattcaagtgagccatttactcattttgttgtaccagagtttacccct

SEQ ID NO: 15208 - DNA, 706 bp, Triticum aestivum
  Clone ID: PAT_TA_15208
accggtccggaatttccgggtcgacccacgcgtccgatccagtcagcctgaggttccggaaaaccctagctcactccgtctcctgccaccgcgaacccctggctgccctcgggtgactaccttccaccgcctcccagttcagcccctcacccggagatctggttcgacttactgggatattcaatcttcatcacattcggcataatcatgtcggaattcgactgtgaggaaggaacgatggaagtgaaatttagggccagtttaaaggacccatctgttaaagttcctgttaaaattgatttcaagaagattcaggaggatatttttcaagaatatgctttgattgcccggtccatgccaaatgatataatcacccaagatcctactcctaagtcgctacacgcggtcttctatgagctatctccccaattgtggcccatcttagagaaggatagcgtccggtgcttactcaactttttggtgagcaagcggggtatggcatataaacataccatcacctcacaaaccttaacttacatgatcagttatgatgccctacgatgtgcaaaagttatattggagggcaaggcaccaaggctcaatggacaccatgccaatcccaactgcattaacccatatggatacttcccgctccatgaagctgccgaaaggttttctgttgacatgatcaagttactctttcgtc

SEQ ID NO: 15209 - DNA, 1273 bp, Triticum aestivum
  Clone ID: PAT_TA_15209
cgtccgcggacgcgtgggcggacgcgtgggaaaaaacatgaaattaagcagagagttgcttgatgaaaaatacaaggataggctagtggaatcttatcagggtctagtacatgaggtattcgtcaaagtcctccgcggtctttctggtgctaaagtcacaaggccgggttctttcagaaattacaaaaatggatatgcagttaaatcatcactcaaagctgaagatggactgttgtatccacttgaaaagggtttcttctttctgccaaagccccctacactcattttagatgaagagattgagtttgttgaatttgaacggcatggtgctggtggcgccagtatgtcatctcagtattttgacctcctggtcaagctaaaaaatgaccaagagcatctcttcagaaatattcagaggagtgaataccgtaacctcttcaactttatcaatggaaagggcttgaaactaatgaaccttggagatggtcaaggtacaagtggtgtcacagatgttctacaggacactgatgatgttgctcctgatccacacctagagagaataaaaaatcaggccgcgagtagtgaggacagtgatgaagaggatgaagattttgttctgcataaggatgatggcggatctcctactgatgattctggtggtgaggaatcagatgctagtgaaagtggtggcggaaaacagtcatccaaaatggaagcccgtagttcaaagccacctgtgaaaaggaagcctaagggcaaggatggcgaaggttcagggaaaaggaagcctaagggcatggatggcgaaggttcagagaagaggaaaccaaagaagaagaaagatcctaacgcccccaaaagaccaatgatgccattcatgtatttctcaatggctgagcgggcaggtgtgaagggcagcaatccagatttggctccaaccgatattgcaaagaagcttggcgagatttggcaaaagatgtcaaccgaagacaagcaaccttacattctgcagtctcaagccgacaagaagcggtacgagaaggaatctgctgcctaccgcgctgctgccccagtggacgtggacgccgggtccggcaatggctctgactagaagaatctcacacttgtgcactcagcagtcgacacgatcgatgaatctgtaaatcaccgtagggcagtttgaacaagatgaccgagcatctgtagatcgccatagtgcagtttgaacaagaacacacatgctaacatgaacctgcataccgtgagggggcta

SEQ ID NO: 15210 - DNA, 609 bp, Triticum aestivum
  Clone ID: PAT_TA_15210
aggacttccgcgacccgaccaccgcgtggtacgacgagtccgacggcacgtggcgcaccatcatcggctccaagaacgactcggaccactccggcatcgtcttctcgtacaagaccaaggacttcatcagctacgagctgatgccggggtacatgtaccgcggccccaagggcaccggcgagtacgagtgcatcgacctctatgccgtcggcggggggcgcaaggccagcgacatgtacaactcgacggccgaggacgtgctctacgtgctcaaggagagcagcgacgacgaccggcacgactgttactcgctggggcggttcgacgccgcggccaacacgtggacgccgatcgacacggagctcgagctcggcgtcgcgctgcggtacgactatggaaggtacgacgcgtccaagtccttctacgaccccgtgaagcagcggcggatcgtgtgggggtacgtcgtcgagaccgactcctggagcgccgacgccgccaaggggtgggccaacctccagtcgattccgagaacggtggtgttgatgcggagggtatcgagctcctccaccggccattggatgaggtttgtccgggtcttctcgtcaagct

SEQ ID NO: 15211 - DNA, 1176 bp, Triticum aestivum
  Clone ID: PAT_TA_15211
atcaacctcaacgagctctaagccagctgctgctcctgcttactcccatcgtcagttcgtcaccgcgaactaaccaagacatggcttccgacggcgtcatcacgcaccgcagcgtcgaggtcaacggggtgcgcctgcacgtcgcggaggccggcccggcgggcgcgcccgtggtgctgctgctgcacgggttcccggagctgtggtacacctggcgacaccagatgcccgcgctggccgccgcgggctaccgcgccgtcgcccccgacatgcccggctacggcgactccgaggcgccccccgccggcccggaccagtacaccgcgctgcacatcgtcggcgaccttgttgctctcatcgattccctcggcgaggagcaggtgttcgtggtggggcacgactggggcgccataatcgcgtggagcctatgcctgttccggcctgacagggtgaaggcgctggtcgccctgagcgtgcccttcagtccccggagccccgcgatgaagcccgtcgacggcttgaaggctctgtacggcgacgactactacatctgcagtatccaggagcctggggcaattgaagcagaattcgcacggctcggcacggagctggtgctaagaaagtttttcacttatcgaactcctggccctctgtttatccccaagagcggctggggctcaccagatgatgaggtgcccttgccgagctggatcacggaggaggacatcaaatactacgcgagtcagtttgacaagtctggcttcactggggcattgaactactaccgtgccctgaacaagacatgggaactcacgtcgccatggaccggagctgagataaaggtaccaaccaagtttatagttggtgatgtggacttgtcataccatgttgcaggcgcacatgattttattaacaaaggtggcctcaagaagtttgttccattactggacgatgtggtggtaatgaaagatgtcgggcatttcataaatgaagaaaaaccagaagaaattagtgcccatataatcagtttcttaaagaaattcgactgaaatgaggagtaacgaacacatcatggaacatggtcaaaatgtagatgcttgatggaaaatttgtattaagcccattgtattattgtgtcgcacaatttcacatatgtatgcaactattattttcttt

SEQ ID NO: 15212 - DNA, 2148 bp, Triticum aestivum
  Clone ID: PAT_TA_15212
ccccgcgccggccgagaagaatctacccacttatcccggcttcgtcgggccaccgggcgggggccgcggcatggatccgcggggctcccgccgcatcccgggcacgcgcacccggccgtggacctccgccgagcaggtcccctcctgcgccgccgccgccgcggaccccccggcggagggggggacgggggggtgctcccgcgtggccgccggccgcggcggcgaggcccgccacgtgcatctcgcgcccgccggggccgtccgcgccgtgctcgggcagaggggcggcggaagatgacgagagatgcaatgcactaattttcatagcacgatataaatattacaagcatgcacgcagcacgcgtacaaatttacattttacacccaccctcgcatatatacctctcgcacgctcacgtttcccacgacgacgggtaccatgcacaggacgacgatgctcggatcggatcggatcgatttcgcctagtggaacttgaggctggtgaggatgttgttgttgacggggtcggagaggtggtcgaggaggttctggaagggcccgacgccggtgaagatggcctgcagggacatgccgaggaaggcgagcatggcgaggcggccgttcttgatctccttgagcttgagctccttcatctccttctcgctcttggtgccgaacccgagcgggttgaagatgggcccgccggggtaggcggggtcgccggagccaccgaggtacttctcgaggcccaggaagtactgcttccccatggagcccgggttgtaccagtcctggagccgccggtgctccgcgaagccgatgagcgccatctcgaacacgaagagcgtgtaggggtcggcccagtactggtaggtgcccgccggcgggatcgcgcctgcctggaaccacgggatcgccgtctccgggggcaccaggcccaccttgcccagggcctccggggcgatcatgcccaccacccccatcatcgccgtccggccgttgaagatctcgccgtaggccagccacctgggctcgatgaacccgccggtgccctccgggtcggacagccccaaggggtcgaagccaaagtcaccgggcagcgtgccgtcgaggtaggtgagggactgcttggacgcgaaccacagctgcctgttgtcattttgcttggcaggggggctggacgatgccctgacgacgaagggggacttccgggaggaagacgacctggagatggaagactgcagaggcctccccagcagctgcctcccagagagaagaccctgggccgccattgttcctgcaagctcctcctcctgctgctccgagagatgaggcaggcgtggtgtgtggtacagaccgatttggaagtcccacgtccccgacgctcgctacaactgcaccaccagcagcggggctgccacccgcggcgcgcttggccccttcggcctccttgtcctcgccaaccgcgccctgaccgaacagacgggagtgtacttctatgtgtccaagggcctcgacggtggtcttcggactcacttctgccacgacgagttgcgctcgtcgcatgctagtgacgtggtgaagcgggtggtgggtagcacggtgccagtgctcgacggcgaagatttttccgttagggtgctcgtggaccactccattgtgcagagcttcgcgatgggcgggaggttgacagcaacgtcgagggcgtacccgaccgaggccatctacgcggcagcgggggtctacatgttcaacaacgccaccggcactagcgtcaccgccgagaagcttgtcgtgcatgatatggactcgtcgtacaaccatatatacacagatgatgacttggtagtcgtcgattagactgatcacttacaacaagttatggatcggttgttctcggtcggtggcttccttttctcttggacagttggagatggagtactagcgactctgcctatcacttcatttttgttcttcgttctggtttttggtttagtaagatgaattagatggtgttgatgacagggctatgatgttgatgatgatgatgatcattgttcacatgtaaatcaatttgttggggaatgaaaatggcatggatgccaccaagtttaagtgaaaaaaaaaaaaaaaaaaaaaaaaaaaat

SEQ ID NO: 15213 - DNA, 371 bp, Triticum aestivum
  Clone ID: PAT_TA_15213
aattctgaaaggagcagaggcccaggttcttgcctactactcccttgctggtcagaggcaggactgccctgactgggtgaccccgttgcatccagctgcatgattgtttgtaaatacatctagttgtgtgtacgtacgtactctactttatgttgccccttggggtccctttggcaagaaacgtatctgaatatggtaatttgtatggatgtagatcattagcttagctgctttggtgccctaataagctagtgctgtagtgctgtagctgaggtgtagtgcaataagttgccgttgtcgcttgtactactatgtatgtaatcctgggaagttgtatgctaaagttgctctgtgctttgatccttgagacc

SEQ ID NO: 15214 - DNA, 1996 bp, Triticum aestivum
  Clone ID: PAT_TA_15214
tggtgatacatgcaagaagctacgaagacttcgaattgagcgaggggatgatgatccaggtctccaagaagagcaaggaggagtttctcagttaggcctgacagcggtagctgttggttgccgtgacctggagtacatagctgcctatgtatctgatatcaccaacggcgctctcgaatccatcgggaccttctgcaaaaatctctacgacttccggcttgtcctgctcgacagacaaaagcaggtaaccgatctgccgctcgacaacggtgttcgaaacaattctgttcttgtgacactgaacttctacatgactgagctcaaagtggtgccggctgatctggagcttctagcaaagaactgcaaatcattactttctttaaagatcagtgagtgtgacctttcagacctgattggttttttcgaagcagccaatgcattgcaagattttgctggaggatcgtcccacgcgtccgagctaacaaagtatgaaaaagtcaagtttccaccaagagtatgcttcttggggcttacgttcatggggaaaaatgagatgcctgttatcttccctttttctgcttcattaaagaaactggacttgcagtacactttcctcaccactgaggatcattgccagcttatctcaaaatgcccgaacctatttgttcttgaggtgaggaatgtgataggagacagagggctggaggttgtcggtgatacatgcaagaagctacgaagacttcgaattgagcgaggggatgatgatccaggtctccaagaagagcaaggaggagtttctcagttaggcctgacagcggtagctgttggttgccgtgacctggagtacatagctgcctatgtatctgatatcaccaacggcgctctcgaatccatcgggaccttctgcaaaaatctctacgacttccggcttgtcctgctcgacagacaaaagcaggtaaccgatctgccgctcgacaacggtgttcgagctctgttaaggagctgcaccaagctccggagatttgctctctacctgagacctggagggctctcagacacaggcctcgactacatcgggcattacagcggcatctagaaaactgatgtgcaagatgaaaggaacatgatttatacagtgctaaatagtacaccccttttcactcatccatgtatttacaagcgtgtggtcgaaaataagcacgagatggcacaatagttcctaatttttcctctcctaaccaaaagaatttaagcctaactatagctagctagtacatactagaactccattattgatcccaatcaagagagactgaagatcgagcaacagaaactcacatgatctcaagagtcaatcaaaaggagaaaaaattaactcctaatcaaacggttgtgcgtacgtccgtagtaccctgtcccgtatgcatctttggttttgctcagaggaggatcagagccagagcgcgccggcgtccttgagtatgggcacgagctcgccggagatgtgcacggccatgagccggtcgagcccgccgaggagcctgccgcccacgaaaaccgccggcagcgcgacgacggcctcgccgccggcgtccccggccaccaccgcggcgagctcggcctcgtcggcgacctcgtgcacggcggggttcaccccgagcccctgcagcagccgcttcaccacgtggctgaggcagcacccgcgcctccccaccaccagcaccgggctctccgccaccgcccgcctcaccgcctccccgccgtcgcccctcgccgccgcgtcggcgagcccgccctcctggccggccgcgccgtcggcctcggcctgctcggaccgccgcggccacgccggcagccggcccgcgctgtaggggatcgcctggtacatctcgatcggacggccgggcgacgtacgcacacgatcgatggagctcttcttcttcctcctccgctacctttccgctgggtgcgttgcgcagtttgccggacgcgtggg

SEQ ID NO: 15215 - DNA, 2790 bp, Triticum aestivum
  unsure (1)..(2790): unsure at all n locations
  Clone ID: PAT_TA_15215
cgtccgctcttctctcctcctcctctccgcccccgcaccaccacgcatcggagaaaagcctagcgggaaggcggggagnggaaatcannatccccatgcccccgcccctnncctcgccggacctagatcnctccggcgggcccggcgccggagctcgtagggcggggacccggcctcggccccggccccgatggngtcggggagggcctccggagcccgcnnggcggctcaagccgcgccgcctcanngcctggnnacggcagcnggcngtcccccggagggaggcngccctgcacnctnnggtgcntnncggctactgtnnggactgacccctgcngctgaccgggttccgcgccccctggccgctgccacccgcccgcccagccccccgcccttgcgtcatggcaggcatgcgggaggcagctccataccctccgccacttcccacccctccccgcacgcacatgcgggtggtcaataccaacggggagggggcacattaatccccatgctcccacccctcccccggctagggtgccggcgcgccgacggcgagccgcaggcggctgcgggggcggaggcgacgccgctgacggggcggggcttcagcttcaggccgcacgcccccggctccgcggagtgggcccgtcccctactgggctgcggctaaggctgcgcgaacggccgctgggctgcctcctttccctgccgcgcgccgcaccgcttcgccagcctcaagcgcagcgcggctcccgtgccgggcgggttctggcgcgtcccatacgccacttggcttgccctgcgctccgtctggttggatggctacgagggccgctcggagcggccgtgcccgcatcctcatggcggggcccttgcgcggcacatccagggcacgcctccctagcacggggagccgcgggccggctgatgggagcatggggagccctgcgttggatacgcaagctcaagtagtgccatactaccccctccctcgcgctccgccccgtctccccgccctccattgccccaagatctccttttgttgctgtaaacatgttcaacgggtacgctggcgcttctcaggaggaacaccaagcttccgattttcgctttatacctcagaacaggtgggtgtttgggtgtagggttcggctacatcgggcagcacattggaaccatcaagtccatgcatcaggttcatgtagggtagacggatggtggcttgatcagtttcgcagccgggtgccggaacctgcggaagcttgaactgaggagctgttgcttcagcgagcggtctttggccctcgccatacggcaaatgccttctctgaggtatgtgtgggtgcagggctacagggcctctcagaccggcagcgacctcatgctcatggcgcggcccttctggaacatcgagtttacgcctcccagcacggagaccgcgggccggctgatggaagatggggagccctgcgttgataggcaagctcaggtgctggcgtactactccctttctgggaagaggtccgactacccgcagtctgttgttcctctgtatcctgcgtgactgtaaatacattaagccggtatggtgtctctctgggacggcccctggctggccctctgcgcttctcgggcaataaggatgtttgtatgtgggtattgtatggatctggtaggttttctatgctgctgtgtactggaataagagcattggtatttttgcctggtactcctatctaatcttaggaagatgtatactaatgctcgacggaaaaatgtgggactctgaccggcacaccaacaacgctgctcgtgctctgttaaggagttgcgccaaggctccggagccttgctctctacctgagacctggagtgctcttagacataggccgcgagcacagcggcaacatccgcgaccagctttcagtaaacgccgctcagccacatggtgggatgatcactaccgcatgcgcgggcttgagcttgcgggagcctacctggggaagcttctgcttcaaccagctgcttctggccctcgccatacctcgaatcccctatctcaggtaagtttcagtgcatggatacaaggcagctcagaccggccgcggcctcatgcacatgacgcggctctgacggaagatcgagctccagcctcccagctacggacaacgcggcccgggtgaaagcagacggggaaaccctgcgttgacatgctggctccggtgctcgtcctgctactccctctctgggaagaggtccggactacccgccgtctgttgggcctctggatcgtgcgtgagggtaactacattaagccggtagggcgtctctccgggacgccccctggctcgctggccctctgcgccgctcgggcaataaggatgtttgtatgtgggtattgtatgggcctggacctggtagattttctcgctgctgtgctcgggattctgtgcctctgtagctgcgccgtggtcaaatacgttgttgtggtcgcccgcacgcctccgcccgccaccctggccgcttggctcctccggccgccccgcgccggccccgccgtcgcccctggccgccgcgtcggcgagcgcgccctcctggccggccgcgccgtcggcctcggcctgctcggcccgccgcggccacgccggcagccgccccgcgctgtaggggattgcctggtacatctcgatcggtcggccgggccacgcacgcacgtgatcgatggagctcttcttcttcctcctccgctgccttttccgctgggtgccttgcgcagcttgcttgcgtccg

SEQ ID NO: 15216 - DNA, 1158 bp, Triticum aestivum
  Clone ID: PAT_TA_15216
ctcgagattggtgagaatgagctgaaggaagctatctctgctgtacgtggtagccagcgagttacagatcagaatccagaagggaagttccaagctctagagaagtatggtatcgacatgacagaactagctcggcgtggaaaacttgatcctgttataggacgtgatgatgaagtgcgccgatgcattcaaatcctttgtagaagaactaaaaataatcctgtaattattggcgagccaggagttggcaaaactgcgattgctgaagggtgggctctgcgccttctccggggtgtcgttcctgtgccgtgacttcagagtgtgcttatttcgttggacatgggagcattacttgctggttccaaatatcgtggtgaatttgaagagagacttaaggctgttctgaaggaggtcactgcttctaatggacaaatcatcttgttcattgatgagattcacactgttgttggtgcaggagccactggtggggcaatggatgctggtaacctgttgaaaccaatgttaggccgtggggaactccgttgcattggggcaacaacattagatgagtacaggaagtacattgagaaagatgctgctcttgaacgtaggttccagcaggtttactgtggtgaaccagcagttgaggatacagtttctattctacgtggcctgcgagagcggtatgagatgcatcatggtgttaagatatcagatggtgctcttgttgctgcagctgctttatcagatcgctacatcactggacgttttttgcctgacaaagctattgatctagttgatgaagcggcagctaaattgaagatggagattacatcaaaacctattgagttggatgaggtcgacagggaaatcataaggtttgaaatggagaagctttcattgaagaatgatactgacaaagcctccagagaacgactaagcaagcttgaagctgaactagaatccctcaagcagaagcagaaaaacctttcagaacactgggagtatgagaaatcgttgatgactcgtataaaatcaattaaggaagagattgacagagttaacctggagattgaagccgctgagagagaatataatttgaaccgtgctgctgaactcaaatattcaacgcttttgacactacaaaaacagctggat

SEQ ID NO: 15217 - DNA, 671 bp, Triticum aestivum
  Clone ID: PAT_TA_15217
cggcacgagggcccggcccccgcgcccccactgctaaccctacccgccgcctgctgcttccctcgatgcgtgccgtgcgcccctgaacgaagaccggcgcccgagcggcggccctggccggtgaagaacggcgccccagcggcggccctggcaggtgaagacgggcgctgcaagcggcggccctgacggtgaagactgtcgccccgcgccgccgccaacctcaacctcccgtcggtcgctctaccgcctcgcagccgtccgccgccggtgctccacctcccgacgaccagttcaaccactgcagttcgtcacgactcaccactacccgtcctcttccaggtcactcgcagctgaagatgttttctgaacatgatgaggatctgaatgagaatgaagatgcacttatgagtgtagaggcagaggcagatgcagaagcagcagctgcagaagcaggagatgaatctgttttgcatagtattattgaaggtcgacgcgcccgaccaacagtgggtttgctgcttgtgtattccatggactgatgttgcttattatcttgtttctttctttgcattgaaatcttattgctggaccatgaatcatgaatcttcttaatttgtgtcatatgaatattgttactagctctcaaatgtaaacatgtacttgtactttgt

SEQ ID NO: 15218 - DNA, 1027 bp, Triticum aestivum
  Clone ID: PAT_TA_15218
gacaagccatgggagaggtgctagcaaaactgctagaagccggattcatcagagatataaaacatccgcggcgcctggcaaacctggtgattgtaccaaagaaggacaaatcctggcgcctatgcatcgatttcaaagacctaaataaggcctgcccaaaggatcccttccccctccacgaattgatcaaatcatcgacgccactgcaggacacgactcattgtgtttcctcgacgcatactctggctaccaccaaatcaagatggcagagccaggccaagccgcgacggcattcatcaccccatacggcccattctgcttcaacacaatgcccttcgggctcacaaacgccggcgcaacatatcagcgcatgatccagacatgtctggccaaccagatcggcaaaacagttgaagcatacgtagatgacgtggtcgtcaaaaccaagcacgtagacactctagtagacgacttgaggctcaccttcgataacctccgaacatatgacatcaagctcaacccggaaaaatgcgttttcggcgtaccagccggaaagctcttgggcttcattgtatccggtagaggaattgaagcaaacccagccaagatccgagctctgtcacaattggatatcccaaaggacctcaaacaaatacaaaaattaactggatgcgtggcggctctaagccgcttcatctcccgcttgggagaaaaggcactacccctttatcgcctccttcggcgcaccgaacacttcgagtggacggatgccgccacggccggactcgacgaaataaaagccatattggcgacaaacccagtcctggccgcgccaatcaccggcgaacctatgctattgtacattgcagcaacacaccaggttgtcagcgcagtgctcgtcgtcgagcgggaaacggacggacacaaattcccccttcaaaaaccggtctattatgtgtccattgtcctcactccgtgcaaatcacggtgtccgcattatcacaagatcgcttacgcggtattcatg

SEQ ID NO: 15219 - DNA, 1342 bp, Triticum aestivum
  unsure (1)..(1342): unsure at all n locations
  Clone ID: PAT_TA_15219
gagggcttcttctcctagctagggagatggtggggacaggggcgttgggctccgtcatcgtcaagctcgccaccttgctcggcgacgggcacacgatgctcaagagcgttcgcaaggacatcgcgttcctcgagcgcgagctccgcacgatgcagatcctggcgactatgctggtgggcatggaggggctcgacaagctggccaagggctgcatgggcagcatgcgggatctcggccacgacatggaggagtgcatcgaccgcttcatgctccgcctcgacgaaaacgacatggagatggaggccgcgcccacgttcccgaggagcaccgcacggcagctcaaggcaatgtttgcccgccatggcgtcggggcccagatcaagaagctcaaggcccgcgtcgttgaggagggtgagcggcggcgaaggctgaatctggacaactatgtccagatgatgatagatcctcggctggctgcgttacacggagtggccaaggacttggtggccattgacggccccaggaacgaggtcatctctttgttgacggaggagagcgtggacctgaaggtggtggctgttgttggaggtgctgggttgggaaagaccgcccttgccatggaggcctatcgcaagattggacggcactttaagtgccgagcttctgtgtcggtgtcacgcacccctgaccgtgacnagctcttcaaagatctcctttctcaaatcgaccaggctgcatttcatgattgtcagtcggagaggtgggataaagatcaactaatccgtcggatccgacacattttgacaggaaagaggtacttccttgtggttgatgatgtatggaaagaacaagactggaaattccgtcaaaggagttttcctgacaatcataatggcagcagaataattgttactacacgcatagccaatgtagccaagtcaacttgttctaatctggcggcagctctatcaaatgctacctcctgaactatattgattccccgaagattgtctttaagaggattttccactcccgatactcctgccctcctcaagctagaaaaatttcaactaggatcttaaaggaaatgcggcgggctgccattggctataacaacatcgggaattnctgtccaacaacatcaaaccccanatnatgggaaanacccaggtccattgggctggcttcaatataanatgataacatggnaaggtatgggacatatncacgctaattatgggatctccnacactgaaactgctgtgnctaagctattcaaaggggtaanncttaggaataatgaatgtacttagntcatcaaacgggaatttncaaacaaant

SEQ ID NO: 15220 - DNA, 1176 bp, Triticum aestivum
  Clone ID: PAT_TA_15220
ctcgtgccgaattcggcacgaggcgacatctgccccctccccgtctgccaccttgccctcgtgacctccgtctcgcgtgccctcccctccctcccctcccccgtcgtgcgcgaccggagctcgccgcccaccccccctgaaccccagccctagaccagcggggctgctgcttctggtgcgagcgttggatcagctacccaccggcgggccatggcgaggtggcggccggcgatgctgctggtagcggcgctggcgctggcggcggccgccgggtggcgggcggaggcgctctcggtgaccgtgacggacaccgagtgcatccacgagttcgtgccctacgagggcgactccgtctcgggcaacttcgtcgtcgtcgaccacgacatcttctggagctccgaccaccccggcatcgacctcacggtaacttcaccaggtggtaacactgtatatacgatgaagggaaagtctggtgacaaatttgacttcaaagctccaaggggtggaatgtacaagttttgcttccataatccatatggggcacctgaaactgtttctttctacattcatgttgggcacatacccaatgagcacaatttggcgaaagatgagcacttggaccctatcaatgtgaaaattgcagagctgaaggaagcactggaatctgtcactgccgagcagaagtacctaaaagcacgtgacgctcgtcaccgacacacaaacgagagcaccaggaggcgtgtcatgttctacactatggcggagtatgcggctttcatggccgccagtgcgttgcaagtcgtttacatccgccgcctgttcagtaaaaacgtggggtacaacagggtctagggcaccgtctacttcaaggcatggcagcagcaggtggctccaacagggaatgttttctgtcatattgtagcttttcacccctttttcttggtgttagtctaaaaatactctttaatttatatcaccatgtacctttagcagcaactatcgtgaaatgtgaagggcacttgtgggacatagatacataattaatcctcagagtcttcatcatattgaaaggggaaaaaagggtgtcgagagtatcgatgatgtgctatgaagtttgtaaatcctggtacaaagttctggttctctcttttaaacaaacaaaaaaaaagccaaaaa

SEQ ID NO: 15221 - DNA, 891 bp, Triticum aestivum
  unsure (1)..(891): unsure at all n locations
  Clone ID: PAT_TA_15221
cggcacgagggtctcactactcctaagcttgggctacaccatccttgtgtctgctgcttgcattcgtgcaggtttgtcgaaaaacgctccagccaaggactactctctaagctcatccaagtcagagcagaccttcaatgccttcctctccatttccatcctggcatctgttttcggcaatggcatactgccttttttttttgagaatctcacaaagctttattactgaatcataatgttcataggtacaaaaagaagatcgccgggttgtcctagccaagtgtgtcggccaaaccctaaagataacgcatgctttgcgagattatgggcctccgtattggaggtcctatactcatgagtaaacgaacatgaaataaaggtagttgctctaggcttgatttcctccgacaatggctccaaattccgctgacttccctgtctgattgcatctaccaccacctttgcaatccggaggcaacaantaaatgggttggatatagagttctccctgaaantgctaatgcctccccgaacagtatgcttcctacacctgggggtttgccntcctccctgaaaacgagancgacgctccccatgaacaactctctcatccccctgaaacacaccaactgtgccaaactacctgggcttacacggcgcntccacattgatttggtatancctnttggtgggtggacccacttcggttgtggacgctaccatgtctcctccttctctcaaaancnagtcngatataactgatnaatgnatggaaangatcgganaacccagtanacttcgttgntcaatcgcaaatacatatacnaatncccgtgaaantcttntgaaaccnacctctagtcagtncattccacaccgttnanncaaaca

SEQ ID NO: 15222 - DNA, 622 bp, Triticum aestivum
  Clone ID: PAT_TA_15222
cggcacgaggaaccccgctccttgccccgccccatctcatcatcatcaccataagctagcactatatacaaagaagatcgccatggcgcctcaagaattgcatgatgatggtaaacacaaggaggcacctacttctacttgtaccccgcccggcagcaacggcaacccttccggcgccgtccaccccaccacctccagcccgccgtccgacgcctccggccaccgccccgccgccgccaaccccttccctctcgtcctcaagtttgaggaagtggtgtacaaggtgaaggtcgggcaggcgacggagggatggtgcacgagggtggtgtcgtcggcgtgcggcggcggggcggggaccaggaagaacaaggcggcggcgttgccgccgagggagaagacgatcatcagcggcatgtcgggggcggtgcggcccggggagatgctggcgatgctgggcccgtccgggagcggcaagacgacgctgctgacggcgctgggcggccggcaccggcacgcgctgctgtccgggaagatcacctacaacgggcagcccttctcccgcgccgtgaagcggcgcacgggcttcgtgacgcagcacgacgtgctgtacccgcacctgacc

SEQ ID NO: 15223 - DNA, 750 bp, Triticum aestivum
  Clone ID: PAT_TA_15223
cgtccgttcctctgtctttgtgaccttccctggtagagatggcaggcggcggcggcgggaagaaagaccgcggcgaggggctggggcgcgctcttgtccggcagcgcaacaagcaggccttggccgccaaggcgaggggccagcagctcgtgatctcccgccgcgcgcagcaggcgctgccgctcgagtccgtcatcgaggtcagcgacatcgacgccgtcctgcagcgggccgccgaggaggagctcctccacggcgacgacgcggaaggcgccgccgccctgaccgccgcgctccgctccggcctcatcgatctggatgggacgggggacacgcaggatgagaggcggcttctgcgggaggagcaggaggccctgcacgccgacagcctgagggtgccccgccggtgagtgctcggcaccgacgttccttttttctttggtcgtctggagtgggatgagccgtgcatggtcgaacggattcgggatgttttcaggcccccgtggactgcccagatgaccaccgaggagctcgacaccaacgagaagcgggctttcctggagtggcggaggaacctcgcgagattgcaagagaatgaagaacttgtccttacgccttttgagaagaatcttgatatctggagacaactgtggagagtacttgaacgcatcgatttgctcgtgatggtcgttgattcttgaaatgccttgttctaccggtgccctgatcttgagggatatgccccgggaa

SEQ ID NO: 15224 - DNA, 1955 bp, Triticum aestivum
  Clone ID: PAT_TA_15224
tccgcccccgtctctcccgcgcgctcccctggtccgccctgctggcggcggcggccgccggcggcggcgccgccgcgaggggcggccgcggccgcgggcccggccgcgctcctggccggccgcgcccgccgcggcccggggccgccagcgcgtgggccccccccccccgcagctcccgccgccccccgcggccgccgccgcgcgcggccgcctccgcgccctccgccagcggccccccccgccggcgcgccgccgcggcggcgccccgccgcgcccccccccccgggcccccccccgccctgcccgccgcgcccgcctccggccgccgcgggccgcgggggacggggggcggcttctgcgggaggagcaggaggccctgcacgccgacagcctcaggctgccccgccggcccccggccccgcccccccccgcggccctgccccgcgtcaccaccgaggagcgcgcctccctcgagtggcggggcttcctcgcgtggcggcgggacctcgccggactgctcctgacgcctgtactggtccttccgcctttcgggaggcatcttgatatctggagacaactgtggagagtacttgaacgcagcgatttgctcgtgattgtcgttgactctcgaaatcccttgttctaccgttgccctgatcttgaggaatatgcacaggaaattgatgagcacaagagaacactgcttcttgtaaacaaggctgatcttttaccactgagtgtcaggcggaaatgggcagattactttaaggaacatgatattctctatctattctggtctgctaaagctgctaccgcagtgttagaagggaaaaaattgagcagccaaaccatggaagaatcagatacagatcttgatacaaagatatatggccgggaagagctcctggtgaggttgcagggcgaagcggagtatattgtgagccaaaagggaacatccgctgttggagaggaacctgaatctagttctgaatctgccttggtgcgacccaagcgtgtggttgttggatttgttggttatccaaatgttgggaagagttcaaccatcaatgctctggttggtgagaagaagactggtgtaacatctacacctggcaagaccaagcatttccagacactgataatctcagaagagctcatgctgtgtgattgtcctggtctggtcttcccttctttttcaagctcgaggcatgagatggtggcatgtggtgtcttgccaattgataggatgacaaagcacaggggagcaattcaagtggtggcaaatcgtgtgccgagaaacatcctggaacaggtttacaaaatcaccctgccaaagcccaaggcatatgaggaagcatctcgaccaccaaccgctgctgagttgttgatggcgtactgcacatctcgggggcatgtcagccatgctgggctgcctgatgagaccagggctgctcggcagatactgaaggattacattgatggaaagattccacactttgagcttcctcctggtgagatagatgatgaaactgatggagaggacaacagtgacctagaaggctcaagcactgcagcagctgatcaatcagacgacggtgcttctgatgaagatgatgaggaaatcaatcgagctgaacctaacatcagtcatgccctaaacgaccttgcatcttttgacatgcatggccaaatgaccaagggttccacaaagaagaagaagaaagaagcatcccacaagcaccaccggaaaccccagaggaagaaggatcgatcatggagggttggaaacgatggtgctgatgggtcgggggttatacgggtgttccagaaacccgccgttaatcttgctgccagtagcactagcgtcgtaggttagtgcttcagttttttgatggcttgtgtgccgcgcccgagccccttccctgtaaccctccctcacattacaagtacccatg

SEQ ID NO: 15225 - DNA, 422 bp, Triticum aestivum
  Clone ID: PAT_TA_15225
tttgatcttgttgttgcaaatatgtagatctagcattcaggattttaacatagattatcaactaaccatattcaagataacatttatgtctcacattcactcatatcaatggcataattaactagcgagcaataataatgaatctcagatgacaacatttttttcaaaataatcatgatacaatatgatataatggtatctcgctagccctttctgagaccgcaaaacataaatacatagcacccgtgaagatcaaggactgactagacattataattcatggtataagagatccagtcacactcatactcaatatcaattaataacagtgcatacaaatgatagtagtgctctctaaccggtgctttttataagagcatgatgacttagcaatacacgtaaatagatacgcccttcgcaga

SEQ ID NO: 15226 - DNA, 927 bp, Triticum aestivum
  Clone ID: PAT_TA_15226
ttgggaaacaagcaacaaatagtgggacaatctctctattaccaagggaagaaggactcatcatccaggagcagtttcggaaattttgcatgtttacgatcttgtaccgcagaggtttttgacggcgcccaagacctgaaagggttgatcctcctctgcaacgatcaaacgggagctttattcccggcggcgcaatacctcatggatggaggaggaaccggactcatcatcgtgtcatccacgacggacgacatgagacccgtgacagattgcgaaggcatcgcctgtgtagttgtcaacatcgaagacgcggagaggatgtgccaatactatgaggacacaagctctgcccaggcaaagattgaaccggcgggcaccgttacgggcaaggagatactggccccaaaagtggcgatcttctcctccagaggcccatctgttacttaccccgccattctcaagcctgacatagctgcacctggagccaacatcctggcagcaaaacaagatggctacgtatttaagtcagggacgtccatggcagcccctcatgtagcgggcatcgcagcgctactcaaagttttgcacccatactggtctcctgcggcaataaaatctgccatggttaccactgcccatgtaaccgatgaacgtggcatgccgataatggcggaaggatattcgcggaagatcgccgacccattcgactacggaggcgggaccatcaatccttgcggggcggctcatcccggcctcatatatgacatcgatccaagtgattacagcaaattcttcaaatgcaccatcagcaacaagaggacacccgtggattgcaacaccaccaccatgcaaccagcgtattacttgaacctgccatccatatcggttcccgatctcaggcatcccatcaccgtttccaggactgtg

SEQ ID NO: 15227 - DNA, 686 bp, Triticum aestivum
  Clone ID: PAT_TA_15227
ggcacgagggacagagcgagcaagaatctgtccctattcctcatagagacggccatggccattcctcctaaaaatgctctctacttcctgctgctcgtctccagcttcatccttggcgccatggcggatctagccttatcatgcccttcccgctgtgaagtggagctacaatggaccttatacgcgcggcagattgggggcggagcaaacgcgaaccaggaagagatggttcactccgtgcaccccaccacaggatttggtacgatcgtcgtcaacaactgggatgtgctcgacgcgcctctgcctaacgcagccatagttgcccgtgcaagaggcactcacaccaaggctggcccagccgccggtgactggttcacttctctcagcatagtcttcgagggagccaggttcaatgggtcgacctttcaagtcatggggatcaccaatacagatggtctgtgggctattgttggcggtaccaaagaattgtccagggcagatggcaccattaaacatactctgttaagggcgacggcccttgagaactatagacaacttgatattcgtgcattctataccccgcctgcggttaatgcaaatggtattgctgcccagtaatatgattaaagggtgcgttgatgttgcatatataccccgcatgggtagatctgacaagaactacgtcg

SEQ ID NO: 15228 - DNA, 985 bp, Triticum aestivum
  Clone ID: PAT_TA_15228
tcggcacgaggctccgacgcagcgcgttgaggaggagctttgcggcgaccatggcgaggcgctcaggcacccaaggagatggcggccatggcaagtggcgttgggctcaggcagcacctgctgctggcctgcgagatggcgctagcctccgaccggcttctcccgtacggctgctcggacgcgggatggaggccatggcgacgccaccgagcctcccggcggtttcgggcgcgagctggtggccacagggcgtcccaaccggcagctgcggcgcttgctgctgcggcggccggctgcatgcgcgcgctgctgcggcgaccgctgcgcgctcccggctgctgcgtgcgcagcgtctccctcggtaggtgtcccaccatccacctgccgccggccttgttgcctcacactgcgacgcccggcttttgcgggtcctgcagctaaggaaaataatgctcgatcttctggtacatgcctcgacatgtcgctctcgtagctgccaatttcctaactgccttaaggtcaaggaactatttctgcatgcgaaggagtgcaaaaggcgtgcttcaggagggtgtgccctgcgcaaaaaagtgtggtacatgattcggctccatgcccaagcttgcagagattcaggatgcagtatgccgaggtgcaggtggatgggcgcgtctatcatttgtcctgctacctccacctctcttctgcatgcgcgtacagtattgcaatctggagtaacacctgaccaccacttctggaaactacacagggatttgaaagaccatcttagaaggttgcaccagcagtccgaatccaggagagggctgctgttaacgaaatgattacacaacgggcagcagaagcttgggatggttgaactagagaatctaggcaagacgtttagatggatctttcaactggagatggaagaaggtgctgggcattcttcgccgatgattaacgtatggctcggaagcctaccttt

SEQ ID NO: 15229 - DNA, 796 bp, Triticum aestivum
  unsure (1)..(796): unsure at all n locations
  Clone ID: PAT_TA_15229
nnnatnngattagcgtggtcgcggccgaggtgccgaatgtgacggtggagcagtcgaagaaactctccggctcattcgacttcatcggcttgaaccactacgctgttttcccaacgctggccgacgagactgccttcaatctgaagcagagggactacttcgccgatggaggagttgcaaatccgacgaaatacatcctagagggccagaatgagtatgctccttgggctctgggagagctactggagcacgtaaaactcaagtatggaaaccctgcaatcatgatccatgaaaatggatatggagacgcccccaaaaccccaggcaagatcgaatacgatgacgataacagatcaaagattctgcaaaattacttggaagttctctacctgtccataaggaacggatcaaatgtgcagggatactttgtttggtcgttcgttgatgtgttcgagttcctgttcggcaaccgcatgcgcttcgggctgtgcggtgtcgatatgagcacggcggggaggaagaggtacctgcccgggcggccgcgctggtactccggcttcctcaacggcggtgagctgcggtcggtgtcgccattgagcaaagcctacggggccgcatgatgtatgtggcttcgttggcaatgacacggaagtcggttttatttcattttgtagctggttgcataagaaacctgctcatagcatacaatacaccagcagccagggtcaaaagtgatggcctgtgtatgcatacaaaacatttttttgttgataaagggcgattttattatctcaaa

SEQ ID NO: 15230 - DNA, 808 bp, Triticum aestivum
  unsure (1)..(808): unsure at all n locations
  Clone ID: PAT_TA_15230
aggaggccctggcgcgggtggcggtgacgcggtcggacgtggacatggacgccatccgggcggcctaccaggagcagttcggggccaagctcgaggacgccgtcgccggcagcgcgcacggccacttcaaggacgcgatcgtctccctcatcgtcggcaagtaaccatacgatacaacattattacgcgccccgagggacggtggcgatggcgcgccggccgagcgtgtgtttttcttcctggttcatctcatttcgtgtgtgcgtttgtatgttgatgaatcgttgtcgagcgggccgtgtaagggtgcttaaggcctttgtacaatgacaaatgcttagaggggtgcttaaaaaaattaaacccgaagattttttngaagcaccggtgcctatttccacaggagagacccttaagttaaccgtttaccctggacaaattagcaaccggggcttaagaaaagttggatttatttttggaagcaaccttccctaagcacctctcnattgtacaaggcctttcagagatgttttaaaaataaattgggtttttctgaagcatcggtgcctaattctatgggaaagacgcttaattaaacgtctattctgtacaaataatcaccggtacttaaaaaacatccggtttatttctctaagcactttttctaagcatcttccattataaaagacctaacatttgcagctgaggtcgtgtaatacggctgatcggggatcaaataaagttaagcatttggatctttctgttccgnagaaaaaaaaaaaaaaaaaaaaaaaaaaaaaaaaaaaaa

SEQ ID NO: 15231 - DNA, 949 bp, Triticum aestivum
  Clone ID: PAT_TA_15231
catctcttccgcccctgctgccgctgccttttcctctgctcctcacctcctccacgcctccctccctaccctttccccctcctactcctctgcagccgcctccgccatgtcgtcgtcgttcgcgcaccaccacggctccctgcaggcggagaggatgtccgcgctgaggagtagcctcaggccgtgcgaggcagccgaggaggtggcggccgccgtggtcgctgggccggcgccgtggggagccgggctgctgggtgacggcttctcggtggaggagctcctagaccttgaggagctctgcgaggtggacaaggaaggcggcttcctctgcgagacggcgccggccgccgaggaggacgaaaagtgcagtgactcccacgggtcgtcggcggtctcctacgagctcatgccgcttattccgccggagatggacctgccgggcccacgacgcggaggaactggagtgggtgtcgcgtatcatggacgactcgcaggcagagctcccgccgccgcagcagctcccagcgccagcggcgtggccaccgcagcaccgccggccgcaggaaagcgccgtgccgaccgtggaccctatgcggaccccgaccatatgcgcgctttccacggaagcgttggtgccggtgaggtcgaagaagcgcagcaagcgctcgcgcggcaccaccgtgtggtcgctctccggtgcgtccatatccgactcggcgtcgtcgtccgccaccagctcctcctgctcctcgtcggcctccctgtcgtccttcttcctaatggactcccccaccttcaacctcctcgacgaacctccacgccccaagaacaagagcaagaagtccaagcacaaggccaagaagcgcgggcgcaagccaaagagccatctcccgccgcagctgtcgggcggcgccgcctccccgccggcccagggcgaccggcggtgcag

SEQ ID NO: 15232 - DNA, 1433 bp, Triticum aestivum
  Clone ID: PAT_TA_15232
ctccccgtgctccccttgcccgccccccccccccccacgcgccccccccgtcaccgcccccccccaccccaaggcaacccccaccgtctcctccctcccccccaccccagccttgtcccccccccctcccccctccaggctagcgctccacccgcctcccccctcctcgcccacaggaccccgggccactgccgccttctccgcgcgcacgccaggccgcagaggcaccgccgccgctctccgtctccctcccggacaagcaccaccctctccgtctccggctcgaagagcactcccgccgcgccgacggatctggactcggacttcgagcccttcgcaacctgccgcccgagggtttccgacgtccacaccgtctactaggagccgtccgccaaccgcgggcgccaccccgtccttttcctccacaccggcccttcggccggcacctctccgggacaaccgcaggttcttcgatccggagttctacaggatcgtgctgttcgaccaggagaggcgccggcaagagcactccccatgcttgtctagagcagaacaccacctgggaacttggtaggctgacattgagaagctcaggcagcacctcgacattccagagtggcagctgttccgcggttcatggggaagcaacttggccctcccctgttttaagactcaccctcttgctttggaaaaaggagcttgattggttctacgagggcggtgcagcagctgttttcccagatgcatgggaaccatttagagattttattcctgaggacgaaaggaattgtttcatagctgcttacagcaaaaggctaacttcctctgatgctgatgtccaagttgaagctgctaaaagatggacaacgtgggagatgatgactgcacatcttcttcaaaatcacgagaacattaaacgaagggaggatgacaaattttcagtgccattagcaaggagtgaaaaccactactttattaacaagggattcttagactcggactcacacttattggacaacgtcgacaagattcgtcacattaaaactttcattgtacaggggcggtatgatatgtgctgtcctatgatgtctgcttgggatcttcataaagcttggcctgaagctgagtttaaagcggttcaagatgcagcacactcggcaaatgaagttggtgttgcagctgaactggtatcagctaacgaaaagcttaacagcatgttgagaaaatgagcagcatgagtctatagcggcacacagcaactgacaaacgaatttcaagctgaattttactggggttacattgcaaaataagaactggtaataccactttgtcacttaacaagaaccgtgattgtacgtgtcgcatttagcactgcccgattgtacgtgtcagtcagttccctattcaatcaaagtaatactgcgtaggaagaa

SEQ ID NO: 15233 - DNA, 693 bp, Triticum aestivum
  Clone ID: PAT_TA_15233
cggcacgaggcccttccatccccttcccttcccttccccgggccaaaaacaagcaaacaagtaacaaaaaccaaacctttttcgtcgctcccccgccgctctggtcctgcgcgctggaccggagcgctcgcctgccttccggaagggggaaagtgggactgagagagagcacaccagaaccagatggccccgctcgccgcccgtcggtagccccgggcagacattgccgtctccctcttcctcctccccggacaagaagtagaagccgccgggggcaatgaggaagcacgggtggcagctgccgtaccacccgctgcaggtggtggcgatagccgtcttcgccgcgctgggcttcgccttctacgtcttcttcctgcccttcgtcggcagccagacctcccagtacgtcgccatgggcctctacaccccgctgattacgtgcgtcgtcacgctctacatttggtgcgccgccacgaaccccggcgaccccggcatctgcaagtcggccaagctgcactcgaggatggacaaggacgggcggcagtcccactcccacatggattcggaccacggcctgaatgccgctgacaacagcgagaagctgagcagcatgctcgagaggaaggactcgccttcttggcccagatgctctcaactgctctgcttagtctgcttgcccttttcctgcctctg

SEQ ID NO: 15234 - DNA, 929 bp, Triticum aestivum
  Clone ID: PAT_TA_15234
cggcacgagggcagtagacacaagggatcgacgatagcagtatgagtgtcatgttgtctctcgtctcctggttcctcctggccatggctgctggaggaggcttgcacgcaaattcagccaccgccgaagtgacgatagcctcaaactcggctgcggttaccgcgtactggcacacaatgcttcccaacacactcatgccttcagccatcctcgagctgctagccccacctgcggggaacgaagtccagaatagcaaatgtgtatggggaccgtccacaccaaatgacgtcgagaagatcaacaatggtaattggggcccatccaccaaagctgaagacgagaagagtaatggtgtatgggacccgtccacaacaaacgacgtcatgaagaacaatggtaattggggcccatccacaacaaacgacgtcgagaagaacaatggtaattggggctcatccacaagaaaggacgtccagaagagcaaaggtgtatggggctcgttcacaacaaatgatgtcgagaagatcaataatggtaattggggcccatccaccaaagctgaagacgagaagagcaatggtgtgtgggacccgtccacaacaaacgacgtcatgaaggacaatggtaattggggcccatccacaacaaacgacgtccagaagaacaatggtaattggggctcatccacaagaaaggacgtccagaagagcaaaggtgtatggggctcgttcacaacaaatgatgtcgagaagatcaataatggcaattggggcccctccaccaaagctgaagatgagaagagccatggtgtgtgggacctgtccacaacgaacgacatcctgaagaacaatggtaattggggcccatccaacaaagctgaagaccagaaaaacaatggtaattcaggctcatccacaacaaatgacatc

SEQ ID NO: 15235 - DNA, 466 bp, Triticum aestivum
  Clone ID: PAT_TA_15235
cgtccgaaacacttaaaatggagtgtagctgcaaaggagagcttgccctcgcgcaccaagattgtgctgtcaaatcgcgtagcatcaagggtaacaagatatgtgatgtctgcagacaagaagttaagaatctgcctgtgactctgttgagaattccgactcaaaccgttaccaggcgactagcaaatggtgctcagcaaagagcagctcaacagtacagattttggcaggacattccaattttagtgatggttagcatgcttgcttacttctgtttcttggaacaacttctggtcactgatttgcagtcacgtgcactggcaatttcattgcctttctcatgtgtgttgggcctcctttcttccatgatagcatctactatggtgaccaagagctacctatgggcctatgcatcctttcagtttgctatcgtgatcctgtttgctcatatcttttacaacgtgct

SEQ ID NO: 15236 - DNA, 1062 bp, Triticum aestivum
  Clone ID: PAT_TA_15236
aaccatataccaggagcgaatagaagatgctgccattgccaataccttagaaggatgatgaaccttctaaacaaatgtattttactactttttttctgttcaatcaagttgctggagccttgctaatgggttcgattatgttaatatgttcgtttgaaacatgaaattgcatattatgatgtttcaagttaacgaattgcactggcttgtttttagtcaaagtattttggatgatatatagtatattgtaacaccaaattcaagaatactttgtgcagttctgtagcataacttgcttgaccacaaagatgggctatgaaccgattgtaacctctctttttttttgcaggatagatgattgtaacctctcatcatgcgattatcctctcttgtaggataaactacttttagtgaaagtagttgtcgccaaacatattgtatgtgtgcctatcaccaactttatgagaaaagatagaccatgtgatgaagttctacacaagatatatttgtttccaaggaaactataagggttcttgttttttctcttatcattttaccacatggtcttcttataccaggttacaaaatgtgagttattcttgtactggtaatccttttctttaactgtggcacagtgtattgacttaattcttggaatattctgtggtcgcaactgtatgtatttcagattggatgcagttacaattatctcaaggctaatgacacgctagattttccatacttctaggagtgttgtacatatgcagattcttatgaaggtgcatgtcatcaatttctggcttccttttatctcggcagatattgttcatatttttcggacgcataaaatttttggtggtcagtctatttgtgcacgaatgaacttccataatttaataatttggtcgtctatggtagcactatcaactgttatttacatgaaaccatatgtatgttcattatgctttattctcctaccatgatgtgattaactggtaattgtagcctattgaagttcgagaacagcatagcatatttaccacaattattatcgtttcctta

SEQ ID NO: 15237 - DNA, 576 bp, Triticum aestivum
  Clone ID: PAT_TA_15237
cggcacgaggtttttttttttttacgatgaaattatttattttcaccagattcatcgccttatagaagtaaagtcgcctcgtttatatccttaacgaataggcaagtcaccgtggccgcggcccaggggcagtcctgccccgccgctctctccccttgatcatatccttaacgaatcgacgactctttctcctcgagagaaatgctcaaggtgcgcgaccaggaaatccttgaccttcattttcctgtatcgcgccggttggtcctcagccaacatctgagctatcggtccaatctctctttcaggatccaggccatagaacacggccactgacatcctctctttctcagaattagtcacaaccctatgtaccggcccgtgcggccgcccgttggtcattatctccattgtaacaccaacgttgatcagcaaggtgtagttagacgcagatgggacattgtaccacgttccatctctgagaaactgcagcccagcgacatctttgtccattagaagaaccgtaagagcgtagacatcagagtgaggcttgatgcccaagacaagatcaggccttgg

SEQ ID NO: 15238 - DNA, 955 bp, Triticum aestivum
  unsure (1)..(955): unsure at all n locations
  Clone ID: PAT_TA_15238
cgggcgcgttcatccccgcctgggtcgccccggctctgccccccggggtggcctcgtggtcgggccctgtccggcgacgccccgcggccccgggggcgcccctccggccgcccccacccccccccacccccctgctcccccccgggtccttagtgcgctctgcgggctccccccgcctcctcgccccgcgttccgcggtgcccggggcctctcgggaggccccctcgcccctgctgcgcccgcccgccagccctgccccgccccctccctccgccttggacccccggcccgcgcctccctcctcccggggcccggcgcccgcgccagcgggtccccccccgcgtgccccagcgctgggccggtgctcttcctcctccaattgccgggataccacccggccctggtgcacgcgatgatgttcaacagcggcgaggacgcccatgcagttcagaaagggataacttgtttttttgttggattttggctagagatttgataccttgtgcggtccaattgcagtacgcatcgccccccaggctgcagctcgcgctggcgggtgtggcgcggtgcccggttgccccgtgcttttgcgcggtgcgtattgctnttttgnttgttgcctgtggggatgtatgcaatgttcaatgcatgtccttgaccctgcttgagcttgcaccgtcccgccaccttaggtaagagctcatctcctctacaagatcgaatcggcaagcacaaaacaaaatggaaaagttcatagaagccgcgttcgtgcactgcaggtgtttgaccaccgagacactggagcagcttccgtgcagtgcttttggcgagcggttcggcccgcacgttcctgtgcagtgcggcatgtgtgttcgtgcagtgcggaaacatcggtgttgtatatcggcggcaagagacaagtatactgccctaggggtggaaggcgtcatacttt

SEQ ID NO: 15239 - DNA, 1207 bp, Triticum aestivum
  unsure (1)..(1207): unsure at all n locations
  Clone ID: PAT_TA_15239
gnnatagncgataanccntnttaacccccactcgagggccccgccgctccagccccccccccctcccggcccctccccccctcccggcccccccgggcccccgcgattcggcgcgcccccgacccggcctcgtgcccggggcatgccacgcgcggcctcaaatctgccagattccaccacctcccgatagctcccgctcagcagcaccaccaccagccgcgagccgtccggcgggcgcgatgcaggcgcgggtggcgtccatggaggacatgaaggaggcgaggctggcggcgccggggcagggcggcggcagggtgttccccaccgggatgctcaaggtcttcctcggcttcctcctgctcggcgtcggcctctccgccgccggcatgtacatggcgcgccacacgctcgcggccgccgcgccggccatcttccgcccctgcctcggggcctccgccggcgcgggggaggagcagccgctcgacgggctcgagcgctggacccgccccccgtcccgcgcgcgccacgcgatgacggacgaggagctgctctggcgcgcgtccttcgcgccgcgggtccgcccctacccgttcccccgcgtgcccaaggtcgccttcatgttcctcacgcgcggcccgctcccgctcgcgccgctctgggagcgcttctttccgcggacacgagggcccgctacttccgtctacgtccaacgcccttgccctcctaccgcgccaaacttcaaccaaagaactccgtcttctatccaccggcaaatccccaantaaggtttgccgaatggggtcnagatgaaccatgttgttaatgctgaaaaacccctgcttggcaaatgctttgctgggatattatctaatgggtgggggtgctgcgtccgagccatgcatccctttcttgtttagattcaaaaaccacttncaatacttttaanaattnaaanccaaantttngnantggggnttnaataatcctggaccaatattgnccgggcccatttaattntnacangnanccntnaggttnaacttnaaaaattggnncnaagggctncnnaangggtttnaaatnnnnnanaaanttnnnatcnnnanntttntnnanccacnttttacccnnaattaaaggnntttnnancntaatnntattnnntnaaaaattttccctnaaatntnacnattaanttnnaaantnt

SEQ ID NO: 15240 - DNA, 759 bp, Triticum aestivum
  Clone ID: PAT_TA_15240
tcggcacgaggtcaccactccatccccccccgtccaacacaccagcagccgccccagtccaacgctcctacctacatcgatcgctcgccgcttccactgctcgatcgagctcagtcgatctccgatctctcttctccggccggcttgccgtcgctgtcgcggcgggaggaggaagaagaggaggagaggcggtcgacttcgaccgccgatcccacccccgccaggcgcgcggccatggggagggcgccgtgctgcgacaaggcgacggtgaagaagggcccctggtcgccggaggaggacgccaagctcaaggcctacatcgacgagaacggcaccggcggcaactggatcgccctgccgcagaagatcgggctgaagaggtgcggcaaaagctgtaggctcagatggctcaactatctgaggccaaacatcaagcacggcgacttcacagaggaagaggagcacatcatttgcagcctctacattagcatcggcagcaggtggtcgatcagcgccccgcccccgccgcgctggtcgcaccgcgtcctccacgtcctcgggatcaccctcctccgcaagatccccctcggcttccccgcgccctcccgccgcccgccgcgcgcccgccctctcgccccgtgcccctactccgccccggcggcgggcggcggcagcgccagcagcagcgggaacgctagcggcaccaccgcggcactcagctcgtcagcgctggagcggatccagctccacatgcgcctg

SEQ ID NO: 15241 - DNA, 1162 bp, Triticum aestivum
  unsure (1)..(1162): unsure at all n locations
  Clone ID: PAT_TA_15241
gtgatgtcaaagaggggtcatgtacaggntcagcgacatcagtccttaagctattcggcaagaaagtcgtggtgaatgattcattccaagaagccgaataccagcaccggcaacccgcagaatggtgccgacgtcggaactgaagcttcagacgatacaaccacacaaggaagcagaaacctaccttctggcggtgccacagaaggaagctcatggaatccatggccgagcagcatgcagcagtttgtgtattttgttcctcaaccggatggtttcgccacacaatctgcggtgccatggttcggcaccctgcctggtgcaatgttctaccagcaagccatggctccaaatcagcaccagagcgccatcgctcagagaccgcagaccacaagttcatgcagagggaaggatcctggacaggatcaaacactggccctggatcagctgcgcataattcagatgctgccgactcccgagggggaggagacagcagtgagagcgacaaaacgcctgtgccgcggttaacaaagtgcgagagctctgtttcggtcagtctgcaaagaggtttcatgccatacaagagatgcgcggccgagagcgaatcgctgcggtccggaggcgcccagagaggagaccgacggtgagttgacgaggctgtgcttgtgacagccgaagattcgacacgctcttcacagtttagatgtttgctaagttttgctctagactcttgagctggtggtgtgatctgcaagtgggaagaagcgaccactcatcctgctggttttgcctgtcggtatgtcgcacttctccgaagcagctcgaagccgcattagattgagcatttctggttcttgctcgtgaatatatataagttggaatatgtaagtatccatgtttttgttctctacagagtgtctctgcagtttttaccccaaatcgggaggctcagagttcagtgttgttgcctgtatcaacctgggcctgagagagggttgtcgtagtcttaactgcatgttgtaagctaggcaggcttgtatcactctgtagtctgcattctgtaaaacatatgataggcagaagacgaacaaaaacgtcgaatgctctgtatatctaaagtataacataatatacctggacttgggtctgtgcattaaaggggggg

SEQ ID NO: 15242 - DNA, 811 bp, Triticum aestivum
  Clone ID: PAT_TA_15242
cggcacgaggtgagctcgccgacccgccgatcatccaccgcgatatcaagtccaccaacatcctcctcgacgagaacctcaaggccaaggtcgccgacttcgggctctccaagctcgtcgccgacaccgagaagggccacgtctccacccaagtcaaaggaacactgggatatttggacccggagtactacatgacgcagcagctgtcggagaagagcgacgtgtacagcttcggggtggtgatgctggagctggtgagcgggaggcagccgatcgagaaggggaaatacgtggtgcgggaggtgaggcaggccatcgacccggccgaccgcgactactacggcctgcgcgccatcgtcgacccggcgatccgggacgccgcgcggacgcccgggttccggcggttcgtgcagctggcgatgcagtgcgtggacgagtccgcggcggcgcggcccaccatgggcaccgtcgtcaaggaggtggaggccatgctgctgaacgagcccgacggggaggggtccaactcggccgggtcgtcggccaccgagttcgacggcgccggcaggggcgcgccctcgcacccgtacagcgacgtggagatcacccggtcgtcctacggcggcgccggggaggcgtccgattacatgccctacttcgaggtcaagccaaaataatagacacattgtacattcatttttggggtatagaaagtgtacattttgttccttctcgtgtcagcttgtgagttgtgacgatgaattgtacattgatttttttttgtacgtgtggcgggggatgtgacttgtgatgc

SEQ ID NO: 15243 - DNA, 675 bp, Triticum aestivum
  unsure (1)..(675): unsure at all n locations
  Clone ID: PAT_TA_15243
cggcccctgcctcttctccatccaatctagccaggagccgcacgtccgcgggccgtggtggctggccagcgcagcactccctaattggcgatgaacccagaggacgccatggctggcgccttggagctcctctgcctcgtcctgatctggccgtctgccccagtcgtcggccccgtgctccggatcaggccagcaacctcacctacgacctgatttggacctcctagccttcgccacctgcgccatgccccagaggttcggccggtcccgcgtcgctcattctcgcttcttcctctgctcgtggctcgcgttgactgcgaaaggccacatgcctcgtccaaccacatcctctcactgccttgctcctccaccaccacactctcctttcttcctcccctccctgccagccgggcactctccctctcccgcctccgttcgccgcaggtgagtgcccggctgcgggtgtctggccaaacagcaacaactgcggcagttcggcgcccggagaagccgcgcgttgggcgatgtggaggaggacgacctgccgcttcctcatccgggcgtcctcctctgccccgccgagactcgtcccgccccgcccgacgccccggcgccgccccccgggcacgcccccgcgcccccacccccgccacgccatcccctcctcccgnacac

SEQ ID NO: 15244 - DNA, 763 bp, Triticum aestivum
  Clone ID: PAT_TA_15244
cggcacgaggccagaccggatgcattccacaccatatgtcattacagcattttgaaagacatcacaaacaatttctctgatgatcgaataattggtagaggtgggttttctgtggtatataagggaatacaaccaagtgaggaaatggttgcagtgaagaagtttgtgcaaccaacgagctcacaggaggaattcgagaacgagcttaaactccttatggaactgaagcacccaaatatagtgcaacttgcaggctactgctatgaaacgcggaaactacatatgtttcatgaaggagaatacatttttgctgaggacactcaaactttgctctgtttagaatgtctgcctaatggaagtcttgagaactatatttcagatgcatcttctagacttcattggtgcacacgctacaaaataattgaggggatttgttgtggtctacaataccttcatgagcaatctaaagatcccattcttcatttggacctaaaacccgcgaacatattgcttgataaaaatatgttaccaaaaattacagactttggtctgtcaagactgtttgatcaaagccaaactattcatactgcacgtacttgtggaacactaggttacatggcacgagaatttctacaaggtataatcacacctatgtcagacatattcagtttgggtgtaataattttggaggtaataacgggtcacaagggggtcccagatgatattagaacatcttccaagatcttcatcgagcccgaacttc

SEQ ID NO: 15245 - DNA, 812 bp, Triticum aestivum
  unsure (1)..(812): unsure at all n locations
  Clone ID: PAT_TA_15245
tagccacggccagcgacatgccaatcaatctatcggcgcattagccaggctacggagttggttaacactgctagtatcttataagctaccgctccggcgcaacgggccatccatcaatcgcggcgaatcaaagcgaattattggctgttggttgggaaccaccggaggattagttagccgctagctgctcccgttgatcgtgccaaggagaagcagaggaggaggcgaaggggaaagaggaggaggaggagaccgacgatgttcgtattggagctgggcgtctggctgctgcccttcacgctgctgctggcgccggcgcggcggctcgtgcacctcgtgcgcgagctgcagcggatcctcctcgtcgtcgcctgcggccgccgcacgcccgccgccttcggcgaggtctggagccgcctcgaccgcctcgactccgccaccgtcatcgcctgatcggtcggccacaccccgcccaccttgcgtcgctctggctcggctccaccctgtaattaacctcctgctgttcttcctcttgtatattctgcgcgtcctagttttatttttggcgcgtcctagttgtgcgtaactgttcttcaagaaaggatcaaaggaccggtgctacctctgttcttttgagcttttgagcgaacccgctctccgttttcccttttgattttgagttcctcttttgctttcctcctgaagtatgcatcatgcatgcctcctgcaattgcgttgaggagatgatccatgagcagggatcgcatctgagaatgatcttgtttncaaatgtttgtttaatanaaaaaaaa

SEQ ID NO: 15246 - DNA, 466 bp, Triticum aestivum
  Clone ID: PAT_TA_15246
gacacatgggtgattgaatgcgtcttctcctcatcctcttctgccatgaagatctgatggtatcctgagtatgcatcaagaaatgaaagcaagtcacatccggccgtggagtcaacaatctggtcaatgcgcggcaagggaaatgggtctttgggacaagctttattgacatcggtaaagtcgatacaaagcctccatttcccgtttgccttgcgcacgactacacggttggccaaccacgtaggatggagcactcctctgacaaggcctgctgcttccaatttcttgatttcttctgcgatgaattcttggtgctccactgcctgcttccaaactttctgcttgacgggccgcgcatgaggacagatggcaagatggtgctcgattactttcctgggaacaccggggatgtcagaccgttgccacgacaaaccatcgacgcgcgcccgcatgaaagcaacgagcg

SEQ ID NO: 15247 - DNA, 453 bp, Triticum aestivum
  Clone ID: PAT_TA_15247
gcttggaagtggtgccaacgccggcgaagaagcggccgggggagaggaggtcgcccgcggtcggcgtggcggcggtgctggtgtgcctcttgatgatgacgttctgcggccggctcgcggccacgctgcttaccaccgcggtgctctgcttcttcccgcgaacatggccgcctgccagggccaaggcggccgagagcctgctgctggttgcgtcgtcgccggagcacagcgcggcgtcgaggagacaagtggagacaatcaagacgaaggcggttatggatgggttccttgtgaggaaccgcaacgaagtgatccacctttgatttctccttactttttctttgttattctatgcacagtagttccattattttcttagttttttgtccgagagtttatgtaattataaaattcggattaacacttaacactgacaaatatactgtgaattaa

SEQ ID NO: 15248 - DNA, 1290 bp, Triticum aestivum
  Clone ID: PAT_TA_15248
cacacccaccatctctcacgccgccgtgagcgccaccgccaccgccttcgtggcctcctctatcgccgctgccgctgccaaggttagaatgaggcgacaacagggacagggacaggggcaatacggggatcctaacatcaattccatggcctcttcccagttgcatcactaccaggctcagcaaagggttcaacaactccctgataatagttaccctggaagagatcctgggcaagctgctggggagaaccagtataccacccagaaggtgagacagagccaatgggacagaggtggaccgaatatcccgaatcagatttcaccatatgcatataacgagggtcaaagtgctgagggtaaacgatccttttatgatggacaacaatctgatatgaaggttggtctagaaaagcaaccaagaaaggaattgagggaccagcctcgtaccgataagattgaagcaaggcgcgatgactataatcttcctcgtacatttgaaagtctagagcagagttttcgtgaagacatcgtggtcctatccaaggaactaaatgatgcagaggatgctgaaaatactaggcacagggagagattgaacgaaataaatgcacagtatcatgagaaactattggcacttcgagctcggcagacagcctatcgagaagaattcctgcgcaaagagtctctggaacgccaacagcaataccaaaaggccagcataagcaattatgcaaataatgtggtgcctagggaaccacgtggctatcctccaacagctgcagccacgcctcctgctgctgctccctctggaagttcttatggagaggctcatcggggttatgcatctggtcagtatgaatcctttggggagcggccagattacccagagttccatggtgggggccaaggccgtgatcatggttttgagcatcgtggtcatcaataccctggcggtcgtgcttataactctggcgggcgcagattctaaagatggcttgattgaacagtcagccattttggcctcacttcacctggtcttatcttccgtggaaagcttacagtaaatttctttagaagcttagttccagcctcctctgaatgtaaacacttgtaaaacctgtttttcgattttgtgccgctatttattcaagcattgatcattttcttcagtagcccgcctaaaattctccaattctcaactcttgcgcatgtagctatttgtgctttgcaacctcaccagtgttgctttggattcgtaatgtagaggaaaacggaacactaaaaaaaaaa

SEQ ID NO: 15249 - DNA, 3045 bp, Triticum aestivum
  Clone ID: PAT_TA_15249
ttcaggctgagggttgcatcccaacaacaacctgagggcaaattcccggctccatggagggaactcctcaacctgctctaaagcataccgctccttgtcgggggctcacggagctaggtcgataaagttaaggagcgtgcctcctcagcgagcgtacacgaccttggtctcatgagggaagtcgagtgcaaggatgtgataatcgacgctgcatggcagcaggttctggcagtatactttacctactgcaagctgcaagaagggttcacatgcgcctcgtcctcaccagcgccatgggcctctgcttgaagggtgggaactacgccaccgcggcaaactttgcccgcatgctcctggacaacgggccgaacgaggcccaggcaaagaaggcccggcaggtcctgcaggcctgcggcgacaggaaggacgcccaccaggtgaactacgacttcagaaacccgttcgtcgtctgcggggccaccttcgtcccgatctaccgtgggcagaaggacgtctcctgcccctactgcgcgtcccggttcgtgccctcggtcgagggtcagctgtgcagcatatgcgagctctcggtggtcggggcggacgcctcgggcctcctctgctcccctacacaatcgagataagataagtggcgacgacttcgcctctgtgttcatcatgtttgtatctccagttcgaagactgttgtgtcagttatattctacctaccagagatttttatcaccaacttgcgaggaataagtatagtataattgcgtcgtttctcccccctttttttctgtcatcgatcggtcgtggcctgatggctgtgatcggtcaatcaacaaacggtgtaggatttttggacagatccattttttagggcacaatgatgatgtatttaaatcgggattttgttatataatgaaccacctcccatgttcgagtgaaaggatttccagaagttgctctccactttgtgaaagatgaaaaaaacagattcaacctggcccttgaaagcgggaacatccaaattgctgttgcttccgcaaaggagctcgatgacaaggatcactggtacaggttgggaattgaggctctgaggcagggaaatgttggtattgttgaatatgcataccagcggacaaagaattttgacaggcttgcttttctttatctgctaactggttacttggacaaggtgggcttcatgtctaagatagctggccagaataacaatttgatgggccagttccacaatgcattgtatcttggagatgctaagaaaagagttgagatcttggagaatgcaggacagctacctctagcatatgtgactgctgccactcatgggctcactgaaattgccgataggcttgctggtgagttaggagaagaggtgccttctctacctgaagggaaaactagatcacttttaatccctccagcacctctcacagcttgtggtgattggccattgttgagggtgatgcgtggtatttttgagggtggactagatgctactgggagggcagagcaggaggaagattatgatgatgctggtggtgactggggtgatgaagacctggaaattgttgatgcaagtaatgtgatagaaaatggagatgccggccatgccgatgaaagtgaaacaaatgaagaggatggggatgaggaaggtggctgggaccttgaagatctggaattgccgccggaggcagatacaccaaaagctagtggtccggaacgctctgctttgttcgtggctcccacaccaggcatgcctgtcagtcaaatttggactcagaagtcatctcttgctggggagcatgctgcagctgggaattttgacacagcaatgcgtctgcttagccgccagttgggcatcaagaactttgctcctttgaaggctttgtttcttgatgcgcatatgggcagtcacacctttctgcgtgcgtttgcaagtgctccagtgatacctattgctgttgagaaaggctggagtgaatctgccagtcccaatgtgaggggcccacctgcacttgtgttcagctttgcgcaaatggacgacaagctgaaggctgcctacaaagccacaaccgagggcaagttcccagaggcactgaggcagttcctcaacatcctatacaccatcccgctcctcgtcgtggactcgcggagagaggtcgatgaggtgaaggagcttatcgagatcgtgagggagtacgtccttggtctcaggatggaagtcaagaggaaggagctgaaaagcgacgccacccggcagcaggagctggcggcatacttcaccaactgcaagctgcagaaggtccacatgcgcctcgtcctcaccagcgccatgggcctctgcttcaagggcgggaactacgccaccgcggcaaactttgcccgcatgctcctggacaacggcccgaacgaggcccaggcgaagaaggcccggcaggtcctgcaggcctgcggcgacaggaaggacgcccaccagctcaactacgacttcagaaacccgtttgtcgtctgcggggccaccttcgtcccgatctaccgcgggcagaaggacgtctcgtgcccctactgcgcgtcccggttcgtgccctcggtcgagggtcagttgtgcagcatatgcgagctctcggtggtcggggcggacgcctcgggcctcctctgctcccctacacaatcgagataagataagtggcgacgacttcgcccccgtgttcatcatgtttgtattatctccagttcgaagactgttgtgtcagttatattctacctaccagagatttttatcaccaacttgcgaggaataagtatagtataattgcgtcgtttcttccccctttttttctgtcatcgatcggtcgtggcctgatgcggctgcggtcggtcaatcaacaaacggtgtaggatttttggacagacacattttttagggcacaatgatgatgtatttaaatcgggatttcgttatatgatgtactgcctagctagtttgtgtaatgtttggctggttttcattgctttttaatc

SEQ ID NO: 15250 - DNA, 1408 bp, Triticum aestivum
  Clone ID: PAT_TA_15250
ctgcgatcaagtctggcgtccggccagttctgccttctcaaactggccagactccagaggaactcaactcagtgatgctgtcttcgtctggacccactccacttgccactccaactcctggagctgttccaagctctatttctattccgcaacaacctcttccaatgttccgccagcctgtgggtgtacatgtaccccattatcaacctagctttatcccatacaatcagtatatctctcctttctatgttccaccacatgcccttcaccatttcatgggcaatgctgcgtttcctcaagctccttcacctggaagcatgtatccacctgtaagttcagctgttgcacccccagtcaaatactcggccacagcatacaaacctggtgccaacaccggaagccagacatatgctgtaacgcctggtgcctatggaacatatggttctaatccatcagtctatacaaataacaatgtggtggcaagtggaacttcggcagagaacggtgatgtcagtggatcacaattcacatgaaaatgcgtccgatattgccggacagcagagtgaaggctccactgtctggattcctgcacccggacgggacctatctgctctccaatctagctccttctatggcctgcctccacaggggcagcacctggcatttgcccctgcccaagctggtcatggtgcctacggagggatgtaccacccagcacagactcttgctggagctgcaggtcatcctcttctccagccatcacagacaattgctggagctgttgaaatggttgggccgcctgccaatggttatcagcagccgcaacatgctcagatgaactgggctaactattgacaacaggcagtatattcttgcgagtagccaccataggatgaacaaagagagcagtcatttgttggatacctcaaagtgttggtaaaggaagttttccagagttttcagcatagggggtgcctgatcaagagtgtatatatcatcaagcatgggtgatttgcagggaagggttgcagattcccagatggtctaagtgttcgttcgtcactggtttgatttgtagcaggaactgaccattatgttagacaacgagggtctacgcaggtacccgttcttttgcctcgcacccccacatcattttaagttttgctgcaaaaaaagttccaagcttcgtctctcttgaggtaatagatgctctggacttcggagtcatggtatggaagtgagctagggggattttcattctttccgctgctttacatgtaaagtagtaaattttggtgctacgaggacatgtctgtactgtttgtacttgggtgtaatatgaacagtagtataaaccaatcccgaagttgcagcaaagctttatttcttttgaaaaaaaaaaaaaaaa

SEQ ID NO: 15251 - DNA, 756 bp, Triticum aestivum
  Clone ID: PAT_TA_15251
attcggcacgaccccccgtccgcatcgtgtcagtctcgactcgccgtctccctcctccgccaatctttctctctcgccgccgtacgtcgtccggcgccgcccatggccgagtaccacctcagcgcgcagctccacggccacgaggatgatgttcgtgggatctgtatctgtggtgatgtgggggtcgcaacatcgtcaagagataaaacggtgagattctggacgcagcacccggaaaagaagcgcgaatatgtcctctcaaaaacacttgtaggacattccagttttgttggcccgatggtttgggccccaccttctgatcgctttccggaaggagcgattgtttctggtggcatggataccctagtattgctatggaatttgcatacaggagaagttgttggaacaatgaggggtcacacctcacaggtgactggtcttgctatcgacgacaacggtgacattatatcttcatcgatggattgtactttaagaaggtggagagatggcaatgctgtagaagtttgggaggctcataaagttgcagtgcaaactgttctaaagctgccctcgggagaactatttacgggttcaagtgattccaccattaaactttggaaaggaaggacttgtctacatacattctctgggcatgcagacactgttcgatgtttagcacagatgccagggatgggtatactttctgcatcacatgatggaactataaagttatgggcattaactggccaacccctg

SEQ ID NO: 15252 - DNA, 1335 bp, Triticum aestivum
  Clone ID: PAT_TA_15252
cggcacgaggcacaaactcacaagctactactcacagtgcacagcacaagctaactaaggtagcatcatggcggtgttgagcagggcagcgatggtgctgaccatgatgggcctcgctgccacttcagccctttcacagccgtcgttgatctccatgaccaccgacgtgccccttcccgacggcctgtcttacgacttccacgccttgtcctgcagcaacctacagaacatggtgcgcgacgccgtgcagggagcgatggcaagggatgccggcgtcgtccccggcctcctccgcctcttcttccatgactgcttccctcagggttgtgacgcatcgatcctgctgacgggaggcaacagtgagcagaacatgcctcagaacggtgggcttcggaggagcgtgctcgacctcatcgagggcatccgcgcaaccgtgcaccgcgcatgtgggcccaccgtgtcatgcgccgacatcaccagcctcgccaccaaggaggccgtcatgcagtccaggctgccgggttatgacgtgccgcttggccgccgggacagcctcgcgcctgctacggcccaacaagtcgggatcctgcccggacccgacttcaacgtcgagcggctcgtgagaaccttcgccgaccgcgggtttgacaagatggacctcgtcgcgctctctggtgcgcacaccgtcggcaaggccagctgcggcagcttcaggaaccgcgctggggagaacgccgacttcgtccgcgtgctccagcaagtttgcgccagaaaccctggccacttgcaggacctcgacgtgaccacccccaacacgttcgacaataggtactacaacaatcttcaggtggggaggggagtgctcaactccgacatggcgctcacccaggacggcgagaccaggaactgggtcaacaacttcgccgggaaccaggggtggttctttagccagttcagcacctccatgaggaagctggcgcatttgccaggaggaaacatcggcgagatccgcaacaactgcttcaggcgcaatgggaatggagagtctgtcgtcctcgccgctgagatttttgcggcctttgcttgacagatcagattgatcataccgttagcgccgtcgactgcatgtatgatcaacggcatgtcatgccatgcatgtaataagagcttgctacatagcttatgttttgcttgattgcaagtagcgtatggccacgtagcatagagccactaggcaggccccctggatcgtttcagttcacaaactatcttaatttccttactttagctttcattatcctttgtgtcatggaaagttaattactgtcagcgtgc

SEQ ID NO: 15253 - DNA, 2503 bp, Triticum aestivum
  Clone ID: PAT_TA_15253
acaagcaaagtccctcctccccacggaacggagggggtagaactttgtatctgcaaagacagacgtagtcttatcatcgctatttattttcatcagatgaggacttgggagtggtattgggtttctgctggaagtcaatgaagctggcgtcgaagttaatacagctgaccgctggtagctagaaggattttttaggctttgcggttgattgtgcagctgacgaagcggcactcatcttctgagttaccagcctgcaggcacgagtttttggtgatatcgcatttagccacaaaggcatccccgcatttgctacttggataacggcagctgggaatctcgaaccgcgggaacttctcgtgggcaacgaatcatcatctttatccaaattgaaagccctgaaaaggagtctgcagcacccagaaacgttcccggcagaactcacgttatcaacaccctcgcgtccggtttatgatgcgttgaaggacgcgtagcagccaaaggcgtccgcccatatcccgttttgcggcagggccatttggtacgaagagtgctcgtggcagagcgtcctcccgcatctgcggcaaccgtcgcgacgaggaggagaagagagcgacacgggagccatgtcgaccggtggcgcagcgtctgcggcggcggaggcgatggcctcggaggcgtacctggcgggcgccgctgtgagggaggcgcgggagctggtggcggagctctgccgccacttctacctgcaggggtgggtcaccggcaccggcggcagcatcaccgtcaaggccaacgaccccgccgtgcccctcgcgcagcagctcatcgtcatgtccccgtccggcgtgcagaaggagaggatggtggcagaggacatgtacgtgatgtcagcagagggcaaggtgatatctgcaccagtagcaaagccatggccatacaagcatccaaagtgttcagactgtgcacctctgttcatgaagtcttatctaatgcgaggagctggagctgtgattcatagccatggcatggagacttgcatggccacgatgctcaatcctggtgcaaaggagttcaggataacacatatggagatgattaaaggaatcaaaggtcatgggtacaccgatgaattggtgattcccataattgaaaatactccttatgagtatgagctcacagactctctagctgaagcgatcgcagcataccctaaggcaactgctgtcctggtacggaaccatggaatttatgtgtggggtgactcctggatcaatgccaagacacaggctgaatgctatcattatcttcttgatgctgccatcaagatgtatcagttagggattgactggacaactcctgagcatggtccaataaacagtgccaaaagattgcgtagtgttgcaagtcctggggttcctaatggatgtcatacagccaaatcatcaaagcattgtgttgtacttgacatcgaaggaacaacaacaccaatatcatttgtgactgatgttatgtttccttatgcccgtgataatgtgcggaagcatctgacttctacatacgattccgaggaaaccaaagaagacatcaaacttttacgcatccaagtcgaagaagacctgaaaatcggagttgttggggctgctccagttgcaccggatgatgctggcaaagaagaggttatcagttctttagtcgctaatgttgaagcaatgatcaaagcagaccggaagattacatcattgaaacaacttcagggacatatatggaggactgggtttgaaaggaaagaactgcaaggagttgtttttgaggatgttcccgaggcactgaagaactggcaatctcagggtatgaaggtttacatatactccagtggcagtagagaggcacagaagctactatttggacatacatcttatggtgatctgcggcaatttctgtgtggttttttcgacaccacaaccggaaacaaaagagaagcaaggagttattttgagatctcgcaatcacttggggtggacaatccgtctcaaatcttattcatcacagatgtgttgcaagaagccgttgccgcaaagagtgcaggtttcgaggtaataatctccattcgcccggggaacgcaccgcttcctgcgaatcatggcttccggactatcagttccttcagtgagatctgacaaatgtgcaagaaacgaacatgccagggaatctctattgggtgtgtaacatgacagtgcttcgtggccccctggatcatgttcttgtaatagtagtatagagcctttcgtaggcatcggattgcaataaaacaagggtggcagaataaaagaggaagaatttgcatgtagtcctgtgcatgtaaacgtgcgtatgtgtgtgcttcagtgattgtactttgggtttttgggaaatccgtgtttgccaatgggagaacagaactttgcctctgtccaccaatgaccaagcccaaatagacagatttttttcgttcggtctaaaaaaa

SEQ ID NO: 15254 - DNA, 754 bp, Triticum aestivum
  unsure (1)..(754): unsure at all n locations
  Clone ID: PAT_TA_15254
ctgcgctctactaaaggctagcgcctgagagaggccttacggttcatcttggttgggtcgatcagtcacgatggcttccggcgccggttcatgctgggccctggtggtgctgctcctcgccgcccgcgccttcccggcggccgccaccagcttcaccgtcggcggcaagtccggctggacgatcggcgtcgactacaccacctgggccagcggcaacactttcaaagtcggcgacagtctcgtgttcaactacgccaagggtctccacacggtggcggaggtgagcgcggccgactacctggcgtgcgcggcggccaacgcggtcggctccgacgccagcggcgcgaccaccgtgcccctcaagaccgccggaaagcactactttatctgcaccatcacaggccactgcgctggcgggatgaagctcgaggtgactgtctccggctccggctctgggtcctcaacgtnnaacccgattgccaacccgaccaacgccgttcacgaagtccgacccaaacgaacaacgaacgccnaacacgccgtttaacnaccctaaaaacgcatacaacacgccgaantctccaacgntgaantggaacaanncctggcgcnannccctttaaacgggtttccccaagaacaatgcntttaataattaaaatggggccccccnatttcccccgggggggtnggnnaacttttcccggttttnnccccggttttaaaccggngnttttaatncnagggtgccaaa

SEQ ID NO: 15255 - DNA, 942 bp, Triticum aestivum
  unsure (1)..(942): unsure at all n locations
  Clone ID: PAT_TA_15255
ggccccacctccctccacggcgccgcaccaccaccatcctcccccgcggcgccgccccacctccctccatcgcgccgcaccaccactaccctcccccgcgccgtcgcaccacctcccaccaccgcgccgcaccactatcctccctcgcactgtcgcaccacctcccaccaccgcgccgcaccaccacctccccccacgccgccgcccacctcccaccaccgcgccgcaccgggagctccctccctcgcgctgcccgccccggccaccacgacggatccgagcagcccccgccatcccgcgcccaaccggtgatggatccgagctcctcctccacatgcctcctcccaaccccatgctgttcatctcgatgtatcccccagatccggtgagacctcgcccattcaggtggtgcggctcctggtggggatgggccagatcgagcccggccatcaacggtgacccctttcggcctagatacatggctagcggcagtggctgggccagcctctcctccttcctcccctgggtcaagatccatggtgagacagctgcttgctttcttatattttgctgggatccgttctcacgcatggggatggccacattcgacaaaatgcatcttcactttcaggttcatccatggggttgttctggcatcggccaggacgccaggttgcggtgcggcaccgatgccatgttgttcgggggcgatacatggtgtgggtcatatcgcgcatgcagtttggagcatgggaacatgcaatgcaaaaatgttgcgttttgtgtataaaaaatacgaactcatttgaatgcaattcaccctagacatgtgtcagcaaatgcatttggagtatcgcacatcagtgaaacgtgctttgggtgaggatttagttaaaattcgggaccctgtggttgcctatcgagaacggggcgtgttangtt

SEQ ID NO: 15256 - DNA, 503 bp, Triticum aestivum
  unsure (1)..(503): unsure at all n locations
  Clone ID: PAT_TA_15256
ggaggcttccccaacgggggaggccgaagggtccaagaagggaaggacccttcccccggacagctccgccaacgccaacgtntgcgacgaagagtggccctctagggccaggcctccggcaagatcgtaagtgtccggattcctgaatgatttataatttctcttttgtgccacgtggtgtccttccaatgccgcatacaacctgtagtccggccaaggatgatcttcccgcttcatcgagcgggtccttggctccgtcggatatggattcccttccgaccgcctccacccctcgtgacgcaaatgacgcctatgtgggatcctaagatgggacccaccgggaggatgaggctccggaggtgccgcaaggcaacctcccagacttcgcaccggactccgcaccggaatccgcagtggttccggagtccggcaagcggccccttcgtaagaagggcaagactgtgacaccggcggccaccgtccaaccggtggcgccggataac

SEQ ID NO: 15257 - DNA, 609 bp, Triticum aestivum
  Clone ID: PAT_TA_15257
cggcacgtcgccactccctaatcctaagcaagagaaacatcagagcagagcaaaaacccagccatgaaggggacggcaccatggcgcaggctcgccgaggccgaggccgccgtgaaccgctccgtcgcggcaagcaccgtcggcaagtacttcaagcttgaggcccgcaagagctccttcaccaaggagctgcgcgccggcgccgccaccttcctcaccatggcctacatcatctccgtcaacgccgccatcctcaccgactccggcgggccgtgcaccgtgctcgactgcaccccggtgggcaactccaccgccgttcctgggccggagtgcacgctgggcacgtccaacccggggtacgagcagtgcctgggcgcgcaccaagagcgacctgatcgtcgcgacggctgtggccgccatggtcggctccttcgccatgggcactctcgccaacctcccgctcgcgctggcccccgggatgggcgccaacgcctacttcacctacaacatggtgggcttccacggctcgggctccatcccctaccgcacggcgctcgccggcgtcatgctggagggcatcgtctttcttctcctgtcggccgtcgggct

SEQ ID NO: 15258 - DNA, 703 bp, Triticum aestivum
  Clone ID: PAT_TA_15258
ccacgcgtccgcccacgcgtccgcacgctctttgctcctggaggagaagaaagcacgatatacgtgggagcgcagcccaaactggtcgtcgaggtggtgatcgctcgccctgccgcaggtttcgatagccgtgtatccgcgtcccccagcccccgaaggcagtagtggagcaccgcagcgtgcgagccaacgcaggcatggcgacggcggaggcagacgtcggcgcccccgcgagcgtgacggcgccgatgatgctgcacgggcgcgtggcgatcgtcacgggcggcgccggcgggatcggctcggccgtgtcgaggcacctggcgtccctcggcgcgcgcgtggccgtcgcctacgtcggggacccggcgcccgcgcgggagctcgtggccgccatcaacaacgccgcgcacgccggcgaccatggcccgcgcgccgtggcggtggaggcggacgtgtcggacgcggcgcaggtgcgggcgctgttcgacgcggcggcggcggcgttcggcggggagctgcacgtgctggtcacggcggcggcggtgatggacacctcctacccgccgctggccgacaccagcgaggcgacctacgacgccgccttcggcaccaacgcgcggggcaccttcctgtgcctccgcgaggcggcgcgccggctggcccgcgacgggcgggggcggatcgtcaccttctcgtcgtc

SEQ ID NO: 15259 - DNA, 1277 bp, Triticum aestivum
  Clone ID: PAT_TA_15259
gccgccagcacgaaacaccggcagtagcaggcagagctaacgccatcatcaccggccaacataaatatacgagtactaccaccacggcgaacgttttgctgccactacccagctactagcagtacgcacgcacgtagtgcgccggcaaaagcaatcgaaacaggggttaggtggaggcgagcgagcgagccggcgggcggcgtttggtttcgtcgtcggcggtagtggtaccgaccaccgagcggaggcgatggagacggtggaggaggacgtggaggagtacagctggagggaggtggtgctgccgcgcctcatcccggtggtgccccatgccgcgccggagctcgagcgcgagaccggggagcgccgccgcggcagggacctcctcgtcgccatcgacttcggccccaactccaggcacgccttccgctgggcgctcgcccacctcgcgcgcatcgccgacaccctccacctcgtccacgccgtctccagtgtgcataatgaactggtatacaacaaaagtcaggaactgatggatgagttggccgtcgaggcattcaaggagtcactggtccacaccaaggcacggattgttgagggagatgctggaaatgttatttgccgagaagcagagcgactgaagccagcagctgtcattattggcacacgtggtcgaagccttattcagagtgtgttgcagggaagtgtcagtgagtattgcttaccacaactgttaagcagcaccagttatcatttgtccccagagcaatgcagcggggtcaccggtccgcgcctaaggcacggattctttaaggggatgccggaaaggttattggccgagaagcagagcgactgaagccagcagccgtcattattggcacacgtggtcgaagccttattcagagtgtgttgcagggaagtgtcagtgagtattgcttccacaactgttaagcagcaccagttatcatggtcccaggcaaagaagctggtgaacagtctgtgctttaaagaggggacgacaagtaggagacaacggtgcactggtttggtgtcgcaccttcagtttaatgtaatttatctgataagatgtgtgcatgctgttgttctggatttgtttgtagtgagaatatttattctgaacaaggtagcgagaacatattgtaaatgcttttgctgtaatctgaaccatttgtgtagctcggcagtgaagaattgcggattgcttatgatttggtccctcggccacgaaaaaacaaaacttcacacacaaaaaaaaa

SEQ ID NO: 15260 - DNA, 601 bp, Triticum aestivum
  Clone ID: PAT_TA_15260
ttcggcccgaggcgcaccctccgccgccggcgccctcccgcccggcccgcgccccgccgccccctcccccccgccggcccccgcgccccaccccggcgcggcccctgcccccccttcccttgggccgcagcccccgctgcgtcgtcctgcacgggcgacccccgtcccccccccgcctccagctccccgctccgccacctgccgtccgcgccgcgccgggtgccgcagcgccgctcgccggggggcccgctgcaccgcctgcttgtggggtggtgcccgctgcccgtcgtccggcagtggcgccccctggcgccgccccgcctcctggcctctgcgggtggctcctggtcttggggttgccttgtcgggcctggtctggttccgggttctcgttggttttgcgtcgctcgtgggatgggtcgtgcgtctgcccaggtgccgatgatgccagtgcaggtgacgcaacgcagctcaagtgggagcttgttgaagatcttggttgttgttttatgtttttatccggttgatcggtagtgcagcccagttgggacgatcggggatctagcatttggggttgtcttcttttattttggtttcgtag

SEQ ID NO: 15261 - DNA, 621 bp, Triticum aestivum
  Clone ID: PAT_TA_15261
acaaaccaacaaactagtacttctactactctgctgcgatttgcgacgagcgaatcgcggctagcaggagttggaaagtggcggcccaagccccgcccgccccccgccgccgccgcctcctgctcctcctccccgccgcccccgcccccgcggcgtctcccccgccactccacctcgccgcgcccgcgggccgggggcgtcgggcccccggccgctgccgtcgccgaccgggcggctcggccggccggcgccggcgccgcccgccgcggtgcgcgcgccggccgccgccgcccggcgcccgctccccgcccggcgtcggcgtccccggccgcccgaacctcccgggtcgtctcgagtgggcctgccgcagcgctgcctcgggggactacgtcgcgcctcgtcgttgtcacccccgcgcccgcctgctggtcggcggcctgggaaccctacccacacatggctgctatagcggccatgccgcagcactggctggtgggacgacaatgcacatcgactttgtcattccagtgaacgggaacttgactgcgggcttggaatcctacaaacacaaagcagaaaaggctgctatggactatggatttcacatggccattaccaagt

SEQ ID NO: 15262 - DNA, 575 bp, Triticum aestivum
  unsure (1)..(575): unsure at all n locations
  Clone ID: PAT_TA_15262
gggaagaaaaattccccacctccctctccctttcccctccccgtccccgccgcttcgccatggccgccgagcaggtcgccaagccggccaccctcccgccctatcccgagatgatactggcggccatcgcggcgctcaacgacaagaacgggtcgaacaagtccgccatctccaagtacatcgagggcaagtacggcgacctccccaaggagcacggcgcgctgctgacggcgcatctggtgcgcatgaaggagtccggccagctcttcttcctcaagaacaactacttccgcacggacgcgccggacgccccgcccaagcggggccgcggccgcccgcgcaagcccatagaccccaacgcgccgccgccgccgcccaagtccgcgtcgccgcgcccccgcggacgccccgccaagcccaaggaccccgaggccgaggccgccaacccgcccaagaaggccanagaccgtcatcccgcccaangaaggccaaagacctgctcccgcccccgccgtcgacggatccgccaagcgcggccgcggccgtccgcccaaggcgcgccccgccgagccggc

SEQ ID NO: 15263 - DNA, 1375 bp, Triticum aestivum
  Clone ID: PAT_TA_15263
gcctcttcatcatcatagtcaaccaccacataatacaaaagatattagaggtgcaacagatagtcttgaagttaggccatttatcaggcatggagtcaattcatctgtatttgttcctcggcatctatatgatgcattggatcggaaaactgtaagtaccggtaacttagctcaaccaccataccagcacccagatttgttgtcatcgagtcaacagaatcaaggtacaaattttggaaatcaatctcagcctcatgatgtgccacagtttcatcctcattcccattcccatcctccggaggcatttagaagctttgcccccagcatgcctatagctcccccccaaaatccattccaaggacaaggaggtagtgcagcagtaccaccagttacacctctaccaaacaccttttctgtaacacctactgtgcaaccctatggtgtgtcgtcagtgtctagttttgctctgccaccattacatcgtggcctacctcctgcttcgttgcagatgggtccatcttcatcacaagttggtgggcctacaacatatttctctggaattttaagtaaccttatgaatcatggtgtaattacactggagccttctagtcaacctcaggactctgttggagttgacttcaatgtagacctcaaggtgcggaacgagtctgtcattaatgctctgtatcaggatctccacaggcaatgcaaaacgtgtggccttcgttttaaatgccaggaagagcaccgtgctcatatggattggcatgttacgaaaaacagaaattccaaaaatcgcaagcaatcttcacgtaaatattttgtcacagtgggggaatggttaagagcagcagaaacagtaggaaatgatggtgttccttctttcgagctcacggaaccaatccctgacagaaatgaagagaaagaaatggctgttcctgccgatgaaaaccaaacaacatgtgctttatgtcaagagccatttgaggatttctacagcgatgaaactgaagagtggatgtacaaaggtgcagtttacatgaatgcacctgatggtaatattgttggtctccaaaggtcgcatttggggcctattgtccattccaagtgtcgatctggccccagtaatatttcttaggtgggcctagctggaacccttgccccattatttcagtttctttggttgcggctagacaagacatgtaaaattactggagagatcagattttggtatgcttagtttcccccctctcctggcaacagtttgaatagaatgttaatgtgacaatagtagtgtaaaattgtaaaatacttgtgttttagtgatggagcatgagtaacttgctctgcaaaaaaaaaaaaaaaaaaaaaaaaa

SEQ ID NO: 15264 - DNA, 772 bp, Triticum aestivum
  Clone ID: PAT_TA_15264
ttttttttttttttgccccccaaaatgcactttattgatttgtcgcacaaacatagtaatacatgaaaatgggaagtaacaccttgaaaaggatctcgtacaagcaaaaaatcacccagaattgagaaaaaacaagggaacaattggaaaccccaccattaaaaaggctcatgcttggatggtacatggaaatgtgaacaaccggtgtctgctttcttattgatgcttgatacatagttatgacgttcgtctttgaccttatttgcatcaatagtttggattgcatacttcgatggtgatgtttgaaatgttcttggggctcgactgttgaacaggaaccaagtcaatgaacccagttgcatacttaaataacccagtccctccaacaatagcccactgaccattatccaagatgttgcccataacagcaaggctggagcccttgtaccttggatcctcgaacgttatcatgatggtagatatggagttgccggcaagaatgtggctgccttgtccacgggcgaacaccggacctgggcctgcgccttcataaattacccagtcattaacagcagtatgaccaaacttgtaatccttttggatcacagtggcttgatttgtgtcggccccattgccgatacggtgcaaggacaagttgctcatgatggtcttgttataactggtgggcataacccgggtgttggacaagataacagccgccatgagtgtgtgaagaggagagggcaagaaatagctaggtgcttgggatgtc

SEQ ID NO: 15265 - DNA, 836 bp, Triticum aestivum
  unsure (1)..(836): unsure at all n locations
  Clone ID: PAT_TA_15265
gncacgtatctcaagtggccccacccaccgccctcctccttcagcataccttatcgcttcagacgaccagagaccagatccactcatccacagatctcgcatcgctgccatcgcctccgctccgcatctcgcttccacctcatcccgcgcgtcgccgccgagaccctctgcaaccggcgacgcggtgccggccgggcatggccaccccctcccccggttatatcttctcggctgccccgccaccatttttccccttttgatgaagagaaatgccaccctctttttccctgtgctggaaccggcgggggaattgcttcaaccgacgggcggatttgcttcaaccggcaaggatggtggtgggcggcgacggcgatggcagagggaaaagatagtgctgggcggcgacggcgacgagcggcgatggttgaagcaacatgaaggcgaatctggtgttgcaaccatcacagcaacgaccgacgagcgaccgggatggcgagagtagatactgaaggcggagggaacctctactagcgacaatggggggcgagatgctgcaaccggcattcgtggtgctacatcgggcatcaccggaagctggaaccagcgttcccggtgctggaaccaatgcaccattttttgcatttttgctactacggttttgtggttgctacaaccagtgtcaatttttgctaccatcccctttttgattttgctggaaccaaggctcagttttgcatttttcctaccacctgtgtttttatttgttggaacaatacccaatttttgctaccaccaccgaaaaaagaggncaatccttatatgcatanngtacaacn

SEQ ID NO: 15266 - DNA, 649 bp, Triticum aestivum
  Clone ID: PAT_TA_15266
gataaacttaacacagtcacacaacccaatgtatgatgtctcctcgtgccacgggcccagtggtttgacttccgtccccgccgctttcggccgcttttcagccttaccctaggtacattaatgcatgaatatgccaagaataaacactgctgtctgtgtgtgattgctcaaaactttacgcagtatgttcccaaaaatatagccatcttctgcaaagaagcgatctcgctttgcatcggtgatatggcaaaaaaaatcctcatgcagatgcaacttaagataactgaaacgcgggctctgaattgtctgggcttggaacgtaactggagcaaaaatggcactctttttctctgcttcgaccgctattaacccactgtccatccacgttgtgcaagcacttcacgaacccgtgcagccacatcaatggcatcgttcagaggagggtagctccagctgtctgacatatcttccgatccagttaaaggacgaacagcccctcgtttctgcagagtgttgtggaaatctgagaatttccacctgcaatgctcagttccaacaacatagaccggcttcccagtgctgcacgcctcacttagcatacttatcgagtctgctgttatgatgaaagcatcggcccatgcaagatgcc

SEQ ID NO: 15267 - DNA, 735 bp, Triticum aestivum
  Clone ID: PAT_TA_15267
cacaaataaaccaatcacggaaactaattaaacaattgcattcatccttgtatatgggccaatcgttcggccctctgcctccggactgtatgcaccagcagctggcggtcggcctccttactccagccatcagcagcaggaggctcttctccgtataccctccgcctgccccagcttcctcggggcagcttctcctaccccttccccccaacctcctccggccctctccttcaacgtgctgccaccccccctgcaaccctcattccccgccaaacctgcccgcgccgccgctcatcagcaggatgttctttctaggaagtctcttgacttgaactctgatcagcagcatgttatccctaggaagcctgatgacttcaactctgaccagcaggctcttctctctgggaagcctgatgacttgaactctgatcagcaggatcttctctcttggaagcctgatgacttgaactctcagcagaaggagcacgtgggtagatgatgttgtagtgatttcccgtgtacagcagggtcacactcggacggggaaatccaggaccagtgtagatatctcgagcatatccttgttggaatcctcgcgctcgctccgcgtccgcgtccgccctggccatagcctcctccataacatggtccgcgtccacacgagctggaatgacctgctcgaagcaccaaacttccagactgcaatttccttggtcgacctctggtatattcggt

SEQ ID NO: 15268 - DNA, 1914 bp, Triticum aestivum
  Clone ID: PAT_TA_15268
cgtccgcctcgccctcgcccgcgcacacctcctcggctggcccctcccccactcggcccctacccgctcctggtcgcccgccgctcgccgctcgccgcttgccgcgccatccattggacttcgccatggacgcctccgagtacccgcacatgcaagggggcgcgtcgtcttcgtcgtcgtcctgccgcgccgccgacgccgccgcctgggacgccgtgcagcaacagaaacgccagcgctgccagggatcatcatccggtgataaagttggatcctgtacagaaaataactccttcaaagcatctgaagccgagctacagaattttgactctggtgaaattgaggaagaagattattatatagatgatgaagatgaaggctgctacgatgatgacaatgaaggatctgactatgaatttgatgaaagtgatttcaatcagcagctggctgataaatttgatgatttagatctgcctcctggtgtggaggcttctgtaccatggttgcagaaagctgcaactgatgacggccctggcaattttaagtcaatgtcagaaatagaggatgaaattggtaagaaatacaagttcttcaaacagtttgacactgttgaggatttctctgatcatcattatgctaataaacctgttggaaagacagggaaagagtggacaaaaagaattcagcatgactggaaacttctggagaacgatttaccagcgtccatatacgtccgtgtctcggagaatcgaatggaccttctcagggctgtgatgattgggcctcagggaacaccctaccatgatggccttttcttctttgatgctcaatttcctgctagttatcctgcaagtcctccaattgtatactatcattctggaggacttaggcttaatccaaatttgtatgcttgtggaaaagtctgccttagcctcctaggcacgtgggaaggtcatggttgtgagaagtggaactcagctcactcaaccatgttacaagtgctaatctccattcaagctctcgtattgaatgagaagccatacttcaatgagccaggatatgaaacatatgccaacaatgctagtgggcagaggactgccttggagtataatgacacaacatttcaatactcatgtaggacaatgttgtactcgcttcgtagggctccacagcactttgaagatctcgttgccggccacttccgtgagcgcggccgtgccattctggctgcatgcaaatattacatggagggtaacaaagttgggtccatggttcctgacgaggatgatgaggacaaggaactggaaagcgcaaatgcagaaggatccagctccagcagtgcagtgaagccaaagaataatcaggtagatttgcgtgcaggcgcaggtgtagttcgccctgcatccttcaagaccaacatggaggttctgtttgaagagctcctgatggagttcaatgtgaagggtgctgacaccaagaagttctgtgccgagaagttgaagaagagccagcctgctgctgcttgaaggatccggctgcagcaccagatatctgtggtggttccataatgggagtgaaatccataaaatgatggtttcatttcttgcctaactataggaatgctatgtagatagctctttttttgcgccctttgccgtactggtcctgtggactcggaactgggaaaaaagtggtggttttagatgctaactgaagcgtccacccccttagctttggaatatcgtttgcttatgagttactagtacgtgaggctacatgttcattatgtcgtgatttagttgttcatgagatcctccgaaaaaaatatcctaaaaaaaaaagtaggaagcgagagggcgtgtcaatacattcagaaggatagaacattggttcctgttagtcaaaaaaaaaaaa

SEQ ID NO: 15269 - DNA, 866 bp, Triticum aestivum
  Clone ID: PAT_TA_15269
gcgatggagctagatccattaatcaaatttgaatctctcaaaatatacacatttcagatttgggggtttgaattggtgagacttgtccaatccaaaccaccgccgacgtcgataaagacaggcatcacagacggtgtagcacaacataagggataagggagatgatcgcgcgtgcgattctcaagagagaatgctactccacttactggtacgtgaattaaaccaggagaccaatgagcacaataacttgtagcaactccttattcatcaagacaacagctcatttctcttggtccggattggactgcttagtgtgatctgaatgcatcttaaccaggagaccaatgagctgctcttccaggtcatcttccttgctccgcctgctcaacggtcgtcttcccgcttgctttgtgaccatgacaaccacgtctttgtagttcgctagctcattcgccaccaccacattcataccatactttctcaaagccgcctcttgccttctgtataaggatgtcttggatccgtctcgagcttgaaggatacacaaaatgcagaaggggcccaatggtttctgaggatgaaaagcatcttaggaacttgacttgagctgcatgttcaaagggccacctgctgactggattttatgtttagccatactctcccatggaacatagaagtcagacactgcagctgcacaataaaacattccatggcgctccaagcaattcatagcagtggatacaagctgcagtaactgaaggtactcaaaaattgtggtgaaaggaagtttcagaagtagaccttcatcgattgccttgcgataactgctgatcgctgtcttgaccaccgtggtgtgagactctggg

SEQ ID NO: 15270 - DNA, 958 bp, Triticum aestivum
  Clone ID: PAT_TA_15270
attcggcacgaggccagcctgagctcgggcgtacgtgcggtcgtatccctctgggcctcgccaagtgtcagcaacaagcaccgaacccctcctcccccacccgccaccccttctcgccctgctcccccgcaccctggcggcgacgccccctgccgccgccgccgccgccgcgggcggggcgcacagcgtgttcgtgtacgggagcctcatggcagacgaggtggtcagcgccatcctcaagcgcatcccggcctcctccccggcgctcctcgccaaccaccataggtttaacgtcaaggatcgtatttatccagcaatcctacctgttgaaagcaagaaagttgctggaaaggttatcatgggtatttctgacgcggaactcattgtcttggatgcatttgaggattttgagtatgtaaggagaagagttcagatatcactaaccgatactttatgtatgatgcatgctgacacttatgtatggagtgatgcaatggatccttgagggtatggtgaatgggatttcgaggagtggacgaacgttcacatgaaggatttcctaacgatgacactcggattcatggacggactcgaacggcccgtaccagtctttcatgcacgagcacgaacaacctgaatcaggaacccaggtcgagagttgagttaggatcattcttcatgaagaaccgattcgtcagtgttctgtaatagcgttatctgaaacagcttatatcctcagatttgtgaataagatctttataggatcattctcactgaaactaattcgaatacaatctcttctgtgagacccctgatgatccaagtagtgatgtgtatcagaataaaatcctttctgctagaattgagatgaaataggtgctgttaatgcatgattttacaagcaaaatgaaaccatcttatattctgcgaaaaaaaaaaaaaaaaaaaaaaaaaaaaa

SEQ ID NO: 15271 - DNA, 1312 bp, Triticum aestivum
  Clone ID: PAT_TA_15271
gtcatccgtgctatatgatcatgcagaatcctttcagaatcagttctgaagttctggactgaagccttttgttgtttcctggaccaaatgccgctatgtactgaaatgttaatagattgataaacacaactaatattatgctattttttatatatatatttgcaacgcttcaatgattgtattaccgaattggatatgactatacctggcagcatcgctgcctggtgcggcaagccgcacttcctacctagtacaataaaatggtagaggcggattgtggataaaagaaaaaagttgtagtctagcatctgcagctcttgtttcctaaagaatcaattttgatatctcagtgtagaatgaaaattgtacaacctacaaggtcaaaccgcctacgcaaaattgaactatcacttgtaaccaaactcagacacgaatattggcacagtgcaccctgtggagttcatgaactagatgaggaaattatccatcatgtgattgataacgtctgccccatctgagttaagccaatagctctttacctggatggtgttatgcgcaaccaatctttgactacttttctggaagctcacatcaacacgttcccactgcagttgtgttaggcctcttatcatctcctcttctgggccacagagattagcactcacttcggtttcatttctttccataattcctctatcaacatggactatatgtggatacttctcatcacgaacaagaaggcgatgttttggcaactcgtgttgacgccggattgacgatgttctccaacccaccatatggtcaaaattggcattcgcatatgccacacgtcgtttgaaagagcgcaatccggatctgaattttatatcatcatgatcctgaaccatttgaagaaggagtggacgcctaccatcatcactgtctgtaaggaataaatgctttccagttcttccaacaatcaaatgtgcagtttctgatgctcttcgctccagaaaatgcaagccacatagaaaggggagctggtggaagaatctgtttgtttccacttgaacccagatgtggtgatgcaaaggttataaagttcataggttttaagccggcaatgagaccctccaagcattcaacttgctctctgttgttcccaatggaacatttagttctgttactacattcgtaaagccttcctatagcatatctggcaacaagaccacccagagagtgcgccacaattgagatcttcttcacacctcttctttgctcgacaactgatagaacctatacgggttccgttaggataaatatgcctcgtgcc

SEQ ID NO: 15272 - DNA, 688 bp, Triticum aestivum
  Clone ID: PAT_TA_15272
agtaaccaacggcaggaactaacagcaaacaacaatcatgtgtacattcaaccagaaaactttgcgccgttcagaaacagcatgctgccgtgactaagtcaaggtcttgctccaaacacttctgaccacaacaccccagaggcaaagagcgatgtgctactagtctagtacaacatacatatagccactgttttttgcaaatgtacaacttgaaccaggagacttgtttctgtggggtttctctgattcgaatcgtcttgggtacgcgtaattctgacgcctgcctgccaaagcagacggatgctactccttgaacccgaaatcgtcaaatatcccctcggggtcgtttatcccatatgcaacacaatagtgttcctgcatcatatgccactcttcaaactcatcaaacagctctagcagctcaatcctacgcctttctccaccgtcaatgaaatcattgtatattttcagcatatcccgggcaacagctctcttccatccatgatcgagaaaaagtttctccttgtgacttaaggttggtgtagcatttatgccaaggagcgggcatcctctactctcgagattcctaatcatttgctccccaaatgcatcatctggatggatctgctcatataagaaaaagattgcactggagaacttttcggatgcccaactaacaataacatca

SEQ ID NO: 15273 - DNA, 592 bp, Triticum aestivum
  Clone ID: PAT_TA_15273
aaatttgagaacatactccggattgcaaatgttcagaccacttagaacaataatctctaggtcgtccagacaggttgaaccatcagatgtttactaaaattgtacaagttgacatctctactacagatgccacccagtcacatactacaaatagttgataacattacaacgacaagatcagaggcatcatcggcccagatccaagatgagaggatgcaaacacggatcctctgcgatataagacccagtggcgacaactgtcaactcgcgtgcacatcatatcacccagtggcgaaactgtttctgccgagcctcacgagacctgctctgggcagtgggcacagagcatgggtcaatgttttcctgacaagttagagtacaaacgcttggagtctcagccttgcctcagttactgccttcaggaactcctccgtaggattgtctttcgcggctgctagagccgtgacgtaggctgacatttcctgctccatcttctccgtgtcaatatcacctaccgtatcatcaagctgaaccggttcacattccaacaatgaatcgtcaggtctctctgtgggatgagagactcggttgt

SEQ ID NO: 15274 - DNA, 886 bp, Triticum aestivum
  unsure (1)..(886): unsure at all n locations
  Clone ID: PAT_TA_15274
ttatattataaacagtacgagcgatacacatccaacaagacgtccagctaacttgtgttctacggaaaaataattccagccaaccagcctgctacggtacagccaatccagcctgcagattctttttctattccagtaaactaaaatgaacaattctcggattctgacacaagatcacaacttaggagtatctgacgacaacagggattttcagattgcaatcaccttctatttttcctggtgcttcagagtatccatcagcgaaactctgttttcattctggcaccgccggggacagcaatggcacaagtagagaccattgactggctcacaacttgtgaagaagaggaactccatgtcctggcagactctatttatgctgcttggaatatctattcagtctactggcacagtcttcccctttcaaacagtagagctcggacgccctttacggagttttagccnatcttcgagcataaaagtcagaaagcccccacttggcacatttctcctccaaaatcctcgaacaccaatttgnttgagccgaatgcctcgatgcaccggatagaagttgtcgtgtcccatgattctggagcaacccgctgcgaaattgaccgactgtctgcctgcaaacgccgaccgtgattaacaagcaatgcatggtagagctatgtagattggtggttaaggagagctgagctgcaatgattacctcgacatggagcgtctcaagacatgggaagcatttgagcaactgagcaacgaaggtggtatgtcccttctctgagaagggcacttggatggccaaggtcttcacgctgcacatcagggtagtggactgcaagatgcctccctgcaatatgcaaaacatgacataggaagcaaa

SEQ ID NO: 15275 - DNA, 932 bp, Triticum aestivum
  Clone ID: PAT_TA_15275
ggattatttactgaaatataatgtccagataccatctcgtggacaactttacagttattttctcaaagttacatgtgtggttatggtgatatagcttatgtgtggaacatttgcacaaactgtacgctctctgctaattgaatcagcagaggaaaagcttcatgtcaaccctccacttaggactaacgcggcttggctgatgactctagcaatcctgtggatctcatgctgtacagattgccacgactcggtggtatttgctttctttgcggtctgaatggcatcatcaacacctggatacacttccgctccataatcgttgtacagtgaaggtccataaatcatgtgtttgtaccatggtctcccagacagtccttccctctctgtgaatgcccgttcggtcatcatcagccggtcattcagatctcttaccctcaacgggtcgtttcgccacggggaccaaaatttccatgtttgcagagcctgaagttcagaatccactttcagcactgctctattgaactgtttgatcgacttgtggaggggagataagctgacaggcattcctagtactctcttatttatatccactgcaccattctcgagctctgtggcataggaactgtagttgaagggtaggatctcctcatctgaaagcctcaaagcaacaagcccccatatgcttgccactgcaacatgcctgcggaacatgggatctccatacttttccatccatgtgaagtcatcatacaagctgtggtaaactgcgtatcctgacccaatagccatgtcgactgaaggaataccaatatgttgaacaaaggcagaataatctgatcctccacctcctaaccttccaatcagagaactatcagaagccatccacaagtcatacagactttctgttccattatccggattttgaacctttt

SEQ ID NO: 15276 - DNA, 653 bp, Triticum aestivum
  Clone ID: PAT_TA_15276
ttttttttttttaaccaactagttattcagcatgtttcacctattcctcttattctatttgtattggttttacctacacaaagaggcttacaaatgcagctacatctaaagccctgcacggccgtgttctgaacatactcatcctcatgctgccatcgtgtgatgtcagttcaacagaaaccatctccggtgagatactactagcgttgagatgtttcaacagaaactatcctctgctctttattagtcctatacttacaagaggtaataattatgcccatgcttacaaactgcagttacatctaaaccgctgtacagctgctccgaacatcttcggtgctttggcaacttgttctgcggaagagagccgggccgtgtgtgccaacgaatcgttggaccgtaatgtcagctaagcagaagctctaatgctgtggaactttatcagtatgcacctccctttcctctatgtacctgggaatggtcgccagggggcaggggcggcgaagaccggttaactccatgatcgtggttatatgctgacaatagaatcgtcattcgattgacaaaggcaatcaggaagagggttctcgtaaaatgcctcctctgaccgaaacctatcgctgcccctcgtcccggacacgggacctttccgt

SEQ ID NO: 15277 - DNA, 1130 bp, Triticum aestivum
  Clone ID: PAT_TA_15277
aaatcacggcgcgcctccgtccaccacctgtcccgtgcccgctgtccgcctcccgccccagatctccacctcccccacctcacctcccaagcagggttcgttcacctggcagcagtccggcagctgcagctctccgtggccacagagtgtcggctgggggacgaaatggcggcgcttgctggctccgccctgctgctgctcgcggcggcgctgctcctctccgcgccggccgccacagaggcgtacgattcgctagatccgaacgggaacatcaccataaaatgggatcttaaagagtggactcctgatggttatgttgcaatggtcacaatatacaactaccagcagttccggcacatatcggcgcccgggtggcagctggggtggacgtgggccaagaaggaggtcatctggtccatggtgggggctcagaccaccgagcagggcgactgctccaagttcaagaccaaccctccccattgctgcaagagagatccgaccgtcatcgatcttctcccaggaacaccgtacaaagaccaagttggcaactgctgcaagggaggagttataagtacgtttaaccaggacccagcaaatgctgcctccttccagatcagtgtaggtctttctgggactaccaataagacggttaagctgcccaaaaacttcactcttaagaccccaggcccgggctacacttgcgggcgtgctactgttgtgaggcccaccaagtttctcatcggtgacaggcgcaggacgacccaagctcttatgacatggaatgtaacctgcacctactcccagtttcttgctcagaagaccccgacctgctgtgtagctctctcgtcgttttataataacactattgtgggctgcccaacatgctcttgcggctgccaaaacaataatactcatccaggaagctgtgtaaacctcttgtccagtgcacttcccacatgtgcccggtaaaagtgcactggcatgtcaagctcaactacaaggactactggagagtcaaagtaaccatcacaaacttcaactaccgcatgaactacacagactggaacctggttgtccagcaccccaacttcaacaacatcacaaagctcttcagcttcaactacaagccg

SEQ ID NO: 15278 - DNA, 672 bp, Triticum aestivum
  Clone ID: PAT_TA_15278
ttgaacgagtcttttcgtgcggccgcccgggctggtacatatttatataatgaaaaattaccgtagaacaattgttctacggtcttggcttaaaaaagaagaagcatcgtatgatgtcgagtagcctgcgcaatgacatatttgtgcgctaaagatgagatgctgtagataggaaacatctacagtagtaacctggtataaaattatagtcttccgtctcactccgcatcggccactttcatgtgtttggaataacgtggggggacggaacagtttaacctacggaaaacacctagcgcagtctacccgagctagtgatcggagaatctccccgtctccgtgtgcctccccttgagaaaatccttgtacctcggccccgacctccctggatacctcttgagatcatcatcagcaaaatccacgtaatagagtccatacgtgtccccgacactaagtagttcatataaatccatcagcgaccaggcaaagtagcccctagtattcgaaccattcctgacagcagtgagaaggttcttaagatgttcactcaagaattccaccctagggccatcatcaaatactacatcttgatgcattggatatccattctcatggatatagattggaggattaccataaaattgcttcaaatgttcaagcacttgctgtatc

SEQ ID NO: 15279 - DNA, 670 bp, Triticum aestivum
  unsure (1)..(670): unsure at all n locations
  Clone ID: PAT_TA_15279
tttttttnttttttttttttttttttttttttttttttttgatagaaccaaaatataatagatcaagtatctcccaaagtaacaaagcctcaactagtcagatctcagtatcacatacaccatattatacgagtacttaaacagagcaaacaacaggttgcaagtacacttcaaatctgaatattaaatgtcatacacttctaaattttacagaaatttcagagagagagagaagcagtaaggattcggattcagagaagtgcagcagcaaggtaagggaggaaggagcagcagcagcaagttaggagcagcaggggacgctggagacaaggagcatcagtagtggtgcagcaagataggagaagaagaacagcagtaggcgtgtaaggaagaggagaagcagtttggggatttggagaaggaagagcagcaaagaggctagggaaaaagaagaagagcagcagtagagttaggacaagaagaaaggtggaggagcagcagggagatggattgcagggcgcgcgaggtggtggtggcgctancggcacgaggtgatggtggcgctagcggcaggaggtgatggtagcgctgggtgttggtgctggtgatggatggcgctggtgggtggatgaactgcggaggcacaccaccacgccggcctggccgtggc

SEQ ID NO: 15280 - DNA, 689 bp, Triticum aestivum
  Clone ID: PAT_TA_15280
gaggggtggtatcatattccgtgtccaggaccccaggatgatgttgttgggacggcccgtggcccagcccctgtcggggcaaccgcaccatctgcctttggtggtgcgcccgccctgctagctgtatgctctgcaactatagtagtcccagctcctagaccgacctcgccagcttcaactcctgcacggcatattgccatgtcaccggcgtaatttggggccgacaccaagctgctaccagtgcctacttaggaacatctatctgaacctgactgaaaattcaaatggcaccatattcagtgtccaggaatccggggtcgttgctgcaaagcggtacgccagtacctcatccgatcctgcgcctcgggttcgcacatcagctctgcttactctgcctcctacgcaagacaacctcaccatcttcgaccccggcactgcctgggcccatatcaccggcgcaacttggggctgagaccgaggggctcatcatccacgccctgatgttctgcgccattagcaccatgtgtacatggatacacctgcatgtatttgttagatgaactacttgacagacatgagcacggattatcatctttcttgtgaaagagtacacgttgattcgtcgtgtagatgataaatgtatagacttatgtgacagcaagacacagtgtagattcgtcgcaagaaaa

SEQ ID NO: 15281 - DNA, 1158 bp, Triticum aestivum
  unsure (1)..(1158): unsure at all n locations
  Clone ID: PAT_TA_15281
tgcaacgtggagctgttccccggcggcctcttccggtcgctcccgttcctcagatacctcatctacaccccaacgtaccacacgatccaccacaccgggaagaaggccaacttctgcctcttcatgccgctgttcgaccggctgggcggcacgctcgacgccagctcctgggagctgcagaggaagaacagagcagggatggacgaggcgccggacttcgtgttcctggcgcacgtggtggacgtgatgcagtcgatgcacgtgccgttcgtgatgcggaccttcgcctccacgcccttcgccgtgcggggccttcctgctgccgctctggcccatcgcgctcctcttcatgttcagtggtctgggcctggtccaagaccttcatcatctcctactaccacctccgcggcaagctccaccagatctgggccgtccccagatacggcttccactacttcctgccgttcgccaaggacggcatcaacgaccagtatcgagctggccatcctcagggcctgagagaatgggcgtcaaagtcgtcagccttgcagctctcaacaagaacgaggcactcaacggcggcggcgcgctgttcgtgaacaagcacccggacctccgcgtgcgcgtcgtccacggcaacaccctcacggccgcggtcatcctcaacgagatccccaagggcaccaccgaggtcttcatgaccggcgccacctccaagctcggcagggccatcgcgctctacctctgcaggaagaagatccgcgtcatgatgatgacgctgtcgacggagaggttccagaagatccanaaggaggcggcggcggaggaccagcagtacctggtgcaggtcaccaagttccagtcggcggagcagtgcaagacgtggatcgtcggcaagtggctgtccccgccgggaacancggtgggcgtcgccgggcacgcaactttcaacantttctggtgccccccatcctcgggtttccnccggggactgcanctacgggaagctcgccgccatgcnccctcccaaaggaccccccgggggcctccggntcctggcgaaattcnccctggaaccccgggggtggtgcancccctgccacccccggngggngtncttcaactttntccaagggggggggcccggttnccaanttt

SEQ ID NO: 15282 - DNA, 981 bp, Triticum aestivum
  unsure (1)..(981): unsure at all n locations
  Clone ID: PAT_TA_15282
gtaggagggacgagnagcgccgccgaccagttccaatgaggctactgcttcaaggaagagataagcaaggccacgtctccaccctactatggacggggacccatccaattgacagggtaagcaaaatcccaaattgtggcctatatgacaatctctatagcatcttccacatgaaaaacagtatattggtcaacactgatatcacagactgaaataatctgtagaaaaaaatctgcttgaaaagtactgctgtgttgacattctagctagccgctaatcacgacctgatccaaataagcttttgttttcgcgtgtaataattgttaataacaacaaaaacccagttgggttgctttgccgaagagattgttctcgatgaacaaataattccttgtgccaatgaccaggcggtccaactacgatctcgccgggagagccatcgggaaggacctggtgagcaacccggacctggtgtccacggacgcggtggtgtccttcaggacggccatgtggttctggatgacggcgcagggcaacaagccgtcgagccacaacgtcgccctacgccgctggacgccaacggccgccgacaccgctgccgatcgggtgcccgggtacggcgtaatcaccaacatcatcaacggtgggctcgagtgcggcatgggccggaacgacgccaacgtcgaccgtatcggttactacacgcgctactgcagcatgctcggcacgtccaccgggggcaacctcgactgctacacccagaggaacttcggtagctagaagttgcttgcctgatatatgcaggtcccgcggccatcacagtgtatgcactcgttacgaataaatggcaatacatatgccgtcgtggaataaaggattcgacagctgatctggttgatggtgccgtgtgtaatacgaataagttgctgtaatagattatgtaaactgtccaataaaaagatgaagagattatgtcaaaaa

SEQ ID NO: 15283 - DNA, 733 bp, Triticum aestivum
  Clone ID: PAT_TA_15283
ctgaaggtgagctagttagtacttagcatggtgcggtttgtcatgctcgcggtgtgcgccgccgtgcttctgctcgccgtggcggcgggcggcgcggcggcgcagggcgtgggctcggtcatcacgcggcaggtgtacgacaccatgctgccccaccgggacgactccatctgcgaggccaaggggttttacacgtacgaagccttcatcgccgccgccagcaccttcccggagttcggcaccaccggcagcgcagacgacgtgaaacgcgagctcgctgccttcttcggccagacctcgcacgagaccaccggaggaccccagttccaatggggctactgcttcaaggaccagatagacaagaccatgcttgcaccctactatggacggggaccgattcaattaacagggcagtccaactacgatctcgccggcaaagcgctgaaattggatctggtaaacaacccgaacctggtgtccacggatgccgaggtgtccttcagaacggccatgtggttctggatgacggcgcaggacaacaagccgtcgtgccacgacgttgccctccgccgctggacgccgacggccgccgataccgccgctgggcgggttcccggctacggagtgatcaccaacatcatcaacggcggggatcgattgtggcaaaggcatgaacccttcgaacgtggaccggatcggctactacacgcgctattgcgggatactcgggacg

SEQ ID NO: 15284 - DNA, 1949 bp, Triticum aestivum
  Clone ID: PAT_TA_15284
ccatttcccactggtttgccgacttcgtacccattttattgagcagtcccatgatcgatgagatttatattctgcaattgctgttaccctattcatcgatccgattgccgttgcctttcctacgcaagaaatctcataatgcgtcgaggcttttggcatcgatggggggaatacgggcaaggaaaagactatgaatcaaatctcgttctgccaaggggtgaggcatctggcatcagcggcagatgccaagaacaccaaccgcaacacccattttatcttcaaaagtctaaccgaccgttaaccctacctcgccttcgcaaccagggggccccatccgcgctccccatatcttcactgacagtagaaccaagacaggacccgcgattccttgcaccaacactggggttgactacggtgacaagtcaaatcataacacgtcatgccctggcccgattatggaggagaaagcacacgatgctaaggtgtgtttcacttcgggccctcccgcggggtgaggcatcaggaagaagagacacatgacgaggaaacagcaccgcaactagcaactttaccttcagagagctaattgcctatgaattcggcagcgggctatacagccggggtgcctcatccgcgctccccatcatcgcgctgacaggccgaccaacagccgggccgcccttcctgtcgcggaccgggaactcgctacggtaacccctcaacttgtgaggcttgatgtccaggtccgcaaaactgagagcattctcagacactaggttgtctaacggtgagtgccttcatatgatcaagattgaaaatggacggagtcggcagaggaaaaggcactttgtttagcagcatttcccttctagtagccatagcctttgcaatagggcaaggaatatttcacctatcttggatatttcgcgtattgtttcaagacatcatttcagtcaaggtcatgaacagtgtaaatatctggtccaccaagctcataggtctttcccatgctggtgccatcatccttgagggagttgacaatggcagccgcaacatccacaacataaacaggctgaaactttgtagatccaccgccaaaaagtgggaggaaaccccaatttttggcatacattgcccatctgttcaaaatccgatcttctgtgccaataagggttgcaggcctcataattgtagcttcaggaaattctttcaacacagattcctctccagcagccttcgccctaagcaatctagaaggtgaagaggctgatgcccctaaagcagaaacctggataaatctcacgatacccccatgctccttggatatcattgcaagttgttcagccatctgatggtttacttcttcaaacccatagtttcttgtttcatactcccgtccaatgaggttaatgaccacatttgacttggcaacggcagtcttaatcgaattcacatctcttgggttgtagttcattggaacaatctgacccaagtcacccattaatttcaggtgccggtgagaatcctcacaacctctgaatgggacaagaacctgagatcccatcttcgcaagttgttgaacgacatagcgtccaagaaatccagtagctccaaacaccgtagcgacgattccactcacggacgacctccctccggtgcccttgcggacgagatgcccggcccccttgacggccggcgccctcgcggacatgtacctcgcgccatccgccccgcccaacccttggggcgcgagcgccggctgggcggcggatctgaaggcggcgatggcggccgaggaggccggggagaggtggtgctggtcgaggaggtggcgccgcgccgccgccgccgcctgcatcgtcgccgccgtcggtggtggtcgtcggagtcggaggaggggagggagagggggaggccgagagccgaggggtgcggacgcgtgggtcgac

SEQ ID NO: 15285 - DNA, 996 bp, Triticum aestivum
  Clone ID: PAT_TA_15285
gccggcgggccggggcacaggcctctctccactctccttgagctatactacattacacgagctggtcagctgtaggtgagctagtgagcatggcgcggtttgctgcgctcgccgcgcttctgctcgccgtggcggtgggcggcgccgcggcgcagggcgtgggctccgtcatcacgcagtccatgtacgcgagcatgctgcccaaccgcgacaactcgctgtgcccggccagggggttctacacgtacgacgccttcatcgccgccgccaacaccttcccgggcttcggcaccaccggcagcgccgacgatgtcaagcgcgagctcgccgccttcttcggccagacctcacacgagaccaccggcgggacgagaggcgccgccgaccagttccagtggggctactgcttcaaggaggagataaacaaggccacgtccccaccctactatggacggggacccattcaattgacagggcagtccaactacgatctcgccgggagagcgatcgggaaggacctggtgagcaacccggacctggtctccacggacgcggtggtgtcgttcaggacggcgatgtggttctggatgacggcgcagggcaacaagccgtcgtgccacgacgtcgccctccgccgctggacgccgacggccgccgacaccgccgctggtcgggttcccggctacggagtgatcaccaacatcatcaacggcgggatcgattgtggcaaaggcatgaacccttcgaacgtcgaccgcatcggctactacacgcgctattgcggcatactcggcacggccaccggggacaacctcaactgctacacccagcagaacttcgctacctagaagatgcttgcttgatgtaggcagatcccgttgcgggcagactacatgcgtatgaataaggtttccgcttcagtacacttccttaaatagtcaatggtggagatttaaaatcaccccattattattaaataaaagagtattatagtct

SEQ ID NO: 15286 - DNA, 1067 bp, Triticum aestivum
  Clone ID: PAT_TA_15286
cggccgctcgaggcggccggccgagatcccacagcgtcctgcaagctctcctcttgcgctataccacacaggagagcattacacgagctgatttgctgaaggtgagttggcatggcgaggtttgctgccctcgccgtgtgcgccgctgcgcttctgctcgccgtggcggtgggcggcgccgcggcgcagggcgtgggctcggtcatcacgcggtcggtgtacgcgagcatgctgcccaaccgcgacaactcgctgtgcccggcccgggggttctacacgtacgacgccttcatcgccgccgccaacaccttcccgggcttcggcaccaccggcagcgccgacgacatcaagcgcgacctcgctgccttcttcggccagacctcgcacgagaccaccggagggacgagaggcgctgccgaccagttccaatggggctactgcttcaaggaagagataagcaaggccacgtctccaccctactatggacggggacccatccaattgacagggcggtccaactacgatctcgccgggagagccattgggaaggacctggtgagcaacccggacctagtgtccacggacgcggtggtgtccttcaggacggccatgtggttctggatgacggcgcagggcaacaagccgtcgagccacaacgtcgccctacgccgctggacaccgacggccgctgacaccgctgccggccgggtgcccggatacggagtaatcaccaatatcatcaacggcgggctcgagtgcggcatgggccggaacgacgctaacgtcgaccgcatcggctactacacgcgctactgcagcatgctcggcacgtccaccggaggcaacctcgactgctacacccagaggaacttcgctagctagaagttgcttgtctgatatatgcaggtcccacggccatcacagtgtatgcactcgttacgaataaatggcaatacatatgccgtcgtggaataaaggattcaacatcttgatggaatcagattatataaaaaaccagttggtgtgatagctgttgttgcatgttcaaacaattcgatcgtcaaaaa

SEQ ID NO: 15287 - DNA, 1102 bp, Triticum aestivum
  unsure (1)..(1102): unsure at all n locations
  Clone ID: PAT_TA_15287
gcacgcggcagcccccacgcgcgcgaatacgctgcagagcagcaatggcgaccgccacgccggcgctgccctcgcccgctgcgcccctctccgccgcggccgcccacccccccgccgccggcggcgccgtcgtccctggcgccgcccgcggcagcgcgctcgtccgcggccgccccccccccccccgcagccgccgccgccgcgccggccccgccgcccgcccccccgcccccgcccccgagcccccggcgccggagcggcggcccgcgccgcgccgccccgtcctgccgcgcccccgcccccgcgtctgcgccccaggggccgccgcggccgcacgcggggcgccccaccgtgcccccgcccgacggctccgtcccgccgccaccctgtcgaccccagctgccgcacagccgggggccccgtggagctctctgcactagtcatccctgccccccgcgtatccagtcagtgccctcggtccgattctagccagcgagctcaggcgtccgttcctgaagattggtgcgagcttggaaacagggaaaggtttttcgttggttgcaaatatgagcgctagggttggctcgattggagacaatgctctgggaggctggcattcgtacagagcttctaaaacagcactgaatcaattgactaagactgcgtcagtcgagttgggcaagaaggacaacatcgcctgcattttgctgcatccaggaacagtcgacaccgatctctcacggccgttccagagaaacgtggccaaagataagctcttcacgagggagttctctgtacagaagctcctgtctatcatcgacaatgccaagaagactggacaacgggaattcttccgcttggggatggccaagaaatccttggtgaccactgttttccaagtcaagtgatcatctctaccccaattttcctcttcaagaaccacctgtgtgtccttttagccttaaattcaaatgcctgaaccaactctagtaagacaatgatatgaaaacatgtgaagtatattccctttcctctcantttaactacctgaaaattatgcatatatgatgttaacnctgagtacaactttaaaaaaaaaaaa

SEQ ID NO: 15288 - DNA, 751 bp, Triticum aestivum
  Clone ID: PAT_TA_15288
cctccggcgcgcgctttggctgccggccacctccaagcctgcaagtgggcttaaacatcgggacataatctcacgagctcagcttgtggcagacggatccgatggtgatcggcgaaatggatgctgctcaggtcgcagcatacttcaggggcaagaatatcctcatcaccggcgcaactgggttccttggaaaagtgctcttggagaagatactgaggatccagcctgatgtcacgaagctcttcctcttggttcgagccaccgacgacgaatcggcaaggcggcgggtccagactgaggtaacagggagggagatcttccaagttctcagagaaaagcatggcaagggttttgaagatttcatcgaagagaaggtgtgccctttggcaggagacgtcatgtatgaggattttggactagacactgccaagctgaaagaagtgtccaaggatgtagacatcatcgtcaacggagctgcgactacgaatttctatgaaagatacgatgtatccttcgacaccaacgtcttgggagccaagcagatctgtgcatttgcaaacaagtgcaccaaactgaaaatgctgctccacgtttcaactgcctacgtatgtggtgaacaagagggactaatactagagaaaccattcatgatgggggacacactacgggagggcacacacttagacattgaatccgagctaaatctgatcaaacatacccagatggaactgaaagctaactgtgctactga

SEQ ID NO: 15289 - DNA, 707 bp, Triticum aestivum
  unsure (1)..(707): unsure at all n locations
  Clone ID: PAT_TA_15289
ccacgcgtccgannaaaggtattaaatatcttttcgtccccccagctcgcctgtgcctcttcttcccctcccccaagcaaaggagaaggatcaatggccgctcggatcatgaggctgctccaccaccacaaccgccgcctcctcgccaccgcggcggaggccaccgctcgtcgcctgccgcgcgctccccttggcggcgccatctacaaggatgttgcaaaggctgaagcatcctctttaaaaaattcaaggtggtacatgaccaagtcaagcccttctagtcctctgacaatgcaggagtaccgcaaaacatttccttctttaataaggtcatctgcatcttactcctcacaagcttcagaccaaaatcccaaagaggggaaaaaagacttgtcaactgttggagatcccttcgatgcccctacgtataatataccccgagaacgccagttgacttttgctgangggggcttcttacagtgtttgttataactccccggggcttggggttgccgcattagctgctgggtctgttctcgtggcgcttggttttgaaccaaaagagtacaagatctttgggaaagctctagcaagagttcagagtgatagtcaggttacagcgagaattgggtaccctattactggttatggtaatgaaagcagaaaccgtgcagctcgacagcgtattccaaacagggtttggacag

SEQ ID NO: 15290 - DNA, 806 bp, Triticum aestivum
  unsure (1)..(806): unsure at all n locations
  Clone ID: PAT_TA_15290
cggcacgagctgcttcattccttgtgcggccgcgcgagagtttgctaacgaaatggtgcaggggccgagcccggtggtgaagctgggggcgtggggcagcgacggcggggccgcccacgacatcgacgtcaccgcggcgccgccgcaccggctggagagcatcgccctccgctggggcaaggtcatcgactccctcgccttcacctacaccgacaaggacgggcagccgcacgccgccgggccctggggcggcgccggaggcgtgtcggaagacctgatcaccctggccccctcggagtacgtgacggaggtcggctggaccgtgggcccgttcaagctcaaggagataaaggcctgcgtcacctcgctcaagttcgtgaccaacctggggaccacctacggccccttcggcaacggggacggcacgcaccacagcctgcccgtgctcgacgccggcagcgtcgtcggcatgttctgccgcgccgacgactacctccatgccatcggcttctacgtccgacccttggccatcgtcaaatccaccacggcctcgccagccaagcctcaaggggagagtttgcctgccctagccaccgagggataggaaagggaaatataaaataaaaggccatttgaatgtttgcgatgtcgagtatatgaattacattacatgcacatgatgtgcatgtatctatctcaaaaaaaaaaaaaaaaatcattacactatcacttctgtgtaaagaaatgtaagatcctatggatccacagagagatttgcggctgttgcgcactntaaaaaaaaaaaa

SEQ ID NO: 15291 - DNA, 1789 bp, Triticum aestivum
  Clone ID: PAT_TA_15291
tattttggtgagcacaatatcgatggaatgcttgcggtacttgagccattgcatgcaatgcttgagagaggggctgagacaataaaagagaacactttcattcaggcctatggacatgaattacttgaagcccacgaatgctgcttaaaatatcgcgctactggagaggatgctgagctaactaaggcatgggatttgtattaccatgttttcagaagaatcgacaaacagcttccaagtcttacaactcttgatttgcattctgtttcacctgagctgctcaaatgtcgaaagttggagcttgctgtaccaggaacttattctgcagattcaccactagtgactatcgagtattttgttccgcaattgattgttattacatccaaacaaagaccaaggaaactgacaattcatggaagtgatggcgaggattatgcattcttgcttaaaggtcatgaagatttaagacaagatgaacgtgttatgcagctttttggtctggtgaatactctcctggagaactcaaggaaaacatcagagaaagatttgtcgatccaaagatatgctgttattcccttgtctcctaacagtggattaattggatgggtacctaattgtgacacgcttcatgctctgatccgtgaatacagagatgcaagaaagattttcttaaatcaagagcacagacttatgttggcgtttgcacctgattatgaccacttacccctcatcgcgaaggtggaagtatttcagcatgctcttcagaataccgaaggaaatgaccttgcaaaggttctctggctgaaaagtcgaacatccgaagtatggcttgagcggcgtacaaattatacaagaagcctggctgttatgagcatggctggctatttgcttgggttaggagatcggcatccaagcaatcttatgttagatcgttttagtgggaaaattttacacattgactttggagactgttttgaggcatcaatgaatcgagaaaaattccctgaaaaagtaccattccgtttgactagaatgctcgtgaaagctatggaagttagtggtattgagggtactttcagaacaacttgtgaaaatgtgatgcaagtcctccggacaaacaaggacagcgtcatggctatgatggaggcatttgtacatgacccgctgatcaattggcgtttgttcaatttcaatgaagttcctcaagtttcaaactatggaaatgctcatactcatacagtggtcagtagtgaagaagctgctcctagtgaagagctcatgcagcctcctcgaggagcccgcgagaaggaactgctacaggcggtcaatcaactcggtgacgctaatgaggttttaaacgagcgtgctgtagctgtcatggcacggatgagtcacaagctaacagggcgtgacttttcttctggatcagccttgtcaggcgccggcggctcaagtcaacatggcagtgaacatttagcctcagtagatgctcgggaggtagaacctggattatccgtgaaggttcaggttcagaagcttatacttcaagcgacttcacatgaaaatttgtgccagaactatgtcgggtggtgcccgttttggtgaactccggcaaagcagatctcgtgtacgtactgtaaataacttgtacataggtaggcaggtagcttgctgtatcccctttttcaatgaacgtgttgtatcccaacgtgtgcagtattttatgtaatcacatttggtaatgaaagctatcatccgcctttttatgttataatatggaattactgta

SEQ ID NO: 15292 - DNA, 771 bp, Triticum aestivum
  Clone ID: PAT_TA_15292
tatccattcactttgaccacacccacagccacacacctccgacctccccggagacacccgagagcctcacaactcctcccccaacagcgctctctcgtcggtggattccggcggcgtgcccgaaagaccgcggcggaggagctcgtgcgggtggcttccgcggcgccgtgcccggatacctcgacggaggagctcgtgcgggtggcttacccggcggtgtgcccggagccccccgcgggaggagatgctcccggagcacgagctcggtgctgtcaagcgatcgtgctcggggcggctccggcgatgcacagggaagccgcttgagtgcagagtaacccaccctctcagtcctggcataagcactaactgaatctgatttcgtgagcagcacatgctgtatgcagaccgagaagtgcgattcagaataaatagtcacactcgcaccatcgtcatgaagcaggggccaaccgtgagtttctaatgcattccaggagtaactattttcgagtcaataggataaggaaattgttgttcctatgataatgccatgaaaatggtttgagaagacagtgacactttttatgctcgatgtttagacagtttgcctcctatcaaattcagattaaggtgtgtagatgatttttgcagaatctacacatggcaaatcgacaaattgtagacttggatgagggcaccggattagtgtatgttttgggcattattttaaaaaaaaaaaaaaaaaaaaaaaaaaaaaaaaaaaaaaaaaaaaaa

SEQ ID NO: 15293 - DNA, 1651 bp, Triticum aestivum
  unsure (1)..(1651): unsure at all n locations
  Clone ID: PAT_TA_15293
gcgtccgctagtcagatcgcgagcggccgcccgcgatctaactagttctagatcgcgagcggctttttacaaatttgctgatttggagacttgtacatcatcagtttagcttgtagtataattttttaaagcatctaatgctgtagtatcatggttgatgatgtaaataatgcgacaagctattactgatggagtcaggggttcatcacttaattttcatccgttggagcacctgcactcattgaagtttcatcggccaggtgaaactgctcttcatcttgccgggtcgactattgatcttcggtcacgtgatacaagcttagaggtggctgagatgcgtaatgcactcttcgctgaagaggaatcgactgctttatccacatgggctgttgcaacaatatgtggatgcctcaggttggaacatgtaattaccctgtttgccgccgcgctcctggagacacagattggcattgtctgttctaatttgggaatgctttcagcttcagttttatccataatacctctaatacggccatatcagtggcagatctactcataccggttttgccaaatgacatgctggattttctggacgcgcctgttccatacattgttggtgtgcagaacaaaacacctgatctgcaatccaggctagcaaatgccgtgataattgatgccaacaagaatcagattaagtctgcttcagtaccgcaacttccacaacagaaagaattgctttctgcgttgcggccgtatcattcaagacttgtgggtgaaaattatctcgctaggaagcgccctgtctatgaatgcacagatgcccaggtggaagcagccaaaggtttcttggcagttcttagatcccaccttgattctctgtgctccaacttaagatctcacactattaccaatgtgcaatccaacaatgacaaggtttccttaattttaagagagagcttcattggttctttcccggcccgagataggccttttatgaagctgtttctggacacacaattgttctcggtacatacagacctagttctctccttttatcagaaggactgagtctctctcctgacgatttgactgtcatcagcgacatgaattttccaagcctttcaacgttgagctcaactgtacataccgtcgtagaagctgcctttgatcacattggcagctcatagtggactagaagctgcaagggacaacccgtatactgttggcgaagctgtagattattgaggagatccaggtaatgtaataccagaaaatgcccgtcgggctgttgtaaattagctctgctacttcatcagaagactttgtaggcagtagtcgttgccatgacgaaccttctggcttgctcttcctacaatgcagactccccgggcgtgggatcctaatgttacttctgcagctagttcgtatacggggagagacaaccagaaacatataccgcagtaatttaagcacagactagagttaaacctgatgttgtcaaaatgcatgatctgtgtattcttgccgtgtgccgttttttgttgtacagaaaaagtttggtagtgtgatactaaacaggattttcctcaaagatatatacaagtgcaggatacctgttgctaattctnaggnctggtcttttaatcataaa

SEQ ID NO: 15294 - DNA, 771 bp, Triticum aestivum
  unsure (1)..(771): unsure at all n locations
  Clone ID: PAT_TA_15294
aggaattcggncgaggcttctcctnaaagcttggaggccatgtttctggggtaaaataccaattgattcacttggttcgtctctggattgtgtaactttaagtttggggcgtactgtggaattaacttcagaaataagtatgaaccctggtttcatagagccatcacttcttgagcatgacagttgtttgacattttgttctctaaaggcaaatgctacaggttcatataaactaaaagcaagcatagatgtacaagaggctggtgcaagaaacatgcgtttatctccttacaatatttactcatatgatgatatcccacagtcgttactaccaaaaatcataaggttacgaacaggcaatgtgctctttaactacaagtactacaaaaatttgtacaaacgtccggttacagaagactttacttgctctttttgcttggtaccatgtggaagcttcaagggtctggaatgtcatttaacctcttcgcatgacctattccgctacgagttctgggtatctaaagagtaccaagctgttaatgttagtctgaagattgataccaggagagaagagcttccgactgttgcaggaaatgatccaggcagtagagtatttttctaccgatcatcaaggttcaaaaggtgtaaaatatcagaaacagcaactgagaagacaaaggatgtatatccacatatcacggaattaggatcacctggaatgaccgtgcctgtggaccaagatatgtgggaccaagatcaccacgaaataca

SEQ ID NO: 15295 - DNA, 727 bp, Triticum aestivum
  unsure (1)..(727): unsure at all n locations
  Clone ID: PAT_TA_15295
attcggcacgagggcttaaaggtcgaaaccctgatatttgcaaacacgatgttctattttgtccccccccccccgtcatataacctcgactatttccataaactggttgtggagaatggaggatctttctcgatgaatcttaatgactctgttactcactgcatagcagcagagaagaaaggtatcaaatatcaggcggccatacgccacggaaggatcattcattattcctggatcttggactgttgcaagcaaaaaatacttcttcgtttgcaacccaagtatatcctctttcttgcagattttgccaggcacaaatttcctgaagagatcgactcgtacgctgatttttactactgggacatcgatgtttctgacctgaagcagattttcatcaacatggacaaagttactgtcgatccaagcatggtacatcggtacaaaaagaagtattatgctgatgaaagattctgcttcttccagggctgctgcgtttacttgtatcatgcacctttagtgaatgaggactacaacgtaatatctgatcttgcactaaagagggtgaagcacgaccttacaatgcatggtggtcagtattgcagtagccttgctcctgccacccatttggttatagtttcagttcttcaggtgtacaattttgacatattgtacaagagcttctctccagctgnnnnncgttacctacatgacaaaagattgcatgttg

SEQ ID NO: 15296 - DNA, 647 bp, Triticum aestivum
  unsure (1)..(647): unsure at all n locations
  Clone ID: PAT_TA_15296
cggcacgaggtatcaacaaaccataagtgctttgataaaccagaggagaggggcanttgaagaagatgtcatcagaaagcatacaactcctgcttacagggctcctgagatgtgggacttgtacaggagggaggttattagtgagaaagtagatatatgggctcttggatgtctcatgtatagaatctgctacttaaaatcagcttttgatggagaatcaaagcctcgcgtccgcaatgggaactatcgtatccctgaattaccgaagtactgttcttccattacaagtctgatcgaagagatgcttcagtcctctccagatgccagaccagacattacacaggtatggtttcgtgttaatgagttacttcctttggagctgcaaaaggatttacctgatggatccccatctggatcagcgtgggaactgcaaactactgaggatgaaggaccctcttcatcacggtcaagagacaatgtgagaaatacacctccgaaaggtccttccagtttgaggtcacaagttcctgctgagagtaagggttctgcaagtgcattttggtcaactcaacatgcacaagaactagcttttgcggatgacaaggggtcagttctagatcaagagcccatacatgatggcatagcaa

SEQ ID NO: 15297 - DNA, 671 bp, Triticum aestivum
  unsure (1)..(671): unsure at all n locations
  Clone ID: PAT_TA_15297
gcagggacgcgggaggcgggnagcgaccccttggtggcggtggcggtggcggtggcggagacgagtgaggagcccaacgcggcggcgcggccgttggaccccaacctggttgggcagcggttggagttggacctcaacctggttgggcagcggttgatcgagcggctagcgaaagagcaggcggccgtcaacaggcgatgggaacagcagtacaaccgtccgcgcgcggaagaggcgatgtacaggaaagaacaggagaaactatcacaagtaaaggttgtggtaaaggtgaaacccaagcaagacaaactaggtataaactggactcagatcaagaacaagatttttcgtagagaaggaagggaaatatgttcggaacatgtgaaccaccagacacatcccatcactgaagtcagaaggcattataggcttgattctgacgaggcgaaccattttgatgcctattcggaatatagatcggtgattggagatggggagtgtttctacaggagcttcatattttcgtaccttgagcaagttattgataggcaggacacaaatgaggaaaacccgtctccttcatgttgttgaaagaatgtctatgcgacatggaaatcttcaatggaactctgagttttgcaggagcagcaaagcatttaggaatctgatca

SEQ ID NO: 15298 - DNA, 1735 bp, Triticum aestivum
  unsure (1)..(1735): unsure at all n locations
  Clone ID: PAT_TA_15298
cgtccgatttgttcatgctgatacacttcctcagccatacggagatcaagcaaacttgggttacatgcttccagtaatggagtactatcctgctgctggtacagatagcacaaatgccaactactatatgcaagcaagcgattctcaaattcttcaatcacaccagcattcttactatgcaccattgtctgcaagtggcgtatctattcctgttgagaccacatccatccccccagtaccaggttcttattatagctatccttccgtcaccatggctgccactgaagtagcggctgaatcttctggatactatgcttcatcaacctctgccatttctagtggtgaattagataacaaaacaagcttggcctcccttgttgcaaatagtaatgtgaatactgtggagtctgataaagtgatatccaaggagcccacagttgcgtctttgagccaatcagtaggagtagtatcttcaggaccaacagtacatggaagttctactcaagcttctactagcaccactaatcagactaaagttcctcgtactaagaagcgacctgttgctgttgcatcatcactgagatctaataagaaggtgtcaagtctggtggataaggtatctctccgacctcccaaagctgctgttaaaatagtgaccatttatgctctctcctaccctaccatccactgccccctagtgtggtgtcctgacattaatgaagaaatttaacacactgcatgatatgcattactgctaattgtgtgtacttagccgttgagacatactcttggttatgtcattaacaagagagcacactgttcttggccagtttatttcattgtgcacaatataggtcgtccagaaaaaaacgactcatgcaagtgggagtgtgacagtgtttcctgactattttgtctcatgtttatcatttcttattttaaaggcagagcaatctgtttacatggtaattggtaaggcttaagacaaggtgagtgttgatgtataatgattgtttccttattaatctacctttgctaaagcaacctctcttttatttcactattacagtggaaagctgcanaagaggagcttcgtgatgaagaggaagaggagcctgaagatgctttggagtacctagaaaggaaacgccggaaggaaatagatgggtggcgtaagcaacaaatagctagtggagaagccaaggaaaatgctaattttgttccccttggtggtgactggcgtgaccgtgtaaaacgcaaaagagctgaagcaaagaaggaagcaaagactgaacctattcgtgcagctgccgaacaacacaaaggggagcctgatctctcagagctctccaagggttttccttctgggtggcaggcatacatagacgagtctacgaagcaagtgtactatgggaacaacctcacttccgagacgacttgggatcggcctagcaaataaagattggattagttgaagatggtctagttttgctctgtagatatccctgtacctcgatatatacgttgcctgtcttgaatggaacggatatgacagtcacgccctgagaagcaaccggtttctgatgttaccttggttttgaggctgtattgtttcttctattttccactgggagatcgtagtggggaggagagttcgttttggtatagaggcacccttgtaagagtggcaacttgagatcgaattactgaagcaaaatctactagttagttgctg

SEQ ID NO: 15299 - DNA, 707 bp, Triticum aestivum
  Clone ID: PAT_TA_15299
attcggcacgagggcgtcttgcaccgcttctctttttcgatttgaggctggaggtccgtctggatctgtccatggcgactcccgctccgcccgcgccggcgttggcccctggatcgatggggacggcaagcgattccgtggtgcgcggcgtgccgttcgtttccggcaccgccggtcccgccgtggccgactctgccgtaggcgtagagtcgccggagacaccagcggtggatcaggtcccgccggctcgcggcctggttggcgacctgtctgatgtcgacctgtccggcgagtcccgcacgacgttgcgtcggctggcggaggtgtggcgtcggcaggcgccggtgtcggggcgcgcgccggcgactcctgcagcgcggtccagtccttcagccccagtgctccggcggcggcgagcaccactatccacgttggctggaagcgcaggggaaccccatgaattgctacaaccaagtactattgctcttgcaggagaaggattctccggacgatttttggtacatgatgattgttggggccaagggtaccccgcggaccagatgagagggcggctgtagttcgtgtgccggcgcttgaagctgcgatccgaggattcgccaatagagggactgatgtggttgtcaacccgtcgatgggcacagtatttgactcgctgacagaggcctatgaattctacaatttgtatt

SEQ ID NO: 15300 - DNA, 578 bp, Triticum aestivum
  unsure (1)..(578): unsure at all n locations
  Clone ID: PAT_TA_15300
cagccagtggcagagaaggtcgaatggggataccttcggctgggctctcgtcggcgagctcgtcggcggtccggctctcccctccgcctccggccctctcggcctctcctccgcctccggtgtcccaggcccccctttaggtgcgtctccatcccagcacccgtgctcccctgttccttgttggccagcagccgcggtgaggcgctcgtcggccggcagccatggcgcccctcggtggagaagactggctgtggcgtcaagatcttcccgtcgtccggttcatctcgtgcaccgccacgtccaccgcttcgccccccatcgcgcgcgcgagtgcggtcgtcgtgtatatggcgcccatccgccccggctcccccgggacctgccctgctncggcccgccgcccgacaaccacatcccacctcacgtcaaggcacctccgggcggcaaagaggtcaagcgccagccggcagcccaacttgcgcaccgtccccgtcaggcgccggcacaccgggctcgacctcgcgcgccgcagcaccgcccacgcctccggacgggtcggggtaccttgcccgctggac

SEQ ID NO: 15301 - DNA, 498 bp, Triticum aestivum
  Clone ID: PAT_TA_15301
actagtctcgagtttttttttttttttttttagacacgggatatgacatttttaaaagcaatgaagcaatgcataagtacatgatatagcgagacttgtaggaggcatgaaatagaaggacaataactgaatgatcggccaggccgtcatctgctacaaatattcacgcccgacaacatgattgaaatgcaaacacacaagcaagcacaagagcatatatagtacatgccgaatccataggcaacaatgttgtataccgtcttaaccacttaactatgcttcttcgaagtcatcgagtttccactggccatcggtgcccttgaccatgcatttgtttttaatgacccaccagctccccggcactgggtattcgtctgtcagcaggtcgatagtcttgttcaccagcgccacgtcgcggggaaccactagtttgaagtccgccttgtcgccatgatcccctgcgacaccgtgcaggtaccagcccgggcggccgctcga

SEQ ID NO: 15302 - DNA, 1077 bp, Triticum aestivum
  Clone ID: PAT_TA_15302
ccctccctctgcccctcttgcccccaccggcgaaaccaaagggcacgcggcacgcgcacggccgagacgcagcagcagcagcatcaccaccagatggatcccgcggcggagatggatacgttcgagctggacgcccctctccgtccgccggcctacctcgccacctacccaagtcaaaacccagagcgagcccgcggcggcgagaagcagcagcagcaccacctaagctggatggatcccccggcggagatggataccggcgagctggacgcgctgctccgtgcggcggccgacttcgcctcctacccagggacgcatggtgaggacacagtgaggcagttcctggaacaattccctctgcctaagctgctaggtgtattgcagagccaggcagacgtacctgagacggttgaaactgttgcagcgtgcttggacaaagtattttcatccagatatggagcatcgcttctgccaagctatggtgaatttattcaagctgggttgctcacaaactcaaatagtatcatgacaattggcctgcaaagcggtggttacatcttcttgacaaggctggcagatattgctgtttgccgtggacacatttgtacagcacaatctgtaccctcttctgatcaactgcttgattgagggagacgaagagatctcagcaattgttttggatgccataaagcgtctagcagaaattcctacagggactgatatcatatttccaccagatggtcaaggattgcaactcaacaaagtggcagcccagtcatcctcaatggcacggattcgcattctatctttgatagctaagctctttggtgcatcaagttgtactgctactgcaattcgtgactcaaaccttctcagcttatttgaggatgagataaaagatagaaaagatatgcttaaaaccctgagtgcactagaggtcctctatgagcttgcggagcaccctcacagcaatatgttcttgttaaagaccagtttgcttcaacacataactgatgtgataaacgatccctcagctgattctattgtacggtcaagggcatcattgatcagtgggag

SEQ ID NO: 15303 - DNA, 1237 bp, Triticum aestivum
  unsure (1)..(1237): unsure at all n locations
  Clone ID: PAT_TA_15303
gcacgaggcctgctttggcgccacacaaaacataggccgatagcctggtcctggtacgcgcgacgccgccgccgcatcctccctctcagactcatggcgacggtccacgcgcgcttgggctgccttccgcaaccgcctcctcctcgacttccccgccgccgcgccaccttctcctccggttcccgccggtccgccgcggctcgcagtcgcgttacgagtttgcgcagggcgtcccgtttgggtccatggactgcgcaggcaatgtctggcgcagaacctcctgctggtggcggcgaagctggtgagatcatcgatgcggtggaagtggaacctagcaatgctggcgcttccttgcttgcaaaagtggcagttgcactgggtgttgcggtgacggtcaccgcgatatccatcttcatgaagcaaccttcctctggtccttctttcagcctgccacagattattgatgcttccgcgcagtcagatactgtcggatatacattttctcagttcgggaagaaggtcatcattccggaatatacgccagggtgggtctacttctggttgctcatggctgctggatttggactgtttgtcagtgaagaagctttaaacgtttgggtctgtcctccgctctggttgggatctcgttagcacgcaccctttgtttggatggaacttggcaatctcttgttaactcgttctcgacgaatgcatcttatataatttcgacggtgttgtgggtttactggggtgtttgtatcagcgatatggttccattctatcttggtaagctttttagacaaacaagagcatctgaagacatatacagcaagcttggaattagcaaggagaaagccgtaagtgtatctcgtgctatacaaaagtacgggaacctgattggctttggtatgcatctgaactagcagtttcacagtcattattaagctttgagtaaacagcgcgcctgttggaaattccacaaaatggacctcatgtgtatgtggacaattgttgtagcagtttaagccatcattatctgttccttncactgcagttgagcggttttctattggcgtaaggaatncgacaggatttctggcaggcgccanangcgtatcaacagactgttatttncttggantttgntgnggcttgnctatttacttnttcctatccagtagcccgncggattttatntnananaacgcccanncnngggcgctnccaanccgtttca

SEQ ID NO: 15304 - DNA, 662 bp, Triticum aestivum
  unsure (1)..(662): unsure at all n locations
  Clone ID: PAT_TA_15304
ggcacgtcctgcaagaaatagctcacgttcatagcgccagcgcaggagagatcaatcgatgaagctgttcgcgttcgtgaggcgcgctcgccgaacatcgtcagcggcgatgacaccggagccggttccggtggcgctggagaacgcgacggcgcctgtgtccgttgcggagaagcggcggcggaggccctcgtcgggatcgtcgtcgtggaagccgacgctggtcgccatctccgaggacgctgcggtggccgccgccaaggccgacgccggaaaggccaagggcaaggcgaaagggaagccggcggcggccaaggccaaggcgagggcgtcgcctcgcgcgctccggcctgactacgacgacttccggcgcttcggggcgcccacggtgctgccggcgttcgcgcccacggcgttcctcttctgagcggccctcaagcgacctcgctgtggtggtgtgccgtgatggcaacggccagcggcgtccgctggcctcctcgcggtcctcgcgcgccgtgtgggcccttgacgaccgcccgctggccgtgggcctctctgtgtttgtgcgcccaatatgactcccaaactgatcctctacgatcctctaatgctggctctcatgtgaatatcattctatantcggctcatccaaaaaaaaaaaa

SEQ ID NO: 15305 - DNA, 1204 bp, Triticum aestivum
  Clone ID: PAT_TA_15305
gacgcaggggccgctcgaatctcaaaggccatagtatgcagtttctgtaggaacgggtaaagccgtatctaagggaacgctggggagcccaaggacggcggagaagccgtcggcaggcgacatcgtgtcgatggtgatgaggagaaggcgtgcgatgcccaggagcgagcagccctctgaagctgggcgcgtgaaatcctctggcgggatttttggatacgtgcgggaatccagtggtaaacaagagaaagagggcctggcatcacctggtgagggggagataacaccacagaccaaggaaggtgtggtggctgctttggggggcggtgaggaaactgggcttactgcagatgcgccggtttctgcagagaaggcaatagcgggtgatgccgctgtggttgagggaactggaggtgcgactgaagcttgttctgataagctgggttcttgtgcaatttcagagaagtcggcgagtggtcctcggcatgtggaggctgtaggaggtgcgacagaatcttcatctaataagctggggcgtgcaggtgcagtggaagcagagaatgcagcggaagcagggaaagtggagaaggttgaatctgataagaagcctcgtgtggagggggaggggggagaagacaagctgggatctgcagaaagatgtgtggttagttgagctgagctgggctgggcgcaaggaagaagctatcatgacaagacaagtgtcgattttctggactggactggactggactggactggactggggcaatggtgattttctggactgctggagcgcaaggaagaagaagaagaagaagaagaagaaggaggaggaagaagaattataattaaattattaataatatgtatggtaactgtaatagttagtgttaagtaagtagttggtccctctgctctgagaactaagtaatttaattatggttggttggattattactatgtgctcctcctgtatgatgcatgatgcatgcattaggggagtgaacttgaacttgaacttaagtgaagtgggtgtgtttttgttgctctgaagtgaagtgggtgtgtttttgttgctaaatgaccatcatgatgtttgtgttaaaaaaaaaaaaaaaaaaaaaaagggcggccgctctagaggatccaagcttacgtacgcgtgcatgcgacgtcatagctcttctatagtgtcacctaaatt

SEQ ID NO: 15306 - DNA, 570 bp, Triticum aestivum
  Clone ID: PAT_TA_15306
ctcgtgccgaattcggcacgagttccggcgaaaccaattcattgctcgctttcgcaagactctttctttctcccctttcctctcccccaacccatccgtcgtcgcctccgcccgaggtaaccgccatagccacgaagaatcaagaacatcgcctgtcgcacgtcgtccctgaggacagagaagaagagatggagggcggctgcgtcgtggccgccgggacggaggacggctgcggcaagaagcagcagcagcaggcgcggccgcagttcgggcggtcgctgacgtaccaccaccaccaggggcaccggctactgccgcggtggcggcggccgcagctggcggacgagccccgcgcgcggccgcaggcggtggtgctctacacgacgtcgctgcgcggggtgcggcgcaccttcgcggactgctccgcggcgcgggccatcctgcgggggtcccgcgtcgccgttcgacgagcgcgacgtgtccatggacgccggcgctccggcgcgagctgcagccgctgctggccgcgcggggccgcgccttctcgctcccgcagctcttcataggggg

SEQ ID NO: 15307 - DNA, 705 bp, Triticum aestivum
  Clone ID: PAT_TA_15307
ttcggcacgagcgaactctctcgttcgcgacgggccgcgcccccactctcgcctcctcgcgattgcgcgactgtttcctcctctccccgtttctctcgtccctcaatctcgattcgcttcgaatcgcgtctgatttgagttcgttgactcgccgtcgccgttgccttgccgtgttcgcagggtatgcgagtccggcccggcctcctccgcctccgtgcgagctcgggaagcgatcgatcgaccgaggaattcatccgtttgggacctccatctggtttgcggatcctcctcagaatctgttttgtgtgcttgcaactgtggatcccgtgttcctcgtcgtgttcgcgtccccgcgcgttggttgcatgcaggatcgtcgagccaggtttttggaattggagctctgatatggagccggaggccgaggcaaggtcagtttcccgtgcgagttcagatcgcttcctctgcgttcgtccgagatgccagatttcaatcaaatggatacatggcccgtgtgatcctgtcgttgcccgagcgctgtggtttatttattccctatcgtccgttagttcaaggtgtatccattcgaggccttcaattcgtggaagattctcttatattgtgccggctgatctcggttttggtatgtcttgtgctctcaccctagatgcagaggaagccagagggcgcgctagttctgcggag

SEQ ID NO: 15308 - DNA, 1260 bp, Triticum aestivum
  unsure (1)..(1260): unsure at all n locations
  Clone ID: PAT_TA_15308
ggcacgaggagcgtcaaggcctggatgcgctcgcacgccgccgaccgctccggcgccggcgagccgtgctccatgagccgcggcgagctccagctcatgctcggcgtcatcggcgcgccgctcatcccgctccctgtcagccgcgccaggcagtcaccctcctcggtgctctgcgagcagctcaagggcgatcccattgaatcgtcgtcggccaagtacatagtgcagcagtacatcgcggcgtccggcggggagtgggcgctgaacaaagtgacgagcatgtacgcgatgggcaaggtgcggatgacggccgcggagctcaacagcagcgacgcggacggcagcagcaataatggcggcgcccagcgcggcgggaagaaaggcggcggcaagggcggcgccggcggcgagatcggcgggttcgtgctgtggcagaagaagccggagctgtggtgcctggagctggtggtgtccggctgcaagatcagcgccggcagcgacggcaaggtggcctggcggcagacgccatggcaccagtcccacgcctcccgtggtccgccgcgcccgctccgcagatcgctccaggggcttgacccgatgctgacggcgagcctgttcgcggaggactcggtgtgcatcggcgagcggagcatcgacggcgaggactgcttcgtgctcaaggtggaggcggaggcgtccagcctgcgcgcccgcaacaccaccggcgtggagatcatccgccacaccgtgtggggctacttcagccagcgcacgggcctgctggtgcagctggaggactcccacctgctgcagatcaagtccggcgccggcggcggctccgtcttctgggagaccaccatggagtcgcgcctccgcgactaccgcgccgtcgacggcgtcaacatcgcccactcgggccgcaccgccgtctcgctcgtccgcttcggggacacccacgacggcggcaacacccggacgcgcatggaggagcactgggacatcgaggaggtcgacttcaacatctggggcctctccatggactgcttcctgccgcccagcgacctcagggacggcggcaaggaatcgcagcagcagcgccggaggagctcgccgtcgtcaaggcggcgcgcccgccgccgctgangataccgggcgttggcgntctccggcntaggncnttccaaaggtggccgcnntcaacctggacaaancgngttcctngttgccaataatnatgnaatccnacancaacaacagacc

SEQ ID NO: 15309 - DNA, 688 bp, Triticum aestivum
  Clone ID: PAT_TA_15309
attcggcacgaggcccgcgctgcagcaccgaagcagggtagcagagatcgcatagcaccggagcgcgtcgagcaactagcggctagctacaatggcgccgcagctccggtcatggggccgcctcctggcgctcgcggccctcctcgctgcggccgcggcgcagtcgtcgcccgcagcggcgccggccacgcccacgccagtggcagtgccgacggctcccgcccagtcccctcccgcgccgaccacgcccgcgcccacggccaccccggtcactcccgcgcccaccgccaccccggttgcgcccgcgaagccgccaccggcagtcgcgccggtcaagccgcctccggtagtcgcgcccgtgtccgcgcccccgcccgtcgtgacgcctcctccggtgacgccaccgccggtgaaggctcctcctcccgtgactccgcccccggtcgcggctcctccgccagcaacgcctccacctgcggccgccccggccgaggcgccagcagtgctcccccccctggcgacgcccccgccggtggccgaggttcccgctgtgctgcctccggccgaggctccgtccaagagcaagaacaagcacaagagaaagaggagcggcaagaagaagtcgcccgcgcccgcgccggagccgctcagcccaccggcccccatcgcgcccgagcccaccaccgtc

SEQ ID NO: 15310 - DNA, 321 bp, Triticum aestivum
  unsure (1)..(321): unsure at all n locations
  Clone ID: PAT_TA_15310
cccgtccgcgttcccgtggcctgcctgagtcccgactccacgcggccccgctctcggtttcccttccccgtctcctcccctcccctctccgtccggatctatctacctttcccccctccccacccctccgccgccctcctggattcccagcccaccgccggccggccttcctgggtgctcggtctcgcctgcgccatggacgacgccggggagccgcgcctgctccaggaggaagggcaacaagaggccccctccctcggnggcgccggcgccgnccgcccagggcggnggcanngggaagganangtttgaatcctcngg

SEQ ID NO: 15311 - DNA, 722 bp, Triticum aestivum
  Clone ID: PAT_TA_15311
ccttatccattcctcaccaccaaccgcgcccaccgctcagtgcagagggtcggcccgaggcaaaccgcacgcagcacgccgacgcgaagcaccaggccgccgtgctccggatcctcgccgaccggctcgagctgccgtcgtgggcggaggtggaggcggaggccgaggaccgcggcggttgcgaacaacatttatatgcacggaggaggaaggtgcgcgtgtggctgctactgggcttcgagctctgcctccaccgccgcggagcgaggatgggaacggcgggtgcgcgcgtggctgggctccccggcgcggctcagcctccgcgacgaggcggatggcgggggatgctggaggtgcgtagcggcagggagcgtcgctggcgtgcgagatttgatgcgcatgaagggctgtagctgggagcggcagcagcggcgactgcccctccggccgagctgttcaacgccgcagcgggggcctacctcggcgccgtcttcagcagcgtcgagatgggactggtggtggtcgttcccatcaccagttatgggcaacatgcgggcaacatgccggagacgactatctaccggcggatggaccagtacacgacgacgcggacggtgcccggcgtgctcgtgctgcgcgcggactcgcccatctacttcaccaactccggtatcatgcgggagaggatcacctggtggattgacgacgcgacgacgacgacg

SEQ ID NO: 15312 - DNA, 740 bp, Triticum aestivum
  unsure (1)..(740): unsure at all n locations
  Clone ID: PAT_TA_15312
cggcacgagtctcattcagccttatggcgctcctgaaatccgccttcataaaaattaagcaatcatctgcgaataggagatggggaatccacggggcagagttgctcactcggatccccctatcaatccatccaccctcaaacacttgtacgggcaatgtcttcccaaaaacatggaggggccgccgctgtattacagagggcggtgtcatggtccaactacctggtggtgcaggtgccataatccagggcggcggcgaggagctctttagggccgacctgtcaaagttgtagatctgggctgggttcgcggagcggcacagccgtgtctactccggccggtacgccagtctcaacatcgccataaagatggctagccagccctagcaggatgccgccaagctgaagcacccgttcgcctgcgaggtcgcccgacgccttcgccaccacatcctcgctgattgtattacactataacttgttatggtgacaagggtatttatcttcagggaacgaccatgatatatatagaggcttctgtagaaagaggaggccgcttcatgattcccctatgcttctttgacataacctccacagagcaaagatttgagttgctcgatttaacctattctgtactatgccttggttgtatataagctatatttctcccgtacaccctanatatagaactttgttataatttaataaatgagtatgtgtgggtttatgcagtttcttatc

SEQ ID NO: 15313 - DNA, 1278 bp, Triticum aestivum
  Clone ID: PAT_TA_15313
cgaaaaagctgaaacccctcccccctcagtcccccatccgccgtcggctgccctccccaccccacgagacggcggcggcggcgacggcgacggcgagcagcacccgatcctctccccctcctcgttcactgcaggagcaaagcagtaaaaatgaatgtgcacctcagctttgaggatggctggaaggtcctggagcagggcattgtgacatgttcaaagattttggagggatccactggtacaaggcctactgttgctgagtacatgaattgctatgactgtgcttatagaatggcggtgcagacaaccagctattgtgaagagatgtacaatggttacaaggctacacttgcagaatctgttcgtgcactggtttgcccccatctgatgcaccagagagatggctaccttttgagacagcttgcgaaaatgtggtctaactattgtatcatggttaaatgtgtatctggcttcttcaactatttggaccgttgctttgttgagcaaagaaagctaccttgtcttgaagacactgctgccacttcttttttctctacagtcttttccttcttcagtcatgaagtatcagacgctctgctgacttcgcgtcgccgaacgcgtgggggaatcaatgctgatatggacatcttgatgggcattatgcgtggcatatgtcgctctgaagtcaaatccttcatgaaaaatgctgttgttcaagatacatatgcttactactccaggaaaagttctgaatggattgttcagtaccctctacaagattaccttgccaaggttcaggattgtatggagaaggaaaccatgagattgatgagctatctgagtattgctgagggagatagcacagagctctgtttgaaggttgttagtgctccattgatgcaaacttatgacagctatgcaagagagaaacagattggtggccaacttttgcttcaaacatacaagactgtagaggatgatctgctggccagatgcagtcgcttgacaattgacagcggtgtggacaacagttctggcagttacatggagtagaaaggaaatgtgcttcagctaacattcatcgttaaccaagcttacatacaggaaggggttctagaacatggcctacatctgggggaattttttgtgcggttcgttttttggtacctcggccgcgcccgcgctctgtggattttgttggcaagggttgactagattaaacgctatactgaatctgcaggggatacctctttaggcgccgcctcctaccccattatg

SEQ ID NO: 15314 - DNA, 906 bp, Triticum aestivum
  unsure (1)..(906): unsure at all n locations
  Clone ID: PAT_TA_15314
ttcggcacgaggcaagacacggacatggcaggtgcgatcttcatgtgcaacaccagggcaagggagcagttctttgtctcaggcgttttcagacttgctttagagtatcagccctttgtcgacaatgtcaaacaagggatgcctctctttctctttgactacaacgaacgcaagctttacggggtgtttgaggccgcctctgatggtggactggatattactgacagagctgcttttagatcttctgtccactcccacccggcccaggtccgattcaaaattatttggaagtgcagaccacttgcagaagatgagttctctcatgccataaaagagaattactatacgatgtataaattctattttgacctttcctaccagcaggttgtccagctatatgagttgtttgataataagagggtagagcaacctattcgcaactacaccataagtgctcattcgaaagaaggccacttctgtaaagggagaccagacaaaaggagtttgactccaaatatttctcccatttctactgatcaatcacacactttgactgtaacagctggaacaaactattctgctcctacaaggatgcgtggaaccgcaccacataattttgaggcacgaacaaatctgtcagtgccattggtaagtaaacccgttggagtccaaattgatcccatccgcagcagccatcatgttcaaaagatattaccttatcataacaattcacatctccaagatgtttcgacagtagatggcatttcaactcnnntatatgctccctgttctcagacaaatggatatcaccgagatcaatttgttacaaatcaatcatatccaatatctgatgactacatgcacagtagcttgtcttctggatgcatgactgccagtccaactgat

SEQ ID NO: 15315 - DNA, 788 bp, Triticum aestivum
  unsure (1)..(788): unsure at all n locations
  Clone ID: PAT_TA_15315
attcggcacgagcccatccatcccctcacccgccgccgcncacttttcccaccatctacatcgggatccttcctgatccagccaaccaccagctcccctcccgatccacctaccaggcatcgccatttttccccttgctctccgtgcccaaccaaccagcgccatgccccgcgtccttttctcctcctccctgtctcgcccggtgcccgatctgcatcacgcccatgccctcgttccccgctacagccagcctccccgagctcctagaaccaccaacgcctctggttgcctcgccggagcaagctccacagaagaaaagagccacctcgtgtcgctggcctcctctgtttctcctcgtgcccgcagcaacagctaaacccgagcaccccatcgctgcacgtggagccgcgacccccgccagagctcctccctgcccgaggctgctgcctcctcgtcgtcttcctcgagctcgagctcacacccgagcacttcgccctccagcttcctcgcaatccgcgccaggtgccctttccctgcgcctgaagtcagccgacgccaccatcttcagagacgggctccctccggccggatctgacgcagtccccgcgtccccggccatctccggtgttcccgcgcctgcagctgcgccaagaagctgccgctgctctgcttgctgacgagcagggggcgaggcacccgttcgcccagcgccgctcgtcgccttcgccaagtccctgcgccgccggagccccgcattacgccgagtccgccgctgcgtccttcttctc

SEQ ID NO: 15316 - DNA, 710 bp, Triticum aestivum
  Clone ID: PAT_TA_15316
gattcggcacgaggccaccgacgcctcccgtgatcggctaatggctcgctcggtccctggccggctagctctcttctgcgtcttggcctcctgcattgcgctcgcggccggcaccaccgtcgccacccgtccgagccggcggggcctcggcgtaagcgacagccacgacggagcggtcgcagtcggggttggcggtggcggcggatacgatgacagcttgatgccccggccggcgccgtcgtccgagccgagggcgtgccagttcgagaacgagcggctctacagggcgtacctggtgatccagaagttcaggaagacggtgatctgcgaccccaagggcgtcaccgccacctgggccggcaccgacctctgcggctcctacaagggcttcttctgcgggcggcccatcaacgtcagcgaccggaccgtcgcgtccgtcgacctcaacggcttcaacctgcggtccgactcgctgcagggcttcgtggacggcctgccggacctggcgctgttccacgccaactccaacaacttcggcggcgccgtgcccaacctccgggggctgcagtacttctacgagctggacctgagcaacaacaagctggcgccggccccgttcccgacggacgtgctggggctcaccaactgcaccttcatcgacatccggttcaacagcttcttcggcgagctgccggcggggctcttcagct

SEQ ID NO: 15317 - DNA, 577 bp, Triticum aestivum
  unsure (1)..(577): unsure at all n locations
  Clone ID: PAT_TA_15317
gctgaccataccgcaccaggacgagtgggagtacagcgacggcaagtcgacgacctgcgtcgccttcatcctcgcgatgttcaaggcggccggggtgttcgctcccttcacggagtccatccaggtcacggagttcaccatccgggacgcgtacatgctgaggatcttccaaggacaaccggacgaggctgccggggttggtgcaccggcgacccnggacgggctccccttctgccaagatcctccggggagtacaagatggagctcccgggagtacaacaccatccagccctacgccaacatgaacgagaactgcccctcctcgccgcccacctacgacaggccgctgcgctgttgatcatggatccatcattcttccgtcgaaaggaaagatgattttacagtattgtgccctgtgcaatcaattaggacgtaaatagaccacgttcgcgtctcctccacctcgtgcgctctctccctgcgtcatgttacgaactgcccctggtgtgggtcttacacctgcccccggtgggatggtgttccttaccatcgttttctcggttggatggtagttaaa

SEQ ID NO: 15318 - DNA, 971 bp, Triticum aestivum
  Clone ID: PAT_TA_15318
cggtccggctcccacgtcccacctcccccccggcgaacccacccacgcaagccccaagcacacgcagcgcccgcctcctccccacccaccacaccacccgctccgcccgccgatcccacggcaggcggctggcggaaggcaaggttggcggccggcggcaggatgaaggccaaggcgggctcccgcgccggcgactccaggctcgcggtgaagaagagcaaggccgagaaggaccccaacaagcccaagcgccccccgagcgccttcttcgtcttcatggacaccttcaggaaggagtacaaggagaagcaccccgacgtcaagcaggtctccgtggttggcaaggccggtggcgagaagtggaagtctctgagtgatgctgagaaggctccctactactgccaagggccgagaagctccaaggccgagtacaccaagaagatcaacgcctacaacaacccgcaggcaggagaggcgtccggcgactctgacaagtccaagtccgaggatgaacgacgagagtgacagcagggagggcgagcagctgcagcagggggaggggcgtctcttgaacgtggccgctgccgctcatggatggtggcagttattgatgattgctggtgtcactgatcgatgatggatgttcgctgctagtttagctccatggtagtccctccctctctttcaggttgctgctgctgatggcgatgatagaaatggtagctctagtcccatgtagtcgttgtcctggatccgagtggtgaatttgctagtctggtttccttcgtacagggtcctttgctcggaccgccctctgttccttcgtttttagcatgttttaattcagtctctgtcggatgtacctagtgtcgtgcctgtggttgttttaagaatcctacccagatctcaatatatatggtgttgaaaggaaaaaaatcatcttgataaaaaaaaaaaaaagcggccgctct

SEQ ID NO: 15319 - DNA, 973 bp, Triticum aestivum
  Clone ID: PAT_TA_15319
gctgaacgtgccggcggggatggcggggtcgctccgcctggacgcctcctccccggcctcgtcctcctcctccgtggcgcgcctgctcgagatccccaagacgccgtcgccgtccaaggtcacctacagcgaccgcttcatcccctgccggacctcgtcgcgcctccacaacttcgcgctcgccgaccgcccctcccccggctccggctccagggacgacggcagcgcctactcgcgcctcctccgcgccgagctcttcgggggcgacgcctcccccggcggcgacaggcaggactcccccggctccaacaacctcttccgcttcaagacggaccgctcctccgcgccctcctcccccttcgccgagaagctggactgcgccggcggcgcccgcccccccacccccccgaggcccccccccaggggctggacgcgccgcccctgcaggacgacttctacctgaacctcgtcgactggtcctcccaaaacatgctcgccgtcggcctcggcacctgcgtctacctctggtccgcatcgagcagcaaggtcaccaagctgtgcgatctggggccgaagggacagcgtctgcgccgcgcactggaacgcgcgaggggtcctaccgccccgcgcggcccccgccctcgccgtcggccccagccgggggtgaccctcactgtttggcggagctgctccctgggacccgctccaggccccgggcggggcccccagcccccgggcccggctggctttgcccgccacggcaaccagcgtcgtgcttcggcagccacggtccaagccccttccccgccgcatctccttccgcggtccctctggccacagttcagaggcctgttgggctgaaatggccccatgacgaccgcgagcttgcgtctgggggaaatgacaaccagcttctagtttggaccccgccgccgcagcagccggtgctgcgactgacagaacataccgccgc

SEQ ID NO: 15320 - DNA, 1055 bp, Triticum aestivum
  Clone ID: PAT_TA_15320
tcgccgccgcgccccgtgcgtcgccgtgcttcttccccgtccactcgccgcgttgccgtccgcctcctcctcctcacccactcgccgccccggccgccgtccgccctccgccggcgtcgcgtccctgcaggcagaccggagaaggtaggtggtcggctgcgatggcgcgcgtgtacgtcgggagcctggaccctgctgtgacggcccgggagctcgaggacgagttccgcgtgttcggggttctccggagtgtatgggttgcaaggaagccacctggttttgcatttgttgattttgatgacaggagggatgctcaggatgcaattaaagatttagatggcgcgaatggttggagagttgagctgtctcgtaatgccagcagtggtcgtggtggtcgtgatcgatctggtggatctgagatgaagtgttatgagtgtggcgaatctggtcactttgcccgtgagtgccgtctgaggattggttctgggggcctaggcagtggaaggcgtcgcagcaggagtcgaagccgtagccgcagtcggagccctaggtaccgcaggagtccaagctatagcagaaggaggtacagccgctctccaaggcgtcgtagtgtgtcaccggctcgtgggcgcagtgtgagcaggtcaccagtccgtggacgtgacgaatcacctgcctatggcaatgggtatcgccgcagcaggagctaaagctctatgttatgtctggagagtgttctgttgcaaatattgctctatacccgtcagctatgaacagtgtcatgtcccccatttgaaacatccgtcatcgactgcttgagtttggttaagttccccataacttttaccgcagtaatatggttgtgtttgatttcatctctagataaacttatggatgggtgtatcattaactaagaccagctgcttttcttttgtgtgttaaaaaggcatcgtcctgcactgcttaaaaaagtcggccgacaaaagctttgaaaaatgtcttcatggttttgctcttcgctcttcgttcatccttcgccctcgcctgctccatgc

SEQ ID NO: 15321 - DNA, 469 bp, Triticum aestivum
  unsure (1)..(469): unsure at all n locations
  Clone ID: PAT_TA_15321
gcgccccgcccaggccaccaagcaccccacgccgcctgccgccggccaccaccccgcgccgcccacccgctcccgcttctccccaccttcttcttcgccaccgaccgccgtggtggccgccacgcccaccccgtgagcacaaccccacccaaccgcttcctacccgggaaaagatgggtgatggagtgcgcttcacgaggttggtccgtatccctcctgccaggtcgtgcagttccttggctcgcgacatgcggtccgggtagcatgggctttctgttcacgggcacgccggtttccaccatgcagttcgctagctggttgggcgtggtttcggtatcgcggcaatgcagtttgattgagtgcttccggtgtacacttcaaattagttttttggtatgtccagatttacattgcaatgtggtgaagtcccggctgggtggtgctaaaancaatttgtgtgtgcaaaaaa

SEQ ID NO: 15322 - DNA, 731 bp, Triticum aestivum
  Clone ID: PAT_TA_15322
cggcacgagccacgttcgaggcgaccctccaccatccaatctgctggaaggtatagtccgagtagaacactggcggggcccaggaaaagccaggaggaaaaggtccggagctccacgaaggtgctcccagaggaacaacacagcgccggagcttctctgcatctatatataatggacattccctagcttctggacaatcaccacaaagcagcaggcctttgtctttggaggctgagtgtctccagtagtcatccttgtgcagacgtatccatctgcacataggcacaagcaaccttgtcggtgataatgccgagaaccgtgtccgacggaggtgaagactttgatggcgacgtctccagtcagccggggtcgcgccgtcacacagacagcaacagcactcaccaccaccatggctacaaggtcgggttcccgccggtgaagggcctcttcgcggagttcgctgatggggtgaaggagacgttcttcgccgacgacccgttgcgggagtacaaggaccagccgaggtccaagaagctgtggctcagcctggtgcacctcttcccggtgctggactggggcaggagctacaccttcggcaagttcaagggggacttggtcgccggcctcaccatcgccagcctctgcatacctcaggatattggttatgccaagcttgccaacctgcaaccacacgttggactgtacagtagcttcgtcccgcctttgatata

SEQ ID NO: 15323 - DNA, 879 bp, Triticum aestivum
  unsure (1)..(879): unsure at all n locations
  Clone ID: PAT_TA_15323
gccggccggtttcggaaagaaagcccgacccgaccaaaaaaaaccttatctttatcctatcccatccccaatcccacctccgcgagcgagagaaggaagacgaagaagatgctgctgggctcctccttcgcgtccccgttcacccagctccacctctcgccgggccccaatgcgggggcggcggcgcgggcggcggcggggctggtgctgaggatcgaggcggcgaagcagctgacggggcgggtggtgacgaccaaggcgaacaagacggtgggggtggaggtggcgcggctgaagcagcaccccaagtaccaccgccgggagaagatcaagaagaagtaccacggcgcacgaccccgacaaccagttcaaggtcggcgacgtcgtcgagctcgtccgctcccgccccatctccaagaccaagcacttcctcgccgtccccggtcccccgccccggccgacacccggccgcaaggcccagcctcctccccccgctcgagtcccaccgccggcgaccgccgccgccgccgccgaagagacccctgcttcctagtgatgcttcttgcttttgtttcccccattctcttctcttgttaattaatcgtcggttccctttgctgctgctgttcttgctcccctgctagactgaactttgatactactcgggtaccacttgtctctgaaatttgtattttctgttcttccttcagcaagaattaatcttggaactaataaaaaacataggatttgaaaaaaaaaacatggggccattaccaatccaaaggacctctacatacggcgaatccccctttacaatagcccggccgtacaaatnccccaaatgntctttacccccanaggcntntttaattganggna

SEQ ID NO: 15324 - DNA, 1432 bp, Triticum aestivum
  unsure (1)..(1432): unsure at all n locations
  Clone ID: PAT_TA_15324
cgtccccccgactccacccgagttacttgcaccacccacaattaggtctcctgctctttctggctctagaaaagaagaacctaaagcactgatgccggtagaggaatcgtgagacgctgagggtcagagcggattgaaagctaacattgatgtgagttcttcagcgcataaggtgaccacaattccagatatccccgaagggacaatggactctaagaacagcaaacatgaaaaaacaccagaaatgattcatgtcgcaaaagagtcacaagaaaaattacctgcaggcgaacaagtaaggaagaaaaagaagaagaaggtgcgagcaccagggaatgccgaggagcaatggaataataattatcaagattttggacctgaaaattttgctggaatgcctttgggcccgcaaggaggttttaacccttactggggaggagggatgccatggccttttgggtccacgcgtgccccaggtccaggtcccttgccttacatggcccatcctccaccaggtcctgttgttcctgttcctgggggtgttcggtcactagcgccttctaggcccccggcctacatgttgcccccagggcctagggacctttcggaattagctggcttcggcggggctttgggcttggggccaccagttgtgagggggggcgagttggagcccaggttgccagttgggagcagacgtggaatggatcgtttaaacgggagggagagggagccggttcgggggcgtgatcatttccgcgagtgggacagggagcggnagaggcagagggagcgagactgtcatggtgatcgagaccgagaccgagaccgagaccggggcagggagtatcgaagggaagcaagggaatcatcaggagccgtaaacgatagtacatcgatgagacctaaggataggtcgaggccccaggcggacaggtcggagcgcgcactgccgccgccgctacacagccccgaccggcactcgcgtcgctccccgcaccgctcctccagctccggcaagaagcgctcctcgtcggaccgctacgacgacctgcccctcccgcctccgccgccacctgcgtcgcggcacgaggcagagcacgcgaaggcggcggctgctgcagcagaccagcggtccaaggccaaggccagcgtcttctcccgcatcagcttccccggcgaagccaacacgtccgaccccaagcgcagccgcaggtcgtcctccgacaagcgccctgcatcctcgtcgtcttcatccaagagaagcgtcgctgccgctgcagctaccgaggagagcgacagccgccaccaccaccaggagacggtcttggcggcggaggaggagaggcggagacccgcgcctaccgactacgacgactaggagcagtcgagcgaggaggagaagcatttcaagaggaggccgtcgtcctcc

SEQ ID NO: 15325 - DNA, 577 bp, Triticum aestivum
  Clone ID: PAT_TA_15325
cgtccggcagcagcagcatcgctaccgtcctgtcaaccacaatgaccactcctcgcagcacccgcgccacccaccggcgggggagctggaccgacaccaagggcagggaggctcctccacttccacccggcgcctgcggccaaatcgtccaccacagcctcgccccaccttcacagaccacaagccgtctcctacctccacacccaatgccaacgaacccgacgacaaggccaggcgcaatgctgccaatttcgagtgcaacgtctgcttcgacatggcggacgaccccgtcgtcaccaagtgcggccatctcttctgctgggactgcctctaccagtggctccatgtccactccaaccaccgcgagtgccctgtctgcaagggccaggtcgctgacgatgccattatacccatctatggacgtggcggctctgcagcgtctgttcacgccgcaccgccgaggcccactgggaccagagttgaaagctccagacagcagcagctgcagcagtttgctgcttccaacttgaatatgatgatggacgaagatgatgaagacgacgacccctttctcgag

SEQ ID NO: 15326 - DNA, 867 bp, Triticum aestivum
  Clone ID: PAT_TA_15326
attagactgctgccttcttatgtgcgcacatggtttactggcttgagagatcgttcactgtcatcatccatcgagtccttgactagagtatggtgcagtcctccgcttctattagatgagttttgtcaggtgaaggagtctgtttatgctgatgaaacattctcggtgagcgtgaaccggtcggcatacgagatcattgctacgtacaagaaggaagaaacagggattgatcttgtgatacggcttccgagctgttacccgctgcggcatgtggaggttgaatgcacgagaagcctgggcatcagcgaggtcaagtgcaggaaatggctgctgtcgctgacgtcgttcgtgcgcaaccagaatggcgcggtggcggaggcgatccggacgtggaagagcaacttcgacaaggagtttgagggggtggaggagtgccccatctgctacagcatcctgcacacgagcaaccacgggctcccgcggctggcgtgcaagacgtgcaagcacaagttccacggcgcctgcctctacaagtggttctccacctccaacaagtccacatgcccgctgtgccagacccccttttagtttagttagcctctagaagcaaatcctttcatgttcacatggttcatgttgtgtcgagttatgcatcaagtttgtttgttgttagctggggatgtatgactttttgtgtgtgagcccagcaaaagaaacaaattttggaacgcagtagggagcatccaaattttgtgcaaatagagggacatgttgtaatcgggaattatgtgagatatgttatagatgaggatgatgaaattacaggagcactgtagtaagttcatgatcgttatagatgaggatgac

SEQ ID NO: 15327 - DNA, 1228 bp, Triticum aestivum
  unsure (1)..(1228): unsure at all n locations
  Clone ID: PAT_TA_15327
tcggcacgaggcaagcatgcagatggtggccttcagcagcttcctgctccccccgccgtcgcctccgctgcccagccccgccgcagccgccgcctccgcctccacctcctcgtcctcgtacccagtggccacgcaccgcggccgccgcccgcgggaacctcgctgccgctgcggccgctcgccggagataacccccgccaccaccaccagcagcggctccggcgaccgcggcccgtgcgaagaggaggacgcctccgccccgcctcccctccccgtcgaactcgacagcgccgccgccacatccgcggacagcctaaccggaagtgcgacgccaagatatcaggcaacttcgactaaaggggacactaggaatggagattttgaaaaatgggaaaacaatcaacgcgggacagatggtttatccagtagcaagtccaagtcagcttactccaaagcatttgngggtggatttgtcccctgataacgtggctgttgccactgtttattttgtgcaaggagttttaggtctttccagactagctgtcagcttttacttaaaagatgctcttcagcttgatccggcagagactgcagttataactggtttctcagctttgccgtggttggtcaagcctctttatggttttatcagtgattccgtccctctctttggttatcgaagaaggtcgtacctcattctgtcaggactccttggagcaatttcatggagtttgatggcaacaattgtggatgacaagtggttgattctatggttgttgagagaactcggggtgagtcacagagcacatctggatctctccagtcactgtgttggggatcttcagcctttggggcaattgtgagcgcatacttcagtggttctcttgtggatacttatggtatttgtctttggtgttacagcatttttacccctgatgacatctgctgttgcagttcttgtaaatgaaaagcgtttgcctactgaggaacgttccatctcactttcaagttcaaggttgattgaaagctctaagcagcagatcaggcagatttggactgctgtaaagcaaccgaacattttcttgcctactttgttcatattcctttggcaagcgacaccacagtcggattctgccatgttttatttcgtcacaaacaagattggattcactccagagtttctagggcgtgtcacactcgttacatctgttgcatccttgctgggcgt

SEQ ID NO: 15328 - DNA, 526 bp, Triticum aestivum
  unsure (1)..(526): unsure at all n locations
  Clone ID: PAT_TA_15328
gcgcgccggcgcgctgtgggatgatttggacgagatgactgatgaggacatgagcgttgtcggatgacttggacgagaggactgtagcacgacgcaatgaagagccagatcgtccgtccgctcccagctcacttcccagttctgttgtgctgccccgtgcaccaaccatccagtaaaggtgctgtggtttgctgcccttgtgcgtgtttctcatatctggcgttgtctcctcattatcggttcagccgcatgttggcgttgtgcctctctcgagtgcctcttcttctttccaggtcggctgccgcgggtggcggcaaccccgtgggccacgcatcccctgccctacttccttgccccccctctggggtcgcggtcctcgtgctggggcgggcgccgccggactctgggcgcgtccttctattgtgttcagctagtccactgtgttattgttgtttgtatgacaccttagagtgaaatagtacttcttttaatcatttttaggtgaaatacaagcatgtagctacnn

SEQ ID NO: 15329 - DNA, 1044 bp, Triticum aestivum
  Clone ID: PAT_TA_15329
tgcccttacatgcttcttcaagcctgaggtattggagggtgcaaacaaatacagttgtgaaagatgcaagaagctcacctcagctcggaagcaaatgttcatactcaaggcacctaaggttcttgttatacaactcaagaggttcgatggaatacatggtgggaagatcaataggaacatagagttcaaggaaggtcttgttctttccgacttcatgtatgacaaaaaccaggctgctgattctgtcccagacaaaaaaaggaatatactgattaataagtaactctctttaaggacccacaaccggtatataatctttttggcagcatcgtccattcaggtttctcccaagattccggtcattactatgcatatgttaaggatgctgctggtcgctggtactgttgtaatgattctcatgtctccctctcaagctctcaggacgttttgactgagaagttaaatcttccaacaccaatgggaatggcatatcaagtgccgcatgtagtgagcccctgaagataccattagtgaagcagaatggctcatgctctactaaaggtattgtgccactacccctaaagaatggcaagattgcaccaggtctacagttcaagccgatccacttgaagaatacaggaacagagaaggttgcatcaaatggcaaaccgcaccccattttgagaaagccagaagttaatgaagccacaacactagtggaatcgaacggatgcggacctggaaaatctgcagaacccagtgaagggtatgctaatgatagtatttcctgcgataagttggatgctgattcacaaagaattttgcaaggcacagatggaaatggacatccagttcattttgttggcctccaagagaccagtggtgccaaggccacgtgtgctgaaaacccccctgaacagccatctagtgttgttacctcaacattgggacaagaacatttgtagttcagaaaaggtcctaaaagttcagttttacaccctgaagtactgctgactcagtcaaagcagtggtggctcaaccaaa

SEQ ID NO: 15330 - DNA, 2070 bp, Triticum aestivum
  Clone ID: PAT_TA_15330
gagaattgcaaatgctgctcaacaaatggccaatgtatcaaagggaagcagcggatctgtcattctattcattgaaattttgaacaagtatctgtacttctttgagaaaggaattccacaaatcacgaacactgtcatccaagatttgatcgaactgatcaggacagagaagcaaaatgacagcagtgcttctgatccgtttttgcaagttgaagcttttgcgaagttcagcaatgctattggaaaggtgatagaagctcaagttgacatgccggttgttggagcagtaactgtttatgtattactcctcacatttactctccgtgtgcgtccagatcggcttgattatgttgaccaagtgctgggtgcatgcgtgaagaaactttctggcaaggaaaaacttgaagatagcagagcaacgaagcaaattgttgcacttcttagtgctcccctggagaaatatagtaatattgttactgcattggagctttcaaattatccccgggtaatggattatctggataatgctacaacaaaagtgatggctctggtaataattcaaagcataatgaagaacacaacctgcatatctacttccgacaagatcgaggctctttttgatttaattaagggccttataaaagatatggatggggctcaagatgatgagcttgatgaagaggattttaaggaggagcagaattctgtagcacgccttattcacatgttgcacaatgatgatcacgacgagatgttgaagatcttatgtactgttcagaagcatatacttcagggaggtcccaagcgtctacctttcactgtgccgtcgttagtattctccgctctcaagttggtcagacgattacaaggtcaagatggagatgtcactggggaggaagttcccgcaacccctaagaagatatttcagatcttgcatcagactattgaagcactccaatgtattccttgtccagaattgtctctcagattatatctacaatgcgcagaggctgccaatgattgtgatttggaaccggttgcttatgagttctttactcaagcattcatcttatatgaagaagaaatagcggattctaaggctcaaattactgcacttcacctaataattggaacccttcagcggatgaatatatttggggtggaaaatagagacaccctcactcataagacaacagggtactcagcaaaacttctaaagaagcctgatcaatgccgggcagtctatgcatgttcacaccttttctggactgatgaccaagatggaatcatggatggtgaaagggtcctcctttgcttaaagcgtgccttgagaattgcaaatgctgctcaacaaatggccaatgtatcaaagggaagcagcggatctgtcattctattcattgaaattttgaacaagtatctgtacttctttgagaaaggaattccacaaatcacgaacactgtcatccaagatttgatcgaactgatcaggacagagaagcaaaatgacagcagtgcatctgatccatctgccgaagctttctttgcaagcactctacgatacattgaattccagaagcagaaaggtggaagcataggagaaaagtatgaacagataaaagcttcgtaactcgagacaagtagggcattgcgacaaggggtttccattttgtctgagagaaagcaagctctttttttttggtgatgtgttgagtaaaaacacaacctgatggtttcagctgcctccgaccgagagatgtctgcacagttgtggtttctgaatctcatgctcaaatcggtgcatgcccaccctttagctacaatgtttgggttacttactacagttgatcaggtggtaataagctgtactctttgggaagctcaggtctgtacaggatacttgtgtaccggagtgccattgttgtatattcctttttctctagttatttcgcaaagcgtgtgaattttaggtggacactcggagtacatatttttatttatcagactggtgttttgattaatttatagtgatgaaggcattgaatttagaactaaaaaaaaaaaaaaaaa

SEQ ID NO: 15331 - DNA, 821 bp, Triticum aestivum
  Clone ID: PAT_TA_15331
cagctcaccaccaaaaggcacaagggagactaatcatttaactcctgccgttccacctttgatacaccgggccattcaaacccccccacaacagaggcaacatcctcattcaaatggaccagttgcttctccaagaacaacaatccatcctgccaaccatgggaaggccaatcgcgttccagttgcatcacctttaaaaggaagacatcaccattccatacctgtaaataatacacatgggatcagtggggctccagttgtggcaccgtcaaagggaaggcatcaccgttccttgcctgtcaataggacatctgtagaaggacctgtcgtttctcctcaaatttcccccagcatccgtaggagaggacatggcattccagttgctgcaccgccaaaggaaccttccagccatgtaccacctgcaaatcataaacaccacaaaggttcctttcctgtcataagccctgctccacatagaactggtaatgcttctgcaacaagccatggacattcaggtttagatcatggtcctgccccagcaccgctagtcttgcctccatcaaatggaaaagatggaaatccagcgtatgctccgcatcaccctcgtcagtatcattcaccttcatattctccagaacatgctctaccacctgacaatcctgcatttagaaagcccagggctttggcaccagcaccaagtcattccttgccgccgccacctccaaattcatactgcacggcgttaaattgtaaagatcctatgaccaatagtcctccaggaacaacatgccctctgtgtgttgccaataaaagttgagctt

SEQ ID NO: 15332 - DNA, 633 bp, Triticum aestivum
  unsure (1)..(633): unsure at all n locations
  Clone ID: PAT_TA_15332
ccgcgccgcttcccctccccgggccccgtgcccctctcctccgccggtggggttcccctccggagctccctctgcggtcgcgcgctcccgcctcccccgctcggtcggcccccccccccccggttctcgccccgtccgcccgctcggcccccagccgcccgcacgcccgccagccgcgcccgcccaggccgggccccgcccccccccccccccccgcccaccctcgcttccccgccccgcgcttctcgctcccccgcgctctcctgggtgcccgccttggggcgccccccccccgccccctcgtccgggcctccggccgccccccgcgccgcccatcccggcccgccaccccgcctccgacccgcgcctggcagccccccccgccccccccctcctcgggccccctgcccgccccccgctcccccggagcccgcgctcctcctccccccccgccccacccgctctgtcgccccgccctcccgcctcctcccgcccctcgccgccccccgcgcccggcccttctcccgcccctctccccccctggctcctggcctcagtcgactcccccgctgctgttcgcgcgccccccgccgnnnngccatgctcctcgtccagccgcggcncacctgctat

SEQ ID NO: 15333 - DNA, 698 bp, Triticum aestivum
  unsure (1)..(698): unsure at all n locations
  Clone ID: PAT_TA_15333
cggcacgaggactggttcgtcacgctcagctcctgggactatcctctcgtcacgcaggacgatctcttttatgcattttcttctgtaccaaggcacctcgacgttattgatcacacaagtaacctcggatggaaagagcatgaaaggtttgaaaaacttattgtcgacgcaagtctatatatggacaagaatacccagccctttcctgcgacagaaacaagacaaatgcctgaggcattcaagatattcacaggctctccatgggtaattctgagtaggaacttcactgaacattgcgtgcatggctgggacaacctcccccgcaggctactgatgtactttgccaacgctgcttactccatggaatcatatttccagactgtcatatgcagttcatctgactttagaaacaccactgtcaacggcgatctacgtttctttgtttgggacgatcctcctgggctggagccgcgtattcttgatgaaacgcatctcgataacatggtgaacagcagcgctgccttcgcaaggcggtttgtggaggaagcaccagtgctgaagaaggttgatgatgagctactgaaccgttcttcggcccagttggttcctgggtgtgtggtgccggaatttgggtgaaaagcaaggaggcggggatgtggaggcgtgctcggaatggggcgacattaacgttgtcannn

SEQ ID NO: 15334 - DNA, 620 bp, Triticum aestivum
  Clone ID: PAT_TA_15334
cggcacgagcctacgtctactcctgcaacgccttcatgtccaccttcagcttcctccaggtcgccgccgtggggctctgcgcccaccgcagcctcggcctcgccgcctggctcgtcacctccaagttccagatcctcaccatcctctacgccggggtggtggggtgcggggtgtcgttcgtgctgctgacgtggtgcatcgagaagcgggggccggtgttcgtcgccgccttcgtcccggtggtgcagatcatcgtctccgtcatggacttcaccgtgctgcacgagacgctctacctcggaagtgtgctgggatcggtgttggtgataggtgggctgtacctgctgctgtggggcaagcggcaggaggccctccagcagcctccaaaagtcgcagaggatgacacggagcagcaacaacaacaacagcaacatcaccaccaccaacaacaacaacaggtgcaggtgcaggtgcagatgcaaccctgaccctgactcaagactaggaaagcagaggagcgctccatccattgggtgggtgggtgttaacaagtgcggtgcagcaaataagttctccaacacgcttttcagtttttttgtttccatgttcttgtgagagtg

SEQ ID NO: 15335 - DNA, 364 bp, Triticum aestivum
  unsure (1)..(364): unsure at all n locations
  Clone ID: PAT_TA_15335
gctaacgtccgctttgagaagagaaaaaagccaagagaagaagaataagatggacagtggcggttcatccgggggaaacaaccaaggcaagaaaaagggcaagaaacgtgtgctgaccgctgaagagctggaaaaccggcagcttgagaacgtgcaacctacctcttgggacgatgaatggattgtaacactgaacatcacagataatgtggtggaggatgaagacactagcaagcatcgtgagcagtttctcgacagacagccccttctcgatagacgccgaggaggagactgacaaggaggaggctgacaatgaaggaggaggaggaggctgacaanggcggaggaggaataataggttgat

SEQ ID NO: 15336 - DNA, 917 bp, Triticum aestivum
  unsure (1)..(917): unsure at all n locations
  Clone ID: PAT_TA_15336
ttatttagttcttcaaactanttattggaagtcggaattgttccttcaagtaccaaccccaagtatgtcttttgaancaggnaatataatatgttaaaatanttantgcttcatgtttgtgtttccttttgtaacaaatcgccgtgccntgccggctatgctatatgccccacatatttacacatgtctccctcttcactggttttctttcnacgcacccaggcggagctcttggtggtcaagctgatgcttcttcgcctcctgttgaagaaaaggatgataaggatgtcgaggctcggagtgacccaggaacaagtggtgctgctttttatgctgcccctcgagatatgcatcccttcagtttgtacagacaaaacaaatattcatttctgactagaactaaacttgcagttaagaaactctgctgctggaaagggagctggggtactaaacagaatatagtttgagcctgccagttctttttaatcctatggcctgtatttttgccagcaatcgtcttttatgtctggttcccaaagttattagttagcctgcctatttctcgccgtttgataacctatattataactatagagaatatagtttgagcctgccagttcttctgccttggatatgaaataatgaggcagttttaatatttgtcgtagattcacctgagtttattttaaactacaggatgcatcactgatggagaaataccttacagaatgatgctgagccccatctggattggaacctttttggagctgcttatgcttggtgcggagcgggaagcctatgatagcaacagtattggactccatagaactggaactctatacctttcttatgtagctcttccttttgttgtcttccctagaaggggatgatgtagtttttctgaattacatgtctcc

SEQ ID NO: 15337 - DNA, 1266 bp, Triticum aestivum
  Clone ID: PAT_TA_15337
ggatgctgcacgagcgtggctgccccccgatctccgtcactagaaccagccacttgagcgctccaaccgtgagccccagccagctcgccgcgagcggagagcctcaggtttcgcccccccgtgcggcggcctgcaaccggccacctcaggctttgaagctcagctggctcgccgcgtccatggagtctcgagtcttgcgcgctgccgcgcggccgcgggcagcagcagcacccgcagcgagcgcagcaccgggcggcggcccaggccaccgagagcgagacggtctactccagcttcgaaacggtgggcgacggccggatcgccgcgacagcggaggcgcccgtttcccgcgacctcgcggggctggccgcaggcgccgcaccaggccgaggagaacgggcggccggcatcggagggctgcgaggcctacaacgtctactaccgcggcgcccacggcggcgcctccctggcctcgggctgcgagctgccgccgccgccgcggggaagcgcgccgcagcgacacctgcgcgatcgatgacgccagctggggccgttgaaggtcgagctcggcgccggccgcgacgcctacgaggatctcagaaagttcccaccccgccacggccgaggccgcgagcggcgcgagctcgacgccgagctgcgcgacgccttcgacgtctacgacatcaacggcgacggccgcatctccgtcgccgagctcagcaaggtcctgagccgcatcggcgagggatgcagcaccgaggagtgcgagaagatgatcgcctccgtcgacgtcgacggcgacggctgcgtcggattcgaggagttcaagaagatgatgaccgccggtgacgccggcgcaccacctcaacccgaagcgatcgccgtgcctgacagcaacaaacccaagaaggagtgatacatgtgcttttgcttgtaaaaaaattgtaatccgagggagcgaattagttggtcagtccctgttggccatagtcttctggtctgaaaaaaaatgggaataaggaaaaaaatgcaattgccagtgtcgtgctgtacctctacgataacggttgtgtgtgcacggtagcagtactagtactagatattttctccgagtatggtcatcttgctacttcattttcacatgaaaatgaagtgccatgttgatgttgaagggtgataagcatccattatcaatgttacttgtaatcgcattcggcaataaatgtgttgtcatcttaaaaaaaaaaaaaaaaaaaaaaaaaaaaa

SEQ ID NO: 15338 - DNA, 1832 bp, Triticum aestivum
  Clone ID: PAT_TA_15338
caacgattgtggtgttcgtgaatatgatatggagagatatcagctcgtgcaccactaccgatatcactcgccgcccaatcacccagccgcgagcccaggtagggaacttctgcctgtgggtcggagtgcttcatgacggtctgcttgtggatacacgaaacggagacggtaacctctagcctagttgggccattttgtactatttattagctagagcatgacacccgcacagactgggcagtccgcgaccggcccccgatggaccaaaccgcccgcgtccgggaccgcccggacctcgagggcgccgaactggacgctctgctcgctgggataactgacacatcagcaggtgtagcgagggcaggcaaaggatatacaaggttgaccatggtcagaggttatgaatcatcaggcaggattacagaaaagctaggttggaacagtacaagaactatgagaacttccctcagtccggagagctcatggataagttgtgcaagcaagtggagagcagcagcaagtactatgaatttcaatacaacactcggatagtgaaaccctcaattctccattttcagcttcggaatttgttatgggcaacttcaaagcatgatgtttatttcatgtcgaattccacagtaggccactggtcgtcattgtctcacaaaatgacagatgttcttgatttctcagggcatgttgctccagcaaagaaacaccctggctgtgcactagaagggtttactggcgttcaagttagcacacttgcagtaaatgagggtttgttggtcgctggtggttttcaaggagaactagtttgcaagagtctaggagaacgtgatgttaagttctgcacaaggactactttgagtgacaatgctatcacaaatgctatggatatacacagatctacaagtggaagcttgcgcattacggtatcgaataatgattctggtgttcgtgaattcgacatggaaagatttcagctcttgaatcacttccgttttaactggccagtgaatcacacatctgtgagcccggacaagaaacttttggcagtagttggagatgaccgggacgctcttcttgttgattcacgaaatggcaaggtaacttctaccctagttggccatctggactactcatttgcctcagcgtggcacccggatggtgtcaccttcgcaaccgggaaccaggacaagacctgccgggtctgggacatccggaacccgtcgacctccctcgcggtcctgaggggcaacatcggcgcaatccggtgcatccgctactcctcggacgggcggttccttctcttctccgagcccgccgactttgtgcacgtctacagcgccgccgagtgctaccggaagcggcaggagattgacttcttcggcgagatctccgggatctcgctcagcccggacgacgagtccctgttcgtgggggtgtgcgaccgcgtctacgccagcctgctgaattacaggatggtacacgccaacgggtacctggactcgtacatgtagaggaataaaacctttgtgtttgacgggaaagaaagagcgccagaactgctgaaaatctgaagatctcgctcggcccgggcgacgagcccctgtcgttcgagggggcgagatatgtcagcgtgctccattacaggatagtccaggtgtgccttcgggcacctggactctgtacatgtagagaaagaaagcttggtgcgaagtttagtgtgttcgtgtaaaggaagagcggaattgcttaaaatctgccgaactgtaacttttaaggagatcagtatggaatttataccaacttcactttccgaacacaaa

SEQ ID NO: 15339 - DNA, 1062 bp, Triticum aestivum
  Clone ID: PAT_TA_15339
ccacgcgtccgcggacgcgtgggcggacgcgtgggcggacgcgtgggcggacgcgtgggtcatccacgatgctcgcgaccgcctctccgcacctccacgccgcggcgcaccgcctctccctggcggcgcccgcgcgcgccgcccgctccgcgcgcctcccgttaaggcgccccctccgctacgcgccgctgcgcctgcgcgcctcggccgctgcggaggccgccccgtccgcgaaagagggggccgaggagctggggttcgaggagatggtggcccgcacgacgcggcggtactacatgctcggcgggaaggggggcgtcgggaagacgagctgcgcggcgtcgctggcccggcgcgtcgccaacagcggccaccccaccctcgtcgtctccaccgaccccgcgcactccctgagcgattcgtttgcacaggatttgactggcggggctctcgcgcctgtcgaaggtactgattcgccattgtttgcgcttgagataaatcctgagaagtctcgtgaagagtttcggacaataaaccaaaagaatggagggaccggggtaaaagatttcatggatggcatgggcctagggattcttgctgatcagcttggggagttaaaactgggcgagttattggacacaccaccaccaggattggatgaagcaatagcaatttcaaaggttatacaattcctcgaagcaccggagtatagcatgtttagccgcattgtatttgacactgctcctacgggccatacactccggttattatctttgccagacttccttgatgcatccattgggaagattttgaagcttaggagcaagattgcttcagcaacatcagctattaaatcagtatttggacaagaagttcaacagcaggatgcagcgaacaaattggagcaactcagagaaaggatggtcaaggtgcgagagcttttccgtgacacagaatcgactgaatttataatcgtgacgattccaacggtcatggcaatcagtgaatcagcaagattacattcttccttgcaaaaggaaagtgttcctgtaaggagactca

SEQ ID NO: 15340 - DNA, 837 bp, Triticum aestivum
  unsure (1)..(837): unsure at all n locations
  Clone ID: PAT_TA_15340
ccgctacccagcttccgctccctgcctcagcaccagcctaacccggcagacgccaaggtcaagcaaccgagcgcataaagcaagcgcaggagccagaaccttcctcgatcgaccagccacagtcgggcggaacaagaatcagggcgacgacgccgggggttctccgctttccgacggcaagcgaggtggcagtggcaccggagggatgggcctttcggcggtgaggcgtaacacgccgctcttctccaagtcgccggcgtccctgctgctgctctccaagctgctcaccctctactgttgagctcccggcgggcggctgttcccttcttctcggtcgagcgagtcatccatccatggggcgccgtggggtcgtccgcgagccggggcgggggcacggcgctgggggacctgccggagaactgcgtcgccgaggtgatgctcaggctgaacccgacggagatctgcggngttggcgcggctcagccgcaccttccgcgccgccgcgtccggggacgccgtctgggaggccaagctgccgcgcaactacgcgcgcctcctcgccgccgccgccggtggcgacgaggaagccgccgcgttggaggcggaggctatcccaaagaaggaggtgtatgcgcggctctcccgccgcaactccctcgacggcggcaccaaggagttctggctcgacaaggctggtggaggcacctgcatgacaatctattcgagggcgctttcgatcacaggcatcgatgacaggagatactggaacttcattccaaatgatgaatcaaggttccgttcggttgcttatctctcccaaatctggtggtttgaagt

SEQ ID NO: 15341 - DNA, 488 bp, Triticum aestivum
  Clone ID: PAT_TA_15341
cggcacgaccgcccctccccgacccgacccggcccccctccggcgcccggcgatggagatccccaccgccaccatccatcgcctcctatcctccattcgggagggcaccacggccgcgccccctgcccctcccttcccctccgtcgccgacgccgtcgccgccttccgaccccgatgcctcaccggagctcctgtgccgggcgctgcggcgcggccgggcggcctcctccgcggcgcgcagcccgccgtctgcgtccactgcgggtcccctaggcgtggggagggcgatgacatcgccttccgaggcagtgcggcctaccagtggctcctcggctcgctccggcttgatggatctgctctcgtagaatttgatggcgactctacggattcaaataaaagcaaggagacaccaaagagtgggttggtcttatctgatcttctggacttaaaacttactttccccccagagaatagggaaatatctggaa

SEQ ID NO: 15342 - DNA, 742 bp, Triticum aestivum
  Clone ID: PAT_TA_15342
cgtccgcggacgcgtgggcggtgacctacagcacctacgttgccgggctctgccgggctggatatatcgaggacgcgttccggcagctggacatcatggtcgccaaggggctacagctgaccgtggtcggcctcaacatactgctggattacgctgacaaggatgtagatatgtgggttgccaaggaggtgctggagcgctgcgaagagctgggcttcgaggtcgacgtcgtgacgtacaacacggtcatggaacatttctccaagaagatgcagtggctgattgccctcaggctgttcaccgatctgctcaagaagcccataacacccgatgtgcagacgtacaacatcttgatctcatccctgtgccgagccggcaagtttgagctcgccaagttcgtcttcagttgcaacgggtttgtggcggacaccgtcacctgtaacattctgatccatcagttctacggtgctggaaaggagggtgagcttgggttcttgttctccgatgttgacgcagggaagattaccccagatacaatcacatacaacacgctggtcgattgcctctttaggtctgggaggaggaccgaggctgccaatctggtcaggcacatcgatggcggctaccctgcggagcccgtagcgcatctggctttctggttggttaggagcggaaatgttcgagaggctttgagtctgtttgatgacatgctagtgaaaggagtcgctttagatgctatggt

SEQ ID NO: 15343 - DNA, 916 bp, Triticum aestivum
  unsure (1)..(916): unsure at all n locations
  Clone ID: PAT_TA_15343
cggcctcgccatggcgacccagaagttggatgcagctgagtttgagatcatgccactgatggataacagatgttgcactgatgcccatcgcctgctctttggtcagcagttcaatgattttgttcgtgattgccaggatgcatttgctggtctcacgcggctgcatctacggaatatgaggtttggtaaatcagatatatccaacatccttagccattgcaagcggttggagttcttgtctttcttcgaggttgacgagggggtccgttcggtgctccatgtagaacacgctcaactagttgagcttgttatcatctttgggagatttgaaacagtggagcttgcctgtctaccaaagctccagcggatgtcctatagggattggcagtatgatgacaatcccttggttcttggttttgtccctcagctttcgaagctcagtcttgcttgtccatacttatcaggcaagacactcaacttaagcaagctgcttgctaatgcccccactgtaagcgatttgtatctggagtttcgaagtgaaaagatttggattcaaccagaatgccaaaaagtgcttgctcctgtgcttgccaaactacggtttgtgaatctggatcatcttcgcgaagaatgtgatatctcctggacactctttcttcttgaagcggcaccacacctaggggcgctctgcactaccatggggggaccgccatcccgcaccgaacacgtcccacgctccgttgaattggtctccatgcgcctcctgacccgttttctggaaggccggggaaggtgataccacggtccaatccgtgaaatcacggtaatancccgcataaagtgcggganacaaggagnacctgtcncagaagggnccattggttcaaagttccaggggnttccctcggtacacgna

SEQ ID NO: 15344 - DNA, 1615 bp, Triticum aestivum
  Clone ID: PAT_TA_15344
cctggtggagtgcgcgcccccgcccggcacccccccggaggaatggggcctcctcctggggcccccggtgccccggccccgccccggccgccgggccgccctggggggccgggagccggggccgccgggcgccgggtccggggggccccgggcccccccctccgcctccaccgccgccccctcctcccccaccgcttccaccccctccggcccctggccctgggcccccgcccccccccggggggccagggccccccccccccccgcccggccccccccccccgccccccccgccccccgaccgtgggccttcaccgacggcggcagcaaggcgctgcattacgcccccggcagctacacacgagaacaccttcaaggggttggattttgtgatgtctgaggctaggaagaatgggattaaggtgatactgagccttgtgaacaactatgacacttttggagggaagaagcagtacgtaaagtgggcaagagggcgggggcaggccgtcggatctgaagatgacttcttcaccaactccgtcgtcaagggcttctacaagaaccatgtcaagaccgtgctgacgaggctgaacactgtgactggggtggcgtacaagaacgacccgacgatcctggcgtgggagctgatgaacgagccccggtgccagtccgacctctccgggcggaccatccagtcgtggatcgccgacccgcccgcccgcgtcaagtccatcgacggcaaccacatgctggaggccggcctggagggcttctacggcgcgtcctcgtcccgggccgcctccgtgaacccggccggccgccaggtgggcaccgatttcatcgccaacaaccaggtccccggcatcgacttcgccaccgtgcactcgtacccggaccagtggctgtcgagctccgacgaccaggcgcagcggagcttcctgggcaggtggctggacgcgcacatcgcggacgcgcaggggacgctgcgcaagccgctgctgatcgccgagttcggcaagtcgcagagggaccccgggttcagcagcgcccagcgggacgcgcagttcggcatggtctacgccaagatctacgagtcggcgcggaggggcggccccacggtgggcgggctcttctggcagctcatggccgacggcatggactcctacggggacggctaccaggtcatcttcgcggaggcgccggcgtccaccaccggcgtcatcacgtccgagagccgcaagctcaagatgctcggcaaggcgttcgcgcgggccgagcgcgccaagcgggacgcgagcgggaaggtcaccggtggcaattagagaagaccaccgaccacgactacaacaaaggataagaatgcgtgctttctttcgtgtgtgagtgagtcaagttctcctcgagatgattcaagattattcatccgggagagaaggagtaatatttgtcatccttcttgttaccttccttgggaagaggacatgttttcttcagtgtttttgtggatcacgagatagccaaatgtggactgatcatcatggcttcggaagaagcagccggtgattagaaccttgatcatactggcttttagtttttatccatcttgatcttagtg

SEQ ID NO: 15345 - DNA, 867 bp, Triticum aestivum
  Clone ID: PAT_TA_15345
gtcaccggccagcgtccgcctgcgctggcgaggtcgggcacgacctgtcggttggcggcggctcgacccgttcctaaatcaggagctgcgaggaggccggggctggggcgtgatgcacgggaggctccaccccgcctccatctctacgcgtgcagcagcgaccccggaggagctcaagccacatccgtggtccacgtcgccgtcgtcggcaggaggagcgtgggtcgcagagagggccggctcagtccggctttcgcgctgccgtccatccacccgagacaccagtccccgcgtcctcgcgtacatcctctctcgctgtcacacacactctctcttccgtcctctcacgcacgtcctcgtggccggatatttgtcactggttcttgaggaaagcagggaactatgagacttgcacagtttgggcagcgtcagcacaacaggcagagtttctgttcaagtagtagcagaccagcaaagcgcggacgaggagatccaggtcacgggccatccccatttagccatcgtcaaccattgttgctggtatcctcacttttttagaaccaaagaaatattgcttttcaactcagatgtgtgttaggtgatgttgcatgccatttttgttcatcggcctgacatgatttggattggtgcagaggtcggtgtgaatgaaaagctagcttctgaagacgcagtcgattattattgcctatttttctattgaaaggtgttgcttcttttatcttgacagtcgacgtctgctggacctgccagttctcaggtggaaggtggtgaccagcagcgcgcacgtggacaatgattgggatggtgctattacccgtgcacaagactgcctaatgtctattctgg

SEQ ID NO: 15346 - DNA, 704 bp, Triticum aestivum
  Clone ID: PAT_TA_15346
cggcgcgggcgtttcgggggcggcgccgtgcgtccccgccgcgctggagttggctcggggccttgcccttgcgggcgcccgtcgctggctcgagggctggtgaggctcgacccggagccccgtgcttcgcccgcctcgccgttgccggcccgccccttccgggccgccgtcttcccgctggcgcgctccggcctgcgcggcgcctcttttcggacgagcgccaggacccgggggccggcggccctgcccctctccccgggcgctgccagtgcgctccaccgccatctcgcgtgctgctacactgcacccccgcccagcctgcccgcggcggctcccgtcgcgccgccggtccctggcccctgccctttcgccgcggggcccgtccctcgggcgtgcccatgccctgagttgcggagccttatcgaccgcccccccgtggctgcgtctggtccgggtgtcgcgcagcccggcgcgccagctgctgtctggcctgcggaggccgtcagagccgtgcccatgcggcgcatttccgcattcattcttcggccaacatgtggtttcatttcagacgagtgcaattaccaatgggccgggagtcatgccggtctgcctggacacttccagtgggataaatgccagagcctaaagtatggaggtccgatggctgtggagtggtcataccctgagttacagatgcttaatga

SEQ ID NO: 15347 - DNA, 1466 bp, Triticum aestivum
  Clone ID: PAT_TA_15347
cccacgcgtccgcccacgcgtccgcccacgcgtccgcccacgcgtccgctcatccaccaatcatcagttcatcacagcacgaacgacatggctgctgctccggtggttgtgccgcgcatgaagctgggctcgcaggggctggaggtctcggcgcagggcctcggctgcatgggcatgtccgcggcctacggcgagcgcaagcccgaccaggacatgatcgcgctcctccgccacgccgtcgccgccggcgtcaccttcctcgacacctccgacatctacggcccccacaccaacgagctcttgctcggcaaggcgctgcagggaggggcgagggagcaggtccaattggccacgaaatttggcatcacggcggcctgggaggtccacggcgacccggcctacgtgcgggcggcgtgcgagggcagcctcgcccggctcggcgtcgactgcatcgacctctactaccagcaccgcatcgacaagaatgtccccgtggagatcacgatgggtgagatcaagaagttagtccaagaaggaaaagtgaaatacgtcgggttgtcggaggcctcggcgtcgacaataagaagggcacacgcagttcatcccatcaccgccgttcagctggagtggtctttgtggtcaagagatgtcgaagaagatataatcccaacttgcagagaacttggcattggaattgtagcttacagtccactaggcagaggttttctatccactggacctaaactagtggacacattaccagaagacgatttccgcaagaatctcccaagatttcaacccgagaacatgaagaagaatgcagagatattcgagcgcgtgagcgagatggctgcgaggaagggttgcacgtcgtctcagctcgcgctggcttgggttcaccaccagggaagcgatgtgtgccccatacccggcacgacgaaagttgagaatttcaaccagaacctgagagcattgtctgttgagctcacggctgaggagatggctgagctcgagtcctacgctgccatggatgcggtccaaggtgatcggtaccacaacacgttcctcaacacctggaaggactccgagaccccttccctgtcatcctggaaagccacttagttgggtatcatgggaatcaatcactatgctgatgcttcgtatcactggtttgaaatagttgcaaatcaaataatttcacgagcactccgtgcatggatggaatcatggaaccaccaattgtttactaatgtagcacaattcctgcccatgagtgttgaactttttattatgcctgcaaggaagtatcccccaagtgttgaactttttggcagggctacaaagggccttttgtaacacattttcgtccggaaaaccatttagaattcccaacctcatgtgaagattgcggtacgcgtcgcacctccttacaggggccgaattacatcaattgttgcaccttctac

SEQ ID NO: 15348 - DNA, 1622 bp, Triticum aestivum
  unsure (1)..(1622): unsure at all n locations
  Clone ID: PAT_TA_15348
ccaaaccaacccggtgggccgccgatcgacccggccacgccctgatagcagcatcttgccggagaactgagctcccaatgcatcaggcccagcaggctcggacggagtggctgcagttcccaggacaactagccgcaccaagtttacgtcccagggactcgattacctgccggcaacatccaagtccagcggggagcactaccttgacgaccatggcgaccgctcctgtcacggtggtgccgcgcctgaagctgggctcccagggtatggaggtctcggcgcagggcctcggctgcatgggcatgtccgccttctacggcccgcccaagcccgagcacgacatggtcgcgctcatccaccacgccgtcgccgccggcgtcaccctgctcgactcctccgacatctacgggccgcacaccaacgagatcctgctcggcaaggcgctgctggggggcgtgagggagagggtagagctggccaccaagttcggcatctcgttcgccgacggcaagcgggaggtacgcggggagccggcctacttgcgggcggcgtgcgagggcagcctcgagcggctgggcgtcggctgcattgaactaaaataacaccaccgcatcgacataagggtgcctatcgaggtcacggttggagaactcagagaagcttgtcgaagaaggaaaaataaaatacatcgaattatctgaagcatcgacataaacaatccgcaaggttcatgctgtttatcctatcaatgcagttcaaatggactggtcactgtggtcaagatatgtcgaagaagacataattccaacttgcagagaacttggaattggaattgttgcttacagcccacttggctagaggattcttctctaaaggagcaaaattggttgactctctatcagaccaggacttccgcaagaatttacctagatttcaaccagagagtctcgagaagaatgcccaagatatttgagcgtgttgatgcgatggccacaaggaaaggatgcacaccatcacaacttgccttggcttgggttcaccatcagggaagcgatgtttgccccatccctgggacaacaaaaattgaaaatttcaaccaaaatgtgggagcattagctgtgaagctcacaccagaggaaatggctgaactcgagtcttacgcggctgcaggtgatgttcagggtgacaggtaccctccaatggctagtacttggaaggagtctgagacccctccattgtcatcttggaaagctgagtagacagtttcatctcttcaacaactacactgtttacttttgatgagaaggtaaaagcagggtagagttgaacccaggatttgttttccatttctgcagatgcatgtatatgaactgagctgcgatgtgtgtatgttatgcttggttgccgatttgctcctgcttaataaatgtcattgctaccaaggcttctgtattgtattgaccaacaaaatacaagtgatgtgtgatattaatatgtcggcagaatgaataatcctgtttaaattatgtaatgaaaccgttggtagagtaaaaaaaaaaaaaaaaaaaanctcgagantagttctcacctcggccgcgaccacgctaatcactagtgaattc

SEQ ID NO: 15349 - DNA, 621 bp, Triticum aestivum
  unsure (1)..(621): unsure at all n locations
  Clone ID: PAT_TA_15349
tttgagcaagttgtctctactctgctaagcttcgtgaaaaccttcgagcgggcccatgccgagaacctcaggcaggcggaggcggagaagaagaaagcccagatggaagctgaacgagagaaggcgaaggcagccgccgctcacaagaaggcggggtcgccggagccaggagtttccgaccgatgactgacccgtcgtcgaagctagacacgacatatttccactaatttcttaccgtgtgaaagtggaggccaggaagacaaagctccgtgtaaaaagaaaagtcacaggcagtagtgcataccaatgtggcaaatgtgattgataggtagacttgatatagcgacgcatttagcacatagacgtatagcgcactgctgctcactgtccatagataaagttttgtaccgctgctcactgtccatagggaaagaagttcgtacatacatatgttgtatattttggggtttttccccccctggcgacaaacaaattttgtaaatggttccttccgtacgtttacaactatgtacattttccatgtgtcnctgttgtcgatgtgatgtaacattgttagtgctactaaactaagcaatcaagaaacagtccatatttacacga

SEQ ID NO: 15350 - DNA, 1534 bp, Triticum aestivum
  Clone ID: PAT_TA_15350
cgtccggcggcctccacttttcttcctttctccagctttgcgttcgttgttttgactgctacgcagcgtcatttattgccttccaccactttgcccccgagtccacccttcccttccccttccccaccaccacgctctcgcggccgacgccgttatcagcgagccgttctgggatggggggaacgcacttcgcagacgacgacctctacaacgaggccacgggtcgacggagatgtgggccgccgcgacgtgggcaagatggagcacgggtgcgagcattatcggcggagatgcaagatcctagcgccgtgctgcaaggaggtgttcccctgccgccattgccacaacgacgccacggctttgtgtgatcggcataatatatgtcgccaggatgttgaaaaagtggtgtgtacactttagtatgcttaacaaccggtgtcaagcatctgtataatatatcaccttaatatgggcgaatactatggtattttctccaggatttgagttgagagctactataaagggtagtacctttgcgatgattgcggcatatgcagggttggtggcaaggaaaactacttccactgtgcaaagtgtgggtcatgttatgctgttgcgttgcgtgataaccatcagtgtgtggaggattcaatgagacagaactgcccaatctgttatgagtatctatttgattcattaaaaggaacaagagttctaaactgtggacacacgatgcacatggactgtttcgctgagatggtggaccataataaatacacttgtccaatatgctccaagacagctcttgacatgacagttcactggggcatgttggatcaagagattgaagcaacaattatgcctcctgtatatcgttacaaggtttgggttctttgcaatgactgcaacaaagtctcagaagtggacttccacgtgattggccataagtgcagccattgcaactcatacaacactcgatcgacgtcgcggcctgcagatttatcaggaagcagttctccgtcgacaacagactcatcttaagacaacctcctgtagagaatacatcatactggtgtatcacctggtctgtgcaaccaatgccagaaccatacacatagaagaagaagcattgtttcgcggcattgcccgtctagtgccagccccatccctgggccttcgccgctttaccattctaccaagattcaattcatctcttgaatcgtcagctactagtgtattgctgtgaacagcgttgcttgattacctggagatctgtcttaaatctgtaatacagaccattactctgtgtatcaccgtggatgaagcccagcacatgctatattccccaggagttgaattctgacctactgtaatccatgggaattgtgtgtacgctgctgttgtcaggtccctgattgtatcatcctcacaatttgagagaagtttattagatttttacaccaaattttttgagcgtgctgtgttgaggtttggttttcatcactcttctagtacaaactgaggtcagttggct

SEQ ID NO: 15351 - DNA, 962 bp, Triticum aestivum
  Clone ID: PAT_TA_15351
atagtgtatacacttgctctgagactccaaaatattatggcgaatgactccttgacaagggcacagatagttggagatgttctagacccatttgttagctcggtgcctctaactgtgatgtatgatgggaggcctgtgttcaatggcatggagtttcgctcaccagcagtctctctgaaacccagcgttgagataggcggtgatgatttccgtgtggcctatactctagttatggtggatcctgatgcgcctaatcccagcaacccaaccctgagggagtacctgcactggatggtgactgatgtcccatcatcaacaaacgatagctttggaaaagagatcgtgccatacgagagcccaagccctaccatgggcatccaccgcatggtgctggttctgtaccagcagctggggcgggggacggtgttcgcgccgcaggcacgccagagcttcaactcgcgcagcttcgcgcgccgcttcaacctcggcaagcccgtcgctgctgtgtacttcaactgccagcgtcccacgggcaccggtgggaggaggttcacctgatgtgtcaaactgatcgaccagcaatgatcctcagcccagccgacggcaatgcttgagctcaccggtacctgatactgtgataaagatatctagagaagttggaataaatgtactggaaggtttatgtctgatctatctagctggttgatcagccatggcccagctcgaaggcagtaagttaagctcgagctttgccggtacttatgtctgcgtgcttactaatacgtacacacatgatagccgcatcacacggtacttagctagacgagttggaataaagtacctgtgtttgtacttgtagactcttaagtaaagtgcctttgcaaggatgcgttgctacttatcaataaggaatgtgacattatgccacaccttggtaatgagatatgtgcggttggttgttc

SEQ ID NO: 15352 - DNA, 672 bp, Triticum aestivum
  unsure (1)..(672): unsure at all n locations
  Clone ID: PAT_TA_15352
ggcccaggncgcgcaggactaggagggtgtcagcagtcggcgagagccagagaagagcttgcaggtgagaacatggccgcaacggcgtgctctacggcgcttctgggtgtagcaggagcacgcctccccgccggcgcgccgccaacctttcttctcccacggcgtcacttctcccctcgtcgcctccaagatgcgccgcggctctctctgctccgggcgaaggcctcctccggtgacacctctgccgcgagcggcgacgagctcgtcgacgacctgaaagccaagtgggacgcggtcgagaacaagtccaccgtgctgacgtacgccggcggcgccatcgtcgccgtatggttctcctcggtcatcgtcggcgccatcaactctctgcctctgcttcccaagatcatggagcttgttgggctcggctacagcggatggttcgtgtaccgctacctcctcttcaaggaacgcaggaaagagctggccgacgacgtggagtccttgaagaagagcattgctggtacagaggcagagtaaaagaatataatgttgtagtatgggttattattttgtttgacgattattcagagaacccttatcagagggtttgcttgtttttttaacaaggcaagagacttgtcattttcattgattaagaaagaacatttagac

SEQ ID NO: 15353 - DNA, 772 bp, Triticum aestivum
  Clone ID: PAT_TA_15353
ggtcacgccggccacggccgagcagtgcggctcgcaagccggcggcgccaagtgcgccgactgcctgtgctgcagccagttcgggttctgcggcaccacctccgactactgcggcccccgctgccagagccagtgcactggctgcggtggcggcggcggcggggtggcctccatcgtgtccagggacctcttcgagcggttcctgctccatcgcaacgacgcagcgtgcctggcccgcgggttctacacgtacgacgccttcttcggccagacctctcacgagaccaccggcgggtggcccaccgcgcccgacggccccttctcatggggctactgcttcaagcaggagcagggctcgccgccgagctactgcgaccagagcgccgactggccgtgcgcacccggcaagcagtactatggccgcggccccatccagctcacccacaactacaactacggaccggcgggccgcgcaatcggggtggacctgctgaacaatccggacctggtggccacggacccgacagtggcgttcaagacggcgatatggttctggatgacgacgcagtccaacaagccgtcgtgccatgacgtgatcacggggctgtggactccgacggccagggatagcgcagccggacgggtacccgggtatggtgtcatcaccaacgtcatcaacggcgggatcgaatgcggcatggggcagaacgacaaggtggcggatcggatcgggttctacaagcgctatccctggccgtcgcccacgcgtccg

SEQ ID NO: 15354 - DNA, 1454 bp, Triticum aestivum
  Clone ID: PAT_TA_15354
gcgaacgcagtactcactacacaacaaccggtccagcttttgttggcggttcgcacggccccagcgaaacgcagagcgagaggccgaggaagcgatagcgataaggcaaaggcactggcgataaagcggtggcccacggcgtgctccgtggccgtcctcgcggggcccgcccccccgccggcaccggccaccccccccccccccgcctcccccctcctcccgcgcccccccccccaccccccccctccccccgccccgccgccccggctccgccgggcccgccggcgccccccgctccgagggccagccgcgcgacacgtcagcgcggcgggcaacgacgagagtcgaggggcaccaggacggcaacggggggccgctccaccagcagccccacctcgtcctctctcggcctcgcgacggtgcggcgcccgtgccctccactctcttcggcagcacccatcctcctccggcgcgttgccccccccggcgccggggggctcgtctgccccctgctaccaggggggggattcgtgaaactgttgcctcccctgctcgggaacgtaaggaagaaatggccacgggacagaatggacagaaggaaaaagaaaacgttatgaataggaatatacgtctgttctctttaatgaaggtattactgacttgtttggctgtacaatcaatgaattatgagctacttgcttacggtacgataaacgtcattgcctttagttcataccgtatgagaaaaaatggcttgcgcaacctccacccgctccgcctccaagatgcgcccaggccgtccctgctccgcgtgaaggccgcctccgacgacacgtcggcgagcggcgacgagatcatcgaggacctcaaggggaagtgggaggcgattgaggacaagcccaccttcctcctctacagcggcggcgccgtcgtggctctctggctcaccaccgtcgtcgtcggcgccatcaactccgtgccgttgctccccaagctcctggagctggttgggctcggctacaccgggtggttcgtgtaccgctacctcctcttcaaggaaagcaggaaagagttggccaccgacatcgagagcttgaagaagaagatcgccggaacagaataaactcaagttctctggaacgttttcgatggctcttttgtctgtccatgtaatggaagaacacctacttgcttagagtaccatccactgcatttgtgtgttacatacatatctgtatgaaaaaagaaatgcgctttggttggtgtgcggtgacaatagtgaaattgtatcagtttctggaagtcttctattgttttctatatcaatgtgttcatatgggaaacgtgatctgtcgaattgactttatatgaataaaatgaaactcatattgtattgtagaggataagtgactcaaagctgaggcacacctatttttagtatatttatttggtat

SEQ ID NO: 15355 - DNA, 1230 bp, Triticum aestivum
  Clone ID: PAT_TA_15355
atccaaccatgtccacgctgagagcgcggtgtgcgacggccgtcctggccgtcgtcctggcggcggccgcggtcacgccggccacggccgagcagtgcggctcgcaagccggcggcgccaagtgcgccgactgcctgtgctgcagccagttcgggttctgcggcaccacctccgactactgcggcccccgctgccagagccagtgcactggctgcggtggcggcggcggcggggtggcctccatcgtgtccagggacctcttcgagcggttcctgctccatcgcaacgacgcagcgtgcctggcccgcgggttctacacgtacgacgccttcttggccgccgccggcgcgttcccggccttcggcaccaccggagacctggacacgcggaagcgggaggtggcggccttcttcggccagacctctcacgagaccaccggcgggtggcccaccgcgcccgacggccccttctcatggggctactgcttcaagcaggagcagggctcgccgccgagctactgcgaccagagcgccgactggccgtgcgcacccggcaagcagtactatggccgcggccccatccagctcacccacaactacaactacggaccggcgggccgcgcaatcggggtggacctgctgaacaatccggacctggtggccacggacccgacagtggcgttcaagacggcgatatggttctggatgacgacgcagtccaacaagccgtcgtgccatgacgtgatcacggggctgtggactccgacggccagggatagcgcagccggacgggtacccgggtatggtgtcatcaccaacgtcatcaacggcgggatcgaatgcggcatggggcagaacgacaaggtggcggatcggatcgggttctacaagcgctattgtgacatcttcggcatcggctacgggaataacctcgactgctacaaccaattgtcgttcaacgttgggctcgcggcacagtgagatggtaagactatgggtccttgatatgcatgtgtggatgtgatcacacataaataaataatcttgggaagtactttatgaccaaataaatggatgaccagacctcccacgtgtgtaatggtacatttacgtcgatgaacggagaggaatcacctttattaaaaatatattctagtttatgcagaaatatctgcaaataaaaaaaaaaaaaaaaaaaaaaaaaagggcggccctcgcgcggacgcgtggg

SEQ ID NO: 15356 - DNA, 917 bp, Triticum aestivum
  Clone ID: PAT_TA_15356
cggcaccagatccaagcgagtcgctggatggaccaaaattttcaattaaagctgcaaaaactgggacaacgtctctttatgttagtactaagcaacgctctgggcaaagagttttgagtcaggttataaatgtggaagtgtacaaaccattgcgaatacatcctgagtacatctacctcacaccgggtgcctcctttgtgctctctgttaaaggtggtccgaagattggagtttccgttgagtacacaagtctgaacgtgggaacgttggaagttcaaagtgctactggaaagctgtctgcaaagactgtaggaaactctactgtacgtgcagctgtcgtcccacgcggccgcaccgtcattcgtgaagcttttggaagagttgaagtgggtatcccagtggctatggcattgagtactcaaagtgaccgtctttgtgttggctgtagcatgccagtctacccttccgtgcctaagggggatccattttccttctatgaaacttgtcaaagttacacttggatgatagcagatcagaaggttgtgacattccaatcggctagatcttggcaaaacggacttgatcaagctctttattcagaaggaaaaacctatccatggttatccaatggaagtagcaatgcttttatcaatcatgtgattggaagatctgcagggaaaaccaagatatccatttcagttacttgtgatttctcgctacatggcagttctggatctgtatcttatgatgcctccaagacaatcctggtcgtaccagatcccccccttgcacgtggacttcctataacatggctattaccacccttttataccaccacagaccttttacctagatccgttaattcatttggagaacaagactcaaatggcctggatactactattggatattctctg

SEQ ID NO: 15357 - DNA, 736 bp, Triticum aestivum
  Clone ID: PAT_TA_15357
gcttcggccagcagcacagctccagtactaaatagcatcaagtgatctagctaggacactgcacgtgaaatactgaaatggctcggttgatcggtgcttccggcgccgtgcgcgctcctcgtcgcccggcgcgcgccgcggcccccccgcccccccgcccgggtgccgcgcggcagctgtgggacgacgggaggaaggtggggggaaggacggaggtgagggacgtggaggacgacaaggaggtacaggagctgggccgttactccgtcgaagaacacaaccggcgacgggaggagggctgcgagggcggcggcgtctgcgggcggctggagttcgcccgcgtggtgtcggcgcagcgccaggtggtctccgggatcaagtactacctccgcgtcgcggccgccgcggcgcgccccccggggagcgccgcccgcggcgccgcccccgcggccaccgccgcgggggccgccccgccctggcccccgtcccccgcccccagtcccgcgcgctggtcaggttcgcgccggccgacgccaaatgagcagctgcatgcgcgatccgacgagccgctggcccgccgcgggccgttttgcccgcccgagtatccgtgggtctggtcccgcggttggcgtgggcgccgctggaggtggccgccacggcgcgccggtcgtcgttgtggtggtcggccgcccggatagttttgcttggcaggtgaaaaaaaaaaaaaaaaaaaaaa

SEQ ID NO: 15358 - DNA, 513 bp, Triticum aestivum
  Clone ID: PAT_TA_15358
ggtctgacgaaagctggagttgccttggtcggggacctggcggatgcgctaggaccttccatcaaactgctgctcaagaattccaacttccactcggagctccttgggcgctgttcccagtctgatgacgaacagctgagggagactgcatcctgggtccagggtgtgatctcacgtgtgctggtttcatgagggaaagcttctccagcaaagctgccagcgttgttgatggttctctgggcaaactatttctcttgccagatgaaatatttttgagaaatatgctgcatatatgtcctgatatcatgttgcaaaagtggaacaaggttgcatgagatcatttacggtcgtcaagttcgtagtagtggcagcggcttgccattgtctaaagtgggttgggttcctgttgcattttgttcaggtgtccatgtgagtcgattgtaattgcagcaattgtgtcttgttggcaccattgctcatcagtaaagttgtcgccgatggcgtggaactgtt

SEQ ID NO: 15359 - DNA, 1385 bp, Triticum aestivum
  Clone ID: PAT_TA_15359
gagctatcaaaaccgtccgcggacgcgtgactcagaaatgatcaggcaatcaatgtcatccgtaagaaatatgaattagaaaaggtagaaatcattagtgctgaaaaagagaaggcagaaaaactcataagggaaatggagcacaaatgcaacgaaaagatattagagaacaagcgagaatctgagaggtgtttgatgcgtcttaaggaggaacatgccgcagtggtggcaagaattcaacaggataatgagcttaaggaatcaactcttcgggcttatcacaaagaagaattgcagcgcattcgttctcagggtgagagtgaattgagggagaggctgtcgtcgctcagacaagagcatgaagctcaaataaaaacagtgaacatacggcatgaagaagattgtcagaaacttcaggatgaactggagcttcagaagtcaaaggaggagaagcaaagagcattattacagttacagtggaaagtgatgggcgaaagtcagcaagttgatcaggaagttaattctaaaaagaggagagatccatatgtcagaaaagaaagtcagcttcagttgccaggtccaggtcctgagaccaaacggaaggatgtaaacatatctggagttatacactcgccaatttctaacgtaatgaggaaggtagagaaagcaagtcaggatgttactaatcacagaaaggtaacacaccatgaatatgaagtggagacagcaaatggaacaatcacaaagcgcaggaaaactaagagcactgtcatgtttggggaaccgaatactcagaagtcattgcaaaatactgctgacaaggatgtcacaaaaacaagaaaggttgttgcaggatcccgtccccatcctgccaatatcggtgaattattttctgagggctccttgaatccatatgctgatgacccttatgcatttggttagaagctcacgtctattgatgctgatcttaagaagcatggaaacgtaatcttgattgcataattccctgctgccgccaggtctaatcgatggttttgcctgccctggtcatgatatccaatcattccagtgttcgtatgactgttaacaacgctgtgttggtgtgtctggaacatttctacgatgaacactgcgagtgattatcttgcacgcaggtgtgcttgtgtaaataaaaccgacctcttcaactatggaatagagaatttcaacagagaaaattaccgccaacgtcctgatacctttttggatttctctttgtaaaaggctgaaagataccgtgctgctgctgccgtattaggcgacgctttggaattgactgatcattatgcgcatgaaccctgtttgtgtgtataaatgcagtagatgcctcgatagggaagtatgtt

SEQ ID NO: 15360 - DNA, 823 bp, Triticum aestivum
  unsure (1)..(823): unsure at all n locations
  Clone ID: PAT_TA_15360
gtttgattcctgcagatccagatctggtgtttagccttgctccaagtaaagccatagcctccaaacagatggtgcatatgaatcaaggacaaggggaaacaagctatgcacacaactccagtgtccagaacgctcagcagaacaggatgatgcccctgatagaagcggccatcattgacttgtgcggcagcagaagcaccttgttccctgaaaagatgctgattgcggacttgggctgctcttatggcccaaatgcgctagcactggtatcgactgccgtcaaggccatcatcaaccactgccttcagttccagcaaccgccccccggtcggtgtgcgcgccgctctgtccttccggcccctggcttcttctcggcgcggccgaccccggccacgcgccgtcaaaggctcccgaagatctgaccatgaacccgcatccctgcgttcgacacggatgaacatgctaggcgtgaaaggctccctttggtccgtgaggcttatgcacgtcagttcaggaaacacttcacacttttcctggagctgagagccaaagaattggtcccaggaggccgaatggttgtttcccttgtagggccgccttctgatgtaattgcctccaaattctttcccctcccgggaaccgtagctcagattctaagtgccatggcccctgaaggtgcgattgacaaagcaaagtttgattccttccaagtgccggtgcaaggaccttccggcgaaaaaggtganggaaatcattgaanaaaaagggtccttttcaacaaggaagatccgggcgcaagaacctacaaccgaaatgaacacng

SEQ ID NO: 15361 - DNA, 726 bp, Triticum aestivum
  Clone ID: PAT_TA_15361
ccgcctcgcccgtcctcgagcgccgccgagccctccttcctcccgatcgtttctccccaccaccaccaccagccgcaaaaagaaaatgtgcggaaagggccagaacaacgggctcgcgtcgccggcggggacaagcagcacggcgaccgccatcgtcgtcctcgcgtcgctgctcctcgcggcctcggtcgccgctttctttctgtcgccgtcgccgtcgccggcagcggacgagaagccccctgagcctgtggagctcgccatcggcgtcgccgggcacgaggcctgccggggcgccccccgggcggggccgaggctggcctcccccatcccccgccccctcgtccccgcctgtcgccggtggagcccggggtccttgaagaaggcggccaggcagagcctggcgatgggcaaggaggccgtggagcacacggcggtgtcggccgcgagggccgccgaggagaccatcgggaggaccaccgagaaggtgaggaggaaggtctcggcgtcgccgtcgccgtccgcgccacgcgccgatggagacctgtgatctgcatgcaggtcgacgcaagcgccaaaattttgcgagctgtatccctccctcccacttatgtacctgtagctttctactagtttgagaagaaaagttggtgtactcgttgtaacgtgctgtaacatgtgtatgcgtatcctgcgattctgtctttgagacgtcaaggaaatgca

SEQ ID NO: 15362 - DNA, 1165 bp, Triticum aestivum
  unsure (1)..(1165): unsure at all n locations
  Clone ID: PAT_TA_15362
gagccacaacctagaagccgcggccgcagctctctctccgcgcgccgcctgtggccgccggcggcaaccaagagaaacaggatatttatgcctttttcttgacacggaaagccaatggcgagaggactggattcagattatattggttctatttcgctcatggatggatttgatatgggtatcacgtttgatgggtttggagaaaatatgaagaagttcatggagttaccgatcaaatatcttgattctgctcacgataaagctgttgagctagttgagggatatccatgcgctgatttacgctcactctcctgatgataaatttccgggccaaagaccatgggacattaactgatccatctaggtacccgacctcctcccgggccccctcctcctgtgggttcatgcagcaagttaaccctaacgaagaattctctggttatccttcatctctcgttaccgcggaagaccattctctcggctcaactgctactgatgttcatgaaacagagtcggtttcatctacaagtccagccatgtgtgcttctgaagaccccatttcacttgagagaactgctgacaccaaggaggaagttactttttgcaattcagaggatctctcagataactgcactcctgaaaatcacaattcactagggggttctgatagcagtgacgaggaaattatattatggaatcaatggaattctgtaacatcacgacaatatcctgaacaagccaccgtagtccaagattatatatctgaagaagcaaacggaaataaaatcatcgagcaagttgaactccatggttcaggacattcagttgcttttgatggagcaattctgcttgggaaaggtaaatggtgaaagagcaatcaagaattatgcagtgcgaacagccatgaagaatcaacaaagcacggttacataaagaatttgtctgttggggactgttcacattacttgagtgcagaggtgttcactggtgctgatgatccaaatatgtccaactggacgagaccacggtttgttaatgtaaactcccgggttgggcaaggagctggatgaaatataacaaagcagagcacctcaattcctcaaacctaaaaacacacatccaagaangttgatgaggantgtcaaataaaccggggggcaaagaa

SEQ ID NO: 15363 - DNA, 1254 bp, Triticum aestivum
  Clone ID: PAT_TA_15363
ttcttgcttcttcaacttacactgttgtccgttctcgctatcaactcaccccactgccactcgttgccggtcatcactctgtgcctctctccttgactcaccaactatcctgtgccaccctctccggtcaacaactcactctgcaccgcgtgcccctacaaccactccacgctcctcgccccgtcgtcatccacgtactgtgccgctgcaccttggctgtgttggccctcttcatctgctgcaacacctccatcccatctccctcctagatccggcgagtatccatcgcgcggtgcatcaacagccgtcgtcggggctgctctcgatctgggaggagcggcacctccccatcagatccgacaagggccacggcgccgtgcagttcggatggggttctcaccccgtaccacgccgcccaccgcaggggagaaggacgaggaactccaccaccggcccctctacgcccccaagcagtttgcagcgtgtgcgtgtgcaggacggtaagcacgtcgatgcagtccatcacccgatccgaccgcagatgccggcccctctgcaccttggtgcccggcgcgggcaccaccgcagccccatccccgtgccacctccctcaggctcggatccaccagcacatcccccgcccacggcacgccacggtcaacagcatttctccgagcctctttctctcacagcctccttaatgatctctctcccccttgatttgtctatgccagagcagctgtggcgttagtgcgccatcagatcgagtgctgacgaccacaagcagtgagaggactagaggaggaagaaaaaggattgcaaccgcgtgcagtacatcaccccgtgcgggatccgtgccatggtgattttttcgagtcatgttgcattttacttgcttgagcgagcggctcgtcaggcacattccatgcagtgcattgccatgtttttgcagtgtgttggcatgtcctttccattgaagcaccatctatttctccatgcagtgcattggcatgttttcgcagtgcgttggcatgttctttgccgggaagcaccatctatttatgtgacgagtttgtgttttctttgtatgtctagtgcactacagtttagggcacctcctgccgttcagaaacgtgggcttggagtgcattagctcatcctgtgacgaagaaaacaagtgtctcatatgctgaatttggtgtctcgtgtgtactgtttgtgtaaaaagaatgatgtttcattacctctctgtaa

SEQ ID NO: 15364 - DNA, 737 bp, Triticum aestivum
  Clone ID: PAT_TA_15364
cggcacgaggcgacaactggatttcgaccttctcccgcttatgcggctcctacgaggaagccacgtctataaagccaatgcgatacaccgacgagccgccaccgccctttgccggcgtcggttatgctaatgccgtggtcatcttctcggtgaaggtgacacaattagatgatagcctgggattggccgctcgatgtttacggcatcgttgccgcgcgggattcaattgaccgcaatcgcaacctcctcttcaaccgcaccagagacaattgccagaggctcaccgcaggggatgcctctctattgttgaccggtccaagtcgtgctgttgtgatcgttgatcctgtcaactacgaggttgaactaaaagtgaagggtgacacgccgtctgaagataaactcttaagccttctagtcatcgaggacaagtactatcttcctggtgatcgccgccaaggagttcattgccacacctactcttctaagctaagcacagtggaggtgacggttggccatcttgcaaagacagtggaggctactatcgctgtccaagttgttgagggatcctggccaactggccaactggccatcacgggcgatttgctgcacgtatggccagtctcgatgatctggagatggtgctacttgattctcaggatggcatggtgcctgttactaacgatggggcaattgagttttcacgatgtgttgtttctgtcgaagcggatggagagctg

SEQ ID NO: 15365 - DNA, 484 bp, Triticum aestivum
  Clone ID: PAT_TA_15365
cgtccggaaacgtttgaaagacagcatggatggattatgaggactatgaatcgagaggctgcacctctccaagatgagtatgccccggggattttctcccaggatacggtctcctaccttgcgcgcatggacatgatgtctggggaggaggaccgagaaaacatcttgcgtgcgagggaaactggcaaacctgtgttaacaaacccatttcggcttcttgggtcgaaccacttgggcgtagtactcacttttgcagtgtatcgccctgatctacctgctgatgcatcagttgagcaacgtgtggaagcaactgctggctatcttggtggagcttttgatgtggagtcacttgtggaaaatttgctgagtaaacttgctggcaatcaggatatattggtgaatgtgtatgacgtcacaaatgcttcagagcctatggccatgtatggatctcaaacaccagataataaagtggacctcttgcatg

SEQ ID NO: 15366 - DNA, 1066 bp, Triticum aestivum
  Clone ID: PAT_TA_15366
gcacgaggacgtccgataaaaccgaaatcgctagaagcaaattccccacagctttcctcctcccaccagacgccgcagccatggcttctgccgaaaccctagcccgctccccatctcgcgagccctcgtccgacccgccccgcgatgcctcgcgcgacgcctcctccgagccccaccacaacggctcagccaacgccgctggcgacggcgactcgtcctcccgccgccgccgccgcagccgatgggagcagtccaacgacgaatccggtgccaattcaggcggcgagggcggcgcgggaggacggaagcggaagtcgcgctgggccgaggaggagccccgcccgaccatcgcacttccggatttcatgaaggacttcgccgccgagatgggatcccgaggtgcacaacctcaactcgcgcctcctagagatttcgcgcctgctgcagtcggggctccccctcgacgaccgtcctgagggcgcgcgctcgccgtcccctgagccaatatacgataacctgggcatccgcatcaacacccgcgaataccgggcgagggagcgccttaaccgcgagcggcaggagatcatctcccagctgatccgccgcaatcccgccttcaagcccccggctgattaccgcccacccaagctccataagaagctctacatccccatgaaggagtaccctgggtacaactttattgggctcattattggaccccgtggcaacacacagaagcggatggagaaggagacgggggccaagatcgtaatccgagggaagggcagcgtcaaggaagggaagttgctgcagaagagggacttgaagccagatcccagtgagaatgaggaccttcatgtgcttgttgaggctgatactcaagaagcgttggaggctgctgcaggcatggtggagaagctgcttacccctgttgacgaagtgctaaatgagcacaaacggcagcagctgcgggagcttgcagccctgaatggaacaatcagggacgatgagttttgtaggacttgcggggagccgggtcaccggcagtatgcatgcccgaacagga

SEQ ID NO: 15367 - DNA, 2072 bp, Triticum aestivum
  unsure (1)..(2072): unsure at all n locations
  Clone ID: PAT_TA_15367
gnggtgnnnttttgaaacccctttnnnnnnnccntttattacccttnctcgaaattacccctccctgccgcctgcaaacgctgggcctccacccgcggtggccgcccccgcctggccccgggccccccccccgctgcagggtcccggcaccgggagagagggagaaccggaccctggaaggctggaggtgggagagtgtctatcagccctccctcgagccccggcgattcctcctgccgccgccagaactcgatcgatggtattgaagcgaagacatgtgacacctcctctaccttttgtatggtattgacaagaggtacaaccacctgggtgatctttttgagaaaatggaaggcagcaacctacctactggaaacatgatgcaaggaattccttatagtggtttgaatgtgcacggtaactccatgcaaatgcatgcttcaaactcaggaaaacagctattcaaccaatctcagatgctagggagtttcgcaatgcctatcaacagggctacagcgcctgataaccctggatttcaatttggagaacatgaaaaaaaggatcaccaccagcagcagcagcagcagcagcacagtcattactctaagaactccatcagtgatgaggaggagcatgatatgaccgaggatgttactgatacccagaatgacaaaggcaagaagggttcagcatggcatcggatgaagtggacaggttccatggttaaacttttgattaccgcagcatcctacacgggggaggatcctggggcggatcaaggcggaaggaggaacattgcaatagtgcagaagaagggcaaatggaaagcaatatcaaaggtcatgggcgaaagaggctgcagtgtgtcaccacagcagtgcgaggaataggtgcagtgttcctctcctagcgacatccgtgggctttcacccgaagatcgtgcacttcagcactcactacaggttgctcttagatgtaaagaggagcatgatcatagtctttctgataagatgaaagaagacgcaaggaagatattgaactctaagcacttattctatgagcagatgtgttcctatcataacaacaaccgtgtcaatttacctgaagatctcgcacttcagcactcactacaggttgctcttagatgtaaagatgagcatgatctgaggagggatgcaagtgcagatcctggaagaggttgagcagagtgcagattctgattacgaggagcatgacgaagagcatcaaacagttcataccaacttgagggattcttacatgaataaaagaatgtgtcgtgcggtggatcatggtgatgtgggttttgtcacctcaagctcaaacggtgttagcgggaggttcaatccgcatgacatcacattggatatcaacaatgctattccaggtggagccaacttgtcttttgcgcggaaggacttgacttcacaacaaatagagcttcagaaacatcgcttgcagacccaagaacaaaaactggaagtggcaaaacaacgtctcaagtgggagagatttaggatgaagaaggacagggaaattgaaaggatgacattggagaatgaacaaatgatgcttcagcagaagcgtttggaacttcagctaagacacaatgagctagagcttgagctaaaaggcaatgcaaatcatgcatgatagttgtttgatcagagttttggtttgcaatatggtcgaaggtggtttttgacaagagcatggttgtccaagaaggaaccctcaagaccgattcgatgcattagacttggtttagtgatcttctgattgcctgtcgtcgttgtaacatcctttgtactcctgggcttggtctgttctgtgaacctgaaatgattttctttttctttttcttggaagtcttttcttctttctagccaatgggtgaacttgtgttgactatagattagtgctagaagtcaggtcagaagggcatcctactcagcgttggttgccgtcgcaactctgtgcacattgtttgccttatatgcaattcgaggttatatttgaaccagtcaaaaaaaaaaaaaaaaaaaaaaaaaaaa

SEQ ID NO: 15368 - DNA, 633 bp, Triticum aestivum
  unsure (1)..(633): unsure at all n locations
  Clone ID: PAT_TA_15368
cgtccgcggacgcgtgggctcgccggcacgcgtacgcggcgatgatgtacatgggcacgccccgcgactacgagttctacgtggccacgcgcgtcatgatgcgctcgctgcgcggcttcggcgccgacgccgaccgcgtcgtgatcgcctcgctcgacgtcccgccgcgctgggtccaggcgctgaaagatgatggtgtgaaggtggtctctgtggataatttgaagaacccatacgaaaaacaagatacacttcaactcacgattcaagttgaccttaaataagctgtatgcttggagcttacttcactatgaccgattgttatgctagactctggacaacatgtttcctccaagaacactgatgattatttcaatgtgggcacttccgtgcatccttcatcaacgcttgcatcttcaatacaagcccctttgtgctggaaccttctatggagtttttaanaacatgcacagagcaactttgggcctnnaaaccanatgtgcaattaagntccttgcaactattccaaactgctgatagcaagttcatcacaactaaggacaaattgatgnatacgctcctcaaggtacaaaggtnctctaaataatnanncggggatntccnntgggcgan

SEQ ID NO: 15369 - DNA, 920 bp, Triticum aestivum
  Clone ID: PAT_TA_15369
aaaaaatccccccaccctccctgcaatagcaaacacgcggaaaaaaatggagtcatgaacacgcccccctcctcctccgtccccgcctcctccgtccccgatcccgtcgacagcccagcggccccgcccccgccccctcctcgccggcggcacccttgctcgtaggcgggcgtgaggggagcggcgcgcagcgacgatgccgtcgcactcggatctggaccggcagatctcgctgctgcgggactgcaagttcctgccggacgccgaggtcaaggccctctgcgagcaggccaaggcgatcctcatggaggagtggaacgcccatcaacttggcgctaaggctcgtcacggcactgcggcgacagcagtcacagttttcagtgcgccaaactactgttaccggtgtggtaacatggctgcgactctcgaaattggggagaacatggatcagaacttcctccaattcgatccagcgccgcggcaaatcgagccagacacaacgcgcaagacccccgactactttttgtaatcgtggagttgacttttttttaactcttgtgctgctggtgctcctctcatccgcagcactgcctggctggatctgtagatctctgtccttagaaaatgggattccttgagctgagttgtgtacccccctctcattcttttgtttggagattttggttgccgcttctcaggacctcataggacatgttaaaagtacattgcattggtattttttttgtatctccattttgtattatttccgagacagagaagggaagctgcaatagaatcgtctcgtaacataaaaaaaaaaaaaaaaggcccctatttcatgctcttcttcagaagagttcccttatttcagggaagttgtgttgtctggtatggcctgtggaggatctgcctcaagtgac

SEQ ID NO: 15370 - DNA, 1438 bp, Triticum aestivum
  Clone ID: PAT_TA_15370
ccgaaatcccgccatcccccccataacaacaaccaatccggaaaaaattggaggattgaacaggccccaggacgcccccgtactcctcgcccccgtcccccctccccgtcatccccgatccggtccccccccccccgctcctggcccccggctcccctccgcgaccgcgtccctgaggggcgcggggctgcccggggaagtggcccaccgcggcgatgccgtggcactcccagctggtgcggcagatctcgctgctgggggactgcaagttcctgccggacgccggggtcaaaaccctctgcgagcaggccaatgcgccctttatcaaggggcggatcaacctgcccgtgcggtgcccaattgcgctctgcggggagattcgcggtcactacttttcagtgagccaaactattctcaccggtgtggtaacgccgctgacattctacctatatttgggagagtatgtgtcagatctgtcctcatttggatccagtgccacagcaaatgcagctataaacattcgttatggccacagaatcctaatcttaagcggaagtcacgaaatttttttaatctctcatgtgtatggcttctatgactaacgtttgcagaagtacctagactcaattgtgtaggactctgttcataggaattgttagattttgatgccacttgcagctctcattgtaaacctggtgttttgcgtttatggtggtctctttccatcattagatacattggacaatattcgttctcttgatcgcttataagaggtcccgcatgaaggaacctatgtgtgatcttttagtggtctgatccggatgaccgatgcgggtggggaatttcaccaagaggagcaggctacacatttggacaagatatagcacaacaatttaaccatacaaatggtcttagccttatttcaagggcccatcaacttgtgatggaagggttcaactgggcacaggagaagaatgttgtcacagttttcagtgcgccaaactactgttaccggtgtggtaacatggctgcgattctcgaaattggggagaacatggatcagaacttcctccaattcgatccagcgccgcggcaaatcgagccagacacaacgcgcaagacccccgactactttttgtaatcgtggtgttgactttttttaactcttctgctgcctggctggatctgtagatctctgtccttagaaaatgggattccttgagctgagttgtgtaccccccctctcattcttttgtttggagattttggttgccgcttctcaggacctcataggacatgttaaaagtacattgcattggtattttttttgtatctccattttgtattatttccgagacagagaagggaagctgcaatagaatcgtctcgtaacatacaccagcccccaaaaaaatgggtcgacccgggaatccggacc

SEQ ID NO: 15371 - DNA, 707 bp, Triticum aestivum
  unsure (1)..(707): unsure at all n locations
  Clone ID: PAT_TA_15371
ctccctccgcggctcccttccggccatcttccccaaggggctgcagagtttggacctttctggcaaccagctctccgggagaatccctcctggtctcggggactgctcgcggctccggcggctccggatgtcttccaattcgctggatgggttcatccctccgcagattgggaggcttgccgagttgcgggtcttggaattgtccgggaacagactagccggtggcgttccgccggagctccggcattgcagttaccttgtcaagatggacctcagcagaaatttactccatgggcaagtgccttcctccattctcaaggagctcaagaagttgaggtttctgtcattagctgggaacaatttcagtggtgagataccatccggtctgggtcagctgagatcactcagggtgctaaatttgtcctcaaattctctgtcaggagtggttcccattgatctcgtggcactgagagatcacaccgttctactccttgacggtaatctgctccctgcgaaggtttccgctcctatgccatcacctcaaatggatgagatttcccaagtgacagctgatagttcaggngtaggtccaccaccccactctgctgaagtatttacagtcaccccccaatacaaaagcacctgggtacttaccgaggcaaaccgaggcaccccgcctgatggcagcggcaatgttggtcatctga

SEQ ID NO: 15372 - DNA, 811 bp, Triticum aestivum
  unsure (1)..(811): unsure at all n locations
  Clone ID: PAT_TA_15372
cagaaacctatacgtggctgtttaaggcgtgggtagcatgcatgtctggcaaccttccaaaggctatcatcactgaccaatgcaggggcatccagagtgcagttgctgaggttgttcctggagttcgccatagaatatgcttgcatcagataatgaagaaggcggcagagcaattaagtgggctatcagagtacaaagctatcagcaaggcattgcaaaaggctgcatatgattctttaacagtagatgagtttgaaggtgaatgggagtactttgatcacatacaatgggcttcagggtcatgactggttaagatcactttatgagtgcagattttcatgggttcctatctttcttaaagatgctttttgggcaggaatgtctgctacacaaagaagtgaaactatcactcctttctttgaagggtatgttgatttgaaaacctctttgaagcaatttcttggtaagtatgagatgattttgcagagcaaatccgagaaagaagcccaagcagattttgagacatttcataagcaccgtccacctgtttcaaaattctttggggaacaacagctcgctaacgcctacacccctaacgtgctcatgaagttgcaccttgacctgcctgcctttttgtacggccagggccctcccctgtatggangaannttttcttnaanggaaaggcttnncnanttttnnttntttacaagggaanggttnntgtnttgggggtcnntnnngnnttngggnnnnncnnnnnaatnaannnnnnnnnnttnnanntttttnngggnaaannttnnnntnn

SEQ ID NO: 15373 - DNA, 1451 bp, Triticum aestivum
  Clone ID: PAT_TA_15373
gctgaggcgtgccgaaacaccgagccgaacacccatccacacccaaaacctcgacccccaaaacacagcgggcgaaacggagacagccgcccgccgctcgccccggcctgcgcagtcctcaccatttcccttcgtcgcggcggcatccgaggaggagagatggcgccgctcgtgccgtcgtcacaaccatgggtggagaaataccggccgaggcaggtgaaggacgtcgcgcaccaggaggaggtggtccgggtgctcaccaacaccctcgagaccgccgacttgccgcacatgctgttctacggtccgcctggcacggggaagaccaccactgcgctcgccattgcctatcagctctacggtccagagctctacaagtcaagagttttggagcttaatgccagtgatgaacggggaattaatgtggtgaggacaaagatcaaggattttgctgctgtggctgttggttctgcacggaaaggtggttatccctgcccaccatacaagattattatactagacgaagcagattcgatgacagaagatgcccagaatgcattgaggcgtaccatggagacttactccaaagtgacaagattctttttcatatgcaattatatcagcaggataatagagccacttgcatcaagatgtgcaaagtttaggttcaagcctctttcagaagatgtgatgagcaaccgcattttgcatatatgcaatgaagaagggctcactctggatgctcaggcgctatccacattaagtgccatctctcaaggagatcttcgtcgtgctataacttatcttcagagtgcagctcgcttatttggatcttctatttctgccagcgacctgattagtgtttcaggggctatccctgaagatattgtcaagtcattgcttgtagcatgcaaatctggtgaatttgatgtggcaaacaaggaagttagcaatattattgcagacggatatccagtttctcagctgctctcgcagtttctagatgtgattgttaatgcggatgatattccagatgagcacaaggcaagaatatgtagaaagcttggggaagctgataagtgcttggtcgatggggcagatgagtatttacagctcttagatatggctagtgagacaattcgtgctctgtttaacatcccgcaagggctggtcttctaagagaagatgatggagatgaacagcgatactgctgctggctgtctgcaaactctggcaattatatcttgtgtctccttcccaacttaagatgctagagaggcctaacctcattctcatcatactcttgtgctatttttaggttggtttgtgatgttttaagtgcgatgaactcactctatttttcaaccaattgaattgtgcctgaatatgtcaacaatcacaagaacagttctgacttgtaaaaaaccaaaaaaaaaaaaaaaaaaaaaaaa

SEQ ID NO: 15374 - DNA, 833 bp, Triticum aestivum
  unsure (1)..(833): unsure at all n locations
  Clone ID: PAT_TA_15374
ccacgcgtccggttcaccgcctaaaatatatgtgaaatacctgggtggttctacattattattgtctaacataaatcgcttcatctggtgagaactatcggtggcattttcagaatattcggtggctcaaatttacgcgtacgaatagcgtgtagcatactaagtgtcattttctttgttaaccccgggccgttctcggcacctgctcgtccgcctcccgtgctcccaccaaatccccccaattcgaacccaccaatggcgaccaggtgcgccgccgcggccgatctgcccgccggccgcccccgcaagcgggcccggcacggatgggacgtcgcgccagcgaccaaggctcagataacattttgtgggcaagaagttggcgatatgaccaccctggtattgccgtcacatcctccggactatacttgcttctctctgctctcaaagggtgttgctcgaaatgcttcccctcctcggagagaagacgataaagatggccattatgtatttgctgttggagagaatttgacctctcgctataaaatatacatgaagatgggcaatggacttttggtaaggtgctggtgggacagagcaagaaaagaaattctggctccattaaaattcttcctgttaaaaatacagagacccacgctgtggttattctgcccgacagacccccagagtggcctctggatgttgtgtgtgttccggtcgctggccttcggtccctgcgttggtcccttgctggcaaactgttattngcgaaagctacgcattcatcacattcnacttgaaaattttgacngcattactgcnagtattaagttaca

SEQ ID NO: 15375 - DNA, 2139 bp, Triticum aestivum
  unsure (1)..(2139): unsure at all n locations
  Clone ID: PAT_TA_15375
ccaagagggcgccggccgcctcagccgcagcaccgctcggccctcgcccgcccgctccccggcgccggtggtggcggcgctgctcgcgggtggtgccggggggtgcgcctacaggcgacagcgcccgggaatgggtgtacacggcagcggccgcggccagcctcctatgcaggtacaggtgctgcgggctcaccatgcctggcaagggaatgcgggacaaggagctcccaatttaaacgtcacaaccagcgccaacctgcgctaccttctcaacctaggagtgcctggggtggggtggcaacctactatggcacaagcctgtccagcacggttcaggcgcccaaacctaggcgctgctcgtgtgggtggcgacatctgggttcatgttcatggtgatggcggggtccgtgtctcaagggtcgtaaggatcttctgacgaggttggcgagtgaatgcacgcacagctcgtcccgccggggccgctgccctgatgcttaatgatcactggagattgttctgcacgtctgagctctgtcccctgtcttgctttggcgaagtggaccgcaagcgggtttcttgcatcagctgaatatgccccatagggatatgctcactcgtaacaatttacacggtacaagatgcatcaacacctcaaatttcatcagtagggcagatatcgaaagacaagtgaatatgacccccttgatctattctctgggtaaaacgaaagactaggcacggccatcaagtcattttactcgacaccccagaacatctactggattttttcgaatcgctccttaagcttcggtggcatggtaggtggcgccgataatgtccgtgctaatgagactgggaagtgtcttgaagatctgaagaagacagggaggctacaactatctgactttattgaactcgtgtcagaggcaatagctaaatctggagtactgtctaaacttttggccaaaccaaaactggatgatcatgacatcgaaagtgcaattcatgtgtattacaacatcatctctcaggccttgtttggtctgcaaaaatataactgatgctgagctattgcacaagtactctgtgttgcattctcttcctttggacaagagctgtaagattgtgagggactttctcatttctgctactgcaaaggactgtagcctcatgatgtgcttccggccacggtagtgtgaaagaacagattctgaatatgattcagtttttctcaagtcatggaaccgagcctatgattacaaggcaagctaagttgatctggatgtgaagcctctggataagttgacacattattttaaattggaccagaagatcgtcagtttctacactaagagcggggaggtcgggcgagttgcttgtgattctcaaaagggggttggcaccagtgatgacacagcggttcagccacaccattgagtagctccttcaacttgaagcctctggaccgggaagggcacatgccattggtcctgttgtttcgtcgtgcgactgttgttgtaaccttgtaagtacagctccattgtcgaggagctcttcccttccatcgggaaaaaagatgccgcagagcggtcactgctgtttgttgtcgctgttactgtagcttacgagttgtacatcatgtatacctaccgggtggctcgtcgcggcagaaaacacaccaggaattcgatacacagataccaagatgctaaaacagaccggttttcagaggcacccacatcatgaagcatctccgacagttggcagagcgcccacttgtcgtgcaggcttcggtgtagccatttcaccggttccctccacctgctaactggcttatgtactactccctccgtctcatattagttgtcgctcaaatgaatttatctagcattgaaatacacttaaataaatgtatctagcattggaatacgtttaggtacattcatttttgtgacaactaatatgagacggagggagtactgtacatcttttgagttgcggttgcttctctggtctcagttgcttattgtttctggacaacattgtcgtctctctatatattgtgtagctagattttccatgtagcacctgaattcggaagacgagcaaccagaccagtcaatatgnaattagacccaa

SEQ ID NO: 15376 - DNA, 2451 bp, Triticum aestivum
  unsure (1)..(2451): unsure at all n locations
  Clone ID: PAT_TA_15376
gcacgcgccgccccctcgtgctccagctcgtgcgccactcggcccccgaggagtggggcgagttcctccacgcccccggccgccgattcgacgatttcgaacacatcaagcgcgagatccagtcggaaacggacaaagaagctggaggtaacaaaggtgtctctgacaaacagattcgtctgaaaatcttctcaccaaatgtaattgacatcacattggttgacctccctggaattacaagggttccggtcggagatcagcctagtgatattgagtcaagaataagaacaatgatcatgcaatacattaagcatccaagctgcattatcttggccgtctcacccgcaaatgcagatttagctaattctgatgctcttcaactggcacggcttggtgatcctgatggatctcgtacaattggtgttatcaccaagttggacatcatggacaggggtactgatgctcgtaactttttactgggaaatgtaatccccctcaagcttggttatgtaggtattgtgaatcgcagccaagaggacatcaactttaaccgaagcatcaaagatgcacttgcctttgaggagaagtttttctcgactctacctgcttatcatggtctttcacaatgttgtggtgttcctcaattggccaagaagttaaatatgattctactaaagcacatcacagatatgcttccaggtttgaaatctcgaataaatgctcagttggtagcagttgccaaggaacatgctgcatatggtgatacggcagaatcgacggctggtcagggagtcaaactgttgaacatattgggaaaatattgtgaagctttttcttcgatggtggaggggaaaaataaagtgtcaacagatcagctttctggtggagcaagaattcactacatttttcagtcaatttttgtcaaaagcttggaggaaattgacccttgcaagaatataagcgatgaagatatccgcacgagcatacagaactctgacggtccaaagggggctatgtttctgccagaggtgccttttgagattcttgtgcgaaagcagataggccgtttgcttgatccaagtcttcagtgtgccaaatttatctatgacgagttagtcaaaattagccatggttgcttaactagtgagctgcagaaatacccaattcttaaaagacggatgggtgaatcagttagcaatttcttgagagatggtcttcgacctgcggagacaatgataactcatattattgaaatggagatggattacataaatacctcacattcaagctttgttggaggcagaaggttgttcggacgcgtgggcacgaaggtctatcttcgagaggaccaacttcactatcggttcataaggatggtgttggtataagttctgaggcgcagctaaaatcttctactgagaacaatgtacagctcaaatctgaaagaggtcaaaagtcacgtgctgtttttgcaagagatacttccagaggagcaacagctgagaagggatttcagcctgatacagatgcaggaacaagtgtggcaggtggaggccagaatggtcactcacttgttagtgggagtttgtcaagcatgtcagatccacgagtttacagcctcaatagcttatactctatgattcggttaagagagccaccgagcaccttgaaaccatcagaaaacaagactgaccgggacagaacagagatagctattgtgaagcttttggtcaaatcttactatgacattgtcaagaaagagtattgaggatgcggttcccaaagctataatgcatttttgggtgaaccacacaaagcgggagctccacaacgttctaattccggaaactgtacagggagagcctacttgnatgacatgctgaagggaaacagatgaagtactttatcagaacggcagcgttttcaaagaaacgctccaagttcttgaacaggcacacaggacgctcgaggaatttccccttgaagctgagaagcttgagaggggctacagcctgtctgagtatggcactggcctgccgaatatccctggactcagcaatcgcaatcctaggggtatcctcccttaacttgtacagttgaaagaagcatcaaatgtacatgaacatgctcatgtggcatgttggtcggacccaggtgccaaaaaagggcacctcttcacttggttttgattcaatcctcaatcattttggagctacttgtttgagttttgagctgggcatccaaattttgttctacaaaggcatttctttgtaatcggaagctatggctggaacaacaccgggagtagatcagtatgtaagttaccccccttgtcaacctgacaacggggaaccacttgcacttatattattattatgcaaggctacaattgccattttacaggagcatctaataaaattcttatagttataagcacatgccaagcaaaaa

SEQ ID NO: 15377 - DNA, 712 bp, Triticum aestivum
  unsure (1)..(712): unsure at all n locations
  Clone ID: PAT_TA_15377
cttatcgataccgtcgacctcgagntntttttttttttttttttttttttgtacagtagcattaagaaattggaaagggttccatcagttacagattcacccatgaagggcacaaattctttctgaagaagtaaatctaataccatacaaagtatgttacagtttttgaaatttttctaccagtgcatgatcagcaaatcgaccgtccttcagttttaataaatcaatctaatttaatggcaacacaacaccttacaatcacccaaaattccatgaatatggacatatcaccactattgtgaagtcgtagatggtaatggccatcgcgcaatgtgagcctcggagaggaagagcagggtttggcagggccaaccttcacaggttggcagcagacacacttggcaattgctcacacgtgcgctgctcccgcgcccatcatcttggctgcctctcccgccactagcaagatgcacattgcccactgggaccaaacaaaaaaatttgagagaagtctggacaaccttgacagggagaaggatcaaaggcttccgccaaataactcctctctttccccgccagattatccggatttgccttcttcctcttgcagcttttcctctttgcttcatttcctgggggggccccccccgttcgcccttgggtcggcccccgcctccgccccttagcgctgcggtaaactggtgctctttcn

SEQ ID NO: 15378 - DNA, 1048 bp, Triticum aestivum
  unsure (1)..(1048): unsure at all n locations
  Clone ID: PAT_TA_15378
ccgcgcctccgggtaacggtcagggtctccttgttctccatctggtagggaccctgcatacatcaccccgtccgctcccgcgccccgcaaaaagaaggttggaacgagctgtctggaacgatacttcttttctggcatcagtgggtgtgatggactactccctcctggttggcatcgacgaggagaagaaggagctggtgatggggatcattgactatctccggcagtacacatgggacaaacagctggagacctgggtgaaggcgtcggggattctagggggctccaaggacgggatgcccaccatcatttctccagaccagtacaagaagaggttcaggaaggccatgtcaaagtacttcctaactggattctggggggctccaaggacgggatgcccaccatcatttctccagaccagtacaagaagaggttcaggaaggccatgtcaaagtacttcctgactgtccccgaccaatggtcaccttgaatcgtcgtcacttgatgcctactattatttgcctattcgagtgcaagatggggtgatagcaactgggaagcggcccattgttttctttctattttttctttggttttgttagaatagtcatcgatctgcgccttatgtatgttatttttgctcgcatcaggctggactgggatcgctggagagggcgtacggtaaaggttgcccccatccaggcagagcccaaggatcgatatgtgtatattatatataacaatgctacactgtaacatgaaatgaaatgccgaatgggggcccgtaccaatncncccaanatgatcntattaccncgccantggccttcttttaaactcctgacgggaaacctgngtaccaactaancccttgaanaaaccccttcccaactggntaaaacaaaaggcccacgntgcctccaaaattccacctaatgnaatggaccccctgtacggcataaccggggtttgtgtacccactnccgnaaatncacccacccnccttgctntcctcttccattcggttcccaaccaatgggcccttggc

SEQ ID NO: 15379 - DNA, 890 bp, Triticum aestivum
  unsure (1)..(890): unsure at all n locations
  Clone ID: PAT_TA_15379
ctcctccctccctccccattgctatgcccggaatcgaaccctagcctgagcttgaccgcgaccctgatcccctgttcgccatggatcgcccgccacatctcgacttcgacctcaacgagccgcccccgccgtcgccggcgccgccagcgggtctccagccgcccccgcgcgagttcgctgcccccatccccattgttgctcctccgccgccgctgcaagccgccgccaccaccgcagctcccgcctcccgccaacgtgcaggcccaagctgctgctcccgcaccaggcccgcgagctagcgctggcgtaccaccgtggcggaatccgtggaggttagctgctgccaacggccagtgcggcgcgcgaacancgctggctcatcgctgggaggtgccgccaaccgcccgccggttctccggtccgcccacttttgctcctccgccgctgccgccgccgccgccgcccatcatccgctcccctcctcccgctcctcctcccccgccgccaccccgccgcccgccgccacccaacgtgcaggctcagctgctgctcgcgcaccaagccagcgagatagcgctggcctaccagcgtggggaatggggtgagcngccatggcggccacgacggcanggccgtcgggcgggggccgnctncagcgccagcgcaggacccaggagtagcgaggtggggcgggaaccggtgcgcgttctgggggcctccccgaactggcaggatcggacattatttgcgacgcctgcgaacgtggttccacccaaagctgggtccaaagtcgggcggcgggcctcggtgggcgggaaccaaccgctgaagtgccccggatgtgccaaaggaaccctcaaagcccaagaaataaccaggccagttttgta

SEQ ID NO: 15380 - DNA, 1457 bp, Triticum aestivum
  unsure (1)..(1457): unsure at all n locations
  Clone ID: PAT_TA_15380
cacgcgtccgcccacgcgtccgctcggcctcggcggcctcccccaccgccgaccgctcggtgtggaagtccacggagcgtcgagatccaggcgctgctcgacaagctgcaggacgtcaacgacgccatgagccgctgcgccgcgcccgccgcccccgccaccggttccgtctcccagaagctcgcgcgccaccgcgacatcctgcacgagttcacgcaggagttcagaccgacgcgggggaacctgagctccatgagggagcacgccgacctgctcagctccgtgcgcggcgacatcaccgagtccaaggctaccggcggcatgtcgccgagggtacatttgctccgggagagggcttccattcacggcagcgtcaaccagatagacgaggtaattgggcaagctcaaagcacaagagcagccctatccaatcagagggccttgtttggagatgttcagggaaaagtcaagcagttgggtgaaaaattccctgtggtccgtggcctccttggtgccatcaagaggaagaaatcaaaggacacgatcatcctttcagcagtaatcgcggcctgcaccatctttttgatcatctactggctctcaaaatgatcggtccgttgttgggaaagctcgcgacggggacttcctctctcaccacagaatgactgacaagtgaccaacagatggcacgataaaagactggtgattattatccatttcttagggctagtacgagggaatgggagatcccgtcgtgtttagctctcaccgtgctgccctcgacatatcttgtttttggagatctcccttgtcatttataccttagatcaattttgtttggtgaattgagatcttgcttgtttcgagtaatcaagacaccctcgatctccccctgccagcttgccacgggacttgacctaatgctggtacaccggctgtggtcttctcggcaaggcccggccctgggccgccgctcgcattnaggnggccttntttgggaatntccgggggaantcaaccgttgggttgaaaaatcctgtgtcnggaggctcctttggcgcccatncaaggagggaggaatcaaaaggacacgaatcatctttcagcagtaatcgcggcttgcaccatctttttgaatcatctactggntctcaaaaatgaacgtccgttgtttgggaaactcgcggacggggattcctctctcaccacaggaatgattgacnagtgcccaacagatggcacggataaaagatggtgattattatccatttcttagggctagtacggagggaatgggagatcccgttgtgtttagctctcaccgtgctgccctcgacatatcttgtttttggagatctcccttgtcatttataccttagatcaattttgtttggtgaattaagatggaagtgtcagaagtgtgtcatcgtatttactcgaaacaaacaacatctcaa

SEQ ID NO: 15381 - DNA, 244 bp, Triticum aestivum
  Clone ID: PAT_TA_15381
gccggccgggcttgcggctcggcgttggctacagcgacaaccttgactgctacaaccagaggcccttcgcttagtcaattataattttggccctgcgcaaaatacaataagagcgtcatctcctatctacatgttgtaagatgtaactatggttaccttttatgcggagcataaaaaaggcatctcgtatggacggtttggtagtgaatattaccaacaaaaaaaaaaaaaaaaaaggccccta

SEQ ID NO: 15382 - DNA, 434 bp, Triticum aestivum
  Clone ID: PAT_TA_15382
cccacgcgtccggcacgagtagtgtgacacacaatcaccagctgagcggactctgcttcattgcccaagatgagaggagttgtggtggtggccatgctggccgcggccttcgccgtgtctgcgcacgccgagcagtgcggctcgcaggccggcggggcgacgtgccccaactgcctctgctgcagcaagttcggcttctgcggctccacctccgactactgcggcaacggctgccagagccagtgcaacggctgcagcggcggcggcaccccggtaccggtaccgacccccaccggcggcggcgtgtcctccattatctcgcagtcgctcttcgaccagatgctgctgcaccgcaacgatgcggcgtgccaggccaaggggttctacaactacggcgcctttgtagccgccgcccactcgttctcgggcttcgc

SEQ ID NO: 15383 - DNA, 1009 bp, Triticum aestivum
  unsure (1)..(1009): unsure at all n locations
  Clone ID: PAT_TA_15383
cttgcaccacacagcggtggagtactctgcttcctagccgcccacgatgagatcgcttgcagtggtggtggccgtggtagccacggtggccatggccatcggcactgcgcgcggcagcgtgtcctccgtcgtctcgcgctcacagtttgaccgcatgctgctgcaccgcaacgacggcgcctgccaggccaagggcttctacacctacgacgcctttgtcgccgccgcaaacgccttcccgggcttcggcgccaccggcagcaacgacgcccggaagcgcgaggtggccgccttcctggcacagacgtcccacgagaccaccggcgggtgggcgaccgcaccggacggggccttcgcttggggctactgcttcaagcaggaacgtggagccgccgccgactactgcaccccgagcgcgcagtggccttgcgcccccgggaagcgctactatggccgggggcccatccagctctcccacaactacaactacgggcctgccggccgggccatcggggtcgatctgctgagaaatccagacctggtggccacggaccccaccgtgtcgtttaaaacggcgatgtggttctggatgacggcgcaggcgccaaagccgtcgagccatgctgtgatcacgggccagtggagcccctcaggggcagaccgggccgcagggcgggtgcccgggtttggtgtgatcaccaacatcatcaacggtgggatcgagtgcgggcacgggcaggacagccgtgtcgctgatcggatcgggttttacaagcgctactgcgacatccttggtgttggctacggcgacaacctcgactgctacaaccagagacctttcgcttaattagtcagctatgtctaatcttggccctgcgcaatatacaataagagcgccatctcctatctacatgttgtaagatgtaactatggttaccttttatgcggaacataacaaaggcatctcgtatggatgctttggtagtgaatattaccaacaacnnnnnng

SEQ ID NO: 15384 - DNA, 1171 bp, Triticum aestivum
  unsure (1)..(1171): unsure at all n locations
  Clone ID: PAT_TA_15384
gatcgatcatgaagccatacatgcccacggtactgagaccccctagggtggtggccatcctggccgtggtcctggcggcggcgctcgccacagccgtgaacgctcagcagtgcggctcccaggctggtggcgcgacgtgcgcaaactgtctctgctgcagcaaattcgggtactgcggcagcggcgacgcctactgcggtgccggctgtcagagccagtgcagcggctgcggccccacccctcccggccccagccccggcgggggcgtgtcgtccatcatctccagggacctcttcgagccaggctccttcttcaccgcaatgactgccaagaggcccgcgggttctacacgtacgacgccttcctcgccgccgccgccgcgttcccgtcattcggcaccacggggagcacggagacgcggaagcgggaggtggcggccttcctggggcaaacttcccacgagaccactggcgggtggcccgcggcgcccgacggaccgtacgcctggggctactgcttcaagcaggagcagggctcgccgggaagctactgcgagccaaagccggagtggccgtgcgcgtcgggcaagaaatactacggtcgcggccccatccagctctcatggaactacaactatggccccgcggggcgtgccatcggggtggacctgctcaacaacccggacctggtcgccgcggacgcgacggtgtcgtttaagacggcgttatggttttggatgacggctcaggcgaacaagccgtcgtcccatgccgtgatcacaggccaatggaccccgtcgggcacggacaacgctgctggtcgggtgcctgggtacggcgtcatcaccaacataatcaacggcgggctcgagtgcggtagggggcaggatgaccgtgttgctaaccggatcgggttctacaagcgctactgcgatgtcctcggcgttggctatggtaacaacctcgactgctacaaccagaggccgtttaacagtgggctctcgatggggcttgccactgagtgacaacatactaagactgtgagcgagtcctccatgcatggatgtatgaatgtgatcacccataaataagcttgagaagtactgtttgggtaaaaaaaaaaaaaaaaaagaaaaaaaaaaaaaagaaaaaaaaaaaaaaagaggnngcgt

SEQ ID NO: 15385 - DNA, 782 bp, Triticum aestivum
  Clone ID: PAT_TA_15385
agagcggccgcttttttttttttttttttttgattttttacatgttaaaacattttattgaatcgacgcaagagaatgatatccaatagttacatgtcaagcatactgaacatgttctgccaacagctgatatgctaagatgttctatcaaaattacactgggattcagaaacgacgttactgcctgaaccgattttgatacaatgctgttctagggctcttcaataatctacagagttctggtgaatttttttcccgccaatccgatcccaaatcacggtatgttcaacaaaggggcttctcatcaaaagtgagccaaactgtacacaagaatccatgaaagcaggaaaagggtgaaagatgcaaacatcccctcctgaagcagcgcgccatggcctccgaattcttcctcgtcgaccttcaataggtgcgcatagtaccagtaaattatgccagaagaaatggccacgaacaggacgatccaggcggcgccgacgagcgggacggcgccccagagaaggccgcaggcgaggcccaccgcctggcggatccagtgcacggcgtccagcagccggtccttgtcccacggcgcctccgggtcgaggtaccgcgcgagcccggacggcgccgcgtgcccggccccgccgccctgctgcgccgcctggctcttcttcgccgccgccgacgacggcttcgcccgcgccatggtgggtggggcggcggcgggatcgaggtgtgggggggagacggcgatcggataaaggcggaggaacaaagtcgtc

SEQ ID NO: 15386 - DNA, 1230 bp, Triticum aestivum
  Clone ID: PAT_TA_15386
aaaaaaaaaggacacacacataccactacacgagtagtgtgacacactagctcgtaactaaatcaccagctgagcgggctctgcttcattgcccaagatgagaggagttgtggtggtggccatgctggccgcggccttcgccgtgtctgcgcacgccgagcagtgcggctcgcaggccggcggggcgacgtgccccaactgcctctgctgcagcaagttcggcttctgcggctccacctccgactactgcggcaacggctgccaaagccagtgcaacggctgcggcaccccggtaccggtaccgacccccaccggcggcggcgtgtcctccattatctcgcagtcgctcttcgaccagatgctgctgcaccgcaacgatgcggcgtgccaggccaaggggttctacaactacggcgcctttgtcgccgccgccaactcgttctcgggcttcgcgaccacgggtggcgccgacgtcaggaagcgcgaggtggccgcgttcctcgctcagacctcccacgagaccaccggcgggtggccgacagcgcccgacggcccctactcgtggggctactgtttcaaccaggagcgcggcgccacctccgactactgcacgccgagctcgcagtggccatgcgcgccgggcaagaagtacttcgggcgcgggcccatccagatctcacacaactacaactacgggccggcggggcgggccatcggcaccgacttgctaaacaacccggaccttgtggcgacggacgcgaccgtgtcgtttaagacggcgctgtggttctggatgacgccgcagtcacccaaaccttcgagccacgacgtgatcacgggccggtggagcccctcgggcgccgaccaggcggcggggagggtgcctgggtacggtgtgatcactaacatcatcaacggtgggctcgagtgcgggcgcgggcaggacgcccgtgttgccgaccggatcgggttctacaagcgctactgcgacctcctcggcgtcagctacggcgacaacctggactgctacaaccagaggccgttcgcatagtcaatcggctatatgatgcgagaagacatgcaataaagactctctaaatactgtaacaatggcgttgcgatagacctcgcctagtacaagcgaataatggtgcgatccacgcaagatgcgtgtgtagtcgattataatgcaataaatggtgtgttcctatccaagttttttttttgatg

SEQ ID NO: 15387 - DNA, 1299 bp, Triticum aestivum
  unsure (1)..(1299): unsure at all n locations
  Clone ID: PAT_TA_15387
gaacacggcgggggaacagtacacttgcgccgcacaacatgcccgcactatgctgaccacctggggtggtggccagcctggctgggggccgggcggcggcgccttgcccccgccgtgaccgcgcagcagtgcggcccccaggctggcggcgcgacgtgcccaaactgtctctgctgcagcaaattcggctactgcgccagcgccgccgcctactgcggagccggctgtcagcgccagtgcagcggctgcccccccccccctcccggcccggacccccgccggcgcgcagcgcccattatctgcagtgccctcttcgagcggcccctacttcaccgccaggaggggccacgagcgcgtgcggggttctaccgggcgcgaccgccttccgcgccgccgtcgacgcgctcccggcagtcgcccccacggggggcaggccgccgcggccccgggggcggggggcgcccgccgggcacacctcccacgagaccaccggcgggtgccccgcggcgcccgacggcgcctacgccgggggctactgcttcaaccaggagcagggggcgccgggcccgccagctgcaggccaagccggcagtggccatttggcgccccgggcaggcatcactgcgggcgggccctgcccggccccccacaccgagaacaccgggccggcgaggccggcccggggggccggggtgcgggatagcccggacctcctggctcgggaccggccgagtcgtttgcgggcgcgaagacggcgttgtggttgtggatgacgccgcagacccaaaccgctacgacgtgatcccgggccggtggagcacctcgggcgccgaccacgcgccacggagggggcctgggtacggtgtgatcactaacatcatcaacggtgggctcgagtgcgggcgcgggcaggacggccgtcgggccggcccgatcgtgttcccgaagcggaacggggtccttctaagcgccagttatgacctccatcggggtcagctacggagacaacctggactggctacaaaccagaggccgttcgcatagtcaatcggctatatgatgcgagaagacatgcaataaaggctttctaaatattgtaaacaatggcgttgcgatagacctcgcctagtactacaagggaataatggtgcgatccatcgcaagatgcgtgtgtagtcgattataatgcaataaatggtgtgttcctatcaaaaaaaaaaaaagcgatcacgccactccccactaaaaaattaaacctcggccccgaccacgctaatcgaattccccgcggncgccatg

SEQ ID NO: 15388 - DNA, 409 bp, Triticum aestivum
  Clone ID: PAT_TA_15388
tactagcgtatgaatagaagcactaaagagggacaaaattacaaagtttgaatgtgatcacggtatttttttggttgctaatgatacatcgacacgttagtacaggtgctttggatggattgaagatcatggttagctaggctgacatgtgaatggcttctcaagcatattgttcaaccggataaactccttctcgtgtccttcttcctttccgcaaatgaatttcccctttttgggatgaatgatctcaaagctacgggggcaaagtatacacacactcctgcgaggtttcttttctgttaaaagaaaaagagataagttagtattcatgttatgaaatcacccacatgcagtattcaaataactgtacaaggatatatagccgctccaaaagaatgtacacacatac

SEQ ID NO: 15389 - DNA, 1029 bp, Triticum aestivum
  Clone ID: PAT_TA_15389
tcggacctccttctttacgcaccccaggcctctaccctctactctctccgctccgtgcggtgtgtggaatcctgaaccgcctccttggtcaccccggcatcgctggtcctccacctccgcggcagccggcatttcgcaagaattgatggggtgcaagtcgtgccagaagcccaaggcgcagcaccgcaaggggctgtggtcgccggaggaggaccagaagctccgcgactacatcgtccgctacggccacagctgctggagcaccgtcccagtcaaggccggccccccgtcgcccggcctgcgcggcgggctccgctgcgccggccccccctcccccgcccccggcctcgcctgggacctgctggcgtacgagtcgtgccagaagcccaagccgcagccccgcaaggaggctgtggtcgccggaggaggaccagaagctccgcgatttcatcgtccgccacggccacagctgctggagcaccgtccccgtcaaggccgggcttcagcggaacggcaagagctgcaggctgcgatggatcaactacctgaggccggggctgaagcacggcatgttctcccgggaggaagaagagaccgtcatgggcctccacgccgccctcggcaacaagtggtctcagatagcgcagcacctgccgggccggacggacaacgaggtgaagaactactggaactcgtacctcaagaagcgcgtcgagggcgcgcggtcaccagcgaaatccgccggctcgggcgcgccccggagccccacggccaagcgagagcgggtgcggccgctctagaggatccaagcttacgtacgcgtgcatgcgacgtcatagctcttctatagtgtcacctaaattcaattcactcgccgtcgctttacaacgtcgtgactgggaaaaccctggcgtcacccaacctaatcgccttgcgacacatccccctttcgccagctggcgtaatagcgaaaaggcccggaccgaccgcccttccccacagttgcgcaggctaagccggccgtcgtga

SEQ ID NO: 15390 - DNA, 1077 bp, Triticum aestivum
  Clone ID: PAT_TA_15390
ccacgcgtccgctgaccaggtggggtccggacacgaaggagcccggagggtactgaggcggcggctgcctgacgcggcggtgagcggcgaggcggcggccggcggcggcggggaggcgaacggcgtccagccgaacgtgaccatctacatcaataacctcaacgagaagatcaaactcgaagcacttaagaagtccctcaatgccgttttctcccagtttgggaaaatcattgaggtgcttgctttcaagactttgaagcataaagggcaggcatgggttgtgttcgaagatgttgcatcagcaactgaggctttgaagaggatgcaagattttcccttctatgacaaacccatgaaaattcaatatgccaagaccaagtcagatgttgtagcaaaagctgatggcactttcgtacctcgagaaaaaaggaagaggaatgatgagaaacctgagaagaagcagaagcgtgagcagcaccatgatgttaaccaggctggcgtgggcatgcatgcctatcctggtgcttatggggctccgccgctctctcagctaccttttggtgcgggaccgagcttcatgatgccagagattattgtaccaaacaacattctcttcgtccaagaactcccacacgacgcgaccgctttgatgctgcagatgttcttctgccagtaccccgggttcaaggaagtgcggatgatcgaagcgaagcccggaatcgctttcgtggagtatggagacgaggggcaggcaaccgcagccatgaaccttcttcagggtttcaaaatcaaagagaacccaatgcgcatcacatatgcgaagaagtaacttgatgagctgtattgacttgaattaatgttgtaggcctgtttttgcaccatttggtagattttcttcacatgtaaggtagactacatcatccagtaaattaatgtctcatgcttggaagctattttcagtcatgtatttgggtttggcatcgttgtgataattttttgtcaaatcatatgttgccaattccgtctatttaccatttcctacttttgtcgctatttttccacaagttcctcacaacc

SEQ ID NO: 15391 - DNA, 778 bp, Triticum aestivum
  unsure (1)..(778): unsure at all n locations
  Clone ID: PAT_TA_15391
gnggagnnttttaaaacccctnctcgaaacctntatacccntgctcgaaacaaccctcactaaagggaacgatcgccgccgcccccccgccgcggcgccccgcgcttctccttctgccccccccccgctgcgccccctcggctccagatcccgagtaaccaagccagagacaccgcggggccgccgttgcaagaggaggacgggggtgttgcaaggcgctgccgccgtctctacaagggcactactgcctggggcagtgacgccaccacgatggagatgacgggctacaactgccggacggcaagggaggccgctatttctccctccatcttcctgtgatgtctgcatctagcttgctctaccaatgcagccgagcaatctgttgtttcaagggcagccccggtttcctttggtcattctctgaaatcttgtgcagctttttggccgccccaggtttccttcggtcctattcctcactccatctccctcgaatgtctgcctcaccctgcattccccttctagttcgttcgttctttcccttgcccttccttgggaagaagggtacatatgccgtcgccggccatctctctgccttgctcgagtggaggtccggcgggtcttgcgtgcgcgtgggctagtccggctgcttggtccctggctcctctctcgctccttccgcggcgtgccgccgtcgcgccccctccccttgcgcgccgtccccgacgcctcgcaaagagagacgtngccgctatcgtctctgcgcgacgcttagccgcag

SEQ ID NO: 15392 - DNA, 1312 bp, Triticum aestivum
  Clone ID: PAT_TA_15392
aacagggaaagcggctgggaaggggagaaaggtaaacgccgcgcaccgcaatcggaacggaaatcccccgcgccgcacgccgaatccgtcgccggaatccatcgaccgatccggccggccagccggcgagagcaggggcgcggagatggtgagcgccttcttcctcttctgcgggtgcgtggagcaggcgaacgtggcggtggtcgagaagtggggccgcttcctccgcctcgccgagccgggcctccacttcttcaaccccttcgccggcgagctcgtcgccgggaccctctccacccgcgtccagtcgctcgacgtcaaggtcgagaccaagaccaaggataatgtgtttgttcagctgatctgtacaattcaataccgggttgttaaggagaatgcagatgatgcgttctacgagttgcagaatccccaacagcaaattcagtcctacgtctttgatgtggttcgagccatagttccaagaatggagctggacagtctttttgagcaaaagaatgatgttgcaaaggctgtacttgaggagcttgaaaaggtgatgtcagattacggttacagcattgagcacattctcatggttgacatcatccctgatgctgctgtccgcagagcaatgaacgacataaatgcagcccgaaaaggtgctgtcagattatgggttacaaaggagaagcggagaatatcctgtctggtgaagaaggcggaaggggaggccgaggccaagtacctgtcaggcgtcggcatcgccaagcagcggcaggctatcacggacggcctgcgggagaacatcctcaacttctcgcactcggtgtcgggcacgagcgccaaggaggtgatggacctgatcatggtcacccagtactttgacaccatcaaggagctcggggacaactcgaagaccaccacggtgttcatcccccacggcccgggccacgtcaaggacatcggcgaccagatccgcacaggcatgatggaagcgtcgagcagcggcctgtaagccatggccgtctgtccgccatgtgatgatggtttggctggatgggttttctgcgtgaggctgggagagtcgatctgtttatatatattgttagaattatagtagactacgtacttatttatttgtttttagtgtgtaataatacaggcgcagggacttggttgtgcatgaagattgtagagttctggtattatataatcataaaatgggaaacattttgtgttaaataataaaggcgcagggacttggttgtgcatgaagattgtcgaattcggtattatataatcataaaatggg

SEQ ID NO: 15393 - DNA, 722 bp, Triticum aestivum
  unsure (1)..(722): unsure at all n locations
  Clone ID: PAT_TA_15393
aataannagttgattacccctgctcgaaattaaccctcactaaagggaacaaaagctggagctccaccgcggtggcggccgctctagaactagtggatcccccgggctgcaggaattcggcacgagcccgcacatgcccacgctgccacggccagcgccttatgcacggccgtagccgccatatatagagcatcgtccgtctctcttcctggtctgccagtctggctacctcgctgctgcgccgcgtgcgcgcctcgtcgtcgatgaagtcggccacctccctcctgctcggcgccgcgctcgccaccgcctgcttcctgctctacacgtccgtgggccgcgacctcggcgcgaggacgccgccggcgccacggtgggcgccggagaagggggcaggcggcgccgatcggcccaagcaagaggtcgtcgtgaaagtggaggaggtgactaagggcgtggttgccagcagcgacggcggcggcagagatggttcgtcaccggagcaggaaaagcagcaacggcagcagcagatcgtgatgcctgtgaacaagcaacagcagcaggacaagccccaagatctcggcccgatctgctccgacgagccgcgaacgcagaccggaccgtgctgatgacggctctcaacgaggcatgggcggcaccgggggtcgttcctggacctgttcctggagagcttcaagcacgccggcgacgccccgccgcng

SEQ ID NO: 15394 - DNA, 995 bp, Triticum aestivum
  unsure (1)..(995): unsure at all n locations
  Clone ID: PAT_TA_15394
gagnnccnttgctcgacttaaccctcctaaagggaacaaaagctggagctccaccgcggtggcggccgctctagaactagtggatcccccgggctgcaggaattcggccaaaatggaaatgacctctacaaaaattgcattatgttgtgttctaattctttctggagccaccataagaggatgtttttgctacaaggaagagaatatcaaggaaaaaactcagtcaattccatggccattacaaattcctccaatcaatagagatgaagcctctactcaagcttctgaggagcagataaatcatttctcagttcacttatggaacaaaaggctagatggtaataattattatgcattagaagctacgatggatgtctatggatttcatttaggacatgaagaacaaagtgtggcggcaatttggatctatagtagaggagaagatggaaaatctcccgttactggatttgcacttggatggcatatccatcctgcactttacaaggatacaaatacatattttcttacacattggactggcaatggatcacctccagatggatgctataacattcgatgtcctggttacataagaacaagttctagtacaactcctggggacgttattactcctgtgtctagcatcagggataaaaagcagtacataacaatcaaggcttacaaggataagaaatctggtgattggcaagtccactatggattcaatagtcctgcaaaattaattggttactttcccaaatcattattctcggacatggaaaagaaacaattaattatttcttttggtggcttcacaagccacccacatgcacaaccaatcctccaatggggagcgggttatttccaagggagaaatgccgccccttcaaagaatctaaaatttgttgatgcaaaaaggtcctactcatgacatcaacaaagatttaccatttaatgtnacttctcaaagntgttaaccnccttctacnancgtn

SEQ ID NO: 15395 - DNA, 768 bp, Triticum aestivum
  unsure (1)..(768): unsure at all n locations
  Clone ID: PAT_TA_15395
gatannccctttgctcgancttaaccctcactaaagggaacaaaagctggagctccaccgcggtggcggccgctctagaactagtggatcccccgggctgcaggaattcggcacgagggcacaatggcatggtggtcgccagaaaggctgggcgggttgggaagcgacggctgaccacggagggggcgtgacgacgtggtgctcagcagcaatgtttgcgaggtgtacggggtgtggcctcggtgttgggcagtctgctggccgcaggaacggtttatggtgttcgtggtgctgcttcaaccgcgagcaattcgtgctgcttgctccactaggcgctgaaattgtaggttcatctacatggggatttcggaacctcatatttgaaatgcaaatgtctcagtttggccaaaagaagaccagtgcccgtctcaagattgacaggagattgttgtactacagaaagatatatagttttctctatagatactgattttttttagatgctactatgtcaagcagcatgctaactctttttttatgatttatgtgtgatgaactaacatcgcctttgttcattgtaaacaaacaaaattggtgttgtcaggaaatccaagtgcttttcgagtaaaaaaaaaaaaaaaaaactcgagggggggcccggtacccaattcgccctatagtgaagtcgtattacaattcactgcccgcgttttacaacgtcgtgactgggaaaaccctggcgttaccaacttaatcgccttgcacnnn

SEQ ID NO: 15396 - DNA, 843 bp, Triticum aestivum
  unsure (1)..(843): unsure at all n locations
  Clone ID: PAT_TA_15396
ctccacccgtcctctcctcctacttccgctcggcggctcttgcagctcgctcgccctcaaatctccttaataaatcgctcattgaccctgctcctgcacagnaattttgcagatttgcaggggaggggaggggggcgagaaatggggatgaaatggcacgtcgtcgcggtgctgggcgtggcctgcactgtggccgccgccgtcgccgccgacagggggctctcgttcgccggcgccgtggcgccgccggaggaagcgagctacgacctgcgcaagctggccagctccctgtggcagagtgacggaaccgcctaccaccacgtgtggccgcccatgaaactggggtggaaaattgtgttggggtcgttcattggattcttcggggcagcgttcggcagcatcggcggcgtaggtggcggtgggatcttcgtgccgatgctgaccctgatcatcggctttgatcccaagtcgtccgcggcgatgtcaaaatgtatgatcatgggcgctgccgtgtcaactgtgtactgtaacctcaagctgaagcacccaacattggacatgccagtgatagattatgatctagtcctgctcatacagcccatgctgatgctaggggtcagcattggggttatctgcaatgtgatattccctgactggctcgtcaccggcctcttgatcattcttttcataggtacttcaactaaagcttttctgaaggctatcgaaacatgggagaaagagacggtaattattacggtgaaaaaaaaatcctggattggtgtgctttttgttttgacatcacattaggctttttggattccgataacccctttattttgtatt

SEQ ID NO: 15397 - DNA, 812 bp, Triticum aestivum
  unsure (1)..(812): unsure at all n locations
  Clone ID: PAT_TA_15397
ganatgccctttgctcgaanttaaccctactaaagggaanaaaagctggagctccaccgcggtggcggccgctctagaactatgtggatcccccgggctgcaggaattcggcaccagttcccatcccatccaacctcgctctgctctgcccaccgcccccacctcccactcctctcctgcctcctcccgcgcccgccatgaacgaacccgcggcgtaggaccgtgaaccgaaccaaccatgggccgcgcgagggccagggacgccggccacggcggcgccaagtcgttcccgtcgccggcctcgtcctcggcgtcgtcgtccgagttcgagttcacggtgacgcagtcgccgggggccaagcagcggtcggcggcgcagctgtgccccgccgacgacctcttctacaagggccaagctgctgccgctgcacctgtcgccgcgcatctccatggtgcgcacgctgctgctcgcgttgggcttcancttcttcggcttcgcttcgantcaccttcggctcaacttcttccgcgacttcaacggnagacctcctccttcttntcaccgactgcgcccgcgcttgttgctcccggactnttgcgcccttcttctcccgccccagctccggcggccgacgacgaccggcaccttnaaccttgcttccgggggaaccggcttnctacgcccgggctttcccggccgggccaaagcgcaaccngggcaaggcaagtaacctttttctttcntttgggcnaanccgggtttntttctttccgtnttttccttncaaaccgcggggcgggcncccncccgg

SEQ ID NO: 15398 - DNA, 961 bp, Triticum aestivum
  Clone ID: PAT_TA_15398
gggacgcgctagcttgctactgtgactgtgttgctgcaaccatggggcttgacacacacgctctcgccctcctcccgctggtgcttgttgcctcgctggcgacgttcctccagcctgccgctgcaacccatggcacgccacgccccgccgggctctaccgcgctcctctggctcccttcctgcgccggtgcagctcgacgcacgccctctcccccgccttccggcggcgcttcgcgcgcgcgccctgctccgcgcgtcggccgctggtacccgggccgtgcggcccgccagccgacgttgccgcctgcgccgggtggcgcccgcgccgccgcaccgcagcatgggcgccggccacggcggcctgccgcacctggacgaggtgcctgccgccaccgcgtccctgcccacagaccccgccgcccgtcgaccgggagatctcgtcgccgcccacgcccggcccgcacgggagggacccgcgccttcggccatgctgctggaacgagggcgactgccgggccacgggtcccggcgctgggcaggcgagccgtgccctccgcacagagacccccgcccccgccgaccctggcggccgcgccgcatccgcagaggttcggcgccggagcgacctgtgtcatcagccatccaggggcaaccatggcgaggtccggcccgcccccccccgacgccgcgcgcgccagcggtgtgctcggacccgagaccttcgccttcgcggacgatggcgggccgcgcccgcatcccgcggaggttggtggcgtccgtctttggctcgcgcgcacaccggcacagggtccgatgttccggccaccggccacatgaagagcaccaacatcctttacatgcgctggaccagcccggatttcagcgcctacttcgtcaaactcctcggcgtcagcggcgccgggcagcgcctggccgggccacccggaacgccgcatgatcg

SEQ ID NO: 15399 - DNA, 814 bp, Triticum aestivum
  unsure (1)..(814): unsure at all n locations
  Clone ID: PAT_TA_15399
gnagnttcccttgctcganttaaccctcactaaagggaacaaaagctggagctccaccgcggtggcggccgctctagaactagtggatcccccgggctgcaggaattcggcaccaggttgagacagaatccacataatgtggaggagtggcacaggagagttaaactttttgacaaggatcccgcaaagcaagtagcgacatatgtcgaggctgtgaaaactgtggacccaatgaaggcagttgggaaacctcatactctatgggtggcatttgcaaagatgtatgagaaacataaccgcttagatagtgctgaagatatctttaaaaaggccacacaagtgaactataaagcagtggaccacttggctactatttggtgtgaatgggccgaaatggagctccgcaaccaacattttgacaaggcaattgagctgatgaggttagccacagcaaagccctctgttgaggtgaagatgcgagctgctgcgganggtgaccagccggtccagctgaaattacataaatctctgaaattatggagtatctatgttgacctggaggagagccttgggtcatttggaaacaaccccgtgctggtttatgagaagaaatattagatttnaagaattggccacctcctcaaaataattccttaattaccccantttctttctttgaaggaggaaccagagtatttttccaaagaatgccttttttaaaaggtgttatggaaaagaggggggtaaaaaatatatttcaaaggttttncccccattgttttaangggattattttggggggggaaccctaccc

SEQ ID NO: 15400 - DNA, 749 bp, Triticum aestivum
  unsure (1)..(749): unsure at all n locations
  Clone ID: PAT_TA_15400
gagntgnntttgatacccctgctcgaaaccaaccctactaaagggaacaaangctggagctccaccgcggtggcggccgctctagaactagtggatcccccgggctgcagcacttccgccccccaccactcccaccaccgctccccccaccgccgccgacgccgccaccaaccgctgcgccatggatcccgactccgaggtcgccttcgacttcccgccctacctctgccagtacaagagcggccgcgtgcaccgcccgggcggcgacgccatcgcccccgccggcaccgacccgctcaccggcgtcgtctccaaggacatccacgccggccccgcccgcgcgcgcgtctacctcccgcccgacgcctccgccgccgcggcccccggcaggctccccgtcgtcgtctacttccacggcggcggcttcgtggtcggctccccggcccgcccctccacccacgcctacctcaacgacctcgtcgcccgctccggcgccgtcggcgtgtccgtctactaccgcctcgcccccgagcacgcgctccccgccgcctacgacgacggctgggccgccgtgcgctgggtcctcgccggcggggacggcgccgacccctggctgcgcgaccacgccgacctctcccgcgtcttcctctccggctgcagcgccggcgccaacatcgcgcacaacatggccgtncgagccggccgcgcccggcgcggtgcccggaggcgccgccgtccggggcctcatg

SEQ ID NO: 15401 - DNA, 793 bp, Triticum aestivum
  unsure (1)..(793): unsure at all n locations
  Clone ID: PAT_TA_15401
gagggtnnnntttaagcctttgaannnctntattaccctgctcgaaantaacccgccctgccggcggctccagctccagccccacccccgcggcccccccgctctcccacgttcctcgcccgccggccggccatggcggcgatgccgatgccccggtctctcctgctgatcctcctcctggccacccccttactcatcctccccctcgccgccgccgcagtccccacctccaacccggacatcgacctcgagtacctcatcaagaacgccggcctcgacgaccccacccctgccaccaccgccaccgaccccgaggacgacggcgctccggacttccccggcctcgacgccgactacgacgacgaggacctcttcggcgacgacgacgggccggaggaggactcctcccacccctcggcggccgacgaggcccacgtgctcctcctcaccgccgccaacttcacctccgtcctcgcggcccggcgccacgtcatggtcgagttctacgcgccctggtgcggccactgccgcgcgctcgcgccccactacgccgccgccgcctccgccctcgccgagcagggcgtcgacgtggcgctggccaaggtggacgccaccgaggaccacgacctggcgcaggcgcacggcgtgcagggctatcccaccctcctcttcttcatcgacggcgtgcccagggactacgccggcgagaggaccaaggacgccatcgtagctgggatcagcaagaagctgggcccttgcggtgcagaacctcaccaccgccgacgaggccgag

SEQ ID NO: 15402 - DNA, 973 bp, Triticum aestivum
  unsure (1)..(973): unsure at all n locations
  Clone ID: PAT_TA_15402
gagatnnccttnagntgaaccaaccctactaaagggaacaaaagctggagctccaccgcggtggcggccgctctagaactagtggatcccccgggctgcaggaattcggcacgagtggcggtttgcctaaaagcgaccagaggcgacgtctctctcgctctcgtcctccgccttggcccggacggctcgcggggcatctccgtccatcatcgtgcgggtcgcggcctccgccgctcaaacaaccttcataatatactaccgctcccactctcgctcgctccctcccttccttcctccgggcttcacgcagccgcgggctcgtctcgttcgatcccctcgacccccgcgtgccgcaatggcggccgcgggcgcgggcgccgccggcgaagtcggcccggcgagctgattgcgccgcgcggcggcgctggttccccccggagcactatcaccctccccggccccttttcggcaatgtttggggcctcccgggtccccggtttcgtggggaggtcccacatccattcgggggaaaccttcttttccgnggggccttccgtggggaccccccggcggttagagagcntcaacaccttttcnaaaccccccgaccnttccggaagaaatcttaacaccaacttggccgttcgaacccttttccaaaagttgggccccgggtttcccccttttccaacgggggggaagggggaccccctgggggccgcgaacgaccccctttgggggctttggggcggaaggcccccccggcaatttttggccagagacccaatttgggggttccctggggggggaaaattcccaacggggggaggaaccccgggcccggtccccctttcacaccttaccaaagaaagggcgaaaccttattaccacacaggtttccgctggaatggggtggggaaaccccaattgggcttttgggaatttggggcttggcttgggccccttttggatn

SEQ ID NO: 15403 - DNA, 753 bp, Triticum aestivum
  unsure (1)..(753): unsure at all n locations
  Clone ID: PAT_TA_15403
gngnagntntgataccccnactcgaaattaaccctactaaagggaacaaaagctggagctccaccgcggtggcggccgctctagaactagtggatcccccgggctgcaggaattcggcaccaggccggcctagccgccgcctccttctcccgcgaccgcgccgccctctcctccttcctccggcctccctgccgtgccgccgcggcggctgcacgtccagccccacgccgtcgtcgtcttcttcgcccaaccggccgccgccgcaccgcacgctcgtgtgcaggggcgagaaggggaaccgccgcccgctcccggagcgcgaggaggacgaggggaggcagcccccagatccacggcggcatcgacgcgccgtcgtcgacctgagccgccaccgtcctcatggccccctccctccgcggcgccggcaccgcggctccctcctccgcaggctccctgcctcgtggggcctggcggtctcgcgcgcggacgacagccgncgactccttcacctatccagtcgagctcgcgcgacgccatcaccgggaccgggagcagcaccggccgtccatgaatgaattagaattagaaatcaaactatttctggtattttaaggattgagacagctggttggcttgcccatntatagctcgcctccacacattaggaaggcgatgccattatgccttggttgcatggagccgagctaggacactggtcagcctgtcacctatctccatcaagtcccccccccn

SEQ ID NO: 15404 - DNA, 842 bp, Triticum aestivum
  unsure (1)..(842): unsure at all n locations
  Clone ID: PAT_TA_15404
ccccccccanaagcagtttgatacccctgctcgaaattaaccctcactaaagggaacaaaagctggagctccaccgcgctcgcggccccccgaggccctcccgatcccccgggcccctcgtcttccgccccgggccacccgagccggatcggcctagggttagggttccgccgccatggacgccgccgccgccgccgcgcagaagcggaagcgggcggagcaggaggaggagcaggcggcgaccgacgggctcgacgtgctcgacctgcgggcggcgaagcggctgctgctgggcttcgagcgccgcctccgcgacaacctcgaggcccgcatgaagcacccggacgacccggcccggttcgccgactccgagctcgctctccacgccgagacggaccggctccgcctccttgccggcgcgccggagctcttccccgacctggtcccgctcggcctcgcctcctccctctcctcgctcctcacccacgacaacgccgacctggccgccgcggccgcctcccttcttgccgacctcaccgactccgacgacccctcggacctcgccggggtgcaggccctcgctgacgcgctcgtcgacgccaacgcgctcgacctgctcgtgcacaacctctcgcggctctctgaggcgggaccccgacgagcccgagccggtgcaccaccccctgccgcccctcacgaccccctggcaccctcccccgggaggaaacctttaaattgaaaccttacgggcccggaaacctttgtgtcgaaacctttggttcttggcggaatccggcaccccaaagggtgggcttcccgggtggggtttggcttggggaccc

SEQ ID NO: 15405 - DNA, 643 bp, Triticum aestivum
  unsure (1)..(643): unsure at all n locations
  Clone ID: PAT_TA_15405
ccacgcgtccggccaactccacacaatccaacttctaaatcgctgaggcagaccanatcggggggccatatccggtggggggagggtccgatatcgatggagaggttgccggcgcccgtggtccggtgaagccactcaacctcgacagcggggccagcaccgggcagaagccgcgactgtcggagtcggacgtgaagctcatcctggccctgaagagcgaggcgtgcccgacgccggaggacccggagagggcggcgctcgcccggaggatcgacgccatgtggaacgagttccgcgacgacgtcgtggagcagttcttcaccaagggctacgtggaggtggagcacggctacttcgccgagagggccaggtcggaggcttgggtcagggagaagtgggcgacgctggacttcagcaagttcgagctgtaccgccccggcgacgagggggctcgacgacttcgtggttcgtcccggcgaggatgcggaggaggccattctactacggccaagagtgaagaccctcgatctggatggaatcgtttgggtggtgggagttccatctgagacgagaatgcaagtagacatgtagtagtaggagtagatgtttgtacgtcttttaaaagattaattttcccagcaca

SEQ ID NO: 15406 - DNA, 600 bp, Triticum aestivum
  unsure (1)..(600): unsure at all n locations
  Clone ID: PAT_TA_15406
tcctctacttgcagtgatatccatcaggggcaacattcacttatcaaagatattcaagatcatctgtcatctaagggacccaaattaccatccttttactttggtaaaagccgacctccattgactccattgatgcctattggatcatcagcggatccagatatatttggtagtttctgtaaaacaagggaggaccagtctaactctgaagaaagtacacagtctgcccggtctcaactatcaaaggaggatctaaaaaatgcaacacatgatgctagtgacatatctgagtcatttgataattttccatattatctaagtgaggataccaaatgtgctcttctgtcatcagcatttgtgcatttacaacgcaaagactatattgagtttaccagacacatttcttctctcggccaacgagcattgctatccggtctggcagggactgagatctaccaacaatatctggtgaaggcacttngcaaacattttggtgcaaggttgctcacagtcgattcttcaatgctgntcagtgggcagactttcaggaattagagtcatcaaaaaggtgatagagtgaggtacattggttcattactg

SEQ ID NO: 15407 - DNA, 716 bp, Triticum aestivum
  unsure (1)..(716): unsure at all n locations
  Clone ID: PAT_TA_15407
nngtnnntttaannccnttnnnttttnatctcntnagctcgaaattaaccctcactaaagggaacaaaagctggagctccaccgcggtggcggccgctctagaactagtggatcccccgggctgcaggaattcggcaccagcggcggcgcagccaccagcagcagactaattgccgaacccggccgccatcgccccatcctccctgccgcagcgatcctaacccaactgaaatgctcgggccagggcgctccacctccactgacgcctccgccaagccgaagcgtccgcaccttgcagatggcgacggcggcggcggagaggcggacaacgaccgtctgagcgccctgccgaacgacctcctccacgaaatcctgtcgcgcctcaatgccctggagacggtcggtacgtgcgtgctgtccgcgaggtggcggcacctctggcgcgccgcgccgtgcctggacatagacgagcgggagttcaccgccaagcagccttttttcgtcaactttaccggcaaccttctccgcggacatgaggtcgctctcctggaggacctgagggtgtacctgcgcttgcggcgtcctcgggtggtccgcctctggggtnccgccgcgccataggtctgggcgaggcatcgcctttggccggcttcaaaaggttgcattcttttcccacgtggtcatctcttgcaagccgacggagctcccgggcccca

SEQ ID NO: 15408 - DNA, 711 bp, Triticum aestivum
  unsure (1)..(711): unsure at all n locations
  Clone ID: PAT_TA_15408
gagnnttgtnccntnnnnnnnnnttctgattacgccaagctcgaaattaaccctcactaaagggaacaaaagctggagctccaccgcggtggcggccgctctagaactagtggatcccccgggctgcaggaattcggcacggcattccctcttttgctagcctcatggccttgaaccaaccagccatagccatgggtctcctcgtcgtcttggtgcttgccgccatggcacaggtggcgtactgcgcgggtggtggcaccacccagaactaccgcgaggcgctggccaagagcatcctcttcctcgaggcccagcggtccggcgtgctccccgccagccaaagggtcggctggaggtccaactccggcctccaggacgggaaggccaacggggtggatctcacgggcggctactacgacgccggcgacaacgtcaagttcgggctgccgatggcgttcacggtgaccatgatgtcgtggagcgtcctcgagtacggcgggcagatgcaggcggccggcgagctcggcaacgccctggaggccatcaagtggggcaccgactacttcgtcaaggcgcacccggagcccagcgtgctctacggagaggtgggagacggtgacaccgaccacttctgctggcagcggccggaggagatgacgacgagccgtcaggcgtaccgcctcgacccccagcgcccgggctccgacctcg

SEQ ID NO: 15409 - DNA, 700 bp, Triticum aestivum
  unsure (1)..(700): unsure at all n locations
  Clone ID: PAT_TA_15409
gngngnnttttganccgtaagctcgnnattcaccctactaaagggaacaaaagctggagctccaccgcggtggcggccgctctagaactagtggatcccccgggctgcaggaattcggcaccagggaatacgtgcgtgagatttttcgtcaaacacccccttccctcgccgccgccgccaccgccacgacccgcgagccatggcgccgtccgccagctcctcctcctcctcctcctccggcacggactcctccggttcctcctcctcctcggggagcgaccgccgcgtccgccgccgccacagccgccgcaaggacgccgcgccgtccacgtcctcctcctccgcgctgaaggtgcgcaaggaccgcaagtcccgccacaagcgccgccgccgggagaggcggaagtcccgttcggacgacgacagctacagtagcgcaagctcctatgatagtgaccgcgaggcatctggcagatcacgtaagcataagaagagcagtagatcaaggaagtctagggaaagagagcgaagcaaggataggcatcataaacgggacaagagttaacatagagagaagaaagagagtgaacgttctagcggtccggtccaacttttcaagttccttggtcgcgaggaggaaggaaagcngcaaaaaggagtgttatctctggtaaaaagataatgatgaagcttgagaaaa

SEQ ID NO: 15410 - DNA, 727 bp, Triticum aestivum
  unsure (1)..(727): unsure at all n locations
  Clone ID: PAT_TA_15410
gagagnnnntttancccctnctcgaaactttnatacnaatgggaacaaaagctggagctcaccgcggtggcggncgctctagaactagtggatcccccgggctgcaggaattcggcacgagcttccttcccccagctcgccgccggcgccgccatgctccggcgccgaggccgcgtcctcatccggatgctcttcactcccttcgccggcaccaccttccctttccatcgcatcatatccgccgccgccccaccacaggcacacgctcggagctgcatcctctcctctccccgccgcctcatctccggcgccacagcccccggcatctccccgacctctgggttcgccgtggaggagtaccttgtcgacacctgcggcctcacccgaccccaggcactcaaggcttcccccaagctgtcccacctcaggtccgccgccaaccccgacgctgtgctcgccttcctcgccggtcgcggcctctccggcgccgacgtcgccgccctcgtcgccaaggaccccaagttcctctgaccaaggtcgacaaggcctgtccccatcgtacgggctctccgcctcggctgcagatccgacatggcgcgctctctgctcgcccaacaaattccgtgagatcatcgcgcaactgactatcctgcctcttcgcggtctcgagagctgtcgccataactcacacacctcttgtgagangaggtgagtacgtcgctctgcc

SEQ ID NO: 15411 - DNA, 1205 bp, Triticum aestivum
  Clone ID: PAT_TA_15411
aaccagcagtgcctggcaccacctaccttgtttctttcttcttcttcatgtcccccaagttgatctccccctcccccagcagcaacaaaccgtcgcccgcttcgccccgggcttcaagttatcggccctcccatcccgcatctcccagccgcgcgcgcgtccccgatgggctccctgtagagcagcctgttgggcaagccggagccccgggcgcccatggtgctcgtgccgcgagtcttcgactacgagcccatcgacgctcgcaccaggaagggcgtgccggactacgagctcacggcccggatgctgccagtgggccatctgttggacgaatacgtcgttgacgcgggtagcttatcttcccagatcacgcagacccagctgcaagatcatctcgtcaatcgagtcagcaccggatctagcagctggggcaaaaagagagtcgctcaaaaaataagtggattggattttcatgccgggttgaggttgggttggggtggcgttatcggtttgggggttcttttccggagcttagacgcagtaaagaggaataggaggagtgttggcattcatgtggttcctcttggtgcatccgggagggtcaagttgctaattggaaagaggctgtcctctccgggctgggctgaccagggggcccgatatcgttccatgtatctatcacttggggcgtcctttcgaacaggacgacgtcgtacggatttggaatccgcgtggaggatctcaggaagcccagctacgagagggcagacccgaactacgtgatgatgtcgacgaacaaggagcacctggcgccggccgccctgcgtgagttcgggcagcggcccatgttccaggcggacgtggactcgggcaacttcgaccacctgcccacggagctcaggcccatgagcaagatcatctaggatctccagaggtcgcaggaccttgggcgagtagagtagctgtgaaaagacttgtagatttcagtttcaggccggtttgaggttgacttggcgagagcttgctagtttgaggttcagtttccgcagctattccacttagatagacatgtaataggaggatgtagacagtcaagttgtggtgatggttgagccgagcgtgctgaagtatttagtcggccagatggtttgctagccaggcaggacagagcagaagccatttgaactaggcatgtgagtgaaaca

SEQ ID NO: 15412 - DNA, 698 bp, Triticum aestivum
  unsure (1)..(698): unsure at all n locations
  Clone ID: PAT_TA_15412
gngnntgntccccagctcgaaattaacccccactaaagggaacaaaagctggagctccaccgcggtggcggcccgctctagaactagtggatcccccgggctgcaggaattcggcaccagctactgatattttatcatgtctgtgttgaggatatctttacatgcaaatcacagtttcccacacttagctatgctgttttgtcatgttttctccaggttcctatgcatattgttcagtgcaagggtaaagcatcgtcagcattgtattgatgtcgtcaagtcatgtagactaattgcagaacaaatctatactttcgttgggactaaaagtgaaaacgataattgggactaaaactatgcatttctaggaagtaataaatatgcaaaaggattatccatgggatggagcagaggccggcgtgggccgcaaggagcagcagtggcagaatggtgctcgcttgccgggcgttggcccttggatgaattcgacgcctgagttgagctaacgagtcccatggtttgctatcaatctctcaaaaaggaaaaacaacattactttgttcttgggagaaacttcctgtagcgttgctaccttgacagagataaatatgcgatcaaggatatattcagtggtttttcaggaaaaaacttggaggatatttttgcaggttcatcgcttgcattattgctttatcagg

SEQ ID NO: 15413 - DNA, 799 bp, Triticum aestivum
  unsure (1)..(799): unsure at all n locations
  Clone ID: PAT_TA_15413
nngaanaaaaaaatttaaaccatnanaaatnnaatacccttcncgaancaaccctcactaaagggaacaaaagctggagctccaccgcggtggcggccgctctagaactagtggatcccccgggctgcgcgaggtcggcacgggaacagagggagagctcaccgccgtccagccccccagatccaccgcaccccagcgagcgagcgagagagcatggcggcggtgggcggcgacgcggcgagcatggtggcggtgggcctggtgtggggcgccaccaacgcgctgatgcgccggggagcgctcgtctgggaccgccgctcccgctccctccccgccggcaccggcgccgtccggcgatgggccgacctgctcctcacgtggcagtactcggcgccgttcgccgccaacctctccgcctccgcggccttcttccggctcctcggcgacgcgcccatctccgtcgccgtgcccgtcaccaacgccaccacctttgccggcaaccgccgttcgccggccgggctcttcggggaggcacccgcgccgcgcccgccgactcggaaccgcgctcatcgtcctcggcgtctgggtctgcatctcctagctcgctaacttccaagggtccgactgcatctgcatcactgtcctcatatgtcttcaatgttgtctgcatgaattagtctgaattttggtctacttgtgtagtaaatgtttgagatcataatttgtgcctttgatgctaaactgtacgctgaatgcgcttatttttcaggcctggatagggaacccgtaattgtatgtg

SEQ ID NO: 15414 - DNA, 864 bp, Triticum aestivum
  unsure (1)..(864): unsure at all n locations
  Clone ID: PAT_TA_15414
gagagnnnngttgaagccctttgaannnctntaatacccntgctcgaaattaaccctcactaaagggaacaaaagctggagctccaccgcggtggcggccgctctagaactagtggatcccccgggctgcaggaattcggcacgagctcgctcctcctcgccctgcgtgcccgccgccgccgccggcagcagcaagctgctgctgcacactctcgccgacgccgcgaaccatctaagctcgcgccccctcgtcggcctcctcgagcaccggccgcgccgcgcgcccaaccttcctccatcgccgtctctcctgctctgctcctgccccgccggtcgcctctgcctcgaccccgcgcccggccttccgcgaccacgcctctccgtcaccgctccgtgcaccccggccatcctcctgcgccaagtcccgcctgccggagtccctgcgtcgcccgccgtcgtccttcgccgtcgcgtcgggctcctggacctccgctgcgagccccatcgccgcctggtcttggccgtcctggcttcggaccccgaacgaagctgggctgcccaagttnggtcttgctgccctttgtcgtgggccccaggttcaaagtcaggaccacccggaggacnncatcgttgaatttttcgcccaagtacccggggaacgttcagggaccccggtcaaggtttcaatctttcgaaacccggtctacggaactaccgcgggactntcgccaaagtaccacactcccgaaaccaatggtacggaacgacccggtcaacccgaagaaacaccgtggtnaacggggaaccgcgaaaccgtctaactttccaacggacccggtcgccgaagaaacgtcttctctcccc

SEQ ID NO: 15415 - DNA, 1027 bp, Triticum aestivum
  unsure (1)..(1027): unsure at all n locations
  Clone ID: PAT_TA_15415
gaanaattntnacncgtnaactttaaattcccnctactaaacggaaccctnactnaagggaacaanagctggagctccaccgcngtggcggccgctctagaactagtggatcccccgggctgcaggaattcggcaccaggtacaacacggcgctgctcccaccgtgcatggacacggcactgagcaaagattccactgatccaggcctgcatagtggtacaaccagaagcaaaaagggtctgatggatggactctgactaccccgctcatcgacgtgaaccttaccctcccgcttggccagtaccggggccacaacttcgtcgtcaacggctggccgagcctcgtgtacgacgaggcgagcccgtcgtggacgggcctcaacgccggcgtgttcctcgtgcgcaactgccagtggtcgctcgatttcatggacgcctgggccgccatggggcccgactcgccggactaccgccggtggggcgccgtgctcacgtccacgttcaaggacaaagtgttcaacgagtcggaccaccagtcggcgctggtgtaccatgcctgcagcacaagggcaggccgtggtgggacaaggtggtccctggggaaggcatattcttttcagagccgcttgctggcggggaaatccccgggggcgccattgggcacaaaatttgacgggaagctccatggaccacctctccctcaggcccgctcgggccgcgtcaccccccggaacatgggcgtctctgtatttgttccatgattgggacgagattgatatcgaccgcacgcttgtaagatcctgtgggttagaccctataccatcccgagagctatatataccgctctcgtgtgcagagtgcatctataggttgcaagaagtgctgggagtagtctctcttctgtcgcaggagcccatcctgggggtgcgtatttttatgaggtgtgaataaaaagatcatgggatatttatgtgccagcgcgctgctctttagtgtaatatgagacttcgtatcccctgtgctttccg

SEQ ID NO: 15416 - DNA, 893 bp, Triticum aestivum
  Clone ID: PAT_TA_15416
gaaaggcttccccaccccacaattttaagcctaccatttcgaggcggaaaccctcatcttcaacttcccgcggccgccgcggggcgcattcgtcggaatggcggccgccgccaaatcccctggccgccgggggccgcggtcggcatggaagccggccgccaaatcccatgccccccctgcccctcgtccctcccgtcgggcgaagcagccaagcaccacctctcgcgagggcgaaggcgggggaggaggcgatagaaggagaagaccatctcggcgtggcggtacctcgaagcgaggaagaggggggcatcatcatcttctgcgaccttgctccggccgggcccccaattggggggcgacgcgcgcacgcacagttgcggcaattaaaaaggcagcgctcactaccaccacccaagatttgtcatcaacctccgccgctcagatccagatgggcgcctctcggggatgtgatgatgattcgaatccaccaaaaaccttttaaatagggggggggggggcacccctttttttcttcccccctttaacatcaacctccgctcagatccagatcgtcccctcccggcggtgtgacgatgaatcgactccaacgaagaaacatctgctgcgccctagtctctccatcatccagaagcgaggcagaaggcgggcgcatcatcatcttctgcgaccttggtccagcccgcccgacgattcgaagatcccatggcagcaaacatctgttgcgacccttgtctctccatccagccgcccccaaattattactgttggggagcaaaacgctcgccgacgaacaacaacaactggagggactggtccaatctaggcgatgggccggcaggactgattgctgagcgcgtccttgcatatgacgt

SEQ ID NO: 15417 - DNA, 701 bp, Triticum aestivum
  unsure (1)..(701): unsure at all n locations
  Clone ID: PAT_TA_15417
nnnannnntttnnatccgtnaacttgaaattcaccctactaaagggaacaaaagctggagctccaccgcggtggcggccgctctagaactagtggatcccccgggctgcaggaattcggcaccagcacaccaccacaccactaccaccaccgccggttaccgtcacggcgtgtcacacctccctctctccctctccctctctgacaagggcagccatggcgagccacgtccacgggcacggcctgctgctcgacccggccgcgctggcctactcctgggccgccgagccggagatcccgccgcagctgctcgccgcgctcggggagtacctctccaactccgccgccgccggctcccacggggacaaccagtctgccgtcgacaccgagtccgacgcggaggcggacgacgagttcatgatgtacgagttcaaggtgcggcggtgcgcgcgcgcgcggagccacgactggaccgcctgcccctacgcgcacccgggggaggccgcgcggcgccgggacccgcgccgcgtcgcgtacgcgggcgagccctgcccggacttccgccgccgccccggcgccgcgtgcccgcgcgggtcctcctgcccgttcgcgcacggcaccttcgagctctggctccacccgtnccgctaccgcacccgcccctgccgcgccggnccggnctgccgcccgcgcgtctgcttt

SEQ ID NO: 15418 - DNA, 708 bp, Triticum aestivum
  unsure (1)..(708): unsure at all n locations
  Clone ID: PAT_TA_15418
gngtttganccnttnnnnnnncnttctgattccgccaagctcgaaattaaccctcactaaagggaacaaaagctggagctccaccgcggtggcggccgctctagaactagtggatcccccgggctgcaggaattcggcaccagggttggtcctactcctagctagcgcagcagacagaaccaccttccaggatggccaggaaccggcgacctttccggcggcggcggcttgtcaaactcaactcttgggccccggcgatgcctgacaccacgctttgtttaccgagggagtatcttattgcagcactgctgctttggctttgcgtcgctgacacatgcataattttaaccgaatttccatactaatttatatttatatatcctggatgcttgtaggcagccaatcggaggttgtgcgtgaaaccagcagcctagtggatcgatacccgaaaggccggccactggtagtggggttaggacttgatcattcatggcaagttaataagtggagaaagtgaagcctccgaatctgcttgccagggagcatatatggcacgcctgtttgttgccatcagcttcagacgtccggtcgttcgttcatttcggtacagcaacatgtgtatggccatgatccatcttgtactacatgatagtatttgacctctgcgctgcggtacaagtgtctgatgctcctgtactacaatgtctg

SEQ ID NO: 15419 - DNA, 1022 bp, Triticum aestivum
  Clone ID: PAT_TA_15419
taccggtccggatccccccggtccacctccgcgcccggaaccccgcccgccccagccacaccgccgcggccctcccccccggctcactccttcccgagcgttcctagccgccgccggcccgccgccgcggcgcacccagccggccgaaggcctccgccgcccctccgcccagcagcgcctccctccgtcgagcagccgctcccaccatgcagcgtggagcagccgctcccgcccaacaacgccgccgcccggaactacgccggcgaccagtccataggcaggcggttataagcatggagcccaaagagaagcccgaatcgaccagcgctgccagcccacctccaccgcggctggactgcataaagtgcttcgatgcgctatggttctgctatacccctctccaccagctgcagacctactaccgccacggggattttgacacctgcttcggcaagtggggcgatctcgttgactgtctctcgctcaagacgaagcggagggcggaggtagaggagatcctcatcgcgcgggagaaggccaagccgcacatctggaccttccggactgccgaagaggcgcaggcgaactggtggcagatgtacaagcacaaggtggtgatgtcgtcgccacccaagactgcaggttctgctgcgcctcctcctggatcatccggtgttctttcctgagaattgaaggtcgggggagcctacagaagcgtcgattgcgcttttggtgcgctgtgcttagaccgctggtctttgttcaaacttgaatgtaccctggcagggtaaataattggaaccttggatggaaagatgccttaatcctgttctgtagatcatggcaggcaactgaaccaagatgttctggtggttcttttgctattttttgcaccagctatgatgttagcctttttgcttaagtgcttatcaggcataaacgcgcgcccgcccccggctcccagctcgccctatcgggagtccactcccgctgcactgctccttttggtatctgaaaaaaac

SEQ ID NO: 15420 - DNA, 535 bp, Triticum aestivum
  Clone ID: PAT_TA_15420
ggggggctcgatccactaacggtatcggttgcacgagtccacggacggctccacccatcgatgggtccacctttaagcaaccacccccgccaacggcggcgcgggcccccatcgggtcccacccccccaagggtccacgaagaagcaaccttgtctatcccaccatggccatcgcccacgaaggacttgcctcactagcggtagatcttcacgaagtaggcgatctccttgcccttacaaactccttggttcaactccacaatcttgtcggaggctcccaagtgacacctaaccaatctaggagacaccactctccaagaagtaacaaatggtgtgttgataatgaactccttgctcttgtgcttcaaatgatagtctccccaacactcaactctctctcataggatttggatttggtggaaagaagatttgagtggaaagcaacttggggaaggctagagatcaagattcatatggtaggattggaatatcttggcctcaacacatgagtacgtggttctctctcagaaaatta

SEQ ID NO: 15421 - DNA, 645 bp, Triticum aestivum
  unsure (1)..(645): unsure at all n locations
  Clone ID: PAT_TA_15421
ntgatacgccaagctcgaaattaaccctcactaaagggaacaaaagctggagctccaccgcggtggcggccgctctagaactagtggatcccccgggctgcaggaattcggcaccagccgcaccgggagtaccgcggcacagtgcgggtcactcgcggccgcgcgcactgccccctccctccgcgctccgtgctctagccagcaagtcatcatggccacgcgagctctgttcgtctccctcctcctcgcgctctgctcggctctcggggagggcgtctcggcattgcgcggccgctccaacggcgacgcggtcaagttcgacttcacgcccttcctcatccagtaccagagcgggcgggtgcagcggctgatgggcaccagcgtggtgccgccgtccgtggacgcgcgcaccggcgtcgcctccaccgacgtcgtcatcgaccagggcacgggcctcgccgtcaggctctaccggccgagccgccgcggcaggctcccggtgctcctctacttccacggcggcgcgttcgtcgtcgagtcggccttcggccccgtgtaccacaactacctcaacgtgctggcggccagggcggggcgtcatcgccgtctcggtgaactaccgcctggcgccggagcacacgctgc

SEQ ID NO: 15422 - DNA, 1457 bp, Triticum aestivum
  Clone ID: PAT_TA_15422
gtcgaccctcgggtccgctcgcccgagcgggaggtgcgcgcaggcgtcgtggaggtggaggtggagcttgggtgaaaggtgtcttccgcagcagtagacctgagagtcgaggagggggccggcatggacgtgtcgccggctgcggccttggccatggtggactcggagcactcatccgaggaagaggaggaagaggaggtgtcgtcgtcgccggtgctggcgctgccggagcaggcgaggaggaagcaaggggctgctgtggccgctgccgtgccgcctctggtcgtgcccaaggaccaggacctggagaaggagaagaaggagaaggagcggcagagggagagggagaggggcccctaagtcggctacatgagcggcggctgcaagagtgatgatggaagtttgagttgtggatattcaagttttagaggaaaaagggcaagcatggaagacttctttgacataaaatcatctaaaattgatgataaacaaataaatctctttggaatatttgatggtcatgggggttcacgtgctgctgagtatttgaaggagcacttgtttgagaacctcatgaaacacccacaattcatgtcagatacaaaattagcaataagtgaaacatataaaaaaactgattcagatttcttggattctgaaatcaacactcacagagatgatgggtcaactgcatcgacagcagttctgcttggaaatcatctttacgtggctaacgtaggtgactctcgggctgtaatatcaaagtcgggcaaagctattgcactctctgatgatcacaagccaaacagaagtgatgagaggaaacgaattgagagtgctggtgggattgttatgtgggctggaacttggagggttggtggtgtacttgcaatgtctcgggcatttggcaaccgcttgttgaagcaatttgttgtcgcggaaccagagattcaggatcaagaaatagatgatgaactggagtttctgattttggctagtgatgggctgtgggatgtggttccaaatgaggacgccgtctcgctcgttaagatggaggaggaccccgaggcggcagcccggaagctgacggagactgctttcggccgtgggagcggcgacaacatcacctgcgtcgtcgtcaagttccagcacagcaagacgggcggtggtgactcccctcccatctctcccccgggcaatcaaatttgattgcttctattcgtccgctatacatgttgttgttagcctttaaatttacagcagctggatggatgttttctctgttgaatgagttgtatgtacattggcggctggtactagatggcgacttccgtacatggtgttaactggtatacaaccaaattgtggtgctggttacatacagtggtacatggacgagaatatatctagctagtgcgtattcctcttaagaagtttttatttatttaaaaaaaaaa

SEQ ID NO: 15423 - DNA, 699 bp, Triticum aestivum
  unsure (1)..(699): unsure at all n locations
  Clone ID: PAT_TA_15423
ngttggntccgnnagctcgaantaaaccctactaaagggaacaaaagctggagctccaccgcggtggcggccgctctagaactagtggatcccccgggctgcaggaattcggcaccagaagcagttcatctcctcaaccctgagcccgccgcgcccgcctgcccgccccgatggcccgcacgaagcagacggcgaggaagtccaccggcggcaaggcgccgcggaagcagctggcgaccaaggcggcgcgcaagtccgccccggccaccggcggcgtgaagaagccgcaccgcttccgccccggcaccgtcgcgctccgcgagatccgcaagtaccagaagagcacggagctgctcatccgcaagctgcccttccagcgcctggtgcgggagatcgcgcaggacttcaagaccgacctccgcttccagagctccgccgtgtccgcgctccaggaggccgccgaggcctacctcgtggggctgttcgaggacaccaacctctgcgccatccacgccaagcgcgtcaccatcatgcccaaggacatccagctcgcccgccgcatccgtggcgagagggcctagattttgcttcgtggtgcctgatctgacgtgtagagatggtagcttcgtcttagcatgtgntgagtggtggaatgatcttgtatcgtggtaggaggaaatctcgttcgtgctaccttgg

SEQ ID NO: 15424 - DNA, 771 bp, Triticum aestivum
  unsure (1)..(771): unsure at all n locations
  Clone ID: PAT_TA_15424
gagnnntntgatacgtnaagctcgaaattaaccctactaaagggaacaaaagctggagctccaccgcggtggcggccgctctagaactagtggatcccccgggctgcaggaattcggcacgagaaacgttgtagcaacaacagtgtctcgatggcctcggagcgtcaaggacaccgttccatttcctcgtgcatcctcctcgtcgcggccgtcctactgctcagcgctcccaggtcatctgctagttgctacaagcgcatcttcgccttcggcgactccatcatcgacaccggcaacttcgtgtactcgaccggcagcgctccaaacgcgctgaaggagttcccatatgggatgaccttcttccaccaccccacaggccgcgtctgtgacgggcgcgtcctccttgatttctacgcgcaagcgctgggtctgccgctggtacagccaagcttgcccgagcagagatggggacaatgcacattcggtgccaacttcgcggtgtttgctgccacggcgcttcccccggagtacttccaaagacggggccttagtattcccgggtctggcaacttgggcatgcagatgggctgggtcaaagaagtggtgcaaccgatagccaccagggcccggtgcgaggagactcctgggagagtctctcatcatattggagcgagatcgggggcaacgactaccactttctgttattggggccgangaattcngtgggcaaacgaattaacaaacctttctggggttactcaaaacaataan

SEQ ID NO: 15425 - DNA, 1629 bp, Triticum aestivum
  Clone ID: PAT_TA_15425
tagcgtggtcgcggcttttgttagaacagatagccaacattgtcatttcagttactgatgacagcaagaaggtgacatcagatcagacacactacatccacgatggaacgaacaaacactagcacgcatacatttccaaggctggacaaaggctaagatggacctaaacactcacggcgcacagattgcggcctaggccctctcgccacggatgcggcgggcgagctggatgtccttgggcatgatggtgacgcgcttggcgtggatggcgcagaggttggtgtcctcgaagagccccaccaagtacgctgcggcggcctcgtgcagggcggaggcggcggaggactggaagcgggggtcggtcttgaagtcctgggcgatctcgcggacgaggcgctggaaggggagcttgcggatgagcagctcggtgctcttctggtacttgcggatctcgcggagcgcgacggtgccggggcggaagcggtggggcttcttgacgccgccggtggccggggcggacttgcgggcggccttggtggccagctgcttcctcggcgccttgccggcctggtggacttcctcgccgtctgcttggtccgggccatgtcgtcggagatgcgccgggaagttgaggagatttgggctcttggccgaactgggctcatcctcaccttgtacacgcgcgcagcattctccattggagcggattaagctcggcaccaacgaactctaaactctagcgatggcagacgcaacggcgccgcgtccgctgctccgccgcgtgctctcgttccgggagccgctgctgctcatcccgcacctcgtcgtcttcctcggcaccgtcgcgtccgccttcttccacagctacgcctccttcctccagtccttcgccaggtccatcgtcgtcccgtcgccggccgcctgcgccaagtgtccgtacgcgacgtcgtcggcggtgtgctgcgaggacgtcgatgccgaggaggaggaggacgaggagctgaggaaggaggaggtggaggcgatcatggccaggatcgggctgggagtggccggcgccggcgaggggctgagggccagcatgggccacaacgaggtgtcccggctgttcgacgccgaggagccgagcttcgcggaggtgcggcgcgcgttcgcggtgttcgacggcgacgcggacgggttcatcggcgcggcggacctgcagggcgccctcgcgaggctcgggttcccggacgtcgacgccgccgcgtgcggggcgatgatctcgtcgagctgcgggtccacggacggcaggatgaacctgttccagttcgtcaggttcctcgaggacggcctctgctgacagaccgatcggcctctcttttttgatccgttgcacggtgcgcggctcggctggcgcggcagaaaatgggagtgtgtgcgtgcgtgcgtgtgctggtgggctgccctctcgggccttccgtcttttccttctgcgacgcggtggggtggggggggtggtttcggctactccttaccgctctgggtcccgagcgtcctattggaatcgaacttgggtcgcctgtcgatcataaataaactttggcgatctcagtagtttttttttttgaaaaaaaaaaaaaagaaaaa

SEQ ID NO: 15426 - DNA, 618 bp, Triticum aestivum
  Clone ID: PAT_TA_15426
ccacccaccaccactagagctatcaccgcatcaacgaggcagaggacaaaaaagaatcagcacttgcttggctttccagctagtaattcagcttgcggtccggttactggctcccaggtgatacagatcgtgctaccaccgctaggccttccagggcgtcggtggatcggctagcagcaatggcgcgcgcgttcggcgtcggcgctgcgatgctcgtcgtcgtggtgtccgtcttggcgccggcggtgacggcgcagaccggcagctgcagcggccccctgccgttcgagctcgtcggcaactactctgggctcgcctgcagccccgtctggaacaacttcgtgctccggtaccaccaggacaagaacaacgtgctgcgggtggtgctgtcgaccatgtacagcacggggtgggtggggatgggcttctcccgggacggcctcatgatcggctccagcgccatggtgggctggatgggcaagaagggccttccccacatccgtcaattctccctccgctccaagtccggctccaaggccggcgtcgtcgaccgcggcttcctcgtttccaacaaccacgaccacaccgtcgtcggtcagcaggccaagatctacgtcg

SEQ ID NO: 15427 - DNA, 773 bp, Triticum aestivum
  unsure (1)..(773): unsure at all n locations
  Clone ID: PAT_TA_15427
anaacagctctccaagcaccaggacaagacctccttcacattcgacttcactactgggaaaggattcgccgacgggcccttcccctacggccttcggcgggcgcacggagggctcaacctcttcgcctggggcatcctcatgcccatcggcgccatcctggcccgctacttccggcgcatggatccgctctggttctacctccacgtcagcatccagttcgccgccttcatcatcggcctcgccggggtcgtcgccggcgtcgcgctgtacagcaagatccaggccgacatcccggcgcaccgcggcctcggcatcttcatccttttcctcggcatcctgcaggttctggccttcttcctgaggcccaacacggactccaagtaccgcaagtactggaactggtaccaccactggtcgggcaggctggtgctcttcttcgccgccgtcaacatcgtgctcgggatccacgtcggcggcggccatgactcgtggaagatcggctacggtttcaacctcgccatcctcctcgtcgccgtcatcgggctcgagttcatgttgtggaccaggtggtccaagaacagcgcttccacgccgacatactgagctctgtctgtcacgacagggggcctctattgatccggcgatgtctatgcgcctatttttagttcttttgtttcttttcctttctggtctgattgtgtgatattttgtttttggttctccttgtgatggtcttgtttctgtaatctgaggactgaaatttaagcgtagt

SEQ ID NO: 15428 - DNA, 1709 bp, Triticum aestivum
  Clone ID: PAT_TA_15428
ccacctggtccgctcggggtggcctcctgcccatcggtggcatatccgcaccgtacaaacacgacctgcgccctccccggttcagtcgccacgccccccctccggtgcccggctccctcctaggacggaccggacttgcagctgtcggctctctcttcggtttgctgctagcagatcagcctgcgctcaggggcctggctcccaggtgatacagatcggcctttcacggcgttcggtggatcggccagcggcaatgccgcgcgcgttcggcgtcggcgctctggtgctcgtcgtcgtgtcggccttcttcgcgccggcacttgtgacggcgcagaccggcagctgcgacgacccgctgccgaccgagctcgtcggcaactactccgggctggcctgcagccccgtctggaacaacttcgtgctccggtacgcgcagggcgcggacaacgtcctgcgggtggtgctctcggcgatgtacagcgccaggtgggcggggatggccttctccaaggacggcctcatggtgggctcgagcgccatggtcgggtgggtcggcaagaaggggcaagcccacgtcaagcagtttgccctcaacggcaaggcgccctccatggtcgtcgccgacaggggcttcctcgtctccaacggccacgcccacaccgtcctcgtcaagcaggccaagatctacctcgccttccagctcaacttcgactcgcagctcaagaagcagcaggtgctcttcgccttcggctctgccatccctgtcaacgaccgcctagccgagcaccagggcaagacgtccatgacctttgatttcaccacaggcagctcttcaggctcctccttcccgagtggcctaaaaaggactcatggggcactcaacctgttcgcttggggtgtcctcctgcctatcggtgccattatcgctcggcactgcaggggttgggaccctctgtggttctaccttcatggcggcattcagttcgtcggcttcatcctcggtctggccggcgttgtggctggagtatcactgtacggcaagatccaagcagatgttccagcacatagaggccttggcatatttgtgcttgtgcttggtatcctccagattctagcgttcttcctaaggcccaacaaagactcgaagtaccggaaatactggaactggtatcaccattgggtaggcaggcttgtgctcttctttgcagcagttaacattgtcttggggatcaaagttggaggcgcgggtaactcgtggaagatcggctatggtttcaacctggccatccttctcatcaccattatcaccctggaagtcctagtgtggacaaggtggaaaaacaacagcggtcctacgacgacatactgactatgcttgactagggttcttgttctgtgagctgctgaaggccctattattttcattcgttttcttcttcttatgctgttgttgtaagcatgtaatctattctgcagaatcttttagcaaggatctgcgagactagtctatcggtgatgtgttttggatttgaaatgtgtagagtgtttgaatgtactactccaatgttgtttcttccaataaaaaaaaaagagtgaatagtgggtattttccttgttcaagctaatttaggggctatttcttgttcccttgtctaattcaaaaatgctcccctgcgattcctaaaaaatgctataacaaaaaaaaaaaa

SEQ ID NO: 15429 - DNA, 681 bp, Triticum aestivum
  unsure (1)..(681): unsure at all n locations
  Clone ID: PAT_TA_15429
ganncccntnnnnnnntttngatccctncagctcgaaattaaccctcactaaagggaacaaaagctggagctccaccgcggtggcggccgctctagaactagtggatcccccgggctgcaggaattcggcaccagacaacatagaacatgaccaaccgtaaagtagctagagtgttatgcctcctagtctttttggctatctattcttgttcgcgcaatgcacaaccaatccatggagtagatcactgcaccatcgataaaaataacgtgatagaatactgcaagggtatcatcgaaaagaatcttggcaaccaggttccgcaaccgtggaccctatgttgtggtacaataagaggtgtgacggacatccactgcatctgtgatcggttcgccgctcacgatctgactaggatcagtctacccaagttcgcatgtatggcatatatatgcggcaaagggttgcacccacacactcattgtgcaggttaccttgttccggtcatgaaggtacgacctccaccccccggcaagcacctaggccttcagtgtaagaacactcataatgggaataattgaataaagcaaagaacaatgttagctgaatggcatatgcataatgtatttgtcctcttttggtgtgtaataaaaatgttgcgcatagcctcgtcaaaactgcagccc

SEQ ID NO: 15430 - DNA, 685 bp, Triticum aestivum
  unsure (1)..(685): unsure at all n locations
  Clone ID: PAT_TA_15430
gnganccttngatnccctngccctactaaagggaacaaaagctggagctccaccgcggtggcggccgctctagaactagtggatcccccgggctgcaggaattcggcaccaggccaaccgccgccgcaaccgatctgccaccaccacagcaccaacgcctccacgccctggccagatccgcccggagccccgccacttcgcaccagagcagcgagaacgccagccgcatcaccaccaccacatcacggccgccgaccacccctgccatcggctaccatcaccatccaccggatcaatccgttgcccccgccaaccaccaccatccagaacagagcaggaggccagatccgccgctagtcgacccctggataccgaagcccccgagacgtgctggagggaggggaggaggcggcgctggcggccacaggacgccggtaggagggagagggccgaagcagggccgacccgacgcccgacgccaccaagcagggagaggcgccccgcgatgccaccagctgcgcacgggagggagccgncccaccgccgncaacgccatgcggccttaggccggcgacgcccctggcggcggcgaagggaggggggcagggaggcgacactagggtttcctcctgggggcgcctcggggagggangggagaagccgttttcttcctcgtcatttttgg

SEQ ID NO: 15431 - DNA, 899 bp, Triticum aestivum
  Clone ID: PAT_TA_15431
cctccgcggctagatgcccggtgcgaagggtttggtgactggtacatccatccaccgtcatatatcctttgcatcctttgcagtgccaacctctcgttctccctctccttcctctaatcgtcgatcatatggcgtcctcttctgccgctctcctcgcggtgctcgtcgtcgtgagctgcgcgggcatggctgcggccacgtcgtacaccgtcggcgacaccaagggctgggtgaccggcgtcgactactccggctggaccagcggcaagtcgttcgccgtcgggcgacacgctaagtgttcaggctacgcgagcaaggtgcacacggtgacggaggtgagccagggcggctacacgtcctgctcccggaagcaacgcgctggccaacttcgacagcggcgccaccacccgtcacgctcgcgaccccccggaacgcacctacggccatctggccaccatccccggccactgcgccagcggcaccgaagctcgccgtcaccgtcgccgggggcggctcgtccccgcccgggtccggcgggggctccctggccccggcgatgggcgccgtcgtcgccgcggcggcgggggctctgatcaaggtggcgctgttctgaacgtcggcgggcgtgccagggcagaggcagtgcaggtcatcggtcgctttcgaggttttcggtcgtcttaatttcctttatttttctgggggggcgccgttctttgacgcgcactcgtgtcgtgtatgcacgttggggtgtgtgcctcccggtttttcgtcgtgcctgagcattatggagttgtgcgttttgtgacgaaatattttcttttgctgaagagttctgcgtgtactttgtgcaagaaaaaaaaaaaaaaaaaaaaaaaaaaaaaaaaaaaaaaactcga

SEQ ID NO: 15432 - DNA, 653 bp, Triticum aestivum
  unsure (1)..(653): unsure at all n locations
  Clone ID: PAT_TA_15432
ttgaaacccgttaaannctttgaaaaccctncaagctcgnnattaaccctcactaaagggaacaaaagctggagctccaccgcggtggcggccgctctagaactagtggatcccccgggctgcaggaattcggcaccagcgtagctccccgcccgtgacctgcctagcgtcgttgttgtctgcttctctgctagtgcttgccgctgctattttctgctagttgttgctgcccgtagttgccttgctgctactaattactataggtatggctagctttatgaattttacattgagtaaccccctgggcagcccctaaactatggttaaacaactattaacaaagcttagaaaaatatgagtagaaagtatactggacaaacttcattttatcccattggaccaagtcatttcgatgcatggtttaaatcctacaaaaatcacaaaatgctaagttctgttaagtgaaaaactggaaaacagctttattttagtagctactttagagctgttgatgatcaaggtaatgaactctaatatggatgtaattggtaccaacatgtagatcacagaaaaatgctcaaaattgatataaggcacaaaatcataggaggtacagatccatagttgtagcattttgaaaacagctaacagat

SEQ ID NO: 15433 - DNA, 700 bp, Triticum aestivum
  unsure (1)..(700): unsure at all n locations
  Clone ID: PAT_TA_15433
atnnccctngctcgnanttaaccctactaaagggaacataaaggnnnnanaagntggagctncaccgcggtggcaggacgntctagaactagtggatcccccgggctgcaggaattcggcaccaggccttccacctcttcctccacccggtccaccgcatcctccacgtgcgcctcaccccgcgcgcctccgccgcgctgcgcctcgaggccgacgccatcgcctccctgcgccccggcgccgtcctccgcctccgcaagctgctcctcctcgcgcccccgcaccaccgcctccggctggagcacattcgtctcctccgccgcgacttcggcctccccgacgacttcgccgactccgtcatcctgtccaatcccgctctgttccgcctcacgcctgacgggttcgtcgagtttgtgccctcccctgacgacccacccgacctcaccgtcgccgccgtcgagcgctcccgggagcgccactaccgcgagcaccgtgctcccggcgctggcgaggaggacgcgcgcttcgcgttccccacccgctttccgccgggctttaagattggcaaagtatttnccgcattgcagtttggaaagtggcaagcgccttcccctacgctttccccgtattgcggacgtctcttggccaacgacctgcgctcacttgaggcaacaacccccgcatggaagaagccgcgctt

SEQ ID NO: 15434 - DNA, 636 bp, Triticum aestivum
  unsure (1)..(636): unsure at all n locations
  Clone ID: PAT_TA_15434
natgntttgatncgcnagctcgaaattaaccctactaaagggaacaaaagctggagctccaccgcggtggcggccgctctagaactagtggatcccccgggctgcaggaattcggcacgaggctcgccgccgccgtgcgctgccactgcccgccccccctcctaccccgccgcgccccgccggcgacggcggccaccccactccgtagccgccccctccagctccgtcccctcacatcctcgcccggactgcggacccgtggccgccgccacgccgtcgaccccgaggacgacggcggggaagacgacggcttcctcaccctcgacgtggaggacttcgaggggttcgccgacgccgacgaggaggcggaggggccgtcgccgtgggagggggccgtggtgtaccggcgcgacgcggcggcgcagcacgtcgagtatgccaccaccctggagcgtctcgggctggccgacctctcgtncccgcacttccgcgcgcgcgccggcggcatgggcataatgcccccctccaagccgcggcgcggcgcccgggaggccccgacgacgcccgtgctcgtattcgtcgacgtcgcccggcgccgcggcaggctcccggctcgacggcatactgcgcaccggc

SEQ ID NO: 15435 - DNA, 636 bp, Triticum aestivum
  unsure (1)..(636): unsure at all n locations
  Clone ID: PAT_TA_15435
gnnnnaggngnagttgnatctttanctcncnttaaccctcactaaagggaacaaaagctggagctccaccgcggtggcggccgctctagaactagtggatcccccgggctgcaggaattcggcaccagaaatgctccagctccaccgaatcctcaactcccgcttctccatcagaactgccgctccttgtagaaaatggcactagtacaaagatgttcggcaggtagctctgctcacgattcaggtggagctgggcagggaaacaggaacgagcgagttgggcgtggcatgcgaaccgttttcacttggcggtggcagtttcttcgtaattcttatcaactccttgatttaaggatctgagatctcagaaacagcagctctgcaatttttgcctgcaacaagctccactccccattttttactccacggagtttacacgttcggtgtcgctccaccaactccgggagcggagcccaagagcggagagcatccgaacacgcccttagtttccttgcacctcaagtcatgtgtaatatatatatgccccttgggccttcaataaagtcaagttgctttcctaacaatatttagatgtctcatgcatgacaatacattcttactgttttctaggaagaa

SEQ ID NO: 15436 - DNA, 692 bp, Triticum aestivum
  unsure (1)..(692): unsure at all n locations
  Clone ID: PAT_TA_15436
ctaggaggacacaagatgctgatggcagtagtagcctcagctataatagcaaaaagaagcgaagaaagaatacttttccagcgaatgctgacttgaatgggaagcaaatatttgatgataatgtcactaacgctgacaggcaatctgttccatctgacgtgtctggcaaagtagacatccaagaggaagctaaaactccagatatnaggtgatcaggacaatatcagggcagaagttacagatactgttggtcagagtcaaccttgctattctgtgaagctttctttccctgacgcagattttntcgattttgcgtccttgagggatgctagtctgtttgcaactggtcagatctgggccctttatgataaccttgatggcatgccaagatattatgctagaataaaaagtttggatgcgtccaactttaaaggtcatctcacttggctggagcgcattgcaatgaatgaagcagaggagaaatggtctgatgaagaactgcccgttgcttgtggaagctttagcttaggaacaacagagatatcacaagacagactcatgttttcgcatattggtttcatggacaaaaggcaaacgaaggaaatatgaagtacatcccaataagggtgaggtatgggctctttataagggatggaacatgcagtggggatcagatgcagataatcatagat

SEQ ID NO: 15437 - DNA, 600 bp, Triticum aestivum
  unsure (1)..(600): unsure at all n locations
  Clone ID: PAT_TA_15437
nnnnnagnngnagntttgntacgccagctcgaaattaaccctcactaaagggaacaaaagctggagctccaccgcggtggcggccgctctagaactagtggatcccccgggctgcaggaattcggcaccaggtagattcagcatttctgaataattttcatcatgcctacatgttaccgccaacaacgataaagcgaaggatagcttctgttgcacattgtttttaacacaaagcttcttttcaagctcaggagcattccatagcttactgtatgcactaatcatactccttgataccactatcatggtgtaacattcatgcagtggatcaaaagctcatctcgttatcagttaatctgaatataccatcagtggatatttctgtacatagaggccagcatcagtggatattttttgacatattatttacgatatgcaactgagaacgtgatataccatatagggatactgtgtatgttttggagtttgactatagatgtatgtatgtatgtatgtatgtttgttgcgngtagtcagtcaagttgctaggcctattgaagacttcaggacaaataggtggatcaatgctgccgttttgat

SEQ ID NO: 15438 - DNA, 999 bp, Triticum aestivum
  unsure (1)..(999): unsure at all n locations
  Clone ID: PAT_TA_15438
atagnnnnnnnnnnnnnttctgnttacgccaagctcgaaatnaaccctcactaaagggaacaaaagctggagctccaccgcggtggcggccgctctagaactagtggatcccccgccccccccgttcccggcaccagccatggtggccagcgcggcggagaaggctccggcgacggcgagcggtggcacccggcgggtgctgctgttcccgctgccgttccagggccacctgaacccgatgctgcagctggccgacgtgctgcacgcccgtggcctccgcgtcaccgtcttccacgccgccttcaacgcgccggaccccgcgtgccgccccgccgggtaccgcttcgtgcccgtcggcgccggcgtgccgacggccgacctcgtccccaccggcagcaacgccgacttcgccggggcgctgctccgcatcaacgagcgcctgcagacccctttccagaacagcctccgcgaggtgctggaggatgaggagggggtgccggcgtgcctggtgctggactctaatctccgggggatgcacgtggtcgccgaccggctgggcgtgccgacgctggtgctgcgcacgggtggcgccgcctgcctcgtggcctacatggccttcccggcgctctgcgacaagggcctcctcccgccacaaggtatttacgtactaacagacaaacaggttaaccttccccccctccagctgcaagacatggtcttctcaaccacaactccacatgaaacgatgaccacctgcctagaaacgcattgtggaatcggcaaagtgttcttcaaggttgtcatcctcaacaacctttaacgaacctcnnaagatntcngagctccaaaaagatcgtccattggtgttgtgtttcccaagtgtaagccgaattgggtccctccttnacaaagaataatccttcaagggtngcccaataagcaancctggtttgtcctccangattnaaaaccttggtttggattgggcntggacaaatg

SEQ ID NO: 15439 - DNA, 525 bp, Triticum aestivum
  Clone ID: PAT_TA_15439
agcacgaggccgacgcgagcgagggctccgagtccagcggcgccctccccgacttctcgtggcagggcgtgtcggcgttcgacgaggccccggcgtaccccgccccggagcccgagaccgagcagctcgcgaagcgggcgaggacgacggaggccgaggacgccgacgagggcatgtcggcccaccaggcgtccgactgcgactccgacgcgctgttcgacgcgctcctcgtcgccgaccagttcgcctacttcaacggcggcgcctacgagtccctcgacagcctcttcagcgccgacgccgtgcagagcggcgccaccgccgcggacgaggcggccctggggctctggaccttcgacgacgactgcctcgtcgacgagtgcagcctgtcgttctagatcttcttgttccgcgtgcgtccgttcatgtcatgcgatgcggtggtgtaaatagagtagcttgccttgtgaaatctgtgtaagagtttgacatcgttgcgaaaaaaaaaaaaaaaaaaggccccta

SEQ ID NO: 15440 - DNA, 1526 bp, Triticum aestivum
  Clone ID: PAT_TA_15440
cattccacttatagtcgagagaaaatcaagagcagcgaccagagctaggggggaaaagcagaggcaaagcatcgaaagaagagaaagagagcgaggatgtgtggcggagcgatcctcgccgagctcatcccgggcgcgccggctcgccgcgccgcgtccggccacgggcacgtctggcccggcaagggcgccaagcacacaaaggccgcggcggccgacgacttccaggccgcgttccgggagttcaacgaggactctgatgaggaggacgtggtgatggtggtggagcggcaggaggaggtggccgagagcaagcccttcgtgttcgccgcttcgcccaagaagaagcagcagcagcagcaggaggaggaggaggagcaggcggcgcccgcccgccgcaggaagccggcgcagtaccggggcgtgcggcgccggccgtggggcaagtgggccgccgagatccgcgaccctgtcaagggcgtccgcgtctggctcggcaccttcccctccgccgacgccgccgcgctcgcctacgacgaggccgcgcgcgccatccgcgggcccagggccaagctcaacttcccttcctcctccgccgtcgccgccgcggccccgggagcacgcaagcgaggccgcgccgcggcccccgctgccaagccagcgccggtcatcaccctcgtcgacgatgaggaggagcacgcgtcgtccttcgtcaagcacgaggccgaggcgagcgagggctccgagtccagcggcgccctccccgacttctcgtggcagggcatatcggcgttcgacgaggccccggcgtaccccgccccggagccggagaccgagcagctgacaaagcgggcgaggacgacggaggcggaagacaccgacgagggcatgtcggcccacccggcatcagactccgactccgacgcgctcttcgacgccctcctcttcgccgaccagttcgccttcttcaacggcggcgcctacgagtccctcgacagcctcttcagcgccgacgccgtgcagagcagcgccaccgccaccgccgtgaacgaggcggccctggggctctggaccttcgacgacgactgcctcgtcgacgagtgcagcctgtcgttctagatcttgttccgtgtgcgtccgttcatgtcatgagatgcggtggtgtaaatagagtagcttgccttgtgatgaaatccgttcgtccgtcgtcgcttcttggatcagcaagcgatgatggattctgtgtaagagtttggcatcgtcgtgaaagattttgcctacgccttcgatgcaaaagcccgacatccgtgcccgaaatgttctgccgacgcggccctggggctctggaccttcgacgacgactgcctcgtcgacgagtgcagcctgtcgttctagatcttcttgttccgcgtgcgtccgttcatgtcatgcgatgcggtggtgtaaatagagtagcttgccttgtgaaatctgtgtaagagtttgacatcgttgtgaaagattttgcctaaaaaaaaaaaaaaaaa

SEQ ID NO: 15441 - DNA, 823 bp, Triticum aestivum
  unsure (1)..(823): unsure at all n locations
  Clone ID: PAT_TA_15441
gagngttgntcntcagctcnaaattaaccctcactaaagggaacaaaagctggagctccaccgcggtggcggccgctctagaactagtggatcccccgggctgcaggaattcggcaccaggagcgacggagcgctgttcctcttcttcccccaacctcactcctccgcacgaacaagcctccaggcctccgtccagcgggcgaagcacgccaactcgaaggatttctctctcatagtcgtcgccatccacataacccgctctaccgaactgccgaggagaggagatccacctgcatggtcatggtggagttctaactgcagttgggtttccagtaattttgggggttcaacagttcaacagaacccccaaaccctacgttagatccgcccccctgccgagctccgctacgtttatgatattgcgacggcatcgtagagcccttcactgctgtgaggctgagacttctaatgggccagatggtttccgatggtgtcatccaagaacaggcagctcgcaatggcgggatcattaagaacgggagggaaatcctattgcaggcttttaactgggaatcccataaacacaattggtggagtaatttagagggcagagttgccgacattgctaaaccggggtttccatcaggtgcgctgcctccaccgtctccatcgggttctccagaagcctttcccccactgtacctcctcagccttgtcgcgtctgatgggtcccttctgcggctgngagngttacaacggtgacanaggttaagggttnaccttnggcccatnangaaaagggtaatttttgggaggaaaantg

SEQ ID NO: 15442 - DNA, 654 bp, Triticum aestivum
  Clone ID: PAT_TA_15442
tcggttcttacacattcttattcttatattttcattcttatcctttgcataggtgaagtgtgaatcaaagtccgaagctgtgaagcatatcaacaaggagtagcatattatgtgttgtaattgtaggcagtagtaggcatatctgggttgtagtatactgtaatgattataatagactaatgtattgttgctttggatcaatttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccttttaaaaaaaaccaaatttaaaccccgggggccggcttgctaagggtaatttttttttaggggccccaaaaaaaaaatccctggcgcgggtttaaaaacgggggggggggaaaaacccgggggttccccaaaaaaaaccccttgaaaaaaaacccctttttcccagggggggaaaaaaaaaaaaggccccccccaaccccccttccaaaaaggtgcccccccctaagggggaaggggcccccccctttattgggcaaaaaacccgggggggggggggg

SEQ ID NO: 15443 - DNA, 1006 bp, Triticum aestivum
  Clone ID: PAT_TA_15443
cgtccgcggacgcgtgggcggacgcgtgggcgccgccgccttcgccctcccagaccaatcctgcccgcgtcggccacctccctccagcggagctcgacccccaccccccgccgctgctccaccctctcccatgagggtctctgaggcccgcgcgcgcacaacctccgtcccctgttgctccaatccggccagcgctccctccacctcgtctctcccgatcccaccggtcggcggtgaccttcaccctagcagtcatactccaccctagcagtcgatcccgaccatcgctgcttcaccagcctcctcatctggcatctccccgagggcggccgatgccagacaggccgtcgacgcgccggacctcaaggccggtcgtgctgctccttctgcctgcgtcccctcgaccgctgtctgcaagatctccctcctcaaggagatgcagcatcggaacatcatcaggctgcaggacgtggtgcataacgagaagagggagggcgccatggcgaagaaagagggaccttgcggccattgcggagtcacaagtgtattgttcctgtacccgagtggctacatcagggaagacccacttggagtccccaacaacctgagccctatgtgcagcaagtcgttgtcgggaggcgcctgcgctgacggtttatgggaccgaatacaacaccaaggatggaataggggtggtgaaattatggtacagaataccagaaattcttctgggtgcgaggcaggattctaccctggttgtgaagtgcgaatccatgttcgaagttttgaagcatatcgacaaagagtagcatattatgtgttgaatttgtaagcagtagtaggcatatctgagttggaatatactataacgattggaatagaataatggagaattgggtttgaacccaattcatttgttctttggcctggtcgaaagatggttggcatgggaattgaatacccaggtgacaaggacgctggcgcccgccttttttcttccccagct

SEQ ID NO: 15444 - DNA, 637 bp, Triticum aestivum
  unsure (1)..(637): unsure at all n locations
  Clone ID: PAT_TA_15444
gnnnnntgatactncaagctcgaaattaaccctcactaaagggaacaaaagctggagctccaccgcggtggcggccgctctagaactagtggatcccccgggctgcaggaattcggcacgagatgccctgcagccgactgcttcggcgttcttccacgcgagcgagcagaggcaccccatggcgcctcctcctctccttctcttggcgcgcgaagacctcgacggagccacctccatcgcgtcatcgatctggccgccgcctcacctgcggctcgatcttatctgggagagatggtgaggggtgggggtggcggagtaaggggagccggagaggaagatccggtgcaggactcccacgctgcagacttgaggcagccaaccacggccacgtcgatgactctgcctcctgaaggacgacatccaccacctccctccctgccgnccagaagtgacgaggttgccgcctctcggcaactttctgtgctctcgcagaaattccccttcagatagtggagcgccgtcgctcccatagtcttcagcatcaggttggcgtctgcacctttgcttcaaaattgtgtcatgccagccagttcatgcaaaagttaatctgacgttccctcttgcattatattggtcn

SEQ ID NO: 15445 - DNA, 642 bp, Triticum aestivum
  unsure (1)..(642): unsure at all n locations
  Clone ID: PAT_TA_15445
gaagtttgatacgntagctcgaaatnaaccctcactaaagggaacaaaagctggagctccaccgcggtggcggccgctctagaactagtggatcccccgggctgcaggaattcggcacgagcgccgtcctcctcacccaccgcccacctcgtccctccctcccctcaccatctctccctaccctctgcctgcttcccctgcctcatccccagatccaatcgacacaaccccgctgcccccgcaccccgtactgtccaccatggccgcctcctcctcctccccgcaccaacccatcaccccgtcgtgggggcgcgtccgtggcggctacccttccacgccgtctccgtccgcccctgccgctccacagtctcctccgaatccgcatcctccccgcagcaggcgccggcaccggtcggcggcgacgacgccaacgggcccaccggcgtgcccgtgcccttctcccgtgccctcccgggcggcggcggcagttgggtgaccggtggaggaggtgtttccgccgctaaacaaccaccctgacgggggggcgaagatctttggcgcgtgttcaccgaagctccgcgggcgggttcgggcccgccgtagacttcttcgtcggcttctttcacgccgtcgactagaaag

SEQ ID NO: 15446 - DNA, 441 bp, Triticum aestivum
  Clone ID: PAT_TA_15446
cgtccgcccacgcgtccgcttcttcttcctccaccatgcatccagccatgtctcatgtgttctgcttcggacttctcctgctcatcatcctcgatccgcacaccctccctcaatgccacgccgccacggacaccctctcgcccagccaagagctcgccggccgcgacaagttggtctccctcaacggcaggttcgcgctcggcttcttccagaccgggagcaacttctccaacggcacgcccaagtggtacctcgggatctggttccacacggtccccaagttcacccccgtgtgggtcgccaacgccgagaaccccatcgccaacctcacggcgtgcaagctcgtgctcacccgcgacggcaaccttgccgtccaccaccaggctaccacggtctggtccacaaaagccaacgccgcgacaaacaccaccgtcgccgctc

SEQ ID NO: 15447 - DNA, 1793 bp, Triticum aestivum
  unsure (1)..(1793): unsure at all n locations
  Clone ID: PAT_TA_15447
ccacgcgtccgggcgtgcaaagtttaagctttcacaagctctagaaagaaagcatattgtggagggcattgtcattggtcttgacaatttagatgctgtaattcaagtgataagagaaacatcaaatcacaccgtggcaaaggaagctttagcaaaggaatatggtctatctgagaagcaagcagaagcacttttggacattacacttaggaaacttacttcccttgagcggaagaagtttattgatgaagctaattcattgtcggagagcatttcaaagttaaatgagctcctgtcaagcaagaaacttatgtttcagcttatcgaacaagaagcagctgatttaaagagcaaatttgctaccccacgacgttctttcctagaagattcagcaaaccgcggagttgatgatatggatgttattcctaacgaagaaatgcttttgattcttagcgagaaaggctatcttaagcggatgaatcccaacaccttcaatttacaaaaccgggggacaattggaaaatcctgtgggaaagatgcgaacgaatgacaatatgtcggatttcattgtctgccanaacacatgaccatgttctttatttcagtgacaaggggatagtatactctgaacgtgcttataagatacctgaatgcacaagagttgctgctgggactccattagtacagctgctcaatttgtctgatggggagagaataacctccattgttcctgtgaataaatttgttgaagaccaatatttagtgatgctgactgttaacggctatatcaagaaagttcctcttaatgccttcgcatcaatcaggtcaacaggaatcatttcaatgcgcccccgcccccgcgacgagctcaagtgggtccgtctctgtagggatgacgaccttgttgctttggcttcacaaagcgggatggttatagtcaacacatgcaacaggcttcgtccgcatggaagaactacaagaggtatgggtgcaatgaggctaaaggaagatgacaagatggcagccatggatataattccatccacaacccatacaatgcctggaaaaactgtcagcagggtcagagacttgagtcctccatggctgctcttcatagctgaaaatggttatgggaagcgtgtgcccctaaatgctttccgtcaatcaagcttcaatagagtaggcttgcgaggctacaagcttccagaagattgccgcttagctgctgtgtttgtcgttggggaaccgactgatgacgatgcaagtgaggagcaggttgttttagttagccatggtggcactgtaaacagaatcaaggtcaaagatatatccatccagggtcgtgcggcaaagggagtaattctgatgaggctggagcatgctgggaagatccagtcagcttcactgatatcagccacagccgacggaagagatcttggaagattgattcagcttacgttacaagaaggaagaagtagattctgctggttggtgttgcattccaagctggggagagctgcaaattttgttatgttgggtggctcatgctgttctccagtagaagctaggaatgacactgatttgacgctgattcggcggggtagaagagtagagctctggttgccattaacgtgtgtctagaaactgatgtactcatcatgccattagcagtcgatgtaaatcttgcacgctgggttgcaaaatttgcttctctggtcagagagaccccttctgttatcagtgctctaatcccacttggccagtgatgccttttttttggaagtgcaaaacat

SEQ ID NO: 15448 - DNA, 630 bp, Triticum aestivum
  unsure (1)..(630): unsure at all n locations
  Clone ID: PAT_TA_15448
gagagnttgnnctttgattcgccagctcgaaattaaccctactaaagggaacaaaagctggagctccaccgcggtggcggccgctctagaactagtggatcccccgggctgcaggaattcggcaccagcttcattcaaaagatgcatagagaccgattgtccaccatggcgaggtcggtcctcacgatggcggtgatagcagtgctgctggtccactgcaccgccgttggtgctgattctggtggagcgacaatgaagcggacaagaagtacagtgacaatgttcccacccatcccgacagagcccttcccaatgccaccgcaccaccagcacccaccgccgccgccggtacatgcgcctactcgccgccggtccccatcgatcgagcagccaacgcacggccgtgttgctgtttagttatgttctatgtgtactctcttttgattatggatgcaccagtgattaaggtgctgccttcttacttcgtagagtaataacaataaaccaagaataagatattggtgcccctaaaaaaaaaaaaaaaaaaaactcgagggggggcccggtacccaattcgccctatagtgagtcgtattacaattcactggccgtcgttttacaacgtcgtga

SEQ ID NO: 15449 - DNA, 629 bp, Triticum aestivum
  unsure (1)..(629): unsure at all n locations
  Clone ID: PAT_TA_15449
gnagagtttgatcgntngntcgcctgctcaaatnaccctactaaagggaacaaaagctggagctccaccgcggtggcggccgctctagaactagtggatcccccgggctgcaggaattcggcaccaggtcgagatcccgatcccctccatacaattcaccccaaactagctagaaattcatctccctagtcctcgggtcctgacaaattggtatcatgagccatcgttcttcggcagaaacaagctgcgggggttaaaaaatttcttcgagccgcgattcccaccctgtttcccacccttttctcttgagatccagcggcataacagagtttggcggatttggcggcggggtccggtgtggcagagcaggcggcggtgaaattcggacacagatcggtcgagaagaagcggttgttcgaacactttgttcgctcggtaaaattctgcgttctacgctccgatccgtgtgtcagggcggtgagttcatcggcggcggcaggatttgttgtattgggaagggttgctgaagattcagtcgtaaaattccgtacccatactccagatcgaggcgattgggcgtttcaagacagttgacgacactgatctccaggaaattttggccatgcgtg

SEQ ID NO: 15450 - DNA, 640 bp, Triticum aestivum
  unsure (1)..(640): unsure at all n locations
  Clone ID: PAT_TA_15450
atnnngatttnattcctntgattcncctnntcntaattaaccctactaaagggaacaaaagctggagctccaccgcggtggcnagcacgctctagaactagtggatcccccgggctgcaggaattcggcacgagggcagcggtccattgagctggcagaagctgacatcaatgacgatgatgcttgtggaggacatgagctctggcggaaggccaccggagaaggagttgtaggagaggttgacatgtagcacgctggtgaggtccgcaagggaccgtgagatgcgcccttcaagtcctctagatgccagggagacctcagtgacagtcccgtctccattgcaggtgatgcctaaccactcgcagcagtccgtgctgctgtcacgccacgatgtggcgaggccgccatctctggacagcccggcaaggaaacggaggacgtagcacttctcctgcttggtgcatgcggtggtgggggaggccaatatgagcagcacgaacagctgcagcacggccgtaggaacgttgaagaaatgcattgaagcaagttagatgctggaaatgagagtcaaatggtcgatcagagaggtccttgcagatcatatttttcatttcccttggtacggaacatgtactggaac

SEQ ID NO: 15451 - DNA, 752 bp, Triticum aestivum
  unsure (1)..(752): unsure at all n locations
  Clone ID: PAT_TA_15451
ntttgtttccngtggaagggttntcagggttagttgtacccagtttccgtagacttttaacgacgccgtgggnggtatangatctttnggggattggtacgggcccccntcggccaccccgggggcgcttttgagtttcgcattatcttgccgcacggcgggtccaacccttgggtaccatggcattttaattccaaaaaataaaaaaatgatcagaaaaacatgaaaccttgcttgatgtaatgtcatgccaccaagatgatgtggtaaaaaattggcatgtttgacgaaagtttggacacacacccctcacaaaccggagcaactcactagaaggttcgtggttccgagagggaacaatgcatgtttgatgacgaacgggagatagcttcctcttacggccttcaaattttttcctacgtttaacgtgcactaatacaactgtcatgtgaaaatttggaaaatttcaggggtcatttgaccttttaaagacatttaagtgattttctaaccatttaatgaccgtaattcaaatttgaactacatctacatgcaacacctaaccataacggtttgaaaaatcatatttgtgtacttgtgtgcgagttaattccatgtgcagtaaattggaaggaattttcaaacatattggtctcaaggcatgggcacatgcatggagtgcatgccatggcattttaattccaaaaagttaaaaaatgaccagaaaaacatgaaaccttgcttgatgtaat

SEQ ID NO: 15452 - DNA, 636 bp, Triticum aestivum
  unsure (1)..(636): unsure at all n locations
  Clone ID: PAT_TA_15452
gnnnagnngagttgntctttantcncnttaaccctcactaaagggaanaaaagntgnagntncnncagctccaccgcggnggcggccgctctagaactagtggatcccccgggctgcaggaattcggcnccagcccaaaacgccaaaacccaaaccccactccgcgaaggagaagaagcggcgcaatgctggaggcggcggcgatccctgagctgtggagcaccgtgcacgggtggttcaccccatgggtgctgttcatcctgctcaacctcgtcgtcctcaccatcttcgtcacctccatggccacggccccggcggagggcggagaagggactgcgcccggtgctgacggcgagaggaggaacctcgccgtccggccgtcaatggagctcgaccggcaccggtcgcccaacctgcctcgcttcaccgcccccgcctctgaggccccggcgaccggagtactggatctggggcagcccgacgatcagccgccggcgctcgagatggagccggagaatccgggtgagcgcgagcacgcgcgcatggagaggagcatgtctgaggcggccgtcgaggccgagctgccgcagcagtcggcgaggcttgcacaagtcggcgagcgacatgtcggcgttc

SEQ ID NO: 15453 - DNA, 693 bp, Triticum aestivum
  unsure (1)..(693): unsure at all n locations
  Clone ID: PAT_TA_15453
agnnnnnnnnnnnntctgattcgccagctcgaaatnaaccctcactaaagggaacaaaagctggagctccaccgcggtggcggccgctctagaactagtggatcccccgggctgcaggaattcggcaccagctatccccttggtcatggcaatggttgccgtccttctcgcagccacagccaccacccgggccgcgagccttgtcccagcagccgacgaccggaactcaagaagcatgccaaccgcgtatgaaatgctagggcggtatggcttcccacccggcatcctcccagagggcgtgcagggctatgagctccggccagatggttcctttgaggtacacctccctagacactgcaaaatccgcatcgccgggcagaacatccactacagcagccggatcgccgggaagatccagaacggcttgatcaagggccttgagggcgtgaaggtgaagatctttattctgtttatcagcgttcgagacgtccgccgcaacggcaacgagctcaggctccacgccgggattatagccaagtcattctcggccaatgatttctccttctccccacggtgtaactgaggctagccgttcccatgaataaatagatatcctcaaaaaagtattggccgtggggagaaggagaaatccttggcctagaatgactggggctgattgacaaatagatatcc

SEQ ID NO: 15454 - DNA, 638 bp, Triticum aestivum
  unsure (1)..(638): unsure at all n locations
  Clone ID: PAT_TA_15454
gagttnnaacttgnntcnccagctcgaaattaaccctcactaaagggaacaaaagctggagctccaccgcggtggcggccgctctagaactagtggatcccccgggctgcaggaattcggcacgagaacaaagccaggggatgccaatatcaatagcttagctagttcagtagatacagtacctaagatggatgaattatgttctccaaaagatgatcgtctggaagaaaacatccagtgtacagctgcagctgacggagatccggataactcaaacatatcatcttcactttcaactgataaatgcaatattgcaacattggagtggcaaagaatacaacagagaatgaagatgaccctaccactttgcaaaggacaccgtgaaccttgcattccaaggtctgtgaagaagggctccaatatcggtcgcttattctatgtctgtgcccgtgctcagggaccttcatcaaatccagaagcgaactgcaatcactttcaatgggcctctgtaaaatctaaagggaagcggcaatgactcttttgtttttcagtcattttctgccgttgccgtgcaggtcaaatgactactttctgcacttgattccncagaagcgctggacacttgtcaagcttgtgct

SEQ ID NO: 15455 - DNA, 713 bp, Triticum aestivum
  Clone ID: PAT_TA_15455
ggctcgtccgctccgccgtcctcggcttcgccgcctccgtgttcgccctcacccgcccccgccccgtcctcctcgtcggcttcgcctgctgcagcgcccccgacctccccgccgcccgcgtcctggtggtcctccgccactcggcgctctgcggcttctccgacgacgccctcgagttccagcgcaagatcctcgagcgctccggcctcagcgaggagacctactgccccgagggcatgcacgccatcccgcccgagcccaccatggccaacgcccgcgccgaggccgagtccgtcatgttcggcgcgctcgacagcctcttcgccgccaccggcgtcaagcccaaggacgtcggcatcctcgtcgtcaactgcagcctcttcaacccgacgccctcgctctccgccatgatcgtcaaccggtacaagctcaggggcaacgtccggagcttcaacctcggcggcatgggctgcagcgccggcgtcatcgccatcgacctggcccgggacatgctccaggtgcaccgcggcacctacgccgtggtggtgagcacggagaacatcacgcagaactggtacttcggcaaccgcaagtcgatgctcatccccaactgcctcttccgcgtcggctgctccgcggtgctcctctccaaccgcggcgccgaccgccggcgcgcaaagtacagcctcaagcacgtggtgcgcacgcacaag

SEQ ID NO: 15456 - DNA, 668 bp, Triticum aestivum
  unsure (1)..(668): unsure at all n locations
  Clone ID: PAT_TA_15456
atgattncgccaagctcgaaattaaccctcactaaagggaacaaaagctggagctccaccgcggtggcggccgctctagaactagtggatcccccgggctgcaggaattcggcaccagcggcgtccctcctccaccggctctgccgctgtcaccgccggcccgcggggctgccaggtccatggcgcccgcgtgcgcactcaccaccatagccatcctcgccgcgatcctcttctacgtcctcctgctgctcagccgcgccatggagctgcgtttcacggccagctatgccatggtcgactgcgccccgccccctgcctcggacgccgccgccgctgccgccttccgggacaccgtcctgccgctcctggccgcgctgcccgcagccgccgcgccaacggggtttgcgtccctgcagtcgggcggcggggcgttcgcccgcggcctctgcctgggcgaccccgcgccgagagactgcctggcgtgcctcgccgcggccgccaagaagctcaccggttgcggcgcgagcaggcgggcccggagtctggaggagcgagggctgcttcctggcctatgccgacggcaacacctcctccacgcacgaggacgtgttccgcgacgtcgtctccttcgacgacggcactccgtcctcctacccgaattgcttcgn

SEQ ID NO: 15457 - DNA, 452 bp, Triticum aestivum
  Clone ID: PAT_TA_15457
gggcagcgcggcaagacgaggcacgcaaggagcgggaggcgccgccgccggtccctttccccagggaaaacgaggaggagagaaatctgaagctaccctctcgtgtggtttctttgttctttggcggtgatatctcaacaacagcacagtcatttgagaaatgggtgtcgctggtacgtttgcggagcgggacatttcgcccatcgtccgtcccacgtcgcaattcaaagattgaagtgatgccaagtggaagcttctcactttttggcagcgcagacttaagggaggaagtgattaaagcagaagcggcgagcagagaaaagaatcctacgcttgatcagcctcctgaaataagcttgtgggagaggcttgggaatgcttctgcattggacattgaatcatctggcttttcatggaatatgctgtcatctctgcaccatacagaacacagt

SEQ ID NO: 15458 - DNA, 635 bp, Triticum aestivum
  unsure (1)..(635): unsure at all n locations
  Clone ID: PAT_TA_15458
gagtttgntctcngncncgccagctcgaaattaaccctcactaaagggaacaaaagctggagctccaccgcggtggcggccgctctagacctcccgggtcccccgccctgcaggtcgtcgccccgcgcttgtttcaaaagaatgaaggcgtggatgtttgtctatttgccatgtatgtacaagagtatggttctgctagcccctcaccaaatcaaaggcacgtttatcttgcatatatcgattctgtcaagtacttcaggcctgaaatcaaatctgcaagtggggaagctctccgtacctttgtttaccatgaaattttgattggctatttggattactgcaagaaacaaggatttgtaagctgctccatatgggcttgcccatctacaaagcgtgatgattatgttttgtattgtcatcccacggcacaaaaaatgccgaggtctgacaagcttcggagctggtaccagaacttgatcaagaaggctgttaaggagggtgtagttgtggagcgtaatacgctgtacgatttttttcttcagcctaccagtgaatgcaaggccattatttctgcagcatgcttgccatattgtgagaatgatttctggcctggggaagcagagaaactcctcgtc

SEQ ID NO: 15459 - DNA, 639 bp, Triticum aestivum
  unsure (1)..(639): unsure at all n locations
  Clone ID: PAT_TA_15459
gaagttnatccttgntcncctnatcgnattaancgtactaaagggaacaaaagctggagctccaccgccgtngtngacnctctaganctacnngatctnccggnntgcaggaattcggcacgagcctccgcaagagcctgagcaatacaaggggctccatcacccctccactcctagtccattccgccgacgccacagcagcgaattcaccagcgcgccttccgaccccggtccgcctgcctcctcccggacctcctagccatgtcggccgcccagatcagagccgagatcaacggccttatcgcctccaagttcgccgagggtacggtggatcagtatttcttgcagctgtaccgtgatgcggaggtacaagaagatacgcaagggcatggtcgctgaggtcatggaacgcttcctccaagacgctgacaagatcctcaccgaaatcgccgtcttgctgaacgagccccagctggactacgacaaggtggaggggatcgcggatcagctcgaggggtgcagcaacagcactgttggtgctaagagaagtcaacctctcatgcgtggagtaccttcattcctgaggcaaaacccgaagaagggacccaccccgggtgggcctttgccaaggggggcccc

SEQ ID NO: 15460 - DNA, 632 bp, Triticum aestivum
  unsure (1)..(632): unsure at all n locations
  Clone ID: PAT_TA_15460
tgattncgccaagctcgatattaaccctcactaaagggaacaaaagctggagctccaccgcggtggcggccgctctagaactagtggatcccccgggctgcaggaattcggcaccagccgccagagaccctttctcctcttcgtttccgcggcgcgccagatctcgcgccccttctccggcggccggcgcggtgagctctttctccccttcctccgttaccgccctccgcgtatcacccttcgccgcgcggaaggccagctcccgccggagatcccccgccaacatcctcgtggtggggcatcaatccattcggcttgtcgcgggtttgtttgctgcgcggtagagtagtttatattacaagagcagtttattttccgggaatttcgttaggtccgcccctgggttaactagtgaagacttgggagtgtgagatcgatgcgctgattgacacctgatgaagctgtagacttgtagttgaggtcgtctaagagggcttcatgtgccttgccatggctgagggttttagggtttagggtgggcatctgctgctctcacaccccgctgtcatttcaaagcatttgctttatcagataaattggcctgttgggtctggttcataagtcttggcctg

SEQ ID NO: 15461 - DNA, 860 bp, Triticum aestivum
  Clone ID: PAT_TA_15461
cgtccgcggacgcgtgggcggacgcgtgggattttttgtatgtggttgcgatacattgccttcgtggatttatcactttgagttttctgcgttacgctacagtgttagagttaaggaagggtttcatgatgcttcaagggcaagaatgaacagtgagatgaaagcaattaggccaagtttgagtgctaagtccgtagagaaattgagtaaatccagaaaaggtgccttgagtaagcaagtactttccagattaagcatgagcattgtggcgctggcctcattcgatggtgatacccaattacacgaatgcacgggcacatgcatcgaaagctcatgtcctgatgctacgtgtttcctgacatcgataaatttgattccttatacttggtggttagggaagatcactgaaagtttgacgattaaagtacgccttcctgatgatcagattgtcactgggtggatagagaatcctgagatatatgttgatttttttatcgtcaaaatcaagaacgacgatgttattgatcccctccatctacgtcatctaagtcttgatcgtgccacgcagtttgagccttataggaaggtagcagctgtatggcggcattatgattcaggagaattaaaggccacaagtggagtagatcttgcctctgtatgcgctcttacagatgaggagatgttaagtacatgccgtatccatgaggtggggattggaggtccccttgttgattttgatggcaactttgttgggatgaactgctctggtaccaaacccagaaccacgctatacgtacaaaggccttcaattcgcgaattcatgtggcatcgcggcatggacagtgttaaggaagaggttg

SEQ ID NO: 15462 - DNA, 869 bp, Triticum aestivum
  unsure (1)..(869): unsure at all n locations
  Clone ID: PAT_TA_15462
cgccagcttgagtacttgacagttcactctcgctgcagcggaggatcttccctttctcctttagccgttgctttctggaagtgtgggcggggcgatggggatgctccaggcgcgcgtcgtcgtgcttgttctcgcggcggcggcggcggccgttgtggtcgtcgtcgacggccagatgtcgccggcgttctacgacgcctcgtgtccggagctgcagtccgtggtgcgccgcggcatggcgcaggccgtgcagaaggaggcgcgcatgggcgcgtccatcctccgcctcttcttccacgactgcttcgtcaatgggtgcgacgcctccgtcttgctggacgacacggccaacttcacgggggagaagaacgccgggccgaacgccaactcgctgcgcggctacgaggtcatcgacgccatcaaggcgcaggtcgaggcttcctgcaaggccaccgtctcctgcgccgacatcgtcgcgctcgccgcccgcgacgccgtcagcctgctcggggggccgagctggacggtgcagctgggccggcgagacgggctctcggcgagccagaacgcggcgaacgccaacctgccgccgtcggacgcgaggctccccgacctcctcgccaggttcaacgacaagggcctggacgcgcgcgccctcaccgtgctgttcaggagcgcacaccatgggctgggcactctgcaccaccttccgcacgcacatatacaacgactccggttacgagggcgtggacgccgacttttccacccagatacgcgccaaggccgtgccctccgtcggcggcgtctgggacactcgcgccgatcgaagctgcgcgcccccgtcgagttcgacaaccgcttctttccgn

SEQ ID NO: 15463 - DNA, 711 bp, Triticum aestivum
  unsure (1)..(711): unsure at all n locations
  Clone ID: PAT_TA_15463
tganccnnnnnnnnnttctgattccgccagctcgaaattaaccctcactaaagggaacaaaagctggagctccaccgcggtggcggccgctctagaactagtggatcccccgggctgcaggaattcggcaccaggttttcttagcacctatgccaaagagaagaaggttagtttctttcaagaatgaaagaactggtcgcaaaggaactgctgtcagtaaaaggcattacgggaagcaagctgacaccccagtgcaacctgtgcctaaagcaaatgaagcaagtgcaggggccaacccttttgtatggagcacaatttcaagctcatcaaccaacataacctttggcactaatagcaatcacacatattgcggacagcttcacaatgtgccccctaatgttgaagtggtttacaaggaaaaagctcaacgtaagcatgttattgatctgaatatccctcaaatgccttctgattatgagtcgactacaagttatctccaaaacttcctctgacaatgaatgcacttattcatgggaacatgccccctcggccgcgccctccctgaaaacccaaaggganggccgggattggaacttggccctggccccaggaatanttcaaaaattaccccttcttaaggttaaattggccaaaattcctttggaagnccggaagccaagccttttttcntttttcnaaaaccttcgggan

SEQ ID NO: 15464 - DNA, 760 bp, Triticum aestivum
  unsure (1)..(760): unsure at all n locations
  Clone ID: PAT_TA_15464
gagnnnatcnngaactntttgtttacccccatcngacnacngnancctaanttggagcncnaacgcggnggctgcnnctctagaactagcgctantacaactagnngatcnaannggctgcaggaattaggcacgngccggccctcgtctaactgcaagccgccgtgtgcatccacgggctgttcatgatggcgcccaaccgctgggacccggccttccgagcgctcctccgcccgctccgcctcgcctacgaccgctccaggtccctgctcgcccgcgtctcccgccaccccgcgcgcccctaccgctccctcctcgtctccctcttcggcgccgacgccctatacccgctcgaccaggactgcattcctcgagcaagtgcggcggatgctgcggctgtcggaggaggaccggcagggtgggggcggagcttcatgcgatgcacgccgcccgtgaaggaagcgggggttcggcccgcatttttcccgctttggccaactcctggttccaaggaacattggtncaaaagtggcaattcctttccttnttggcaaattttgcccaaccaaggantggggaccaaaagaaaccattttgggccnaaatggggcctttaccttggccgcctttggtggcccgaagccttttcaaaatttgggggaggtttcgaaagnaacaattttcaatttttgggataaaccttggaaaaaggtttctctttgggaagttttaagaggggaacctacccctggtccaaaag

SEQ ID NO: 15465 - DNA, 632 bp, Triticum aestivum
  unsure (1)..(632): unsure at all n locations
  Clone ID: PAT_TA_15465
gcacgagggtggaatccttctctgtgtaacaggctcggaagctatgtatgcagatcttggacatttctcgcaacgatcaattcagattgcgttcatatcagtggtttatccagctcttgttctggcttatatgggacaggctgcctatatctctcaacaccacagctttgagaatagctatcatattgggttctagcgtccgcggacgcgtgggctcagatggcctgttctagtgatcgctatcctagcatctgtagtcggaagccaagcgattattactggtaccttctcaattatcaagcagtgctctgcactaagttgcttccctggtgtaaagatcgtgcacacatcctctacggtgcatggtcagatatacatacctgagatcaattggatcctgatgatactgtgtctggctgttactattggcttcaataacacaaagcacttggcgaacgcacaaggtcttgcggtcataacggttatgcttgtcaccacttgtttaatgtcattggttatcgtgcttgtctggaacaaaagtatcttcattgcccttggtttcctgatnnnctttggctcaatcgaagtaatgtacttctcagcttcccttggcaagnnncatgnnnnnncct

SEQ ID NO: 15466 - DNA, 634 bp, Triticum aestivum
  unsure (1)..(634): unsure at all n locations
  Clone ID: PAT_TA_15466
ggngnttgatacccagcttnnatcncccgcttgaannnancctnanttgaggntcaaangctggagctccaccgcggtggcggccgctctagaactagtggatcccccgggctgcaggaattcggcaccagccagcctcaagccgctgccctgagctctcctacaggccggcgacaccactctgattaggagtcacgcatgtggccggcatagcattctggtcaccaactgccctccaggtgtgagctgttttgctcgtggacaatctcatgtgttggatctacattggatggcaaataagcggagtgggagcttgcagcagcagatttgaccccttcccaatgagctgcaggtcgtagacgaggtcccggccgagaaaaaaccttgctgggtccaaagttgtctagatgcatggtgaatgatggctgagatatggtgcgaaatggaatagaaagaaaattcttgtgcctgcagggagcggaactgaatatgatcggggggtcacagtcaagagagtgcttccttggcatgctaccaaagggaaatggtgagttgtcacttgaaactatcatcttcgttctcaatttatttattttagcaaaggcaaaatattctaggttctgctcttcattta

SEQ ID NO: 15467 - DNA, 766 bp, Triticum aestivum
  unsure (1)..(766): unsure at all n locations
  Clone ID: PAT_TA_15467
gagnnttaancctttgntttnattcncnagctcgaaattaaccctactaaagggaacaaaagctggagctccaccgcggtggcggccgctctagaactagtggatcccccgggctgcaggaattcctctatccatttatcccctccactcccagccaattcaaggcttctcgcaggccttgcggcaatggcaacatcacatatgaccaccatcgtcttctccgccatcgtcttcatgcttctttccccggccatcgctgctcagagcagcggcgacgtcggtggcaagaagcccaagccgaacgacttcatggtggaagcgtgcaagaacgcctcggccaactccctcgtatacgacgaagggtccaacaacgtgacccaggaattctgcatctcgaccctccggtccgacaaccggagcgcggacgccaagaacctccgcgacctggcgctcatccccgtcgacatcctcaagcagcgcgtcgtcaccgccggcggcaacgtcaaggagatgctgcacaagaccaagaacagcacgtcgccgatggcgcgcaacctcatgatctgcgagctggggtacggcgccaccgtgggcatgttgaacttatgcggcgccttcctgagggactacgaaggcgacaacacaagcgaggactatgacgggccgctatctttcgagctatacgactgcgtcgacgacctgaacgtctgcgactactgcggccgagacacgctttttcgtatgccgggggcagagcctcggctca

SEQ ID NO: 15468 - DNA, 834 bp, Triticum aestivum
  unsure (1)..(834): unsure at all n locations
  Clone ID: PAT_TA_15468
agngntnnntttnanacccttntanaaaccttccctactaaagggaacaaaagctggagctccaccgcggtggcggccgctctagaactagtggatcccccgggctgcaggaattcggcaccagatcaccaccgtctcgactagcacgacccatttccgccggcggcgctgcttgcactgctagcacggcggacgtccccagcgcgaacgagcaggtagaggtaagcatggagcgcattggcgaggcccaccaggtgcaccagctgcagcaggtccagcagcagggggtggcggcggcgtcgttcggcgtggtcgagcactccgtggtggcggcggcggcggcagccaagccgagggcgccggggctgccgccgacgccgcccgcgtccttcgccgggcagcagcgcggtgcgggcggcgacgtgtgcatggacgactcctcgggggcgccggggcgcaagcaggcgcaggtcgtgccggcgcaccgccggacccgcagcgacgtgccgttcgcgggctacttcccgccgccgacgcagcagcttgccgcagcccaaggcggaggcccggcggcttggggcgacggcaagcggcggcgacgaccttgttcagctcgtacctgaacctgggagggggatgggacgtgctcaaacttctcggttccccccgaacaagcaagcgcccaaaggccccgacaagcaagccgaagaaccgggcggaacttcccgaagggaagtgcccccccgcggtggggggcccccttggcccccccgggccctctaaaaaggaaggaaaccggccccccccngggggaaagccccgggccgaaatggg

SEQ ID NO: 15469 - DNA, 1016 bp, Triticum aestivum
  unsure (1)..(1016): unsure at all n locations
  Clone ID: PAT_TA_15469
nnnngnnttgganacgcnngntttgattccccngctcgaaattaaccctcactaaagggaacaaaagctggagctccaccgcggtggcggccgctctagaactagtggatcccccgggctgcaggaattcggcaccaggctaggtgcaaagtgcaaactacaatggtgggcactccaacaatatccgttgctatggttctcgtcgtgcttgccctcatgtcttatgggctcccctcagcacatgccgatgtcgccttcatatccaacacatgcaagaaaaccaagaaccccgcgttgtgcgaggatgtgctgagctaccatgaaaatagcacccaggcctccaccgtgcatgagctcgccagcattgcgctggagatagccaccgccatcgcaaaattcaacagcaagaacttcggagtcggggccagatacaaccagggcacacccgtggaggacgctctggacgtttgcctccaggcctacgatgatgctatagataacctcaaggtccttgccaaacatagtctccatgtgggggactatgccgatgcgttgaggaaggtgttggacgctaaggctgccggtgatgtgtgcgataatgcgctcaagcggatcaaagaggatttcgctgttgaaagtgatcgcaaaatgacggagcgatgtggcgtcactgctgaactaatcgggctttttattcacacgtgatagaacataaaccatttctcgctcatctatgtattcctatcaataaataggtaattcggcgccttaaaacataaaaaaattcaatattcccgttcttttttctcttaatgtttctatggcccctcatcctctctcctactactcccttggggggtgccgcgttcccacatttctccttaatgggctctcatttacaaaaaacgggggggcggctgtataaagcatgntcgtggtggcaaatcccgcggtattccccctattaatcctctctgagggtaaaatactcttcttaaccgcgaccgtgtttcacc

SEQ ID NO: 15470 - DNA, 744 bp, Triticum aestivum
  unsure (1)..(744): unsure at all n locations
  Clone ID: PAT_TA_15470
ngnnngtntntntcttttgntgatccaattaaccctactaaagggaacaaaagctggagctccaccgnggnggcggtcgntntanaactagtggatcccccgggctgnangaattcngnncgagggcgtttgagggctgcgaccgcgtgcacgtcgtggatctcgtcatcaagcagggcgtgcagtggacaaccctcatccaggccctctccatccgtcccggcggcccgccgtccgtccgcatcaccggcatgagctccgcgcccggcgtcgacgaagctggactccgtctatgcgagctcgggcgtgccatgaacgtgcccttctcgtttcaaaggttcaccgacgattgcctggaccagctcaagccatggatgttccaggtcctgcccggagaggcggtggtcgagaactccatgtggcagctgcaccgcctgctggtggacccagacgccgcgtccacgtctatccccacgcccatggacgtcatgctcggctggatcgcgtccaggcagcccatggttttcacggtcgcggagcatgaggcggaccacaacatgccgaggctgccgacgcggttcgagaacgccatgttctactatggctctgtgctcgactacatggaggccatgtacgatagccgcggatgtgtcatctgcaacagagcccgagccgacgccgtacgtgcagagggagatctttgtcatcgtctggcgggaggcagcgtacgnaccgagcgctata

SEQ ID NO: 15471 - DNA, 620 bp, Triticum aestivum
  unsure (1)..(620): unsure at all n locations
  Clone ID: PAT_TA_15471
gnannttggnncttannnagnaattctccttngaatcgaccttaaccctactnaagggaacnanngctggngctncaccgtctatggactnagtggatcccccgggctgcaggaattcggcacgagcggccacaggcgcaaacctcgctctccctcactctctgaccccgcccgcttttctcgagccccttccgcgcagagcacatcgtactcgagggagtggagtgatcaggggggtgcagctggttcttgagactcactcgagcgacctcgtactacatcacccatggcggcggcggcaccgctccggcccctcagggcctccattgcgctactcctcctcgccctcgccctctccgcgctcgtgccgtcgtcggatgcgtacgattcgcttgatccggttgggaacattacgatcaagtgggatgtgaagaagtggacccatgacagctgcgtgagctactgtatgactatacatctactatgcgccctaggacattcgatcgcctggtggaagcaacctgtgtgccgcgcagtgcatctgagattccgggcaggcccgccgcgatcccgagcgaattgcccgcgctgttcgtgcgcgcgtctgttngtcannncaa

SEQ ID NO: 15472 - DNA, 742 bp, Triticum aestivum
  unsure (1)..(742): unsure at all n locations
  Clone ID: PAT_TA_15472
ngncgtntnnntttannatgacnnaccctnttaaagggaacaaaagctggagctccaccgcggtggcggccgctctagaactagtggatcccccgggccgcaggcggcccgcgccccattgaattggctcgccagacaagcgctgtggctaaacccagcacacagagagatagcagcagcagcaggccatggagaacggcgagggggcgtacgcgcaggacggatccgtcgacctccgcggcaatcccgtcctccgctccaaacgcggcggctggaccgcctgcgccttcatcgtcgtgtacgagctgttcgagaggatggcgtactacgggatcgcgtccaacctggtgatgtacatgaccaacaggctgcaccaggggacggtggaagcgtccaacaacgtcaccaactggtcgggcaccgtcttcctcacgcccctcatcggggccgtcgtcgccgacgcctacctgggccgctactggaccttcgtcgccggctccgccatctacctcatgggcatgatcctgctgacgctgtcagtcaccgtgccggcactgaaaccgccggcgtgcgacggcgccagctgcccgcgcgcctcggcgctgcagctgggcgtctacttcggcgggcttgtacaccatcgcgctgggccacggcggcaccaagcccaacatctncaccatcggcgccgaccagttcgacgacttcgacccggcggagaagctgcacaagctctcctttt

SEQ ID NO: 15473 - DNA, 781 bp, Triticum aestivum
  unsure (1)..(781): unsure at all n locations
  Clone ID: PAT_TA_15473
agnnngtntngntttntgttgcccaaattaaccctactaaagggaacaaaagctggagctccaccgcggtggcggccgctctagaactagtggatcccccgggctgcaggtcttcggctcgcccttcttctcgcctcctccctccccgccggcccgccattaatgcgcccctctcctactggggcaagtggtcaaccagcttagcacgggcaaggccggccttcccgtgatcggccaagaggccgacggacggagacagataccaaagtcagaggagtagtatatataatccggccttctcgccggccggggtgaagagagactctgccgttcgccctcgcctccgagaagtggtatcgcctgcctttgctcgggggactccggtgatctgtcgtttcgttcgttgcttgctcgccggcggccatggggaactgcttcgggagcaggatcggctccgacagcccctacaagagcagcggcggctccgcctccccctcttcctcctcagggtgggtgtggaggaaggaaggggaaagggggcgcgagcgtgtcgagcagccgggtgtcgtcctcgccgtcgacgacggtgcccgccgacgcccgacggagcgaggggcaagatccctgccagtcgggccaacggtcaaagagctttcgcctttcaacggaagcctcaaggaccggcgaacccccggaaactttaccgggcccggacaagccgtcgcttcgggcgtaggggccggctttttcgggctacccgtctttcaaaggggcctggggg

SEQ ID NO: 15474 - DNA, 1250 bp, Triticum aestivum
  Clone ID: PAT_TA_15474
ccacgcgtccgggagaaggagaagaaggacgacacagcgggggaggagaggggcagtgctgggtttatcttcatgtgcaatggaaagacgaagccggagtgcttccagaacagcgtgtttggcttgcccaaggcgaagatagatgtggtggagaagatccgaccaggggcgaagctgttcctgtatgactttgacctgaagcttctctatggggtgtacaaggcaacggcaagaggagggatggatcttgtgcgacgtgcgttcaacgggaaattccctgctcaggtcaaattcaggattgataaagattgtcttccgcttcctgagagtagtttcaagcatgccattaaggagaactatgattcaaagggaaaattcacccaagagctcaattctagacaagtccgtaagctactggcactatacaagccaattaacatacaacagccatcttcccaacatgttcaagaagttcctcggacaaaccgtgttgaaaggcgcatgcctcactatgttgaagaaaggcgacagccatatgattatgaagaaaggaggctgccacgatatcgtgaagaaatgcaacacccacaatttgctgaagaaaggagattagcctatgattatgaagaaagaaggccatcactccatgttgaagaaattcgacgcccacagtttgttgaagaagctcagccacctacatactatgttgctcctgctcctcatggttcataccatccacatcaagctaatatcatttatgaaagggctccagctgagcccgccagcagggtggatccattccttccaagagactacaggctgccgccgcaggaggtcgccgcgcaccccagctacgctgacgagatctaccgtggtgctgcttacccagccgctcaggacccgtcctacgcggccaggcccgccgcttacccggcaaacctcccggggcctgctgcttcaaagggtgccggtgtcctccctcttactcgttcgccggcgcaccggcgtacagatgatcgctgcagcgcctgctcttgaaaccggtcctgaccagcatgattcgctggttggtggtgtagctagcgtcgtcttctgatacatactgtagtcgtttgttggatccctgacttggatgtcgtttgccacaagtgtggtacctggaacgtgtcgtttgccacaagtggggtgctggaacgtgtcgttcgctgttaaacaagtgactttcctgcccgtgccgaattcggcacgag

SEQ ID NO: 15475 - DNA, 558 bp, Triticum aestivum
  Clone ID: PAT_TA_15475
cttgccggagaggaggtcggcgccctcaccgacgccacagcaaggagcagcagcaatgagactgccatggaggacttgctcgcgctcgcccgccggcggggcctcctctagccacccaccaggcaggagccacccagcagccaggagcagcaatgaggatggctgccgccaggtccgtcagtcaggtacacaagacaagaatgaacacctgctctgctggtgcttggccatggcattcagtcatgcctaggaagagaaagatcttaatgaattgtagttctttcagcaccaacaactggattagattggattggcatagattacagcaactcagatgctctcctgggcgctatgtctcttatgtctgtaaaaaggtccgtctggctgatactccagccaatgaactctccctgtcctgcctctgcctggcctcggccttcagtcctgccccgggcgggtgcgccctgtatggatcgccccttttcttcctaaaatccagtgcctggctgatgctccatggaatgtactctctctgtcctccctcgacttattaactga

SEQ ID NO: 15476 - DNA, 916 bp, Triticum aestivum
  Clone ID: PAT_TA_15476
gtccgcccgccccgccgcccggaaacatgcattcgagagagatgatctcgtgaagacgctgcgaaggttgatacgtgaaatctctcagattgactcagctgactcatttgtcgacacaaaaagtaagaccgaagctgtgcaagcatgcagctggcttgacaacaggctgaaagagcaggggtcaatctcaatatatgaagttcctccttccctaacatgtaaagatatacaaaactggattgacaagctaaaacaagtgacagaacccaaaagaccggagataactgagactagcaaagtccatatggctttcctaacaggattgatcgttggcaagaattttcttcagcctatgatcagccagagcctcacaaaaagtggtcttgaacttccaatcatcagtagaagaagtgtgcagcaggcacatggtactggtttgggtcaggtgatgtcattagcacatgaaacttcatctggccctgttgctgggagttcaattgaggattatgtgaccagcatacctatcccatcaacaccaatttatactggcgagacccttttcgaaattttttctattgagaccaacttaagcttgataagtaccattgtactttatgacgatcagggtggtactctagtataccagtcaaatgaaggaaataaggaaaagtttattcgtcggcgctctaagtggctgtcaaagcataccggaaaaatcgcagctgatttcaccgattctcttattctgataggaccgaatcgtcctatgactgctggtgcaggttgttggatttttgagatcaatgtgcctattgagtcatctttgggggtggaagattctgaattctctgatgcaatatttgagacaaccctctgtttggatgacgattattttggataggtcacgttgcagctt

SEQ ID NO: 15477 - DNA, 642 bp, Triticum aestivum
  unsure (1)..(642): unsure at all n locations
  Clone ID: PAT_TA_15477
gngatnnttntnnnccntnnnttntgnttacgccaagctcgaaattaaccctcactaaagggaacaaaagctggagctccaccgcggtggcggccgctctagaactagtggatcccccgggctgcaggaattcggcacgagcggcgccgttcgacctggaagcggccgtgtgcagccacgggctgttcatgatggcgcccaaccgctgggacccggcctcccgcgcgctcctccgcccgctccgcctcgcctccgaccgctccaggtccctgctcgcccgcgtctcccgccaccccgcgcgcccctcccgctccctcctcgtctccctcttcggcgccgacgccctctccccgctcgaccaggactgcatcctcgagcaagtgcggcggatgctgcggctgtcggaggaggacggcagggtggtggcggagttccaggcgatgcacgccgccgcgagggaggcggggttcggccgcatcttccgctcgcccacgctgttcgaggacatggtcaagtgcatcctcctctgcaattgccacagatggacaagaacattggcaatggctactgcgctgtgcgagcttcagttggagttgagacattcatctggtactgaagttcttgagttaaggacacctccaa

SEQ ID NO: 15478 - DNA, 1108 bp, Triticum aestivum
  unsure (1)..(1108): unsure at all n locations
  Clone ID: PAT_TA_15478
ngnncgntttgttgcttccctagctcgaaatnaaccctactaaagggaacaaaagctggagctccaccgcggtggcggccgctctagaactagtggatcccccgggctgctgactatcaattcatccccacctctctctcagctacaaagcctacaatacaatttcagctatccttgcagcaatggcaaccgcacgggcgaccgctgccttctcctcggttgccatcatgctcctttttgtgtgcgtcggcgcacatgccggcgggcgcggcgacaaggtcaaggtggtggacctcgtggtagaaacctgcaagaacgcttcgagcagctgccgcaacaagcacctgaacgtcacccaggaattctgcgtgcagactctccggtcggacaaaaggagctccaaggccaaggacctccgtgacctgtccctcgtcgccgtcgacatcctcaagatccatgtggcagctgccggcggcaaggtgaaggaagcactccagaaagccaagaaaggtacggacgaggcgctcggcctcaggtattgccaggtggactacgatgccgctatcggcaccctcggtctctgcgacgccatgctcagggacttccatgtccccaggggcgacgcagacggcccgtggtcctttgaactgcccgagtgtgtggagaaggcgactgaccatgtcagcgactgctggcatgatcttcacatggatagccagacacttatcaatgaaaacgaggagctgatcaagctgggtgacctcaacaatgtcttgctagggccatatgactttgatagttaataatctattttctgccagaaacaatgttcatgtaaaaccaacattactttcgtttgaaataataataataatgttgtttcgatatcgagtataccccccacccccgagaaacactcataccgtgcaaaaaatctcaaatattttcaaactattgaattcaaacgctcaactgatagttaaatatgtggcatctcttaatgaacatcatgacaggtcatggcctaggtggcaaagccaaggtttccgcggcagcaagtctcgggttcgagtctggatgcaaaaagtaaaaacgtcgaactcacgac

SEQ ID NO: 15479 - DNA, 680 bp, Triticum aestivum
  unsure (1)..(680): unsure at all n locations
  Clone ID: PAT_TA_15479
ngnngngttgttactanctcgaaattaaccctactaaagggaacaaaagctggagctccaccgcggtggcggccgctctagaactagtggatcccccgggctgcaggaattcggcacgagaaaaaaacaaccaccgtacctcccaacgcaacccactccctccccgatctagccaccatccccgtgcccccacttcctctccgatccagccacccaccatcgccggcgccagcccgtcccgagataacggccaccgcgcagccccgccccgagaaccggtcgccgcgtcgccccccgccacggattgtgtcgttgccgccgcttccctccccggatcgcgccgctgcccccgtcaccctccacggatcatgtcgccgnncgcttccttcccggatcgggcccgncaccgtccgccgctagctacaagctgcctctgtcgtccttctctagttgtcgctgcagaccaccgctagctctcgtgggggatgtggtgcggctccggctgccgccgtgaacggcgtccggacgccaccacggactgccccccggcgccgcctccagcccgtatccgcaacagcctcgggacaaccctcgtccacgcgtgcgactagctgctcaaacttcccctcgtcggccatcgtggacctctgtatcctctcatggcggctctaaggtcgagg

SEQ ID NO: 15480 - DNA, 1443 bp, Triticum aestivum
  unsure (1)..(1443): unsure at all n locations
  Clone ID: PAT_TA_15480
gaattcggcacgagcccgccgccgcctccgggggagctccggggtcctagagtcccagcggcgatggcgtcctccatactctccgactgctcctcctgcgcgacctcccgcctcctccccccccgcccccccctcctcccgccgtcgccccgcttccgcccctcccccggcccggccccgttgccgaggaggcctctcctcgccgccgccaccccgctcccgctcctcccccgcgcgcgccgcatggccgcgctcgccgccgccgcctcttccgccgacccagcaacagttttggccgatgcgtctgcaaagatcatcgacgggaagttggtggcgaagcaaataagagaggaggtcggcgttgagatcgcccggatgaaggacgcgatcggggtggtgcctgggctggcggtcatcctagtcggctcgaggaaggattcccagacctacgtgcggaacaagaagagggcctgtgatgcggtcggtatcaagtcgtatgaggtcaatctgccagaggacgcttccgagtacgaggtcatcaagcacatagcaaccttcaacgatgatccgtcggtgcatggcatcttggttcagctgcccttacctcaccatatgaacgacgagaacatattgaatgctgttagtattgaaaaggacgttgatggctttcatccagtgaacattggacgacttgcgatgcaaggtcgggatccattctttgttccatgcacccctaaaggatgcatggagctgctacacagatctggagttgaaataaaagggaagagagctgttgtaattggaaggagcaatattgtggggacgcctgctgctttactcttacaaaaagcaaatgcaactgtgagtattgtacattcaaaaaccaagaaccccgaggaaataacaagacaagcagatattataatcgcggctgttggagttgctaacctggtcagagggagttggataaagcctggagctgctattattgatgttggcatcaatccggttgatgatccagcaagtcctcgaggttaccggctagttggagatgtctgctttgaggaagcctccaaggttgcaggagccatcacaccagttcccggcggtgtcgggccaatgacaattgcgatgcttctgtcgaacacactggattcagctaaaagaatccacaaattcaagtaaccggacaaccctgtagtcagaacttcggagagtgcttaacgtttggcttagtctacaaggcaaggatctgccaactgttctatgcgccttttgttggaccagaaaaaggtcaacaagagccgtgaaataaattttgacaggggtgagaaatttaccccggcttcaaactgtaccgtattcgctaatgttccatgaaacccccccccatccgtggacaacttagtcaattgagatccanttagctggatgaacgtagtt

SEQ ID NO: 15481 - DNA, 973 bp, Triticum aestivum
  unsure (1)..(973): unsure at all n locations
  Clone ID: PAT_TA_15481
nagnnnanngttgtttnatcccttactcgaantnaaccctactaaagggaacaaaagctggagctccaccgcggtggcggcccgctctagaactagtggatcccccgggctgcaggaactccgcccgccgcgacggcggcttcgcccattccgtcgtgcgtcggcgatggccgccgccgtgcctcgcgcgggaggacggagggcgctcgccgggaggatggaggacggcgcggcgaggcggggcagtggtggtggcgtgtgcggcagagacggcgcggcaaggccgggcagtggcggtggttgaccggccgtcgtgcctcgtgcgggaggatggacaacgctcgccggggcgtgtgcgacggagacggcttctgccgcgcgtcgaggtggagcagcagaggacgggaaggcaaggaggcaaggtgggtacgctatgcaccagggccgccttcgcccttcaccttctccaaaagcgcgcgctcgccgcgggcgctggcggtggcgcggcggtcctccccccccggtgcgccggtgccccggagcctcggggatcgagggagctctcctccctagcagctggaggcgctcgggatcgaacgagtgggcgaggggatcggggcccctggtggctgcctgcttggcgattgcacgagatgctgctcgggcgtgggctggccgactcantctccncgacccagggccccgtgctcgtcagcggtctgcnccatcgcgcacaacttctcngatccagcgccaanttccgagaaccatgcggaactcgacctggaggnactccacctaatgggagggcagcnccaagancggcnacngnagtattggacttgcngcnagcaaganggtggaaggaggcaatncaaactttgtnagtaangttccngttgagganagaacagagagaggaaagacaacaangggaattnggtgaaagcgaaaaacngtncgngtgaaactc

SEQ ID NO: 15482 - DNA, 620 bp, Triticum aestivum
  unsure (1)..(620): unsure at all n locations
  Clone ID: PAT_TA_15482
gtntnnnttttttcctttgattcccttagctcgaacttaaccctcactaaagggaacaaaagctggagctccaccgcggtggcggccgctctagaactagtggatcccccgggctgcaggaattcggcacgaggcgaccaccagcaggggggctccgacagccagcagcagctgcaggagcgccggaagcgccaacgccgccacacaccggagcaggtccagaagttggaggagtcgtacaagaagtccgatcaccccagtgagatcgagtgcgctcagcttggacgcgagcttggtctggagaccaagcaggtcagatcctggttccagaaccaccgcacacagatcaggattgagcacgagcggctggagaatcgcttcctccgctgggagaacatgagtctccggtccgagatcatggccgtgcgggaggcgctcaagaactccgctacctgccccaactgcgtcggcgtcgccaaggactgcatcgaccagcaggagctcaatcgggagaacgctcgcctcaatgcggggctcctccactgcaccacatctttccaagaggagccctagctttactttttgcatgtcgatgttcctccgccatgctttcggcgagg

SEQ ID NO: 15483 - DNA, 507 bp, Triticum aestivum
  unsure (1)..(507): unsure at all n locations
  Clone ID: PAT_TA_15483
gcacgagggattatttcattggaatgatgaaatcatctgctcatactgtggatcccttggttgttgcatcgtattttccattgtcccaatgcataaagggcttaaacgtgctggtggaatcattatttgcgtccgcatttcatcaagttcctatgggggacggagagtcgtggcatcctaatgtgataaagctttctctccatcaccctgatgagggtgatttaggatttatgtatctcgatctctactccagaaagggtaaatacccaggatgtgctcattttgcaatcagagggggccggcgattgtctgacatgaactaccaacttccaatcattgccttggtatgcaacttctcaagttctaggggattaactgcaaggctcaaccattgtgacgtcgaaacttttttccatgagtttggccatgcccttcatnnnntgctatcaagaacggaatatcagcatttctctggtactagagttgctctcgatgttgctgaaacnn

SEQ ID NO: 15484 - DNA, 772 bp, Triticum aestivum
  unsure (1)..(772): unsure at all n locations
  Clone ID: PAT_TA_15484
gngtgttgannccntngnntttaatacccntactaaagggaacaaaagctggagctccaccgcggtggcggccgctctagaactagtggatcccccgggctgcaggaattcggcaccagaatctctcgatccccaaccaccgccgccaccgtcctccgcctctcccccaaccccagtcgtcggcgacccctccccttcccttctctcccacggccgcggtcggatccgcgctccctcctcgctcgtgacctggacctagccgcatggcacggccatggccatggcagcggccagatccaccccctcccctgctccgttccctcgacacccggtggtcattctcccttatgccacccgccccccttcttcctcccgcggcagctcacccgcagccttccccgtggctctagggttttgggggcggcggcgcctccattgccggtatggctccggcgactctacaggctcctccccgacatctactgcgctgagacagccgcgtctctgacttgccgcttccccagtggctgctactggacccgatccctcctcgttgcctgtatgcttcctcgactctccctcctccccaacaaggccgccgtcggacaccttcttccccgacagcgccgacggagatccactcctccattttcttctcacggttgtccgcagcatatatgactcagatctgacatttttggtgggggtctgctttttcaggatgtgggtggggcaggggccgcatggcctccctcggaaaacgcctcgggna

SEQ ID NO: 15485 - DNA, 630 bp, Triticum aestivum
  unsure (1)..(630): unsure at all n locations
  Clone ID: PAT_TA_15485
nncgngtttgttaccngctcgaaatnaaccctcactaaagggaacaaaagctggagctccaccgcggtggcggcccgctctagaactagtggatcccccgggctgcaggaattcggcacgagttcaccgccaagctcgaccaacaagttttttggttcatgttcaatgggaggtgaagagtgttgagcaggtattgatgcaggtccaaggtaaactctatttttcttcttttattgtgtttattagatgaacatgtcaaaggtgcagatggacatgatgaagccgtgaattgtcacgcaggtcattgagcttcttgggtttgacacagctcaccctcgtctacgaaacgaaaaatctcggcatgcctaaataaaaggggtcgtgggttgcgaatcaaaaaaacccggttagtataaataaaggaaattatgggctcttgacgcgaaaaatctagttgacataaataaggcgattgtggctccgaaacgatttctcaattgacaggattgtgttgctaatgaaaaataaagcactggctgtgaacgaaatacgcaagctcccagtgctaataacggcctggtgacactcagtttatctatgttttcattaaggctgattgccccgtgaccc

SEQ ID NO: 15486 - DNA, 694 bp, Triticum aestivum
  unsure (1)..(694): unsure at all n locations
  Clone ID: PAT_TA_15486
anaaaaaatttttaacctntaattcccttaancctnactaaagggaacaaaagntggagctccaccgcggtggcggncgctctagaactagtggatcccccgggctgcaggaatttggcacgaggtctcgtctccgcatagccattctccccaaatcgcccctccgcagaaacgggagcagcgcggcggcacccctgaaccctacctcttcccacccatgggccttccccgccggcttcttcccctctttctccgccgcggcgggcgccttcccttcttccccggccccacccccacccgcgccctcttcacgggcgccctgccggccgacgccctctccgcggaggaggaggacgactccatcaccatcaagggcgtgcgcatctccggccggccgctctacctggacatgcaggcgaccacgccccgtgggaaccccgcggggtgcttcgacgcccatgccccccctttctaccttctcccgcctacgggcaaccccgcacttcccgcaccccaatctcttaacggcctggggaagttcgggacggccgcccggtcggagggaaggccccggcgccgccgccggttggaccaggggcctcaattcgggcggcccggacccccccaaagggaggaatcctttcnttttcaaccctttcgggggccggcccaccccggaagtggcgcacaacna

SEQ ID NO: 15487 - DNA, 862 bp, Triticum aestivum
  unsure (1)..(862): unsure at all n locations
  Clone ID: PAT_TA_15487
cgtccgcggacgcgtgggcggacgcgtgggtgcgacgaacttgtccagaactctccagtcagtggcagcttggtcgtcgacggcatggtcaataagttgaacatggtggtgctgggcatggtgcacattgatttggtgatcgtctggcgataccaaaagagagtggaaggaagaagggctctctagctcgtgagggatggtgttgagaacatgatgatggtttggcatttgatattgcagcttcagctctctcttgtaggtgttgttgagcatctggaggtgttgttcttgtagtgccatgctgtggtgaggtggcattcctctcatgggagagttgagatcatgcatgaagggcccatcatcgtcgacgtaccagcatggcgcatcatgatctagatctcttcttgttgtcgaggagcttgcaggtttatattcgagtcaagatggacagagatcgatgtatatcaagtgaaataacatagctatagcttgcctgtggagggccgttctcattggtctcgaggcggtactcatgcatgatccaatcggatttctggccattgggagctctgcccttgtaatacaccagggtcttcctcatgccaaccaagcagtgctttgcatagatgggcttgtccctccctgtcgccttccagaaccctgcagcagtcgcgcggtttgtccgagtccccgtcgggtacttcttgtccttgtggctgaagaagtaccagtcactctgctcctcctcaggccctatcctgcatttctctgtacacaaatgaatgtaagctaaatcagcaaaaacatattaatttgtgttgtcaagactcaagactacattaagctgtcattgcnaattgga

SEQ ID NO: 15488 - DNA, 691 bp, Triticum aestivum
  unsure (1)..(691): unsure at all n locations
  Clone ID: PAT_TA_15488
ngnagatntgtttccttcctngnaatnnaccctactaaagggaacaaaagctggagctncaccgcngcggcgggcgntctagaactagnggatcccccgggctgnangaattnngtacgaggaaatccggcccgtccaggcccgagtgctgtcgccgccggtacgccgacaccaccagcgcccgaccctgagctcctcctcccgtgcgccttctcctttgtcttcctcgcgcgtggtccggtgaccggcgccgatgccggcgaccacccaggtcacgccggcgtttccctgccttgtgtgtgtcccctctctctgtaatctccttgtatctgcgcgcttccacgagatcagtggcagggtcatggatgcccactcctcggagctcgaggtttgaacgccgccacgtgacctgcactgggcagatgccgcgcctacctacgggatctgcgcgccctccaccttctctacccgatccggggccgtccaacctgcgatgacctccagcatggagcttctgtagctcgtgggctgcctcctgtttctgtgctcgagggaggcgcgcctccagcgcaagcgaagcacaaaggccaagccgtgccaaagacctaaccgcgaccacctcttgcgtgacaaaccgacataccctgcgcgacgctcgaaccggtgtcgcgccaaggcgccaaccgacgcc

SEQ ID NO: 15489 - DNA, 930 bp, Triticum aestivum
  Clone ID: PAT_TA_15489
ttcggcacgaggcgggaggagaggagatggggctcacgttcaccaagctgttcagccgcctgttcgcgaagaaggagatgcggatcctgatggtgggtctcgacgccgcgggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggtagattcttacactactcaaagggtcccatctgcattacttgttggactttatcccagcgatttcgagtgctgacagttcacatgttcactggttgcaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacaggggagggactgtatgaaggcctggactggctgtccagcaacattgccaacaagtcctaaattttcgtcaagattttgaaggagctaggagcgctttggatggacgattgaatcaccgggtacctagggattgtgttgggatgggatggtgctatgctattcccgtatgtactgtgtattttcctgagatcaacagctactgagccagctccggctgtggtttcactgtcatactattgttttattgtattttgagccctaagatgtttcttctgaagtaaacagctaaagagagtcctgttcaatttcgtaataagt

SEQ ID NO: 15490 - DNA, 756 bp, Triticum aestivum
  Clone ID: PAT_TA_15490
attcggcacgaggggtatgcttgctgatcctaaggaggcaagagctggcatcagggaagtgcacttcttgccattcaaccctactgacaagaggaatgctctgacttacatcgatgctgagggtaactggcaccgtgccagcaagggtgctcctgagcagattattacccttgtgcaactgcaaggaggatgtgaagagaaaggtgcactctgtgattgagaagtacgctgagcgtgggcttcgttcgcttgctgttgcaagacaggaagtacccgagaaatcccaaggattctcctggtggaccatggcaattcattggtctgttgcccctgtttgatcccccaagacatgacagtgctgagaccatccgcaaggcacttgttcttggtgtcaacgtcaagatgatcacaggtacatacactgtcatacaaatttcttgcttagaattttgcatgtttggtgcaaatttagctaaacatagttatgtgatttatttcaggtgaccaacttgctattggaaaggagactggtaggaggcttgggatgggcacaaacatgtatccttcttctgcattgcttggccaaagcaaggatggttcacttgagtcacttcctgttgatgagctgattgagaaggctgatggatttgccggagtcttccctgagcacaagtatgagattgtgaagaggctgcaagagaagaagcacatcgttggtatgacttggagatggtgtcaatgatgctcctgctctta

SEQ ID NO: 15491 - DNA, 444 bp, Triticum aestivum
  Clone ID: PAT_TA_15491
cgtccgctggtccgccccaagtccctcctcgtctcatgatctagccaaggaaaaacagggtggcgtgatgccctggtcgtcgaccggcggggagcctacgtagaggcggtggcggagacgaccctagatgggccaagatctggacagggcgcctcaacctcgccttcctcttccacgtactcgctgatagagagacagcagcagcggtgggaggagcctgggcatagaggagagaagtggaagagggggtgcaaagccaggagatggggtcgccggatgagcacagccgcacagggcctgatcccgccgctgccagagcagagtggaggaccacacggggcccgatggggtggccgggagcgcgcggcacccggctcccaagaagggaatgcagcggtgctggcctctcctctccccgcgcctctgtcctgcgtcgtcaccacc

SEQ ID NO: 15492 - DNA, 564 bp, Triticum aestivum
  Clone ID: PAT_TA_15492
gggctgaatttgctaacttcaagtgaataaaatatatgtacatgaaaggagatccatgacccacactggattctaatacagagagaattacagcttgttaaaaaagtaaacacgtgcttaaacagagggataatgtacttgaggaacatatatacagatttcgaagtatacatgtacaggatgacacctcccaagtcttttagacctttcaagcaagttgctccgacgccgtccaacttttctgaccatcaatcaaaagctcaagccgctttcttgctcttgaacctgttggcgcacagcacgtacaccaagaagttgagaaagctgagccccgcgagcagccagaagaagttatcgaggcgcccctcgttcaggttgtcggggatccacccgggtctccctcccctcgtcgtgaagtaggcgaccatggtgaggatgaaggcgctgaggtagttcccgagcgcggtggtgatgagctgcagcgcgctgcagaggctcctcatggcgtccggcgactggtcgtagaagaactcgagcgccccgatgaaggtgaacacctccgag

SEQ ID NO: 15493 - DNA, 616 bp, Triticum aestivum
  unsure (1)..(616): unsure at all n locations
  Clone ID: PAT_TA_15493
tcgagcggccgcccgggcaggtactcggtagatcggttaacgggacaacatatgctggaattcgagcaaggaccaccggcgctccgcagaaccactggtttggtcctgccggtgacccgagaggcgcggggatcggcactccagaagccatcaaactcgtctggtcttgccacagggagatcatatatgacattggtcccttgcccaagaagtgggcacttcctgcggctacatgatatgcctaggctaggacaactagctagaagaacacgacggcgatggagagaaagcaacacggacagaattagctggttgagaactgacattgtgttgaataatggaagcctcgtgtaggcaattgggagagtctcgacccccaaggaacacaataaaggtcataattatgaatggaagtacaaatccactggaatcctgcgttatgagcgcgtgtttggggagggttatgtcagcaccggtggattcgagaccacaaaagaatttgtggacaagctggatctgaaagctggccagannntgctcgatgttgggtgcggcatcggnnnaggtgacttctacatggctgaaacctatgatgtccatgtcctcggcatcgatc

SEQ ID NO: 15494 - DNA, 651 bp, Triticum aestivum
  Clone ID: PAT_TA_15494
caggggttggcttctcctccccactcagtcctcggttcccggtccggttcggttccgttcggttcgttagggtttagtagcggggaagaggaaggcatggcggacgtcgagtaccgctgcttcgtgggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacctggacggccgcaacatcaccgtcaacgaggcccagtcccgccgctccggcggaggcggcggcggcttcggcggcggctcctgcggcggctactggagggagtgaatggtggggccgctcgctggccagttgtcctagttaccgatcctttttttacctttctaccagaagtgttgtcgctcgcctcccgagtaccctagatctcgctccgtcgcgtaggttccgagatgttcaggctaccgttagatgtgacgctgctaccgttccgtgttactgttccgtccccgctctgttcgctatgcttctaagattgaaatgaaaacctgagcaaagtttgttcgc

SEQ ID NO: 15495 - DNA, 308 bp, Triticum aestivum
  unsure (1)..(308): unsure at all n locations
  Clone ID: PAT_TA_15495
ctcctccccactcagtcctcggttcccggtccggtcccgttccgttcgttarggtttagtagtagcgggggaagagggaagggntgcttcgtcvgcrgctcgctgggcacggcgrccagtcctccagaacgccytctccaagacggsggsgtcatcgactccmagathatcactgavagggrgmmrgggcgatyycgccggggtcbggtkygcacmytcgcggtcgggatrargcgtrtcgccavtsatatgtagtvtavtagagtdsavwagtacwbagctgcgcaaaawawacngbatataggagg

SEQ ID NO: 15496 - DNA, 696 bp, Triticum aestivum
  Clone ID: PAT_TA_15496
gaattcggcacgagccgcgtcggggtcggggtcgtcctcatccgcacagggaagctggactgggaggtttgctgcttccggtcggcagacgatggctatgacgctatgcccagcacgagtgctaacgccatcacggccggcaccactggcacaacagccgttcggtgtgctctccgggatgctgcagtcgaagggtcgagcaggagctatggatgccagcaaacaagcctgtgcagacggcaatgcatcaatcaaatcggatggagaacatcacacaacagcctttctccaggacataaagaaaatggtggcactttgggttttgaagacgccgcctcgcgtaggactacaaacatgggacgctcggtcgagtttttcttaactcgtcaggattctcatgctgcaaatttagtaacagggaaaatttttgggtgtcctgatgtgtatgcggattgatgaaaatttggcgagggagatcataaaccatcgctcgctgcagcacatcaattgttgaattcgtttgaaggagctgtcaattgttgaattcgcttgaaggagatggagcttgtttggctgaatttgctactgagttgccacattttgagggcctgcaattgaagaatacaacacttgagataacaattgaagaatactagagtaataataactactgcaagagtgatgtattttcttttt

SEQ ID NO: 15497 - DNA, 594 bp, Triticum aestivum
  Clone ID: PAT_TA_15497
tcctccccactcagtcctcggttcccggtccggttcggttccgttcggttcgttagggtttagtagcggggaagaggaaggcatggcggacgtcgagtaccgctgcttcgtgggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgatgccatgaacggccaggacctggacggcctgcacatcaccgtcaacgaggcccagtcccgtcgctccggcggatgcggttgaggtttcagtggttgttgcgggggtggggtttctgtggccatctcggaatgaagtagctgtgctgtttccattttaacgttgtctcttactattttgaattttcgttttatgtgtgtttaccgttcctctttgtgtggtgtgaatttgtcaatgttagcgttgtgttttgcgagtatcccattgttcgagttgtctctttaaattacaatttgtccattttcgcattttacttattg

SEQ ID NO: 15498 - DNA, 605 bp, Triticum aestivum
  unsure (1)..(605): unsure at all n locations
  Clone ID: PAT_TA_15498
gtgcctcaatgcttgatgccatgttctgtaagaggccaaggttaatgtgtgactatcacgttccccaccaagtgaaatgtgctatttcaccacaaacattgacgaagttaagttcagtgaatggcgaaaaatttatcaaagttgctgaggttcaagggtctgaaattaagccatttgtggatagtttatctaaatgcccaaaacccacttagagctccagagaggtcttgttttcttgtactatggatntaaggtgattctcaagaggaacaagtcgccatggaccgatgagatcgagagacggcttcgcgattgcgtggagtggcggctgaaaggagaagcaacaacaactcgttgttcgtgacggcccgagcgtttgcgagaggggatggagncggggttgcattgtcacggccagttgccatagtggatggagtggtggccgcacggacgcgctcctggaggttgccgtatgcanccctgattnnttgagcctgngagagtttccttgcttcttgccctattcctcaaaagggtgttcaaatctactttcggggtattcggtgcttcttggaagtcaaggaacgaatgccactaaattggca

SEQ ID NO: 15499 - DNA, 570 bp, Triticum aestivum
  Clone ID: PAT_TA_15499
gaaaaaccaaaggctcgggatgttgatttttcggatgaaatgatttatcaggcaaaaactacaagtgaaatggaagaggtaatgctcaaaagcctgaatagaattccttgggaaagggtagatgttagcttcaagagaagtagacaaaggattttcgctcatagcaccattcaggtgaagacgtatttcttcaactctgatggggctgatgtgatcttccacatgatcgaccattttctctactaacatggagcgataatgtggcggtgccaatttctttctcttcttctatttggatgccaatttcaattgggtaggaaaaggatggggtaaaaagtgttggagatatactacagtggaacaggtagaaccacccctggtaaaggagtgctgggcctgggcctatgtatgcttcctgtaaagtctgtctggggctcgtaggttcttttcttttctctcttgcatccatgcttcagtgtgcatgcatgcatgtaaatgtttaatggaccacaggctgttgattcatcagtgtaataaaataagataagatccgctgtgtgttgcgtctta

SEQ ID NO: 15500 - DNA, 824 bp, Triticum aestivum
  Clone ID: PAT_TA_15500
ggaggaagaggaggaggaggaagatgatgaggaggaagaggaggaggaactaatggaagatgaagacatggaagctggcatgcagtctgtcgacaccatgtcaagcactcccactggcgtggaaacacctgacgtcattgatcttcgaaagcagcagaggaaagagtctgaaaggccaacagataagcagttataccaggttcttgagcagaaggaggagaaaatcgcacctggaaccctctatgggtcaagccatacgtatgtggttggggcacaggataaggctggggttaaaagggttgatcttctcaagaatcaaaagtccgacaaagtggacgtcaccatacatcccgaggagctggaagttatggacgatgtcctggcagccaagtatgaagaagcccgggaggaggagaagctccggaaccagaaggaagacttcagcgacatggtggcggagaacgcgagcaagaggaagaggaagcacgagaaggacgggaaatcttccaaaaagaaggacttcaagttctagacggcggcggctacggcggcagccgcggcggctccggcggcggcaactggagggagtgaatggtggggcccctcgctggccagttatcctagttacccgatccgtttttacctgtctaccaaaatgttatcgctcgctcgctcccgagtatcctagatctcgctccatcgcgtaggttccgagatgttctggctaccgttagatgtgacgccgctaccgttccgtgttacttgtccgtccctgttccgttcgctatgaatgaaatgaaaaatcagagcaaaagtttgttcgc

SEQ ID NO: 15501 - DNA, 774 bp, Triticum aestivum
  Clone ID: PAT_TA_15501
tgctgtaatgcttgtttttgctaacaagcaagatcttcccaatgccatgaatgctgctgaaataacagataagcttggtctacactctctgcgtcagcgacactggtatatccagagtgcttgcgccacaagtggagagggtctgtatgaagggctggactggctctccaacaacatagccagcaaggtttctatctaacactcagggctggaatggggatttttttggtcaactttgctctgctgtttattttgtggtgttcaagtagttcaagcctttccctgttcctgaaggcttccaatggattggcagggccgcagaagcaactagcggctggacaaatgactggaatatgtaggcatgttaaaatgctgccagagtgttgacatgtctttgtaagctctatctttgagcagttatcacactgttactatgttgtatcaatgattgaatgtacacacgaggaaaacctttatgctatagtgaaaatgatgccatgtcaggtgtccctgagcctgatgagtgatgatgatcctgccccggttttgtgaaccgaaatgtattctgcgcgtgattaaaaaaaaaaaaaaaaaaaaaaaaaaaaaaaaaaaaaaaaaaaaaaaaaaaaaaaaaaaaaaaaaaaaaaaaaagaaaaaaaaataaaaaaaacataaaaacaaacaaaatagcaactcatataaaagtcacttaaaaacaatgaacactgggaaaatttctaaagttaccaaactggaaaacccttgaggttatcc

SEQ ID NO: 15502 - DNA, 608 bp, Triticum aestivum
  Clone ID: PAT_TA_15502
cgtccgctcctccccactcagtcctcggttcccggcccggttcggttcgttagggtttagtagtggggaagaggaggaagaatggcggacgtcgagtaccgctgcttcgtcggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacctggacggccgcaacatcaccgtcaacgaggcccaatcccgccccttccggcgaaggcggtggcggctttaacggcggaggcggtggcggctacggcggccagcgccgcgagggcggcggcggcggctacggcggcgggggcggtggctacagaggtggccgcagcggcggcggcggtggctacggcagccgtgatggcggcggcggctactgctgcggaggcgtgggctacaggggaagccggggcggttccggcggatgcaactggaaggagtgaagtggggggcccctggttggccagttatcctatttac

SEQ ID NO: 15503 - DNA, 542 bp, Triticum aestivum
  unsure (1)..(542): unsure at all n locations
  Clone ID: PAT_TA_15503
ggagcctctccttcccggtctcctccgcccgttgccttcgtcccctccatctccggctgcgtcgccggcgagcccgacaccgcgaatcggatccgccgacaaggtgagagggaagagatggggctcacgttcaccaagctgttcagccggctgttcgccaagaaggagatgcggatcctgatggtgggactcgacgccgccggaaagaccaccatcctctacaagctgaagctcggcgagatcgtcaccaccatccccaccatcggattcaatgttgaaactgtggagtacaagaacatcagcttcactgtctgggatgtcgggggccaggacaagatcaggccactgtggaggcattacttccagaacacgcaaggtctcatctttgttgtggacaacaatgatagggaccgtgttgttgaagcaagggatgagctccaccgaatgctnaatgaggatgagttacgtgatgctgtgttgctggttttgctaacaagcaagatntccaaatgctataaagcnctaagattactgataacttg

SEQ ID NO: 15504 - DNA, 1078 bp, Triticum aestivum
  Clone ID: PAT_TA_15504
ggatctcacttcatgtgtattagtccttgccgcatgtgtgctttattgtgcaaaattgttcccttttgggtagatgaaagtgcagattccaccaaaggaagatttagtaggctttatgttatcaatttatttttgttacatgttgctaaaagtaaatgaaacgaatttctttctgttttggttcagaaagatttgattttgggaggagaaaagtcatacaaggatgagaatgggacaccatattatagcgacgtggtgattttattcagtttattcagaggacatacatacgtacaagtagttccctaaggcgaaggccttccatttgctgttgctggccatgtaaaatagcatgaacctgaacctaactgcgattggatgtctaaactgaattgttgcattcctagacatggaaatgtggatcagttttagttctgaagaatctgcatacttctggtcctatgtaattccaatttatttagacaagcatgccaaaagtgttgaaacccaagttagggttcaaattcgtggggttgtgcttgctgctaaactgatcctggactttctgttggctatattataattagcaaatggaagtggagagataaagcataaatacttgataaactttttttgttggggcgggggatggtttagtccatagttaaaaaaggcgcgcctaagcgagcgcttaagcgcgcctaggctctaggcgttgacaaaacgcattgcacataactacgcttaatctgtgcataactacgcataggttacaaaacgcacaattaacgcctagcacttttttgaactatggtttaggcacttcatgcattgttggtgttgcagacttttgcactgctactaaatgtcctatatgttattctttagtagggatgttggcatagagatatcgcaataataaaaacgagaatcctcattactcacatatatattactatgtccttttgtttccattgagacctattttgtttattcttttagttccaaggcaaaattctctgatttttagtaattcacatttaacaagacatgtgaatggaggatgggaggcatttag

SEQ ID NO: 15505 - DNA, 555 bp, Triticum aestivum
  Clone ID: PAT_TA_15505
agtagacaatggatttttgcccatagcaccattcaggtccagttgtcgttgccttcacttgctttgtcgtttacccatctgtcagctcgccgatcccctgacttgctgtcaagttgagatcgaggagagagcaagccgttgcagaggagaggggatacgagggtgggcggaggtcaggcattgctaacagatttgcggcggagcctcaccaccggctcctgtttggcggtggcaaagagaagggtgccgaggatgtgttgctctatgcatggctgttgaagtacatcatcgttatgatgtgtatggtttctctattttcagccctactgctccagatcccaaatcccatgaccatgcccccacctctccttcgttgaatgaagggagtctggttgctaaaaagtgacttctcttaatcagtatgtatggcccctctgcacatgccgtttcttcgtatttaagaggccctcaagctttgtcagttttctgatagatatggaattttaatttgatagtcccaacaacggtgggtacctgcccgggcggccgctcgaa

SEQ ID NO: 15506 - DNA, 793 bp, Triticum aestivum
  Clone ID: PAT_TA_15506
accctgttagttgacttcctatgtcagttgaagtgaccgtaagatattatgagaagatcaagagaatccttatctgctttggtggttctttttttacttatgcttaatggaacagtttgtcgtgtgtgccattgtgtcckgtataattattctattgaagcaccactgcaacccagtttgtttatcaaattgatgcaagaaacaaactaatacatagaaagtataaatttattgcattaatctgtatatccctgcacctagagataggtagagatggataaattttgtagctttttgttcccagtttttcctattgaaattatggatttggaagctaatcatggagtgtttcgattgcctgcttacggattcgcaatgagcacaagtctgcaaccttgaaggaaaacccgttgcaactgatgacataatattacgtcgcaacaagaatgtatagagctgcaarctctggtggatccttctcttcacaaaaggtgttgccggttgacgggggcctaaccatgagtctaactgaaagtgaacgggagcgatgtgcagaaaaaaatcttagcacataggctggatttgtatagtaatttgaatttattaggcagtaccccctccatttgtatatcacttccgaatacaagttcaggttattaggcagtactattgaatttaaggattgatacttgaagattttaaggttactaaatttaatttaattttttgacagcaggttactaaattttgtaccaagtctactgttatgtagggaagaacatgcgctaaaata

SEQ ID NO: 15507 - DNA, 604 bp, Triticum aestivum
  Clone ID: PAT_TA_15507
attggttatctatttaccaattcagaatttaaaacactttattttatggccttgagtaaaagttcagtcattgttggctggaagacatcttcaatacgccgtcaacacgagcttcccaaggtaatgatctaagaggaagtgagttggagatgagatggggacagaagatcctgcagcgatgttgtttctttgttctcctgctcaagctcaggtggatgagccccgtcctgtgttattccccttgggtttctgaagctcccaggatttaataatgagttgtcttgggcttcattggacaaatgatctacctccgagcaatgatacagtgtaggttggcgttgaagcctgatggcgtttttcttgcagcaaatcttggcgggaagactctgaactcaggtggatgatccccgtcctgtgttattccccttggtttctgaagctcccaggatttaataatgaggtgtcttgggcttcattggacagatgatctacctcgagcaatgatacaggttggcgttgaagcatgatggcgtttatcttgcagcagatcttggcaggaagactctgaaggaacttagaattgcgtgcactattgctcaaatgg

SEQ ID NO: 15508 - DNA, 702 bp, Triticum aestivum
  Clone ID: PAT_TA_15508
cggcacgaggggcacaggagcacttgcgaactgtgatctttccattgcgcgtgcttccctcgtagctcaccaccaatctgctcgcagcccagctcatcgtcggccatggggaactgcctggtgatccaagacagaaaggagatcaaggtgatgagcgtcggcgatggcgagatcctcaaggcgctcccgccacccctctctaagggcgccgtcgcacgggtctctggctccgacaccgatgacgcgctccgggcgcagaagcaacacctcgacggccgggtgggcgacttggggcagctgcatcgtttgttcccctccgacgtgaaggcaccttccgctgtcgctgaccctggagccgtcatgagggtgaagctggtcatcagcaagcaggagctcaggcggatgctgggcaaggacgaccaggccgtctccctggacgacatggtggctctcatgcgaagaggatcggaagatcagcaccaggaggagatcggttgctgcagagggtggcggcctgccttgcacagcatacctgaaggaagcggtgatttattctattagcagaagaattaactggcgattttgggagcttgctggagaaaatgcatattggataataagcataagaaaatatgcatgtgtgtatgtatatatttatatattcacataggaaaacagagatcatagtagatttgctagtag

SEQ ID NO: 15509 - DNA, 958 bp, Triticum aestivum
  Clone ID: PAT_TA_15509
ccacgcgtccggtattttatggttgataattctgtactacttgttatattgtataaaaatagtctctggtttcatcttctttgatgacatattttctatcacaattggaatgcattatgcacctgttctttttactatggttccatatgtttttcaaatttatatattctctatgaatagtaacatagatgcatgttcttaatctattttagatttttgttcacccgaaaatgcagcatagatctgccattgacatttttttgaagcactgggtgaacatttgccgagatgctgataggaaaagcctttttgtttcctcataaaatgttgcccatcagttattaaacttaatggatgcatgttgtgggcttgatgaccatgtacaccttttttagttagaactgtgtctgctatggatctatcttgcttaatacaaagaactctgcatgcttaggaaacaagaggtaatgtaaacaatagattctcttgtgaaattgcgattcagccttggggcgtggatggcaagaagcggaggcgtgtgcctagagtagcggaccatgatggattgatgagctgatgtcacgtgacgtactcacgtggcggctggttaggctctggcggctggagccatcatcgaccatgatgccacgccaggagcacaagggctaagacgaggacatgttggtgccgatgaaataaggtgttgccggttgacgggggcctaaccatgagtctaactgaaagtgaacgggagcgatgtgcagaaaaaaatcttagcacataggctgaatttgtatagtaatttgaatttattaggcagtaccccctccatttgtatatcacttccgaatacaagttcaggttattaggcagtactattgaatttaaggattgatacttgaagattttaaggttactaaatttaatttaattttttgacaaaaaaaaaaaaaaaaaa

SEQ ID NO: 15510 - DNA, 878 bp, Triticum aestivum
  Clone ID: PAT_TA_15510
attcggcccagcagacacagacacgggcacaacgagcacttgcgaattgtaatctttccattgcgcgtgcttccctcgatcgtagctcatcaccaatctgcccgcagctcagctcatcgccggccatggggaactgcctggtgatccaggacagaagggagatcaaggtgatgagcgtggtcgacggcgaagtcctcaagccgctcccggtgccatccccctccaagggcgccctcgcacccgtctccgactcctccgacgccgaagacgcgctccggccgcagaagcaaggcctcgacggccgggcgggcggcatggggcagctgcacctcctgttcccctccgatgctaacgcgccttctgccgcggcggctgacccggagggcgccgtcgtgagggtgaagctggtcatcagcaagcaggagctcaggaggatgctgggcaaggacgacgaggccgtctccctggacgacatggtggctctcctgcgaggagggccggagcatcagaagcaggaggacgtcggttgctaccgagggtggcggcctgccttgcatagcatacctgaaggcagcggtgatctatattccatgttagcatagaaattagctggaagaaaatacatatatggatactaagcataagaaaatatgcatgtgtatatgtatatgtatatgtatttgtattcacatacgtagaaaatagagatcatagttgggtagatctgctgctagtagttttgagataggggttatcttcaggttgtcttgttataggtgggtgctgggtgcatacatccatgtaagacaaggtaaagatagtcctggaaaccaaacgagacaatacaaacttgattattgaaaaaaaaaaaaaaaaaa

SEQ ID NO: 15511 - DNA, 852 bp, Triticum aestivum
  Clone ID: PAT_TA_15511
gtgttttctcaggggttggcttctcctccccactcagtcctcggttcccggcccttttcgagtcgttagggtttagtagtggggaagaggaggaagaatggcggacgtcgagtaccgctgcttcgtcggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacctggacggccgcaacatcaccgtcaacgaggcccagtcccgccgctccggcggaggcggcggcggcttcagcggcggaggcggtggcggctacggcggccagcgccgcgagggcggcggcggcggcggtggctacggaggtggccgcagcggcggcggcggtggctacggcagccgtgagggcggcggcggctacggcggcggcggcggcggctacggcggcagccgcggcggctccggcggcggcggcggcggctacggcggcagccgcggcggctccggcggcggcaactggagggagtgaatggtggggcccctcgctggccagttatcctagttacccgatccgtttttacctgtctaccaaaatgttatcgctcgctcgctcccgagtatcctagatctcgctccgtcgcgtaggttccgagatgttcaggctaccgttagatgtgacgctgctaccgttccgtgttactgttccgtccccgctctgttcgctatgcttctaagattgaaatgaaaacctgagcaaagtttgttcgc

SEQ ID NO: 15512 - DNA, 1028 bp, Triticum aestivum
  Clone ID: PAT_TA_15512
gcgcaacccttcctcctcgatctctctccctcagccgccacaaaccctagccccctttcctaccatcccgcggtcgctgtcgctgctccatctgacctccctcgtcagccgccgccgctacggctcctcggtccaccgactctgtccgtgcaagcggccagtttccttccgccccgaccttctccactgtctcccagttcatcatccgtcccttgctgctcgaggtgttcatctgcccaggccgcgaggaggaaacatgaggaggagagacctcgtctcgagaagccacgggaggaggggctcaagcaaagaagagcagttgccagccaggtattcggcttggctcgacgctgtccttcgtgtccgggccgtggcagacccttgcgccatcattcaggtgtctttgcggctgcaggagtgtatgtgttaagcttcaggctaatgtattggttgagatcgaggagagagcaagccattgcagaggagaggggatacgagggtgggcggaggccaggcattgctaacagatttgcggcggagcgggaagccggcgcctcaccactggctcctgtttggcggtggcaaagggaaagctgccgaggatgtgttgctctatgcacggctgtcgaagtacattcttgctatgatgtatttgatttatcgacggcgaaggcaggctgactgtactacaaggttactgccattccacctcttcctcgtgatggtataggagtacacactaattcgataaataagaggcgaagttgccaacgcctgagatagtggttcctacctttggccttcgcacctttagttccgcaagtagttcagcaactcaaatgagctcaaggcagagatggcggagctcgagcgagctcgagactatggatccagggctcgactgctcaccggatggaggcaggggagggcgccctacggaaagtgatttatgtactccttcatctggctttttataactgatgacatcttacattgctgcctttaccggctaactggttaactctttt

SEQ ID NO: 15513 - DNA, 729 bp, Triticum aestivum
  unsure (1)..(729): unsure at all n locations
  Clone ID: PAT_TA_15513
cccgtccctacccctcttcctcctcggacaagccctccccctcgccgccgccgccgccgccgccgccccgcaggtcgccggctccgcttcgcgccgtaccgatggcggaagaagcagctgccaatggaaaagaaaaaggaaggaaggaggagttcagcaccgggcccctgtccctgctcctcatgagcgtcaagaacaatactcaggtgcttatcaactgccggaacaacaagaagctacttggtcgcgtgagggcatttgaccgtcattgcaacatggttcttgagaatgtccgggagatgtggactgaggttccaaagactgggcaaaggcaagaagaaggccttccagtgaacaaggacaggttcatcaagcaagatgttcctccgcggcgactccggtcatcattgttctcaaggaaccccgaaatgagtttagacgacgacgacgacacatcgtacgcccagaagagtctctttgctatgtagtcgctgttaagtttgtgatactgaatactctaaaacagtgagtgcttaagagatgatatcaagccgagatttagcagtattgattaccggtccagtgttgtagtttgggatgttctgagttttgcctgtcctgtatctaaattgcgctcgtagtttgtatttggaccatcaatatatcggcagaacacaatttaaaaagtttgagaaatgtttgatttgccgttgagaaaaacnggaaaac

SEQ ID NO: 15514 - DNA, 838 bp, Triticum aestivum
  Clone ID: PAT_TA_15514
gccggccgggtcgggccccacttacaccactgcacacgagcacttgcgaattgtgatctttccactgcgcgtgcttccctcgtagctcaccaccaatctgctcgcagctcagctcatcgtcggccatggggaactgcctggtgatccaagacagaaaggagatcaaggtgatgagcgtcgtcgacggcgagatcctcaaggcgctcccgccacccctctctaagggcgcccccgcacgcgtctccggctcagaccccgacgacgagctccgggcgcagaaacaacacctcaaccacgtccgggtgggcgacttggggcagctgcatcgtttgttcccctccgacgtgaaggcgccttccgccgccgctgaccctggcgccgtcatgagggtgaagcttgtcatcagcaagcaggagctcaggcggatgctgggcaaggacgacatggtggctctcatgcgaagaggatcggaagatcagcagcaggaggagatcggttgctgcagagggtggcggcctgccttgcacagcatacctgaaggcagcggtgatttattctattagcagaagaaattaactggcgattttgggagcttgctggagaaaatgcatattggataataagcatcagaaaatatgcatgtgtgtatgtatatatttatatattcacataggaaaacagagatcatagttggctagatttgctagtagttttgagataggggttatcttcaggttgtcttgttaggtaggtgcatgcatccatgtaagacaaggtgaagatagtcttggaaatcaaacgagacaatataaacttaattattgatggcaaaaaaaaa

SEQ ID NO: 15515 - DNA, 673 bp, Triticum aestivum
  Clone ID: PAT_TA_15515
tttcaaaccgactgctgtatttgtcccactagtggagatccttaaaaatggtaacttcgagcttgtgacaaaggagatatttggtcctttccaggtggttacagaatactctgaggaacagcttgatttagtattagaagcctgcgaaaggatgaatgcgcatctgacagctgcagtagtttcaaacgacaaattgttcctgcaggaagtactcggtagatcggttaacgggacaacatatgctggaattcgagcaaggaccaccggcgctccgcagaaccactggtttggtcctgccggtgacccgagaggcgcggggatcggcactccagaagccatcaaactcgtctggtcttgccacagggagatcatatatgacattggtcccttgcccaagaagtgggcacttcctgcggctacatgatatgcctaggctaggacaactagctagaagaacacgacggcgatggagagaaagcaacacggacagaattagctggttgagaactgacattgtgttgaataatggaagcctcgtgtaggcaattgggagagtctcgacccccaaggaacacaataaaggtcataattatgaatggaagtactacgatggttgtcaatggagctttagatgttgctctagtaaaagaattaaattatgcaacatcttctc

SEQ ID NO: 15516 - DNA, 1562 bp, Triticum aestivum
  unsure (1)..(1562): unsure at all n locations
  Clone ID: PAT_TA_15516
aggaattcggcacgaggcacagccgcccgcccgcacctctcccgcctccggtcctcccttctctcagccgccaccccacgaaccctagccgtgccctcctgcatctgtcctcctcccccttcctggtccgtcccaagcccctcctcgtctcatgagctagccgaggaaaagaggggtgacgcgacgacctggtcgtcggccggtggggagcctcgtagaggcggtggcggagacgaccctagatggtgccccggccaagatctggacagggtgcctcaacctcgtcttcctcttccacctactcgctgatagagagacggcagcagcggtgggaggagcctaggcgtagaggagagaagtggacgaggggggtgcaaaggcaggagatgggggtcgccggatgagcacagtcgcacagggcctgatcccgccgctgctagagcagagtggaggaccacacggggcccgatggggtggctgggagcgtgcggattctggctcccaagcagggaatgcagtggtgctggcctctcctctccctgcgcctttgtcctgcgtcgtcactaccgccacggccttgctcgccattgccctccccaagtgcttctttccacaaatggtgacgaggtagtgggatgagctggccgccggcgatagagaagagggagggggagtggcggcggcggctgacaagggaggtggggaaggagggttgcagcggctgtggggatcgaggagaaaaggggtagggtttgtgcaggggcggctgaggcgagacgaggatgggattgggtgcgcttgcatggaggggattggccaaatcctcgttcacgtgcgcgcggcctacccagccaatacccgcgacaaacgagcccaccagtcataggctagacaaccaaggccggttcatggagggacctatgtagcctcaacgcctgggtggtgggagactactaccgcctcgtctccgctgtcaacgcactcgagccgcctcttcggaggctttccgacgaacaggtggcgtgccgcgtggaacaccccacccacgattcctgattcctaatggccttttgttgtgcgtatgatggatttatgtgttcctgcggctgaaggggaagacggaggagttccgcgcgcgcctgggccgcggggagacgctcgccggcgttcaggcagaggcgttttctgtggtgagggaggtggcaaagaggacgctcggcatgcgacactttgatgttcagtggtgactgtaaatgattatttggcacagcgagatgctgaatggatgggccgcgttcatcgttttcttggcctaactgtcggtctaattgagtactcggagtgcgaagcgtgctactacgagtctctaggttttgcggatcatcagcaagacttttcagacgacgagtaaggagccataggtcgttgtcattcactcagtgatgccgttggagttgatagactcacgttatcttccaagcctttcgttgttatcaatttagatggccttaagccatatttatngtttatgttctcttttagacattcgatgtaataagtgt

SEQ ID NO: 15517 - DNA, 1412 bp, Triticum aestivum
  unsure (1)..(1412): unsure at all n locations
  Clone ID: PAT_TA_15517
ctcgtgccgaattcggcacgagtccccttccttccagcgtcctctgcgagagactgcagcgactgcctccgtgtgcgtgcgagtgagtgggagcggagatggcgacgcacttcgtgctcaacaccggcgccaagatcccctcggtggggctcggcacctggcagtccgaccccggcgtcgtcggcgaggccgtctacgccgccgtcaaaggcggggtaccggcacatcgactgcgccagggcctacaacaacgagaaggaggtgggtttggctctgaagaagctatttgaagagggtgtagtcaagcgtgaagatctgtttatcacctctaagctatggtgtggtcatcatgccccagaagatgtgcctgaggcacttggggattccctcaatgacttgcagcttgactacttggatctttaccttatccattggccatttagagtcaagaagggaacaagcattggcaaccctgaaaacttcttaccacctgacatcccagctacatggggagcaatggagaagttacatgatgccggcaaagctcgtgcaattggtgtgagtaacttcgcatcgaagaaattgggtgacttgcttgctgtagctcgcatacctccggctgttgaccaggtggagtgccatcctggttggcagcaatctaaactccatagcttttgtcagtcggccggtgttcacctctctgcgtactcaccgctaggttcgcctggttcaacatggatgaatggcaatgtcctcaaagaacccgtcgtcctctcaattgcagagaagcttggcaaaactcctgcacaagtggcgttgcgctggaacattcagatgggccacagtgtactgccaaagagtgtgagtgaagaacggataaagcagaaccttgctgtttatgactggtctattccagaagacttgcttgcaaagttctctgagattaagcaggctaggctgcttatgggcaacttcatcgtcaacaaagacagcgtttacaagacccacgatgagctctgggatggcgaaatctaggacagcccccgtcgtggttgggggttgggcgtctcattactgtcagtcacttgtttttcctttgttgatagcagtgtcagtcacttgttatgtatcaccatatgcgcttaagaaatgtacgggttcagtcaccctggaaactattgaatagacgcacggtttactcccgtatgtgataggaccataggaagtgagatgacatgtatcttaagtttctgaaactatcttgtgttgccggtggaggcatgaatttatcatagcttttcatgtcactgggattgtttgttctgtatggatcgttcctccagcgaagttgattcacatggtaataaaactgggnnnngtttgntnnnnnnntacnnntaattctcgancca

SEQ ID NO: 15518 - DNA, 594 bp, Triticum aestivum
  Clone ID: PAT_TA_15518
gtcgacaccatgtcgagcactcccactggcgtggaaacacctgacgtcattgatcttcggaagcaacagaggaaagagtctgaaaggccaacagataagcagttataccaggttcttgagcagaaggaggagaaaatcgcacctggaaccctctatgggtcaagccatacgtatgtggttggggcacaggataaggctggggttaaaagggttgatcttctcaagaatcaaaagtccgacaaagtggatgtcaccatacatcccgaggagctcgaagttatggacgatgttctggcagccaagtacgaagaagcccgggaggaggagaagctacggaaccagaaggaagatttcagtgacatggtggcggagaacgcgagcaagaggaagaggaagcacgagaaggacgggaaatcttccaaaaagaaggacttcaagttctagacggcgccgttttgttaccgttgctcttccgcttcccaggaggaggatgtttccatttcttcctgtagcctgtactctactctaaatcaagctgtgtatgtatacttggcctctggcaaatgttgaagtgctggacgagaaggccggacg

SEQ ID NO: 15519 - DNA, 686 bp, Triticum aestivum
  Clone ID: PAT_TA_15519
gtcctcttcctcctcagacaagccctccccctcttcgcctccgccgcccccgctccggttcgcctccgccaccgccccgcaggtcgccgccagcttcgcttcgtaccgatggcggaagaagcagctgccaatgttaagaaaggaggaggaggagttcagcaccgggcccctgtccctgctcctgatgagcgtcaagaacaatactcaggtgcttatcaactgccggaacaacaagaagctacttggtcgtgtgagggcatttgaccgtcactgcaacatggttcttgagaatgttcgggagatgtggactgaggttccaaagactgggcaaaggcaagaagaaggcccttccagtgaacaaggacaggttcatcagcaagatgttcctccgcggcgactcggtcatcattgttctaaggaacccgaaatgagttagatgatgacgacacctcgtactcccagaatagtctctttgctatgtagtccctgttaagtttgtaatactgtatactctaaaacagtgagtgtttaagagatgatatcaagccgagatttagcagtatcgattactggtccagtgttgtagtttggggatgttctgagttttgcctgtcctgtatctaaattgcactcgtagtttctattcagatcatcaatatatcagcagaggacaatttaattttgag

SEQ ID NO: 15520 - DNA, 720 bp, Triticum aestivum
  Clone ID: PAT_TA_15520
cttgctgtttttgagatatgtggttggggcacaggataaggctggggttaaaagggttgatctcctcaagaatcaaaagtccgacaaagtggacgtcaccatacatcccgaggagctcgaagttatggacgatgttctggcagccaagtaagatcacttctcccctgcatctgccaagcttttcctgtcagtagccatgagttgaaacattaacgccttccctttaataaatgatgaaacaggtatgaagaagctcgggaggaggagaagctacggaaccagaaggaagatttcagcgacatggtggcggagaatgcgagcaagaggaagaggaagcatgagaaggacgggaaatcttccaaaaagaaggacttcaagttctagacggcgccgctttgttaccgttcctcttccgcttcccaggaggaggatgtttccatttcttcctgtagcctgtactctactctaaatcaagctgtgtatgtatacttagcctgtggcaaatgttgaagtgctggatgagaaggcctgatgaaaaaggaagtgaagctgtaatccatgcatgagaacaaattgtgatgttaaatgtgactgctagcattaatccattgctgtcatgaagagtaatgctaagtttgttatgtttgacataagtgggggattgcacattctgaaaactgccaggggagctggatcattaaatactgtttttgaggactc

SEQ ID NO: 15521 - DNA, 596 bp, Triticum aestivum
  Clone ID: PAT_TA_15521
attcggcacgaggctcctccccactcagtcctcggttcccggtccggtcccgttccgttcgttagggtttagtagtagcggggaagaggaaggaatggcggacgtcgagtaccgctgcttcgtcggcggcctcgcctgggccaccgacgaccagtccctccagaacgccttctccaagtacggcgacgtcatcgactccaagatcatcactgacagggagacgggccgatcccgcgggttcgggttcgtcaccttcgcgtcggacgaggcgatgcgccaggcgatcgaggccatgaacggccaggacctggacggccgcaacatcaccgtcaacgaggcgcagtcccgtcgctccggcggaggaggcggcggcggctccggcggcggcaactggagggagtgaatggtggggcccctagctggccagttatcctagttaccgatccctttttttacctgtctaccaaagtgttatcgctcgctcccgagtaccctagatctcgctccatcgcgtaggttccgagatgttctggctaccgttagatgtgacgccgctaccgttaccgtgttacttgttaccgtccctgttccgttcg

SEQ ID NO: 15522 - DNA, 1359 bp, Triticum aestivum
  unsure (1)..(1359): unsure at all n locations
  Clone ID: PAT_TA_15522
cgttgctcgccgtccccgtccccttccttcgacttcgagcgtcctctgcgacactgcagtgactgcctccgtgtgcaggtagtgtctgagagcggggatggcgacgcacttcgtgctcaacaccggcgctaagatcccctccgtggggctcggcacctggcagtccgaccccggcgtcgtcggcgaggccgtctacgccgccgtcaaggccgggtaccgccacatcgactgcgccagggcctacaacaacgagaaggaggggggtttggcactgaagaagctatttgaagagggtgtagtcaagcgtgaggatctgtttatcacctctaagctatggtgtggtcatcatgccccagaagatgtgcctgaggcacttggggattccctcaatgacttgcagcttgactacttggatctttaccttatccactggccatttaaaatcaagaagggaacaagcattggcaaccctgaaaacttcttaccacctgacatcccagctacatggggagcaatggagaagttgcatgatgctggcaaagctcgtgcaattggtgtgagtaatttctcatcgaagaaattgggtgacttgcttgctgtagcccgcgtacctccggctgttgaccaggtggagtgccatcctacttggcagcaatctaaactccatagcttctgtcagtcaactggtgttcacctctctgcgtactcaccactaggttcacctggctcaacatggatgaatggtaatgtcctcaaagaacccgttgtcgtctcaattgcagagaagcttggcaaaactccagcacaagtggcgttgcgctggaacattcagatgggtcacagtgtgctgccaaagagcgtgagtgaagaacggataaagcagaaccttgctgtttatgactggtctattccagaagacttgcttgcaaagttctctgagattaagcaggccaggctgctcatgggcaacttcatcgtcaacaaagacagcgtttacaagacccacgatgagctctgggacggcgaaatctaggacagctccgtagtcccgtcgtggttgggagcagggcgccttgttagtgccagttacttgttatgtatcgtcgactatgcgcttaagaaatgtatgattcggcatccccgtgggaggctgggaactcttcggtagactgtgcatggatttgctcccgtaggtgatggaatttctgcgaaaaccgcgtcgcgtgttgctaatggaggcatgaatttatcagcttgttcctgtcactggggttacttgttctgtactgatttttcgtttgctggtgtattttgtgttcctccaacgaagttgcttcacannataataaaattggggcc

SEQ ID NO: 15523 - DNA, 1454 bp, Triticum aestivum
  unsure (1)..(1454): unsure at all n locations
  Clone ID: PAT_TA_15523
cggcacgaggctcacctcgccttcctcttccacctactcgctgatagagagacagcagcagcggtgggaggagcctgggcgtagaggagagaagtggacgaggggggtgcaaagccaggagatgggggtcgccagatgagcacagccgcacagggcctgatcccgccgctgccagagcagagtggaggaccacacgggcctgaaggggtggccgggagcgcacggcatccggctcccaagcagggaatgtagcggtgttggcctctcctctccccgcgcctctgtcctgcgtcgtcactaccgccacggccttgctcgccattgacctccccaagtgcttctctccacaaatggtgccgccatgtacagatcaattcaagcgccaggaaagtacaacacgtgcacgtaacttgtttgaggaaattccatctggaagcaatatttgatcatgacttgtgttcttgatgcttcatctgcggctagctgactacaacagcacatatgtaaagggaaaccatcgtaagaaacacagatcagctcttcattctttcaagcgctatgttgcttactcaaatgtttgtggcgattgtatccttgtgccatgaatatttgtacttagcagatcaatataaacatattggctatttaccaattcagaatttaaagcactttattttatggccttgagtaaaagttcagtcgttgttggctggaagacatcttcaatacgccgtcaacacgagcttcccaagaaagaagattttgtggatgatgtaagatatccacatgttgtatatgtggaaaaaccaaaggctcgggatgttgatttttcggatgaaatgatttatcaggcaaaaactacaagtgaaatggaagaggtaatgctgaaaagcctaaatagaattccctgggaaagggtagatgttagcttcaagagaagtagacaaaggatttttgcccatagcaccattcaggtgaagacatatttcttcaactctgatggggctgatgtggtcttccacatgatcgaccattttctctactaacatggagcgataacgtggcggcggtgccgatttctttctcttcttctatttggataccaatttctttctcttcttctatttggattattgggtaccaatttcaattggataggaaaaggatgggggcaaaaagtattggagatatactacagcggaacaggtagaaccacccatggtaaagtagtgctgggcctatgtatgtttcctgtaaagtctgtctggggccgtggggcgctcgtaggttcttttctctcttccatgcttcagcgtgcatgcatgcatgtaaatgtttaatggaccacaggctgttgattcatcagtgtaataaaataagataagnccgctgtgtgttgctctccgagcagagaaccgtagcgagaatacggtattgacctcaaaaaaaaaaaa

SEQ ID NO: 15524 - DNA, 687 bp, Triticum aestivum
  Clone ID: PAT_TA_15524
ccgccccgcccctcctcttccccctcttcgccgccgcccccgctccggttcgcctccgccaccgccaccgccaccccgcaggtcgccggcttcgcttcgcgtcgatggcggaagaagcagctgccaatgcgaagaaggaggaggaggagttcagcaccgggcccctgtccctgctcctgatgagcgtcaagaacaatactcaggtgcttatcaactgccggaacaacaagaagcttcttggtcgtgtgagggcatttgaccgtcattgcaacatggttcttgagaatgttcgggagatgtggactgaggttccaaagactggcaaaggcaagaagaaggcccttccagtgaacaaggacaggttcatcagcaagatgttcctccgtggcgactcggtcatcattgttctaaggaacccgaaatgagttagacgacgacgacacctcgtacgcccggaagagtctttgctgtgtagtcgctgttaagtttgtaatactgaatactctaaaacagcgagtgtttaagagatgatatcaagcagagatttagcagtatcgattactggttcagtgttgtagtttgggatgttctgagttttgcctgtcctgtatctaaattgcactcgtagtttctactcggatcatcaatatatcggcaggagacaatttatgtttgtgaaaaaaaaaa

SEQ ID NO: 15525 - DNA, 732 bp, Triticum aestivum
  Clone ID: PAT_TA_15525
ttttttttttttttttttttattccggctgcaaaacggtaccactaatgctgtcgaatttaacagatgcacaaggtcatgtcatgcaatgccatacatttaggccatcaggaggtccccagttctcgcctcaacacacatacaattacctacgtcataataatatttttatacccaataccgggcgggcaggccaggttacttgccgtagatgcacaggcccacctcgtagctcaccaggagcattattgctgacaggaaaaagagacagaagccgccgcgcagcaccgcagtcactgtgttgcagccaccacagtgtatgcggttatcaggctggaaacctgtggagaagagaagctccatgtcttcatccttctggaacgaccacttgccttgtcgagaagcaacagttaagcttcctatgctgattacttcggtagacacgctgatggtgttagggtgcacaccagacaaggatttgcctgggaactctgctgcaaaagcagggggagccgagattgaatccagcatctttacaaaacgcccattcttagcctgagaatctggtaaaacaacacaatttaactgaccaccagcttcagataacctagtggacgacggggccccaactacaaaattaggttctacaaccttttgagttggactatatgtatagttgggattgttgacctcttgagtaagaactggcccattaaagacatgggagctgctc

SEQ ID NO: 15526 - DNA, 1621 bp, Triticum aestivum
  Clone ID: PAT_TA_15526
caacggggccccggcccccgcccccttcgccgacaagaagaagtcgcgcgagagcgagcgccgccgccgccgccggaagcagaagaagagcaaggcgcccgcttccgacgccgccgcctccgacgccgacgccgatgcgggcgaggaggacatttccgactccaagcccccggtggagatcgaggtggagtacgtgccggaggagccggacctcgccgacggcctgctcgccgacttcaagagcatcttcgacaagttcaccttcaaggagcccgtcgccgccgaggacgaggagaagaaggacgaggctgccgacgcggcgaagaaggggtcagggtccgactcggacgacgacgagcaggagacccagcagaagaagaaggaagggggcatctccaacaagaagaaaaagctggagcaaaggatgaagatcgcggagctgaagcagatatgcaacaggcccgacgtcgtcgaagtttgggacgcgactgcatcagaccccaaattacttgtctatctgaagtcttacaggaacacagtacctgtcccaaggcactggtctcaaaagaggaaattcttgcagggtaagagaggtatcgaaaaacaacctttccaacttcctgacttcattgctgcaactggaatagaaaaaattagacaggcatatatcgagaaagaggatagcaaaaagttgaagcagaagcagcgggagcgtatgcagccaaaaatgggcaagatggatatagattatcaggttttacacgacgccttcttcaaatatcaaacaaaaccaaaattgactagtcatggtgacctttactacgaaggaaaagagtttgaggtcaaactcagggaaatgaagccaggtatgctgtcccgagaacttaaagaagctcttggtatgccagaaggtgcaccgcctccatggcttataaacatgcagagatatggtcctccgccctcttatccttcactgaagattcctggtctgaatgccccaattcctcctggtgctacttttggttaccggcccggggaatggggaaagcctcctgtggatgagcatggacgccccctctacggagatgtttttggtatcctacagctggatgaacctaattatgatgaggagcctgttgaccgcagcaagcattggggagacttggaggaggaagaggaggaggaggaagatgatcaggggaagaaggaggaggaggagttcagcacggggccgctgtccattctcatgctcagcgtcaagaacaacacccaggtgcttatcaactgcaggaacaacaagaagttgcttggtcgcgtgagggcatttgatcgtcattgcaacatggttcttgagaatgtcagggagatgtggactgaggttccaaagactggtaaaggcaagaagaaggctctcccggtgaacaaggacaggttcataagcaagatgttcctccgcggggattcggtcatcatcgtcctcaggaacccgaaatgagtttgacgactcggcgtaaaccagaagagtctcttttcgctatgctgctgttagtttgtatgccgaatgctctggatcagggaatgtgtaagacagttatcaagcaagcattgcctgtactgatta

SEQ ID NO: 15527 - DNA, 707 bp, Triticum aestivum
  Clone ID: PAT_TA_15527
gtcctcggttcccggtccggtcccgttccgttcgttagggtttagtagtagcggggaagaggaaggaatggcggacgtcgagtaccgctgcttcgtcggcggcctcgcctgggccaccgacgaccagtccctccagaacgccttctccaagtacggcgacgtcatcgactccaagatcatcactgacagggagacgggccgatcccgcgggttcgggttcgtcaccttcgcgtcggacgaggcgatgcgccaggcgatcgaggccatgaacggccaggacctggacggccgcaacatcaccgtcaacgaggcgcagtcccgtcgctacggcggcggcggcggcggctacggaggtggccgcagcggcggcggcggcggctacggcagccgtgacggcggcggctacggaggcggcggcggcggcggctacggcggcagccgcggcggctccggcggcggcaactggagggagtgaatggtggggcccctagctggccagttatcctagttaccgatccctttttttacctgtctaccaaagtgttatcgctcgctcccgagtaccctagatctcgctccatcgcgtaggttccgagatgttctggctaccgttagatgtgacgccgctaccgttccgtgttacttgttaccgtccctgttccgttcgctatgaatgaaatgaaaaatcagagcaaaagtttgttcgc

SEQ ID NO: 15528 - DNA, 1638 bp, Triticum aestivum
  Clone ID: PAT_TA_15528
cctatatgtatgtggtacacaatcttaaatagtagaaggggaaaataaagcattaatgtggagtatgttccaatggaaatcttcaggaacaccttgaaggtctgagtgcaatttttctttagttctctgtgagcttaaaaatgcaactgatgtggcccatgcaactgagattaaaaacatggagaagaatcataaaagatctcgctgaaaatgccctcgttccgcacttcgtgtggacaggtagcgccctttaccttcgaagtctcgaaaaattgtctgggtgatgcgggtgcctcaatgcttgatgccatgttctgtaagaggccaaggttaatgtgtgactatcacgttccccaccaagtgaaatgtgctatttcaccacaaacattgacgaagttaagttcagtgaatggcgaaaaatttatcaaagttgctgaggttcaggggtctgaaattaagccatttgtggatagtttatctaaatgcccaaaacccacttagagctccagagaggtcttgttttcttgtactatggatttaaggtgattctcaagaggaacaagtcgccatggaccgatgagatcgagagacggctccgcgattgcgtggagtggcggctgagaggagaggcaacaacaactcgttgttcgtgacggcccgagcgtttgcgagaggggatggagcgggggttgcattgtcacggccagttgccatagtggatggagtggtggccgcacggacgcgctcctggaggtgccggtatgcaccctgattttgagcctgggaggttccttgctctgccctatcctcaagggtgttcatctacttcggtatcgtgctctggagtcaagacgatgcactaatggcaggttggttctttactttttcatttattttgtttgtatgcatatccctgaattttgtgagccgtgatttaaatgttgtcgtgtgtgccattgtgtcctatataattattctattgaagcaccactgcaacccagtttgtttatcaaattgatgcaagaaacaaactaatacatagaaagtataaatttattgcattaatctgtatatccctgcacctagagataggtagagatggataaattttgtagctttttgttcccagtttttcctattgaaattatggatttggaagctcatggagtgtttcgattgcctgcttacggattcgcaatgagcacaagtctgcaaccttgaaggaaaacccgttgcaactgatgacataatattacgtcgcaacaagaatgtatagagctgcaaagctctgtggatccttctcttcacaaaagccttggggcgtggatggcaagaagcggaggcacatgcctagcgtagcggaccatgatggattgatgagctgatgtcacgtggcggctggttatgccccagcggctggagccatcatcgaccatgctacaaaatacaatttatatgtttttcaaaaagagctcaaaatacaaccgacttttccttgtttaaattgtactggtattgtcgtgtgtgtattagctctgaagtatgttctcaaagaatatgtaatatttttcgtgttgtatccatttgtggagagtttatctaaatgcccaacgcatggacttcacaaccaaaaccccc

SEQ ID NO: 15529 - DNA, 770 bp, Triticum aestivum
  Clone ID: PAT_TA_15529
ttttctcctcctccttcctcgcgcgcgctcctctgctctgttctcctctccttgtgcgctagtgttcaccaagatcaggcaaacggccacgcgcgagctcgccatggagcgtaccggcggcaagggcgacgacgactcgcggctgatgcgcgacctctgcacgctgctcgtcaccatcatcgcccccgtcgcggcggcgtcctcgacgaactcgccccggaggcccgtggcgcggcgcccgcggggcggcatgtcgccggcgggcgcggcgtcgatgcttctgggcgcgtcgatggcgctgatgctgtgcgggtccgtgacgttcgccatcggcttcctcctcatgccgtgggtcgccggcgtcgcgctgctcttcggcttcgccggcgtcatctccaccctctcctccggcctcctcccctcgtcctcctccaaggagcaacggctgcggacgccgacgcaagggcgtgtccgcgtctctgctcctccgatgagctctgttccggataagctcgtggcgtggcgttgagctgttcttgaaatttagttaattaattaaattagggcgggattaggatgggtaattcctgtgtaaaaaagcttcccttttgctgttgttgtacgtttccagtcgcaagagatgccgatgatttagtactaccggcacaagcaacatttgttatatgtgttgattgtttccgtatcgagaatctgtgcacggatggcaaacgtgcttcgctactctgcttcgtcagaccagaaaactgaga

SEQ ID NO: 15530 - DNA, 800 bp, Triticum aestivum
  Clone ID: PAT_TA_15530
gccggccgggtcgggctttcaagttaactatgtggctcacgctgcagtggtttgtgatgtcaatgaacattccttcctctcccacgtctccagctcctcctccttcccttcctcgcgcgcgcgctcctcttctccgctctcccctcctcgtgcgctcgtgttcaccgagatcagccaaacggccacgcgcaagctcgccatggagcagaccggcggcaagggcgaccacgactcgcggctgatgcgcgacctctgcacgctgctcgtcaccatcatcgcccccgtcgcggcggcgtcctcggtggactcgccccggaggcccgtggcgcggcgcccgcggggcggcatgtcaccggcgagcgcggcgtcgatgcttctgggcgcgtcgatggcgctgatgctgtgcgggtccgtgacgttcgccatcggttttctcctcatgccgtgggtcgccggcgtcgcgctgctcttcggcttcgccggcgtcatctccaccctctcctccggcctcctcccctcgtcctcgccgtcctcctccaaggataaggagcgacggctgctgatgccgacgcaagggcgtgtccgtgcctctgccccgatgagctctgtcccggataagctcgtggcgtggcgttgatctgttcttgaaatttagttaattactaatcaattagggcgggattaggatgggtaatccctggtgtaaaaaacgcttcccttttgctgttgttgtacgtttccaatccgcaaagaatgctgatgatttactaccgggcacaaagcaacatttattaatacca

SEQ ID NO: 15531 - DNA, 1372 bp, Triticum aestivum
  Clone ID: PAT_TA_15531
cgagggttctacattggactccgacaaaaacgtgcaaggggcgaggagtatgatgagcttatggaagagttcatggctgctgttaagacattctacggtgagaaagtcctcattcagtttgaggactttgccaatcataatgcctttgatttgcttgaaaaatacagcaagacccatcttgttttcaatgatgatatccagggaacagcatctgtggtccttgcaggtctgttatcttcgctgaaggttgttggtggaaccctagcagagcacacctatttgttccttggtgctggtgaggctggaactggtattgcagaactcattgctcttgagatttcaaaacagacaaatgctccaattgaagagtgccgcaagaaggtttttctggtggattcgaagggtttgatcgttagttccagaaaaaactcccttcagccattcaagacatcttgggcacatgagcgcgaacctgtgacaaccttgttagatgccatcaagtccatcagacctacggtgctgatcggaacatctggagtaggcagggctttcactaaggaagttattgaagctatggcttctttcaacgagagacctgtcatcttctcattgtcaaatccaacatcgcactctgaatgtactgctgaagaagcatacaaatggacccagggtcgtgcagtgtttgccagtggaagtccgtttgaccctgtggagtatgatggaaagattcgcgtgcctggccaggcaaacaatgcttacattttccctggatttggccttggtgttgtgatttctggagcaatccgcgtacatgaggacatgcttcttgctgcctcggaaacactagctgcacaggccactcaggagaacttcgacaagggatccatctttccacccttcaccaacatcagaaagatatctgccctcattgctgctagcgtggctgcaaaagcctacgaacttggcttggcgactcgcctgccgcggccgagagatctggagaaatatgcggagagctgcatgtacacccctgtctaccgcagctatcgttaatgcagtggagatcaattttgcagtaataaaacgcaaggtcgcaggatgctgcggcgctgttgttgtctgtcgctgttcttgccgctgctgcaagtcgtatctgtctatacatatatgccgtgtgtgttgtaacgctgtggaagaagttaagcaaactgtcttgtgtatcaacgtttgttattcgtgtaggttgagtgcaacgagtgtaataaggacacagagctctagttctcaaggtaatatggctagtgctcctcgccttttatctcaactgggatccttgaccatatatgaaaatcaatgcaaattagcatgcccc

SEQ ID NO: 15532 - DNA, 707 bp, Triticum aestivum
  Clone ID: PAT_TA_15532
ctcgtgccgccaaaacttggccccgcctcctgccgccaccctccgtcctcgccgcgcctccgccgttccgccccgggttttcaggtcgccggccttcgccccgtcagccagccgccgcgtccatggcggaggtcgcgcccgttgatcaggggaagaaggaggaggaggagttcagcacggggcccctctccattctcatgctcagcgtcaagaacaacactcaggtgcttatcaactgcaggaacaacaagaagttgcttggtcgcgtgagggcatttgatcgtcattgcaacatggttcttgagaacgtcagggagatgtggactgaggttccaaagactggtaaaggcaagaagaaggctctcccggtgaacaaggacaggttcataagcaagatgttcctccgcggggattcggtcatcatcgtcctcaggaacccgaaatgagtttgacgactcggcgtgaaccagaagagtctcttttcgctatgctgctgttagtttgtatgccgaatgctctggatcagggagtgtgtaagacacagttatcatgcaagcattgcctgtactgattaatggtttggtgctgtggtctggatgttatgaattcacgtcttttttagtatctaatctaacaacgtgcactggtagcctctgttcggatcatcaatatgtctgctggagagagttttcagtttaaaaaaaaaa

SEQ ID NO: 15533 - DNA, 1610 bp, Triticum aestivum
  Clone ID: PAT_TA_15533
cgtccgtagcagatatgcaacaggcccgacgttgtcgaagtttgggatgcgactgcgtcagcatccgaagttacttgtctatctgaagtcttacaggaacacagtacctgtcccaaggcactggtcccaaaagaggaaattcttgcagggcaagagaggtatcgaaaaacaacctttccaacttcctgacttcattgctgcaactggaatagaaaaaataagacaggcatatatcgagaaagaggatagcaaaaagttgaagcagaagcagcgggagcgtatgcagccaaaaatgggcaagatggatatagattatcaggttttacacgacgccttcttcaaatatcaaacaaaaccaaaattgactagtcatggtgacctttactacgaagggaaagagtttgaggtcaaacttagggaaatgaagccaggtatgctgtcccgagaacttaaagaagctcttggtatgccagaaggtgcaccgcctccatggcttataaacatgcagagatatggtcctccgccctcttatccttcactgaagattcctggtctgaatgccccaattcctcctggtgctacttttggttaccggcccggggaatggggaaagcctcctgtggatgagcatggacgccccctctacggagatgtttttggtatcctacagctggatgaacctaattatgatgaggagcctgttgaccgcagcaagcattggggagacttggaggaggaagaggaggaggaggaggaagatgaggaggaagaggaggaggaactaatggaagatgaagacatggaagctggcatgcagtctgtcgacaccatgtcaagcactcccactggcgtggaaacacctgacgtcattgatcttcggaagcaacagaggaaagagtctgaaaggccaacagataagcagttataccaggttcttgagcagaaggaggagaaaatcgcacctggaaccctctatgggtcaagccatacgtatgtggttggggcacaggataaggctggggttaaaagggttgatcttctcaagaatcaaaagtccgacaaagtggacgtcaccatacatcccgaggagctcgaggttatggacgatgtcctggcagccaagtatgaagaagcccgggaggaggagaagctccggaaccagaaggaagacttcagcgacatggtggcggagaacgcgagcaagaggaagaggaagcacgagaaggacgggaaatcttccaaaaagaaggacttcaagttctagacggcgccgttttgttactgttgctcttccgcttcccaggaggaggatgtttccatttcttcctgtagcctgtactatactctaaatcaagctgtgtatgtatacttagcctctggcaaatgttgaagtgctggatgaaaaaagaaatgaagctctgtagtccatgcatgagaacaagttatgatattaaatgtaactgctagcattattttattgctgttatgaagagtgatgctaagtttgctaaaaaaaaaataaaaaaaaatggaaagcaaaaatagaaaaggagataaaaaaggcatggaaaatttatttccaattagaaagatgtattaggaaaaggggt

SEQ ID NO: 15534 - DNA, 707 bp, Triticum aestivum
  Clone ID: PAT_TA_15534
tagcgtggtcgcggccgaggtacaggcagcagcgtagcagcatgtttttgcttattcacatgatatacatcgatcgacctctgctgagaataagagcgttttttacactaatagtagttcgtagtagctgcttgagttagttacttgctggtttggtagggcgcctcgcagaactcgcccccaagatcgtcgcacgcctcgtctgggaacaccgtttttggctcgtcgtaggctaggtactccctctccacctccggcgcccttgcgacagcggcagcggggccgccggtgccggcgccgagcttcgtctccgggtacatctgcgcgtcgcacgcctcgccgccgaccaggtcgcaggcctccatggggaacaccgagacgttggagctgtagtccgcctccggcgccgccgccggccgatgcccggacgccggcacccacaatccttctgccaccggcaacggtggcgctcctcctcctcgccgccggcctaccccttacggcgacaggcagcacggccgacgaagcaacggcagcctgcatcatcgtctggttaatctgaccctgtctatctggaaatctagaatacgaggttgtggtgcttatgctcgtgccgattcggcacgaggttcccacaagttgtcccagcagggtgctatcaccaagaggatgactgccattgaagagttggctggcatggatgtgct

SEQ ID NO: 15535 - DNA, 2346 bp, Triticum aestivum
  Clone ID: PAT_TA_15535
ttgaattcggcacgagcttatccacatgcttgcgagatttacattattatttcatttctggaaagaggcaaccttaaataatttataggactcttcagattataagagaaaagccatataggtcataaatgcataggcattccaaaaaaaggcacaaaaattgagctagaaggtatgtataaattcatgtgaaactgagacataggcaagcatacataggaattttgcaggatcattcctacgatctggagggccattatagccagatttacctaacgtctctaagaaaatcttttgaaactcggaccatccagatatatcaacatggaaaagcctgctgaaagaaacttttgtagctgaagatgcttgattatacttcctatgggcttgttttgaaaagaatttttcctggcatgccatatgtgagcccccaaccatctctctctctctcccgcactcattttctctctctcacgttttgcctttgaggctgtagatctaagcactagctgtttgtaaaaatgctcaaggtgggctgcttagaggaggacagtatgttctacagtttcagttatatgattacatacaactaaacagaagtttacatgattctataattattgttggagatttttactcacagtaaatttcttcaaaggatctgtttaaagacaacaggcatatatttgtacagagatcatattattttgatacccatgtaagttctcttatctctttgatgtgcatcttctttaggaacttacctcgttgcaatttctggtcattctttgcatagctaaatcggtatcaagaatattgtattgtttatttcttaccatgtctgatcgactaatatggctacgtctatgcaatacttttatagatgaaattggtggttcatggagacccaaggtgcactgacagaagatatcagaggagcagaggaaaatgcaagtgtgtatgtgtgaaaaattattgctttaactcaagatcagttgttcgttctttcaagcgctatgttgcttactcaaatgtttgtggcgattgtatccttgtgccatgaatattttttacttagcagatcaatataaacatattggctatctatttaccaattctgaatttaaagcactttattttatggccttgagtaaaagttcagtcattgttggctggaagacatccttcaatacgccgtcaacacgagcttaccaagaaaggagattttgtgggatgatgtaagatatccacatgttgtatatgtgggaaaaaccaaaggctccgggatgttgatttttccggatgaaatgatttatcaggcaaaaactacaagtgaaatggcagaagtaacgctcaaaagcctgaatagaattccttggcaaagggtagatgttagcttcaagagaagtagacaatggatttttgcccatagcaccattcaggtccagttgtcgttgccttcacttgctttgtcgtttacccatctgtcagctcgccgatcccctgacttgctgtcaagttgagatcgaggagagagcaagccgttgcagaggagaggggatacgagggtgggcggaggtcaggcattgctaacagatttgcggcggagtgggagaggtgacgccgggccggccggcgcctcaccaccggctcctgtttggcggtggcaaagagaagggtgccgaggatgtgttgctctatgcatggctgttgaagtacatcatcgttatgatgtgtatggtttctctattttcagccctactgctccagatcccaaatcccatgaccatgcccccacctctccttcgttgaatgaagggagtctggttgctaaaaagtgacttttcttaatcagtatgtatggcccctctgcacatgccgtttcttcgtatttaagaggccctcaagctttgtcagttttctgatagatatggaattttaatttgatagtcccaacaacggtgggtactgatggagctatctattatttattgtcaatctgtaatacttttgtcagcttctagcatgtcgttactctgccagagtgcaattttctctgcatggcatacaccagttaccattagttgatatgtttgttgaagttttattgcaagttaaataatgtcaggtgctgatggctttagatatgtaaataaaatatgtcaggcgctgatggctttagatatgtaaataaaatatggtgattgtcaccggtatgtagtgtggcatactaatcaaatgactaagcatttaattattgttctgttatgttattgatttcaccggctttatgccggccgattagttctgaaggattccacaccggctaatttagattatgttact

SEQ ID NO: 15536 - DNA, 1348 bp, Triticum aestivum
  Clone ID: PAT_TA_15536
gcacgaggcttccttcgagcgtcgtctgcgagagactgcaagtgactgcctccgtgtgcgggtggtgtctgggagcggggatggcgacgcacttcgtgctcaacaccggcgccaagatcccctccgtggggctcggcacctggcagtccgaccccggcatcgtcggcgaggccgtctacgccgccgtcaaggcggggtaccggcacatcgactgcgccagggcctacaacaacgagaaggaggtgggtttggctctgaagaagctgtttgaagagagtgtagtcaagcgtgaggatctgtttatcacctctaagctatggtgtggtcatcatgccccagaagatgtgcctgagggcacttggggattctctcgatgacttgcagcttgactacttggatctttaccttatccattggccatttagagtcaggaagggaacaagcattggcaaccctgaaaacttcttaccacctgacatcccagctacatggggagcaatggagaagttacatgatgctggcaaagctcgtgcaattggtgtgagtaacttcgcgtcgaagaaattgggtgacttgcttgctgtagctcgcatacctccggctgttgaccaggtggagtgccatcctggttggcagcaatctaaactccataccttttgtcagtcggccggtgttcacctctctgcgtactcaccactaggttcgcctggttcaacatggatgaatggtaatgtcctcaaagaacccgtcgtcctctcaattgcagagaagcttggcaaaactcctgcacaagtggcgttgcgctggaacattcagatgggtcacagtgtactgccaaagagcgtgagtgaagaacggataaagcagaaccttgctgtttatgactggtctattccagaagacttgcttgcaaagttctctgagattaagcaggccaggcttctcatgggcaacttcatcgtcaacaaagacagcgtttacaagacccacgatgagctctgggacggcgaaatctaggacggctcctgtcgtggctgggagcagggcgccttactagtgtcagtcacttgttatgtatcgtcaaactgtaagcttaagagatgtatggtggtttagccccactgtgggaggaactcttcagtagactgcatggatttgcccctttaggtatggattttctgctaaacccgcgtgttgccaatggaggcatgaacttatcctagcttgttcctgcgactgggatcacctgttctgtaccgattgttggtttgctggtgtaattgtgttcctccaaagaagttgctccacacatgataataaagctggggccgtttgtttaaaaaaaaaa

SEQ ID NO: 15537 - DNA, 744 bp, Triticum aestivum
  Clone ID: PAT_TA_15537
ttcggcacgaggctttccctccccaaaacttcgacccgcctcctcgccgctcccgtccgtccgtcctcgccgcgcccccgctgttccccccgggttttcaggtcgccgagcttcgccccgtcagccagccgtcgcgtccatggcggaggtagcgcccgtcgatcaggggaagaaggaggaggaggagttcagcacggggcccctctccattctcatgctcagcgtcaagaacaacactcaggtgcttatcaactgcaggaacaacaagaagttgcttggtcgcgtgagggcatttgatcgtcattgcaacatggttcttgagaacgtcagggagatgtggactgaggttccaaagactggtaaaggcaagaagaaggctctcccggtgaacaaggacaggttcataagcaagatgttcctccgtggggattcggtcatcatcgtcctcaggaacccgaaatgagtttgacgactcggcgtaaaccagaagagtctgttttcgctatgctgctgttagtttgtatgccgaatgctctggatcagggagtgtgtaagagacagttatcaagcaagcattgcctgtactgattaatggtttggtgctgtagtctggatgttatgaattcacgtctttgtagtatctaatctaacaacgtgcactggtagcctctgtttggatcatcaatatgtctggtctgctggagagagttttcagtttcagaatgttttgtttgcgttcccctg

SEQ ID NO: 15538 - DNA, 1188 bp, Triticum aestivum
  Clone ID: PAT_TA_15538
ctcgagttttttttttttttttttctagcagtaattaagctctgaaattaactgcctaatggacagaaaattacatgataagacggaacaaagcatgaatgtgtgtttcagacaagcaacaagtcgatcgggtacatataaatagtagcatcagagtatctccagggagaaccgattatatagcgagtttgaatgaacattatgcggaaaagaaaaagaaaaaaaagagagtggaaattaagtaggctcggaacaacaaaactttaaaagaaaggcggttaacgacggcgacggcgtaagggaataattgtaatggtctctagaagcgacagcgcaatctgccaatctgccttggcttagctatgagctaacatggaatgaagccttgttcccacatcatacggctggccagtccttcctaatctcaaagtagtaactcatctccaagtagttcttgccatcatcatcaataaactttagtttagcagaataggagcctcttgcaaacatgccagcaggggtggtctcttcttcaccctcatatgtgtagggctctgcctggggactgaatgtccccagcatcatcttctggttctcaactcttactccagtcttccagacggtgttggtgtacttgagacccgacacaatgttgttggagacgatgaacgagaagcggaagctgtaggcgctgccgtccttgagcgcgaaggcgtagcccttctcgtcggggacgaatgggatgggcaggaccaggtccggccgatccggcgacaggatggtcaggttcagcaccttcacctcgggctccgcagtctctccgagctgctctgtgtccacctgcccaagcagttgctccttccacctcctcagactctcatcatccttgtcgagctcgagctggtccttgaggggcacctgggggccgagcacgacggcgcgcttggcctcctcatcctcctcctcctcgacctcctggtcggggtgggcggagtgctcatccttatggtccatggccggcgacgcacggacgtgcgctcgcaactctgcctcccgcgcgaggctcctcctccgtcacacctgggagaaggccgggcagaggggtggcggtgcggttgacggggcgagcggcggcgatcggagggaaggagggagggaaggggggccgcggtgcgccggacgcgtggg

SEQ ID NO: 15539 - DNA, 2236 bp, Triticum aestivum
  Clone ID: PAT_TA_15539
ttttttttttttttttttttgaaacttcaagtgaatgtacaatatatacaggaaaagaaaagcatgacccattttgggttcaaatacagagataattacagcttgttaaaaaaaataaacacgtgcgtcaacagagggatcatgttctgagaagcatatatacagattttcaagtgtacgtgtacaggactgctgctccgacgccgtccaacttttccgaccatcaaaaaagctcaagccgctttcttgctcttgaacctgttggcgcacagcacgtacaccaaaaagttgaaaaagctgagccccgcgagcagccagaagaagtaatcaaggcgcccctcgttgaggttgtcagggatccacccgggcctccctcccctggtcgtgaagtaggcgaccatcgtgaggatgaaggcgctgaggtagttcccgagcgcggtggtgatgagctgcagcgcactgcagaggctccgcatggcgtccggcgactggtcgtagaagaactcgagcgccccgatgaaggtgaacacctccgaggcgccgaccaggaagtactgagggatttgccacaggatgctcagcggaaccgggacgttctggtccaccaggtgcgcctccctggcgatggccagcctctttatctcgaggaccgcggctgctgacattgcgaggatggagattaccaggccgatgcccatccgctggagctctgaaaagcccctctccttgccggtgaacctcctggctattgggaccaggatgctgtcatagataggaacccatataatgacactgaccacgtcgaaggtggatagagatgctggagggatgcttgaatgagccgattgttggatcaagcaccatcccttgttccacaaacatggtggacatcttgagcattggacactggaaaacacaattgtcgttgccccggacagggaacatccttacccaaatcttcagttcctcccacctgggtgacggtgcacacccgccatgggttgttgaagctatcttctttcacatcaagatcagtaattgtagccgccttgtccagacatctgagttcatcagtgtgctccaattgccgactcccttcgattgctgaaaccccatctgctagctcgtacaagagagagctgtcctctggaacaggtgcgttccacttgcgcaaagtggcagcaactacctggcatactcgtgtgataggactgccacctggcttttggaatctataaagtgaggtgccggcaaagaagcttatgatggcaagacccatgaatacggtcggaatgccaaagcctaatccccatcctaaattgtcttgcacccaaaccagaaaactgcttgatataagggcaccaatgtttattgaaaaatagaaccaattgaagaaagaccccttctggattcgctcagctggatctgtgtcatcaaattgatccgctccaaaagatgagacacatggcttgattccaccagtgccgagcgcaattaggtaaagaccaagaaaaaatacggtatactgcaaaggactggcttctgggcaaatggctccttcacaagatggaggcatgagcataggaactgatgctgaaagagtcagtactgacatcccaatgaagtatattgtggagaacgttgcgatcgtccaatacctcccccagtatgcatcagccaggatagctccaataaggggagtcaaatagcaagttccctgccatgtagtcacatttctagcagcagaggagttaccatcatgtagtttttttgtcaagtaagtcacaaggtttgtcgagatgccataataggccaaccgctcacagcattcattacctaagatgaatgggcatgccttccatctgccagttttctccttcacgacagggtttcccgaaaagtcgacagatccatctccagtgtatgtaagttggttcgattcctccgggttagcgaggagcccctgctccagggtggggtcgccggcctctgccatggtggaacggcgagcctccggtccgatcggcgcgcgggagagaacggcgggttggggctgggatactctgctcggaagccgaatatatggagggagggaaacttgtagatctggatacgtagggtccaaagtccaaccggaaacagtgaagggcacggcaccagcaccggctagtcttcagggagggagttggggtgggagaaggaatttggagtcggagtggtgcggacgcgtgggtcg

SEQ ID NO: 15540 - DNA, 734 bp, Triticum aestivum
  unsure (1)..(734): unsure at all n locations
  Clone ID: PAT_TA_15540
cgcgtgggcccgcctcctcgccgccaccgccgctcccgtccgtccgtcctcgccgcccctccgccgtccccccgggtttccaggtcgccggccttcgccccgtcagccagccgtcgcgtccatggcggaggtagcgcccgtcgatcaggggaagaaggaggaggaggagttcagcacggggccgctgtccattctcatgctcagcgtcaagaacaacacccaggtgcttatcaactgcaggaacaacaagaagttgcttggtcgcgtgagggcatttgatcgtcattgcaacatggttcttgagaatgtcagggagatgtggactgaggttccaaagactggtaaaggcaagaagaaggctctcccggtgaacaaggacaggttcataagcaagatgttcctccgcggggattcggtcatcatcgtcctcaggaacccgaaatgagtttgacgactcggcgtaaaccagaagagtctcttttcgctatgctgctgttagtttgtatgccgaatgctctggatcagggagtgtgtaagacagttatcaagcaagcattgcctgtactgattaatggtttggtgctgtggtctggatgttacgaattcacatcttttgtagtatctaatctaacaacgtgcactggtagcctctgttcggatcatcaatatgtctgctgaagagagttttcagtttcaaaatgttttgtttgtgttgaaaaanacaaaaannaaaa

SEQ ID NO: 15541 - DNA, 921 bp, Triticum aestivum
  Clone ID: PAT_TA_15541
tcgacccacgcgtccgcctccctctgcgactccgttgcctctactcgcttgtgctttgggcgattccatccgaggcgagagaggagaggagagcagaggaggaggcgacggaggagaagttcggtagggagatcgatggggctgtcgttcgggacgctgttcggggcgctgttcgccaagaaggagatgcggatcctgatggtcggcctcgacgccgccgggaagaccaccatcctgtacaagctcaagctcggcgagatcgtcaccaccatccccaccatcgggttcaacgtggagacagtagagtataagaacatcagcttcactgtttgggatgttggtggccaggacaagataaggcctttgtggaggcactacttccagaacactcagggccttatctttgttgtcgacagcaacgacagagaccgtattgctgaggcaagagatgagctccacaggatgctgaatgaggatgagttgcgcaatgctgtattgcttgtttttgctaacaagcaagatcttcccaatgccatgaatgctgctgaaataacagataagcttggtctacactctctgcgtcagcgacactggtatattcagagtgcttgcgccacaagtggggagggtctgtatgaagggttggactggctctccaacaatatagccagcaagtcctgaaagcttccaatggattggcagagccgcagaagcgactggcggctggacaaatgactggaatatgtaggcatgttaaagtgctgccagagtgttgacatgtctttgtaagctctatctttgagcagttatcacactgttactatgttgtatcaatgattgaatgtacacacgaggaaaacctttatgctatagtgaaaatgtcaggtgctcctgagcctgatgagtcatgaaaaaaaaaaa

SEQ ID NO: 15542 - DNA, 1409 bp, Triticum aestivum
  Clone ID: PAT_TA_15542
gagaactagtctcgagttttttttttttttttttttaccgtggaaaaaaaaacatcttttattcagagcaagcgtacacgaaagatttacgttactgataatgcatccttttttatcccccacgaaattacatttcttcaaacttcttccttgactgtaaaaattattcttctgctgtgggtctgcctttgctgcttgtgaggatctatacctgaggatgatcgacttcatttcacgcctctactttgcagcatccttggacaggaagttgtgcgactgggtgtggcgcccattggagagctcgtccaccgagtcgccccgctcgaacacggccgccgctcccatgccggaaccgatgcacatggtcaccacgccaaatctgcagtccctgccccggcgcttcatttcgttcagaagcgtagagatgcaccgggcgcctgttgctccaagaggatgccccatagcgatggctcctccattcacgttcacctttgaccggtcgaggcccagcttgttgcagcagtagacaaattgggaggcaaaggcctcgttcaattcaaagagatcaatatcatcaatctcaaggccagcagacttcactgcagcaggtatggcgaccgcaggaccgacgcccataacagctggatccactccaacagcaacgaaactcctgaaaacgccaagtatagggagccccttgctcaccgctacagatctcttcatgagaagaacggctccagcaccatcactcacttggctagaattacctgcagttgtagtcccatccttcttaaaaactgtcttaagcttggccaatccagatagcgtggtccctggcctaatcccatcatccactgatatcacaactttcttttcctctccagttttggggtcaataagctttgtatgcaccggaataatctcatccttgaactttccagaagccgtggctgcagcagctctcgcatgagactcagcagcggccttatcttgctcttctctggttacaccgtatcgctgagcaacattttcagatgttattcccatgggtagaagacaatcctgtgctttctgtagttcaatgactcttgggtttacttggccttcccaaccaacggagttcaccgacatggattcaagacctgcaccaatccctatgtcatagaaaccagcttttattgcagcagcaacatctgctactgcctgtagccccgatgagcattggcggttcacagttctcacggggacggtctcaggaattccagctaacagagatgacgtcctgcactcgatcgcacgctgagaacctgggcctagcaccgtcccgaccacaacgtcgccgatttcagctgggttgattccagttttgtccaggacagcctgaggacaggaataagaaggtccctcgg

SEQ ID NO: 15543 - DNA, 1208 bp, Triticum aestivum
  Clone ID: PAT_TA_15543
gcggggacgctctcctcttcttctccaaaggcaaccacacctccctctgcgtctccgtagcctctactcgcttgtgctttgggcgattccatccaaggacagaagaggagaggagaggagaggaggaggcggcggaggagaagtttggtagggagatcgatggggctgtcgttcgggacgctgttcggggcgctgttcgccaagaaggagatgcggatcctgatggtcggcctcgacgccgccgggaagaccaccatcctgtacaagctcaagctcggcgagatcgtcaccaccatccccaccatcgggttcaacgtggagacagtagagtataagaacatcagcttcactgtttgggatgttggtggccaggacaaggttaggattttgctatttttttcttcttggtttactctttggctgttatttccttttttgtcgtcacatgaataaaatgctaatcacctgtttgcagttactaaagtgtttcattgacaaaagtctatttatgtaaagaaaagctgatgatttatgtatgccattttcaaaacagataaggcctttgtggaggcactacttccagaacactcagggccttatctttgttgttgacagcaacgacagagaccgtattgctgaggcaagagatgagctccacaggatgctgaatgaggatgagctgcgcaatgctgtattgcttgtttttgctaacaagcaagatcttcccaatgccatgaatgctgctgaaataacagataagcttggtctacactctctgcgtcagcgacactggtatatccagagtgcttgcgccacaagtggagagggtctgtatgaagggctggactggctctccaacaacatagccagcaagtcctgaaggcttccaatggattggcagggccgcagaagcaactagcggctggacaaatgactggaatatgtaggcatgttaaaatgctgccagagtgttgacatgtctttgtaagctctatctttgagcagttatcacactgttactatgttgtatcaatgattgaatgtacacacgaggaaaacctttatgctatagtgaaaatgatgccatgtcaggtgtccctgagcctgatgagtgatgatgatcctgccccggttttgtaaccagaaatgtattttgggggtgattaattttgtttcctgtgattaaaaaaaaaaaaaaaaaaaaaaaa

SEQ ID NO: 15544 - DNA, 826 bp, Triticum aestivum
  Clone ID: PAT_TA_15544
gccggccgggccgggaaaaatctcaactcagtcaacaccatcaccaccctcgacacggccgatcgctcattcccctccggcatcacgacaaccgcaatcatgagctccaccaactccgttcagtgcttcggtaagaagaagacggctactgctgtcgcccactgcaaggccggtaagggtctcatcaaggtcaacggacgtcctctccagctcgtccagcctgagattctccgcttcaaggtctacgagcctctcctcgttgttggccttgacaagttcgccaatgtagatgtgcgcgttagagtatctggaggtggccaggtgtcacaggtctacgctatccgacaagctatcgccaagtccctgatcgcctactaccagaagttcgtcgatgagcactccaagaacctcctcaagcaggctctcgtccagttcgaccgaaccctcctcgttgccgacaaccgccgttgcgagcccaagaagttcggtggtcccggtgcccgtgcccgcttccagaagtcttaccgttaaacggttcaagatgttggtcggaatggggctcaaaagcgtcgagtcggggcgatgttgcagtggaggatacaacaggcagtgcgaaaaggggaccggagtcacaatttccctggtttgggaatgggttacctattgacatttgcatggccttgcttttggcggattgaacaggatctggcaggcaaatgaaatctttcaagttaactatgtggctcacgctgcagtggtttgtgatgtcaatgaactgtctcctcgccggacttgctcctcaaaaaaaaaaaaaaaaaggccccta

SEQ ID NO: 15545 - DNA, 660 bp, Triticum aestivum
  unsure (1)..(660): unsure at all n locations
  Clone ID: PAT_TA_15545
ttttttttttttaagacgaacgaattgatcactgcatttcgtttatgtgcaaaacagtacagacagcgtagcagcatgttcttgcttattattcacatgatgtacatcgatcgacccctgctaagaagaagtgcaacttgatggatgtactgctgctgctagtgggtagctacttggtggtttggtagggcgccctcgcagaactcgccgccaagatcgtcgcacgcctcgtccggggaacaccgtttttggcccgtcgtaggctaggtactccctctccacctccggcgccctcgccggcggccgccggggcgcctgcaccggcgccgagcttcgtctccgggtacatctgcgcctcgcacgcctcgccgccgaccaggtcgcaggcctccatggggaacaccgagacgctggagctgtagtccgcctccggcgccgccgccgccgatgcccggacgccggcacccacggtccttctgccgccgccagcaacggtggcgctcctcctcctcgccgccggcctgccccttacggcgacaggcagcacggccgacaaagcaacggtggcctgcatcatctcctggttaatctgatcctgtctatctagaaatctgaatacgaggggggggcccggtacccaattcgccctatagtgnctgt

SEQ ID NO: 15546 - DNA, 2283 bp, Triticum aestivum
  Clone ID: PAT_TA_15546
tttttttttttttttttaagcagttctaaaatactaatatcactgggaggaattcattgatacagcactaactcacgggctgcaaaacagtaccgctaatgctgtcgaatttaacagacgcacgaggtcatgtcatgcaatgccatacatttaggccatcaggaggtccccggttctcgcctcaacacacatacaattacctaacgtcataataatatttttatacccaataccgggcgggcaggccaggttacttgccgtagatgcacaggcccacctcgtagctcaccaggagcattattgctgacaggaaaaagagacagaagccgccgcgcagcaccgcagtcactgtgttgcagccaccacagtgtatgcggttatcaggctggaaacctgtggagaagacaagctccatgtcttcatccttctggaacgaccacttgccttgtcgagaagcaacagttaagcttcctatgctgattacttcggtagacacgctgatggtgttagggtgcacaccagacaaggatttgcctgggaactctgctgcaaaagcagggggagccgagattgaatccagcatctttacaaaacgctttcccatggagccattcttagcctgagaatctggtaaaacaacacaatttaactggccaccagcttcagataacctagcggacgacggggccccaactacaaaattaggttctacaaccttttgagttggactatatgtatagctgggattgttgacctcttgagtaagaactggcccattaaagacatgggagctgctcccagccgactgctgtacagagcacatcatatcattaaataagttatcgtccattgcatcatagtatggaataccatcatccagtgtctcgataccagatagaatggttgctggggaggccgagaaatccattcgtctgtctaaatccatcactgaacattgagttatcaaaggggcgcatcaaaatacataagagaatcatcttctggcttgactgaatttgtaatagaagggtgtgggagatcagtcatagttgagcccaactgggaggagtcatcttgtagtgtctgcaacaactgggccaactcatctggctggaaaggctgatcaccagtgatcagaggaacctcattgttggacctgtttacagcatccaaggggaaagctgttttccaggcccaaccatcagaaggccagatagtggaatcattgcctagaggtaactccaaatccttcagctctaggaatttatcattggggctagaactattaagaaaatctccaacattggcattagataacatattttcaacaagcattgggctattttgttctccaggatgaatatactgaagaaaattagaacaaagacttgggtcattcaaaatgtcccctgaatttccttctacgtcttcagaatggctgctggtgtttgaagtgtcagaaaccggcaaaacaacactgccattctcattttgaccagccaagtcctgaatgagatcattcatctgaagatatcctttctccatagcaccaggagcctcatgctcaccaaaaacgtccctctgcactggcataggaccaaaatcatcatcctcatccgcctcccactcctcctcgacgaagggagctccatactgtgccccgttttgaggaccaggcccagccttctggaagattcggcacactacaaatgaatcctgtgggatcccggctgcgccatcgccctcaaggcgatactcgtgcatgacccagttggtgcgctcgcccttgggcgcgcggccagcgtggaagacgagcgtcttcttcatcccgacaaccctagctccatggcggacctccctgtccttgccggtggtcttccagtagcctcctgcagtggcgcggttggtgcgcgcgcggttggcgtgcttgcggtcgaggcggctgaagaagtaccactgggaatcgcggctgcggaggcgcgaccttgccgggaggtcccatggctcgaccttgtagaggtctacctcagcgatggcgtcgaccttgagcgggcgaccgagcaccttgcgcttgaggtagtaggagacgagctcctcgtctgttgggtggaagcggaagcccggggcaagggaggtcgggtcatccggcgcggccgccggggcggaggaggaggacgaggaagggtgggtcatgtacctgaggaggcttagggttccaggagaggagagggaagattggattgggagattggattggggaaagttttggctcgtgccgaattc

SEQ ID NO: 15547 - DNA, 1679 bp, Triticum aestivum
  Clone ID: PAT_TA_15547
ttttttttttttttttttactgtagaaaaaaaatcatcttttattcagagcaagcgtgcacgaaagatttatgttactgataatacatccctttttgtcccccacgaaattacatttcttcaaacttcttcttgcctgtaaaaattattcttctgctgtgggtctttctttgctgcttgtgaggatgatcgatttggtttggtttcacgcctctactttgcagcatccttggacaggaagttgtgcgactggatgtggcgcacgttggagagctcgtccaccgagtcgccccgctcgaacacggccgccgcgcccatgccggacccgatgcacatggtcaccacgccgaatctgcagtccctgccccggcgcttcatttcgttcagaagggtcgagatgcaccggggcacctgttgcgccaagaggatgccccatagcgatggctcctccgttcacgttcacctttgaccggtcgaggcccagcttgttgcagcagtagacaaattgggaggcaaaggcctcattcaattcaaagagatcaatgtcgtcaatgtcaaggccagcagacttgactgcagcaggtatggcgaccgcaggaccgacgcccataacagctggatccactccaacagcagcgaaactcctgaaaacgccaagtatagggagccccttgctcaccgctacagatctcttcatgagaagaacagctccagcgccatcactcacttggctagaattacctgcagttgtagtcccatccttcttaaaaactgtcttaagcttggccaatccagatagcgtggtccctggcctaatcccatcatcaactgatatcacaactttcttttcctctccagttttggggtcaataagctttgtatgcactgaaataatctcatccttgaactttccggaagccgtggctgcagcagctctcgcatgagactcaacagcagccttatcttgctcttctctggttacaccgtatcgctgagcaacattttcagatgttattcccatgggtagaagacaatcctgtgctttctgtagttcaatgactcttgggtttacttggccttcccaaccaacggagttcaccgacatggattcaagacctgcaccaatcccgatgtcatagaaaccagcttttatagcagcagcaacatctgctactgcctgtagccccgatgagcattggcggttcacagttctcacaggaacggtctcaggaattccggccaacagagatgcagtcctgcactcaatcgcacgctgagaacctgggcctagcaccgtcccgaccacaacatcgccgatttgagctgggttgattccagttttgtccagaacagccttgagaaattgggtaaggaagtccttccgggtaggtgtccttgaagccccctcgcttggcctttgcatatcggcgtccgggtaggcagcgacgatgacggacgtcgttccccgaagcaggagctccgctggtaggcggcgctgtccccggccgcgcacgccgacgcggatagctgggcctggctggatgcggaggggaggaggtgcgcgaggagcacgcgctgccggtcgatcgccttctccatggaagaagcagggagagatctctcgcgctgactctgaggagttcggggtcgggggagggaggcgtgcggacgcgtgggtcg

SEQ ID NO: 15548 - DNA, 806 bp, Triticum aestivum
  Clone ID: PAT_TA_15548
gcggcacgaggccgcccccgaaagccctagctccaagctccctccccacccgcggcggccgcctcctccccctcctcctcctcgcgcctccaagccgaccaacccgtcgggaaaatgagtcaggagacggtcaaccccaaggcctacccgctggcggactcgcagctgacgataacgatcctcgacctcgtccagcaggccgccaactacaagcagctcaagaagggcgccaacgaagcgaccaagactctcaacaggggaatatcggagttcgtggtgatggcagctgacacggagccgctcgaaatcctcctccacctcccgttgcttgcggaggacaagaatgtgccatatgtctttgtcccttcaaagcaagcccttgggcgtgcttgtggagttaccaggccggtcattgcttgttcagtgaccagcaacgagggtagccagctgaaacagcccattcagagtcttaaggatgctatcgagaagcttctcatatgatttatcaagacctttcagtgtgatgggcctctgcgacacagtttttcagagggcttggactggtgatggtgtcttgtctactaggtctttgtgttttttcagctatattttgcaagactgttatgttaaatcatgctgccattatgtcgtcttcttatatttgtgacttgtgtaatccataagacacatgtgtcatggcagttgaatttctccctagactcaacaaatgttgtaacgggtaatggtttatgagtttgagaattgggaactactagctgcttgtgtgcgattgctcaaaaaaaaaa

SEQ ID NO: 15549 - DNA, 2414 bp, Triticum aestivum
  unsure (1)..(2414): unsure at all n locations
  Clone ID: PAT_TA_15549
ccacgcgtccgtttctctcctccccacccacccaccaccactctccccccctcccttctttctccggagcggaggagagagcagcggccagcgcggcctccgtgctggtgcgtgctagagccgggcctcggggttcgcctgtggactccgcctgctcccttcccgtgctggttcggcccccgaccgccacccgccgccagccatgggcgggctcgaggagatcaggaacgaggccgtcgatctggagaacatccccatcgaggaggtgttcgagcagctgaaatgcacgcgccaggggctcacctctgatgagggggcgcagcgtgttgaaatcttcggcctcaacaagctcgaagagaagaaggagagcaaagtcctcaagttcctgggattcatgtggaacccgctctcctgggtcatggagatggccgccatcatggccattgcgctggccaacggtggtgggaagcccccggattggcaggatttcgttggaatcatcgttctcctggtcatcaactccaccatctccttcattgaagagaacaacgccggcaacgccgctgctgcgctcatggccaaccttgcgcccaagacaaaggtgctcagggatggtcgatggggcgagcaggaggcatctatcttggttcctggtgacattgtcagcatcaagcttggtgacatcgtgcctgctgatgctcgtctcctcgagggtgatcctttgaagattgatcagtctggacttacaggagagtctctcccagtgaccaagaaccctggagatgaggtcttttctggatcaacgtgcaagcagggtgagattgaggctgtggtcattgccactggagtacacactttctttggcaaggctgctcatctcgttgacagcaccaaccaagtcgggcacttccagcaggtcctcactgcaatcggaaacttctgcatcgtctcgatcgcagtgggaatcgtcattgagatcattgtcatgttcccgatccagcgccgcaagtaccgtgccggtattgagaacctgttggtcctcttgatcggtggtattccgattgccatgcctactgttttgtcggtcaccatggccattggttctcacaagttgtcccagcagggtgctatcaccaagaggatgactgccattgaagagttggctggcatggatgtgctttgcagtgataagactggcacactcacccttaacaagctcagtgttgacaagaacctggttgaggtgtttgcgaaaggtgtcgacaaagaacatgtgctgttgttggctgcaagggcttcaagggttgaaaaccaggatgccattgatgcttgcatggttggtatgcttgctgatcctaaggaggcaagagctggcatcagggaagtgcacttcttgccatttaacccaactgacaagaggactgctctgacttacatcgatgctgagggtaactggcaccgtgccagcaagggtgctccagagcagattattaccctgtgcaactgcaaggaggatgtgaagagaaaggtgcactctgtgattgagaagtacgctgagcgtgggcttcgttcgcttgctgttgcaagacaggaagtacctgagaaatccaaggattctcctggtggaccatggcaattcattggtctgttgcccctgtttgatcccccaagacatgacagtgctgagaccatccgcaaggcacttgttcttggtgtcaacgtcaagatgatcacaggtgaccaacttgctattggaaaggagactggtaggaggctggggatgggcacaaacatgtatccttcttctgcattgcttggccaaagcaaggacggttcacttgagtcacttcctgttgatgagctgattgagaaggctgatggatttgccgggagtcttccctgagcacaagtatgagattgtgaagaggctgcaagagaagaagcacattgttggtatgactgggagatggtgtcaatgatgctcctgctcttaagaaggccgacattgggtattgctgtccgatgatgctacagatgctgctccaaatgcttccgacattgtgcttaccgagccaagtcccaagtgtcattatcatgctgtcctgaccagcaagtgcattttcccagaggatgaagaactacacgattctatccgtttccatcaacacccgtattgtgcttgggtttaagctaatgccttgatccgggaatttgattcgctcccttcaaggccctaacatgcatcccaatgatggactacatgacataccaaggacagattaacaacccctgccganncngaaccaatgaatctcgcacggggttgtcccgaactactgccnatacggctctctcggtacaananaattctaaaaattcgtgcagcacaggaacanttaatatcgacgtcccat

SEQ ID NO: 15550 - DNA, 2512 bp, Triticum aestivum
  Clone ID: PAT_TA_15550
gaattcggcacgagcccgcccacccaccaccactctcccccctccctcccttccttctccggagcggaggagagagcagccgcgcggcctccgtgctgctgcgtggtagagccgggcctcggggttcgcctgtggactccgcctgctctcttcccgtgctggttcggcgcccgaccgccacccgccgccagccatgggcgggctcgaggagatcaggaacgaggccgtcgatctggagaacatccccatcgaggaggtgttcgagcagctgaaatgcacacgccaggggggtcacctccgatgagggggcgcagcgtgttgaaatcttcggcctcaacaagctcgaagagaagaaggagagcaaagtcctcaagttcctgggattcatgtggaacccactctcctgggtcatggagatggccgccatcatggccatcgcgctggccaacggtggtgggaagcccccggattggcaggatttcgttggaatcattgttctcctggtcatcaactccaccatctccttcattgaagagaacaacgccggcaacgcagctgctgcgctcatggccaaccttgcgcccaagacaaaggtgcttagggatggtcgatggggcgagcaggaggcatcaatcttggttcctggtgacattgtcagcatcaagctcggtgacatcgtccctgctgatgctcgtctcctcgagggtgatcctttgaagattgatcagtctggacttacaggagagtctctcccggtgaccaagaaccctggggatgaggtcttttctggatcaacatgcaagcagggtgagattgaggctgtggtcattgccactggagtacacactttctttggcaaggctgctcatcttgttgacagcaccaaccaagtcgggcacttccagcaggtcctcactgccatcggaaacttctgcatcgtctcgattgcagtgggaattgtcattgagatcatcgtcatgttcccgatccagcgccgcaagtaccgtgccggtattgagaacctgttggtcctcttgatcggtggtattccgattgccatgcctacagttttgtcggtcaccatggctattggttcccacaagttgtcccagcagggtgctatcaccaagaggatgactgccattgaagagttggctggcatggatgtgctttgcagtgataagactggcacactcacccttaacaagctcagtgttgacaagaacctggttgaggtgtttgcgaaaggtgtcgacaaagaacatgtgctgttgttggctgcaagggcttcaagggttgaaaaccaggatgcaattgatgcttgcatggttggtatgcttgctgatcctaaggaggcaagagctgggcatcagggaagtgcacttcttgccattcaaccctactgacaagaggactgctctgacttacatcgatgctgagggtaactggcaccgtgccagcaagggtgctcctgagcagattattaccctctgcaactgcaaggaggatgtgaagagaaaggtgcactctgtgattgagaagtatgctgagcgtgggcttcgttcgcttgctgttgcgagacaggaagtacccgagaaatccaaggattctcctggtggaccatggcaattcattggtctgttgcccctgtttgaccccccaaggcatgacagtgctgagaccatccgcaaggcacttgttcttggtgtcaacgtcaagatgatcacaggtgaccaacttgctattggaaaggagactggtaggaggcttgggatgggcacaaacatgtatccttcttctgcattgcttggccaaagcaaggacggttcacttgagtcacttcctgttgatgagctgattgagaaggctgatggatttgccggagtcttccctgagcacaagtatgagattgtgaagaggctgcaagagaagaagcacattgttggtatgactggcgatggtgtcaatgatgctcctgctcttaagaaggccgacattggtattgctgtcgatgatgctacagatgctgctcgaagtgcttcagacattgtgcttaccgagccaggtctcagtgtcattatcagtgctgtcctgaccagcaggtgcatttttcagaggatgaagaactacacgatctatgcagtttccatcaccatccgtattgtgcttggctttatgcttattgccctgatctggaaatttgatttcgctcccttcatggtccttatcattgccattctcaatgatggtactatcatgacaatatccaaggacagagttaagccatctcccttgcccgacagctggaagctcaatgaaatcttcgccactggtgttgtgctgggaacctaccttgctctggtgactgtcgtcttcttctggctcatccacaagacagacttcttcaccaacaaattcggtgtcgagtcaatcaggaacaccgaatttaaggagatgtatgcactgtaccttcaagtcagtattgtgagccaggctcttatctttgagactc

SEQ ID NO: 15551 - DNA, 2332 bp, Triticum aestivum
  unsure (1)..(2332): unsure at all n locations
  Clone ID: PAT_TA_15551
ccacgcgtccgcttatatataaaatcgacggggggggcacaggctgcagtgagcgagccgacgacgtaactccatccaagtcgaaccacacaccacactgccgccgcgtcccgtgctcccaggtgagatcgagcgcgagtagccagccgatgagccgcctcgtttcccggcggcacctcgccgccgccgcggccctccgacgatcccccgccgcgttcgcttccaggtggctgcacacgccggcatttgcgacggtgtcccccgaggagatctcaggttcaagcccggcggaagtgcagaattttgtgcagggaaaatggataaagtctgctaactggaactggatagtcgatcctttaaatggcgaaaagtttatcaaagttgccgaggttcaggggtctgaaataaagccatttgtggagagtttatctaaatgcccaaagcatggacttcacaacccacttagagctccagagaggtatctcatgtatggagatatatctacaaaagctgcacacatgcttggtcaacctgaggtcttagatttctttgctaagcttgttcaaagggtttccccgaagagctatcaacaagctcttttggaagttcaagtttctcaaaaattcttggagaatttctgtggagatcaggtgcgctttctggctcggtcatttgctgtccctggaaatcatgttggacaaatgagtaatggctatcgttggccatttggcccagttgcaataatcacaccattcaatttcccattggagattcccttgctgcaactgatgggtgcactttatatgggaaataaaccagtcctcaaagttgacagcaaagttagcattgtgatggaacaaatgatcaggttgcttcacgagtgtgggttacctgcagaggacgtggacttcataaattctgatggtatcacaatgaacaagctgctgttggaggcaaatccaaaaatgaccctcttcactgggagctcacgtgtggcagagaaattggctgctgatttgcaaggccggatcaagttggaagatgctggttttgattggaaaattcttggtccagatgttcaagaggtcgattatatttcatgggtttgtgaccaggatgcttacgcttgcagtggtcagaagtgctctgctcagtctatgctattcatgcacaagaattggtcatctagtgggctacttgagaaaatgaagaaactttctgagaggaggaagcttgaagatttgactattggtccagtccttactgttacaacagcaaccatgatagagcacatgaacaaccttctcaaaataccaggatcaaaggttctgtttggtggtgaacctttggggaatcactccatcccagaaatatatggtgccatcaagcctactgctgtatttgtcccactagtggagattcttaaaagcgataactttgagcttgtgacaaaggagatatttggtcctttccaggtggttacagaatactctgaagatcagcttgaattggtattagaagcctgtgaaaggatgaatgcgcatctgacagctgcagtagtttcaaacgacaagttattcctgcaggaagtactggggagatcggttaacgggacaacgtatgctggaattcgagcaaggaccactggcgctccgcagaaccattggtttggtcctgcgggcgacccaagaggcgcagggatcggcactccagaagccatcaaactcgtctggtcgtgccacagggagatcatatatgacattggccccttgcccaagaagtgggcacttcctgcggctacatgatatgcctaggctaggacaactagctagaagaacacgactggcgatggagagaaagcaacacggacagaattagctggttgagaactgacagtgtgttgtgttgaataatggaagcctcgtgtaggcaaattgggagagtctggaccccaaggaacacaataaaggtcgtaattatgaatggagtactacgatggttgtcaatggagctttagatgttattctactataaaagaattaaattatgcaacatctactatggttcgtcatctcccaggtcagctggtccgtcatgcttgagaagcaggcaaggtgtttgtcataatgcccaagagagaggtgggagagaagaaaaaagagagggtcaacgaagtcaacgtgcccggcattttgtttgccaggtcagcactgacgtgtgggcctgaccagtgaaaacgggcttaaaattatgcaatatataatcagtgtttttctgctaanccaaaaccantnggtttaccggnaaaaaaaanggtgggttttttaanccc

SEQ ID NO: 15552 - DNA, 863 bp, Triticum aestivum
  Clone ID: PAT_TA_15552
cggcacgaggccccactcagtcctcggttcccggcccggttcggttcgttagggtttagtagtggggaagaggaggaagaatggcggacgtcgagtaccgctgcttcgtcggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacctggacggccgcaacatcaccgtcaacgaggcccagtcccgccgctccggcggaggcggcggcggcttcagcggcggaggcggtggcggctacggcggccagcgccgcgagggcggcggcggcggctacggcggcggcggcggtggctacggaggtggccgcagcggcggcggcggtggctacggcagccgtgagggcggcggcggctacggcggcggcggcggcggctacggcggcagccgcggcggctccggcggcggcaactggagggagtgaatggtggggcccctcgctggccagttatcctagttacccgatccgtttttacctgtctaccaaaatgttatcgctcgctcgctcccgagtatcctagatctcgctccgtcgcgtaggttccgagatgttcaggctaccgttagatgtgacgctgctaccgttccgtgttactgttccgtccccgctctgttcgctatgcttctaagattgaaatgaaaacctgagcaaagtttgttcgcaaaaaaaaaaaaaaaaaaacctcggccgcgaccacgctaatcacttagtgaattc

SEQ ID NO: 15553 - DNA, 1389 bp, Triticum aestivum
  Clone ID: PAT_TA_15553
aagttcattggaacagagggattacaagcatttaagacgaacaaactactaatccgacgacgaattgatgactgcatttcgtttatgtgcaacacagtacagacagcgtagcagcatgtttttgcttattattcacatgatgatgtacatcgatcgacccctgtcccctgctaagaagaagttccaactttgtttggaggagcttcctccagtttgagcaatgaaatccctttaaccccgaaaaaaaaaaagaagttccaacttgatggatatactgctgctactagtaggtagctacttggtggtttggtagggcgcctcgcagaactcgccgccaagatcgtcgcacaacgcattgcgcataactacgcttaatctgtgcataactgcgcataggttgcaaaacgcacaattaacgcctagcgcttttttgaactatggtttaggcacttcatgcattgttggtgttgcagacttttgcactgctactaaatgtcctatatgttattctttagtagggatattggcatagagataccgcaataataaaaacgagaatcctcattactcacatatatattactatgtccttttgtttccattgaaacctattttgtttattcttttagttccaaggcaaaattctctgatttttagtaattcacatttaacaagacatgtgaatggaggatgggaggcatttagatgcaagtcagaaacttcttctgctagcttattttaagtttattatttccttgctccccttttcattgtagagaatgaaaagcatctttcacgctgccaacgggatctggaccaataagaggatcaggaggacgaatacagtggacactactactcagcaagatacagttcaaaccctgtatcctcctgattgatctcccttcgcccctgtttaagaatcatgtttcacccattcagtgttgtcttcagaattatagacacctcattctataaggaggccgccaccaagaagagcgaggttgtgtcaatggactcaggtgcgtgcactcgttggtggtttcagtctcataattttttctttccagttgaagaacgggcggtggatatctgttactccattctgtctttcctggtctgtacattttgagaagattgcatacattgtattgatgtgtcttttgtgtgaaactttgacttattggtcaacaatatatgagttatacgtcatcaaaaatatatcattgggaagttcattgaaatatgcatccaatggcatactctttgtggcgtataactcacatgttgttggtaaaatcaatgctcaaagttatttttcggtcacaaaacattgataaaactataaatcacattttaattcttggtgcgattacacctattagttgc

SEQ ID NO: 15554 - DNA, 1424 bp, Triticum aestivum
  Clone ID: PAT_TA_15554
gattcggacgaggccgcccccgaaagccctagccgccaagctcccccacccgcggcggccgcctcctcctccccctcctcccgcgcctccaagccgaccaacccgtcgggaaaatgagtcaggagacggtcaaccccaaggcctacccgctggcggactcgcagctgacgataacgatcctcgacctcgtccagcaggccgccaactacaagcagctcaagaagggcgccaacgaagcgaccaagactctcaacaggggaatatcggagttcgtgggtgatggcagctgacacggagcccgctcgaaatcctcctccacctcccgttgctcggcggaggacaagaatgtgccatatgtctttgtcccttcaaagggaagcccttgggcgtgcttgtggagtgactaggccggtcattgcttgctcagtgaccagcaacgagggtagccagctgaaacagcccattcagagtcttaaggatgctatcgagaagcttctcatatgatttatcaagacctttcagtgtgatgggcctctgcgacacagtttttcagaggcttggagctggtgatggtgtcttgtctactaggtctttgtgtttttttcagctatattttgcaagactgttatgttaaatcatgctgccattatgtcgtcatcttatatttgtgacttgtgtaatccataagacacatgtgtcatggcagttgaattttctccctagactcaacaaatgttgtaatgggtaatggtttatgagtttgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccttttaaaagatccaattttaacaaccgggggggggaaaggaaaatttttttttttggggcccccaaatttaatttagggggcggggttttaaaaggggggggggggaaaaacccggggggtccccaatttaatgggcttggaaaaaatcccctttttccccgggggggtttttccaaaaaggccccccccgagccccctttcccaaatttggccccccctgttggggaatgggaaccccccctgtaggggcctttaagcggggggggggggggggggttccccgccggggggcccgttttttttgggccgggccctttaggccccggcttttttgggtttttttcccttttctttttggccccggtgtgcggggttttccccccgggttgcttttatatgggggggcccctctttaagggcccccaatttagggggcttttagggccccccgcccccccaaaacctgtgtttgggggggggggctccccgtggggggcccccccccc

SEQ ID NO: 15555 - DNA, 2791 bp, Triticum aestivum
  unsure (1)..(2791): unsure at all n locations
  Clone ID: PAT_TA_15555
cgccaagctcgaaattaaccctcactaaagggaacaaaagctggagctccaccgcggtggcggccgctctagaactagtggatcccccgggctgcaggaattcggcacgagcacccacccaccaccactcccccctccctcccttctccggagcggaggagagagcagcagccagcgcggcctcccgcgttggtgcgtgctagagctgggcctcggggttcgcctgtggactccgcctgctctcttcccgtgctggtccggcgcccgaccaccacccgccgccagccatgggcgggctcgaggagatcaggaacgaggccgtcgatctggagaacatccccatcgaggaggtgttcgagcagctgaaatgcacgcgccaggggctcacctccgatgagggggcgcagcgtgttgaaatctttggtctcaacaagctcgaagagaagaaggagagcaaagtcctcaagttcctgggattcatgtggaatccgctgtcctgggtcatggagatggctgccatcatggccatcgcgctggccaacggtggtgggaagcccccggattggcaggatttcgtcggaatcatcgttctcctggtcatcaactccaccatctccttcattgaagagaacaacgccggcaacgctgctgctgcgctcatggccaaccttgcacccaagacaaaggtgcttagggatggtcgatggggcgaagcaggaggcttcaatcttggttcctggtgacattgtcagcatcaagctcggtgacatcgtccctgctgatgctcgtctcctcgagggtgatcctttgaagattgatcagtctggacttacaggagagtctctccctgtgaccaagaaccctggggatgaggtcttttctggatcaacgtgcaagcagggtgagattgaggctgtggtcattgccactggagtacacactttctttggcaaggctgctcatctcgttgacagcaccaaccaagttgggcacttccagcaggtcctcactgcaatcggaaacttctgcatcgtttcgatcgcagtgggaatcgtcattgagatcatcgtcatgttcccgatccagcgccgcaagtaccgtgccggtattgagaacctgttggtcctgttgatcggtggtattccgattgccatgcctacagttttgtcggtcaccatggccattggttctcacaagttgtcccagcagggtgctatcaccaagaggatgactgccattgaagagttggctggcatggatgtgctttgcagtgataagactggcacactcacccttaacaagctcagtgttgacaagaacctggttgaggtgtttgcgaaaggtgtcgacaaagaacatgtgctgttgttggctgcaagggcttcaagggttgaaaaccaggatgccattgatgcttgcatggttggtatgcttgctgatcctaaggaggcaagagctggcatcagggaagtgcacttcttgccattcaacccaactgacaagaggactgctctgacttacatcgatgccgagggtaactggcaccgtgccagcaagggtgctcctgagcagattattaccctgtgcaactgcaaggaggatgtgaagagaaaggtgcactctgtgattgagaagtacgctgagcgtgggcttcgttcgcttgctgttgcaagacaggaagtacccgagaaatccaaggattctcctggtggaccatggcaattcattggtctgttgcccctgtttgatcccccaagacatgacagtgctgagaccatccgcaaggcacttgttcttggtgtcaacgtcaagatgatcacaggtgaccaacttgctattggaaaggagactggtaggaggctggggatgggcacaaacatgtatccttcttctgcattgcttggccaaagcaaggacggttcacttgagtcacttcctgttgatgagctgattgagaaggctgatggatttgccggagtcttccctgagcacaagtatgagattgtgaagaggctgcaagagaagaagcacattgttggtatgactggagatggtgtcaatgatgctcctgctcttaagaaggccgacattggtattgctgtcgatgatgctacagatgctgctcgaagtgcttccgacattgtgcttaccgagccaggtctcagtgtcattatcagtgctgtcctgaccagcaggtgcattttccagaggatgaagaactacacgatctatgcagtttccatcaccatccgtattgtgcttggctttatgcttattgccctgatctggaaatttgatttcgctcccttcatggtccttatcattgccatcctcaatgatggtactatcatgacaatatccaaggacagagttaagccatctcccttgcccgacagctggaagctcaatgaaatcttcgccactggtgttgtgctcggaacctaccttgccctgatgactgtcgtcttcttctgggttatccacaagacagacttcttcacaaacaaattcggtgtcaggtcaatcagggacagcgagtttgagatgatgtctgcactgtacctccaagtcagtattgtgagccaagctcctatattcgtgacccgtcacgtactgggcctttgttaacgcctggttcccctggtacgcctcctctccacatggtgcaacaccacgcgtcnagcaacgggagttgcaagataaaggaatcggtgggctgggctgggtatcngntctaacatggtcacttccactnacatttcagtctcaccgattggctangganggccgg

SEQ ID NO: 15556 - DNA, 4383 bp, Triticum aestivum
  Clone ID: PAT_TA_15556
cgtccgcccacgcgtccgcccattcccacctccccccagcctcctccacgctcactcgcgcgcaggggctccgggccgaggacgcaagcgcgcaaccgactcgactcacccacccaccccgaccgcgcgttggagctccccgcggaactcgcagccatgctgtccgcgcgcaccgccgccgccgcgtcccccgccgcctccctgtggaagcgcggaggcggcgcgggggcccgcggcgacggatgcacgagctgcttggaggtgcggaggagggccgcggcggtgacggtccgcgcggcgcagcccaagagggtcgaggcggtggcgatggagtcggccgccgagaccgcggaggccgagaaggaggtggccgccgagaaggaggtggccgcggcgggcggcggcgtggaggacaagtacggcgaggacagggccacggaggagctgcccgtcacgccatgggccttctccgtcgcgagtgcttatacacttctgagagatccgcatcacaacaaaggactggcctttaccgagagggagcgggacgcgcactacttgcgtggccttcttcctccaggagttgtctcccaggatctccaagtgaagaagatcatgcataaccttcgacagtacaaggtcccgttgcagcgctatgtggccatgatggaccttcaggagagaaatgagaggcttttctataagcttctaattgataacgtggaggagctgctccctgtggtttatacaccaactgtaggtgaagcctgccagaagtatgggagcatatttaggcgcccacagggtctgtatgtcagcttgagagacaaggggaaggtcattgacgtgctaaggaactggcctgagaggaacattcaagttattgtagtcactgatggtgagcgcattttggggcttggagatttgggttgtcagggaatgggaattcctgtcggcaaactttctctgtacactgcccttggaggagttcgcccgtcagcttgcttgcctattacaattgatgttggtactaacaatgagcaattgctcaatgacgagttctacatcgggcttcggcaaagacgtgctactggagaggagtatcatgaactcatggaagagttcatggatgctgttaaacaaatatatggtgaaaaagttctcatccagtttgaagactttgccaatcacaatgcatttgatttgcttgcgaaatatagcaagagtcatcttgttttcaatgatgatatccagggaacagcatctgtggtccttgcaggtctgttatcttcactgaaggttgtcggtggaaccctagcagagcacacctatttgttccttggtgctggcgaggctggaactggtattgcagaactcattgctcttgagatttcaaaacagacaaatgctccaattgaagagtgccgcaagaaggtttttctggtggattcgaagggtttgatcgttagttccagaaaaaactcccttcagccattcaagacatcttgggcacatgagcgcgaacctgtgacaaccttgttagatgccatcaagtccatcagacctacggtgctgatcggaacatctggagttgggagggctttcactaaggaagttattgaagctatggcttctttcaacgagagacctgtcatcttctcattgtcaaatccaacatcgcattctgaatgtactgctgaagaagcatacaaatggaccaagggtcgtgcagtgtttgccagcggaagtccgtttgaccctgtggagtatgatggaaagattcatgtgcctggccaggcaaacaatgcttacattttccctggatttggccttggtgttgtaatttctggagcaatccgcgtacatgaggacatgcttcttgctgcctcggaaacactagctgcacaggccactcaggagaacttcgacaagggatccatctttccacccttcaccaacatcagaaagatatctgccctcatcgctgctagcgtggctgcaaaagcctacgaactcggcctggcgactcgcctgccgcggccgagagatctggagaaatatgcggagagctgcatgtacacccctgtctaccgcagctatcgttaatgcagtggagatcaattttgcagtaataaaacgcaaggtcgcaggatgctgcgacgctgttgttgtctgtcgctgttcttgctgctgctggaactcgtatctgtctatacatatatgccgtgtctgttgtaatgctgtggaagaagttaagcaaactgtcttgtgtaccaacgtttgttattcgtgtaggttgagtgtaacgagtgtaataaggacacagagctctagttctcaaggtaatatggctagtgctcctcgccttttatctcaactgggatccttgaccatatatgaaaataaacgttggtacacaagacagtttgcttctctcccagagggggaaatcattgtcatcaccacactgccgccgcgtcccgtgctcccaggtgagatcgagcgcgagtagccagccgatgagccgcctcgtttcccggcggcacctcgccgccgccgcggccctccgacgatcccccgccgcgttcgcttccaggtggctgcacacgccggcatttgcgacggtgtcccccgaggagatctctggttcaagcccggcggaagtgcagaattttgtgcagggaaaatggataaagtctgctaactggaattggatagttgatcctttaaatggcgaaaaatttatcaaagttgctgaggttcagggatctgaaataaagccatttgtggagagtttatctaaatgcccaaagcatggacttcacaacccacttagagctccagagaggtatctcatgtatggagatatatctacaaaagctgcacacatgcttggtcaacctgaggtcttagatttctttgctaagcttgttcaaagggtttctccgaagagctatcaacaagcacttttggaagttcaagtttctcaaaagttcttggagaacttctgtggagatcaggtgcgctttctggctcggtcatttgctgtacctggaaatcatgttggacaaatgagtaatggctatcgttggccatttggcccagttgcaataatcacaccgttcaatttcccattggagattcccttgctgcaactgatgggtgcactttatatgggaaataaaccagtcctcaaagttgacagcaaagttagcattgtgatggaacaaatgatcaggttgcttcatgagtgtgggttgcctgcagaggacgtggacttcataaattctgatggtatcacaatgaacaagctgctgttggaggcaaatccaaaaatgaccctcttcactgggagctcacgtgtggcagagaaattggctgcagatttgcaaggccgaatcaagttagaagatgctggttttgattggaaaattcttggtccagatgttcaagaggttgattatatttcatgggtttgcgaccaggatgcttacgcttgcagcggtcagaagtgctctgctcagtctatgctattcatgcacaagaactggtcatctagtgggctacttgagaaaatgaagaaactttctgaaagaaggaagcttgaagatttgacgattggtccagtccttactgttacaacagcaaccatgatagagcacatgaacaaccttctcaaaataccaggatcaaaggttctgtttggtggtgaacctttggagaatcactccatcccagaaatatatggtgctttcaaaccgactgctgtatttgtcccactagtggagatacttaaaaatggtaacttcgagcttgtgacaaaggagatatttggtcctttccaggtggttacagaatactctgaggaacagcttgatttggtattagaagcctgcgaaaggatgaatgcgcatctgacagctgcagtagtttcaaacgacaaattgttcctgcaggaagtactcgggagatcggttaacgggacaacatatgctggaattcgagcaaggaccaccggcgccccgcagaaccactggtttggtcctgcgggtgacccgagaggcgcggggatcggcactccagaagccatcaaactcgtctggtcttgccacagggagatcatatacgacattggtcccctgcctaagaagtgggcacttcctgcggctacatgatatgcctaggacaactagctagaagaacacgacggcggtggagagagagcaacacggacagaattagctgggtgagaagtgacagtacgttctgttgaataatggaagcctcgtgtaggcattgggagggtcttgacccccaaggaacacaataaaggtcataattatgaatggaagtactacgatggttgtcagaaaaaacaagtggagg

SEQ ID NO: 15557 - DNA, 1678 bp, Triticum aestivum
  Clone ID: PAT_TA_15557
tcgagttttttttttttttttttttgtttagaaaaaaaatcatcttttattcagagcaagcgtacatgaaagatttatgttactgataatacatccttttttatcccccacgaaattacatttcttcaaacttcttcttgcctgtaaaaattattcttctgctgtgggtctctgctgcttgtgaggatgatcgacttcgtttcacgcccgcctctactttgcagcatccttggacaggaagttgtgcgactggatatggcgcacgttggagagctcgtccaccgagtccccccgctcgaacacggccgccgcgcccatgccggacccgatgcacatggtcaccacgccgaatctgcagtccctgccccggcgcttcatttcgttcagaagggtcgagatgcaccgggcgcctgttgctccaagaggatgccccatagcgatggctcctccattcacgttcacctttgaccggtcgagtcccagcttgttgcagcagtagacaaattgggaggcaaaggcctcgttcaattcaaagagatcaatgtcgtcaatctcaaggccagcagacttcactgcagcaggtatggcgacccgcagggccgacacccataacagctggatccactccaacagcagcaaaactcctgaaaacgccaagtataggaagccccttgctcaccgctacagatctcttcatgagaagaacagctccagcaccatcactcacttggctagaattacctgcagttgtagtcccatccttcttgaaaactgtcttaagcttggccaatccagatagcgtggtccctggcctaatcccatcatcaactgatatcacaactttcttttcctctccagttttggggtcaataagctttgtatgcactggaataatctcatccttgaactttccagaagccgtggctgcagcagctctcgcatgagactcaacagcagccttatcttgctcttctctggttacaccgtatcgctgagcaacattttcagatgttattcccatgggtagaagacaatcctgtgccttctgtagttcaatgactcttgggtttacttggccttcccaaccaacagagttcaccgacatggattcaagacctgcaccaagccctatttcatagaaaccagcttttatagcagcagcaacatctgctactgcctgtagccccgatgagcattggcggttcacagttctcacagggacagtctcaggaattccagctaacagagatgcagtcctgcactcgatcgcacgctgagaacctgggcctagcaccgtcccgaccacgacgtcaccgatttcagctgggttgattccagttttgtccagaacagccttgagaacaggggtaaggaggtcctccgggtacgtgtccttgaagccccctcgcttggccttgcatatcggcgtccggtaggcagcgacgatgacgacatcgtccccgaagcaggagctccgctggtaggcggcgctgtccccggccgcgcacggcgacgcggatatccgggacggggcggcggaggaggaggggaggaggtgcgcgaggagcacgcgctgccggtcgatcgccttctccaggaagaagaagcagggagagatctctcgctcgcgctgactctgaggagttcggggttgttgctgggcagtggggatcggacg

SEQ ID NO: 15558 - DNA, 1007 bp, Triticum aestivum
  Clone ID: PAT_TA_15558
cactctctccctccccccttctctctcgcgacctcctgtttccgcccaccttctccggctccggcgccggcgaacccaccgcggatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccaccatcctctacaagctcaagctcggggagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggttgcaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacaggggagggactgtatgaaggcctggactggctgtccagcaacattgccagcaagccctaaattttcgtcaagattttgaaggagctaggagcgctttggatggacgattgaatcaccgggtacctagggattgtgttgggatgggatggtgctatgctattcccgtatgtactgtgtattttcctgagatcaacagttactgagccagctccggctgtggtttcactgtcatactattgttttattgtattttgagccctaagatgtttctgaagtaaacagctaaagagagtcctgttcaatttcgtaataagtgttcaagcatctatctacctatctattcctgtatataaaaaaaaaaaa

SEQ ID NO: 15559 - DNA, 1775 bp, Triticum aestivum
  unsure (1)..(1775): unsure at all n locations
  Clone ID: PAT_TA_15559
ctagtctcgagtttttttttttttttttttttgctccaacatgcatgctgatccaacgttatgcatgagtcgaaagattaacatatcagtacacatcttaataagaagacataaaaactgaatgctaaacaggagactgcagctccgtgatgggctgaacttgccaacttcaagtgaataaaatatatgtacatgaaaggagatccatgacccgcactggatcctcttctaatagagagaattacagcttgttaaaaaagtaaacacgtagttaaacagagggatcatgtactgagaaacgtatatacagatttcgaagtatacatgtacacgatgacaccacccaagtcttttagaccttcaggcaagctgccttgacgccatcgaacttttctgaccatcaaagctcaagccgctttcttgctcttgaacctgttggcgcacagcacgtacaccaaaaagttgagaaagctgagccccgcgagcagccagaagaagtaatcgagacgcccctcgttcaggttgtcggggatccacccgggtctccctcccctggtcgtgaagtaggcgaccatcgtgaggatgaaggcgctgaggtagttcccgagcgcggtggtgatgagctgcagcgcgctgcagaggctcctcatggcgtccggcgactggtcgtagaagaactcgagcgccccgatgaaggtgaacacctccgaggcgccgaccaggaagtactgagggatttgccacaggatgctcagcggaaccgggacgttctggtccaccaggtgcgcctccctggcgatggccagcctctttatctcgaggaccgcggctgctgacattgctaggatggagattaccaggccgatgcccatccgctgcagctctgaaaagcccctctccttgccggtgaacctcctggctatcgggaccaggatgctgtcgtagataggaacccatataatgacactaaccacgtcaaaggtggatagagatgctggagggatcttgaatgagccgattgttggatcaagcaccatcccttgttccacaaacatggtggacatctgagcgtagacagccgagaagacaattgtcgttgcccagacagggaacatcctaaccaatatcttcagttcttccacctgggtgacagtgcatacccgccatgggttgttgaagctatcttctttcacatcaagatcagtaattgtagctgcccggtccagacatctgagttcatcagtgtgctccaattgccgactcccttcgattgctgaaaccccatctggtagctcatacaagagagagctgtcctctggaacatgtgcattccacttgcgcaaagtggcagcaactacctggcatactcgtgtgataggactgccncctggcttttggaatctataaagtgaggtgccggcaaagaagcttatgatggcaagacccatgaatacggtcggaatgccaaggcctaatccccatcctaaattgtcttgcacccaaaccagaaaactgcttgatataagggcaccaatgtttattgaaaaatagaaccaattgaagaaagaccccttctggattcgctcngctggatctgtgtcatcaaattgatccgctccaaaagatgagacacatggcttgattccaccagtgccgagcgcaattaggtaaagaccaagaaaaaatacngtatactgcaaaggactggcttctgggcaactggctccttcacaagatggaggcatgngcataggaactgatgctgaaggagtcag

SEQ ID NO: 15560 - DNA, 2859 bp, Triticum aestivum
  Clone ID: PAT_TA_15560
aggcgatcgaggccatgaacggccaggacctggacggccgcaacatcaccgtcaacgaggcgcagtcccgccgctccggcggaggaggcggcggcggcttcggcggcggcggtggcggctacgggggccagcgccgtgagggcggaggcggcggcggctacggcggcggcggcggcggctacggaggtggccgcagcggcggcggcggcggctacggcagccgtgacggcggcggctacggaggcggcggcggcggcggctacggcggcagccgcggcggctccggcggcggcaactggagggagtgaatggtggggcccctagctggccagttatcctaggtaccgatccctttttttacctgtctaccaacgtgttatcgctcgctcgctcccgagtaccctatatctcgctccatcgcgtaggttccgagatgttctggctaccgttagatgtgacgccgctaccgttccgtgttcccggtccggttcggttccgttcggttcgttagggtttagtagcggggaagaggaaggcatggcggacgtcgagtaccgctgcttcgtgggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacctggacggccgcaacatcaccgtcaacgaggcccagtcccgccgctccggcggaggcggcggcggcttcggcggcggcggcggcggcggcggctacggcggccagcgtcgtgaaggaggaggcggcggcggctacggcggcggcggcggtggctacggaggtggccgcagcggcggcggcggtggctacggcagccgtgagggcggcggcggctacggcagcggcggcggcggcggcggctacggcggcagccgcggcggctccggcggcggcaactggagggagtgaatggtggggccgctcgctggccagttatcctagttaccgatcctttttttacctgtctaccaaaagtgttatcgctcgcctcccgagtaccctagatctcgctccatcgcgtaggttccgagatgttctggctaccgttagatgtgacgccgctaccgttccgtgttacctgttccgtccccgttggctatgaatgaaatgaaaaatcagagcaaagtttgttcgcaaaaaaaaaaaaacaggcagcagcgtagcagcatgtttttgcttattcacatgatatacatcgatcgacctctgctgagaataagagcgttttttacactaatagtagttcgtagtagctgcttgagttagttacttgctggtttggtagggcgcctcgcagaactcgccgccgagatcgtcgcacgcctcgtccgggaacaccgtttttggctcgtcgtaggataggtactccctctccacctccggcgccctcgcgacggcggcagccgggccaccggcgccggcgccgagcttcgtctccgggtacatctgcgcgtcgcaggcctcgccgccgaccaggtcgcaggcctccatggggaacaccgagacgctggagctgtagtccgcctccggcgccgcggcggccgatgcacgaacggcaccgcccggcatccttctgccgccggcggccacggtggcgctcctcctcctcgccgccggcctgccccttacggcgacagtcagcacggccgacaaggcaacggtggcctgcatcatcttctggttaatctgatcctgtctatctagaacccacgcgtccgcggacgcgtgggcggacgcgtgggcggacgcgtgggccgcccaccttctccggctccggcgccggcgaacccaccgcggatcgagcgattcctccgatcaggagaggccagccgggaggaagagcacctacgcgggaggagaggagatggggctcacgttcaccaagctgttcagccgcctgttcgcgaagaaggagatgcggatcctgatggtgggtctcgacgccgcgggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacaggggagggactgtatgaaggcctggactggctgtccagcaacattgccaacaagtcctaaattttcgtcaagattttgaaggagctaggagcgctttggatggacgattgaatcaccgggtacctagggattgtgttgggatgggatggtgctatgctattcccgtatgtactgtgtattttcctgagatcaacagctactgagccagctccggctgtggtttcactgtcatactattgttttattgtattttgagccctaagatgtttcttctgaagtaaacagctaaagagagtcctgttcaatttcgtaataagtgttccaagcatctgtctgtctatctatgcctgtatatattcagcactgctcaacttttaaaa

SEQ ID NO: 15561 - DNA, 776 bp, Triticum aestivum
  Clone ID: PAT_TA_15561
tcgacccacgcgtccgcattgcaggttcagaaccaatttctatggatgattgacatacggatcttagcgagattcaagggaacgcgtgatgtgactgtgccttgtataagcaaatctaagctgttgagattattctatcctgaagtattggtttattactgaggaagccttaaacagagaagctgaatgcagtttttgtatctttcgtcaaagtcctgaatggtccaatgaaaatcttgcgaagagtgaaagccacaacttgacgaggacattctcacggaaaagccttgtatgataaacatccaattcaatgctattgcatgcttcttcgcctatgaccggcagaacacaatcgtccggatgtttgtacaaagagctacaaggagagcactcttcaacgatggcaatatccaatgaagctgcaaattgttgggtgtatgtatatgtgtaccgaagttgagttgaatccctaaggaagaaccaaacatttatttctatcttattatatgctatcttaaatgcaaaagtgtgagctatgttaacaactgtttcagtatgatgtttggaaatgttaatgattgcagtttttgcacgctcaagtagatatttgtaaaaaaatcatcacagtttttcactagagaggttttcattgatgccctaactggttgctcaaaccttaagttactaccccctctgttcacttttacaaggcgttgtagatattttaaaagtgaacggagagagttacacatacacatattttcaatgttggtttt

SEQ ID NO: 15562 - DNA, 753 bp, Triticum aestivum
  unsure (1)..(753): unsure at all n locations
  Clone ID: PAT_TA_15562
gngttgttaccncctcgaaatnaaccctactaaagggaacaaaagctggagctccaccgcggtggcggcccgctctagaactagtggatcccccgggctgcaggaattcggcacgagctcaaattggccatggtgctcgaggggatgttaccatactgccgactttcgtcgtcaataacagacagtacagagggaaaccggataaaagggcggtgctacgagcgatatgctcgggattttgaggagacgaccgaacccgacatctgtttgactcaagacatacaaacaaaccagtgcttggaaaacaatggaggttgctggctggacaaaaacactaatttcacggcgtgcaaggataccttccgtgggcgggtttgcgagtgcccggttgtcaatggcgtcaagttcgttggcgacgggtacacccattgtgaagcttctggtgtcggtcgatgccaaatcaacaacggaggctgctggaaggagaccaggaacggcaagtctgtctctgcctgctcgaatgagcaagctaagggctgcaaatgtccgcaaggattcaagggcgacggcatacacggttgcgaagatgttgatgaatgcaaagagaggctcttctgccagtgcaaggactgcacctgcgaaacacatggggaagctacgactgtggttgcgggggcngccggtnggttagcaaacaatnctattacaatgagaggaggcantgacaacttnccatcangcaaagggtcacgn

SEQ ID NO: 15563 - DNA, 1144 bp, Triticum aestivum
  unsure (1)..(1144): unsure at all n locations
  Clone ID: PAT_TA_15563
ggtttcgtcaagtgctccatccgctgaccccttctcgcagttagacgggcttcttggaccagcatcagcctctcccgcgctttctggaacctcaagctcccagcgcttccaacacaccagatcttatgtccgtcgtcgcggccgaggtacaaactggaggcactagtgcgtccacagaacctgcacaaaaaggagcgacgacgaaaaagggccatagccttcaagatgcgctgcagaaggatgccaccgcgaggcaggttggcgtgaccccaacagggaacaacccaaatcttttcaaggaccttctaggctagaatataccgcagattttcagtgtgcacaagttgggcaaaacgagtttgctcccaagatggtcctgttggtgaaaggctacttgatcagcacaggtgcgagcggtgtatttggatttgagtcgcaaggcactacctttccctcctagctgggagcggtttgcgcgggttgatgggcggacgtgtttgcggggtgattttcctgttgcgtttttttcgcatggcaaaattttctttgtcgagactagtgtgtcgaggcaggttggcgtgactccaacagggaacaacccaaatcttttcaagggactttctaggctagaatgtaccggagattttcaagtgtgcacaagttgggacaaaacgattgggcccccaaggtggcgttgtctgtgaagggttggtgtgctcatgcggctcgatcagcacaggaaacgaggggtgtgtttggttttgcctcgcaaggtaggacctttcccccctcgcagctgggagggggtttgcgcggttcagggggtaattttcctgtcgcgtttttccgcatggcaaaattttcttgttgagactagtgtgtacatgtgtttattattgttgtgtaatctgtacatgatgatgaggccagggtccagaagcgttcttttgttgagctcggaagggtaggggagggcctgtcgtgtcgagtcaatgttttatgttttacccatattggacatatacagtagctggacactggaaaactaggaaatactttgtcctggcccaatccctttttaaaaacccggaccggaataaaaattgtnaagctttccaatttngcaaaanttgaccaanaanan

SEQ ID NO: 15564 - DNA, 769 bp, Triticum aestivum
  unsure (1)..(769): unsure at all n locations
  Clone ID: PAT_TA_15564
gagattntaccnttannntttnattacgctaagctcgaaattaaccctactaaagggaacaaaagctggagctccaccgcggtggcggccgctctagaactagtggatcccccgggctgcaggaattcggcacgagcagactcccacgctcgatcccctcctccagcgccctgcatccgaggactcgctagcgagtcccttgctcgatccggagcgaggcaaccaccggagccgcgccgcctccccgccatggcgcccgcaccctccagccgcgccgcgcccccaagctcctcgccatcactgctctagccagtccgccgttcgcaaccagcagcgccctcctctggcctccgctgccagtccaaccccgtcagcggcgtcggccgctcggcctgctcgtcgtcgttgctccaccatgacgacctccctcgacccatcccggacctcctcgctcgactcctcgctggatccggcaggtactcgtcgcgccccttgccttgctgcgttctgcgccggagttccnctgctcaagccgccgaacccccgaccccatctccacgcgcccgtgatcaccacgacctctagccgctctcgctgtcattattgccatccccacgcgcatcttgctggcgcactgctcttctggttcccggtgtacctcacgtcccgctagaccaccccttgctttcgtcctctgcccgagcacatgcccgctcgaccacctctctgctgccttcctgccccgggccctccgccgccaacgctnttn

SEQ ID NO: 15565 - DNA, 696 bp, Triticum aestivum
  unsure (1)..(696): unsure at all n locations
  Clone ID: PAT_TA_15565
ngttgnncctagctcgaatnaaccctactaaagggaacaaaagctggagctccaccgcggtggcggcccgctctagaactagtggatcccccgggctgcaggaattcggcacgagacgatcccagtgtcctcgttagaatcatcaacagaggcagatagtgaagacgatagtgtgatggcagttgatgaaacagtatcctcgagaaggctggccaaggagatcacttggcagatgaggatgcgcttaaaagatagccaggatgaagatagttcgctctcttatgaataccatgatacttacaatgaaaatagctcctttagtaagtcagaggttgaaaccgctaaagaagtgtccggtgaaataagtgaggatctggagtttggtacttctacttctggcccgttcctgggatttcctgagcaggagtgacagcccttattctgcatcatgctccagtcaggcatccaatcgacgtgaaccgtcggtggttaaggaagccaaaaggcggatcttggagagatggtcggtggtatcgtcaactgttagtggcgaggaagaaaggggagcacgttgaagtgtgggccccacttaggtgagatgctcacaatccccttgaaggggaaaaaaagatcaagganggagtggtgggggggaattacacattttgaagaagcccgattccgccctgaacctgg

SEQ ID NO: 15566 - DNA, 749 bp, Triticum aestivum
  unsure (1)..(749): unsure at all n locations
  Clone ID: PAT_TA_15566
ggcatccccagcttctccttcctcgctcgtcccccctatcgcggcctgcctgcctgcttcctccacccgaccctaaccctagccgcgccgccaccatcgatccccaaatccctcccccctccgccctccccccctccctcttccccgcccgccccccctagctagccgccgtgcgccgccccacccctcccctcccccccccgactccctcctcccccgactccccgctttccgcccccgtctccccaccccgctccccgccggccggacctggcgggccgccatgccccctaccgtgccgcggcgccgccgccggtttcccgccgccctccacggcgcgcgctcccgccgccggtccgccggcccccgcctgccgccacgtcctgcggccccccctagccgccgggcgcccggggcacgccctcacccgctccctgcgcaccctctccgcccccgccgtcgtcgtcgtccccccggcgctctccgttcttcacatactgcgggcgccggtatcccgtcgggctcccggtgcatttncacaggctcaccatgggcactctcttcagcgcggacaagaacctggtcgccatgtacgccggaggggtaccgcctgggcaccggtccctggaggctacctctntacgacgcaggaacgactcatctctggatcccgagctccctccgccactacatagagcatcgggtgcgagtcggcgcgcatggcgagccgcngcgccggacccttctct

SEQ ID NO: 15567 - DNA, 918 bp, Triticum aestivum
  unsure (1)..(918): unsure at all n locations
  Clone ID: PAT_TA_15567
nnngtgntnnnnnantttctcnnnagaaanttcttagctcgaancaaaccctcactaaagggaacaaaagctggagctccaccgcggtggcggccgctctagaactagtggatcccccgggctgcaggaattcggcacgagcttccctgtgccagactcttcccctctctctctcgctcgattcctcgaaattccaccccccttcgccgacctcctcctttgtttccaagttccgacctccggcgatggcgtcgttgggggagatgcttttgaaccaggagctggcggcggtggcagccatgtcggcggacgtgcacggcaggttcgaaaggtacatcctgagccctgcccatggttttccccacttccagcaagctggcagcgctccggcaggattccccgacacgggattgctcgttttccggctttgggcatgcctccctccaccttcatcatgccggaggggacccacgccggccgcgggttatggcgctgaggcccgtccccggtggaagatnccccgtggtcccggcgacaaagaacctggccgccaaagaaacgatgggggccgacacccggttcaagagggaacccgttgggaccgggagggaaggaaggaatgaaactttctctaaagggagaattggggtccgaattgaagccattggggcggaaaaccataaaagtngggggccaaacccaatttttcagaaaagcaaccccttnccccgggggaacgggaattcggggcaaaagccaaantggccccgtgggaagcccgaatggggnaccaaaaaatcacggttggccgnccccccgggcattttaaaagaaaagggaagccaccaattcttgggaacctggagggccgggcgcccaataattggctggcttggacgccggccccccgccnccaaa

SEQ ID NO: 15568 - DNA, 608 bp, Triticum aestivum
  unsure (1)..(608): unsure at all n locations
  Clone ID: PAT_TA_15568
tttaantccctnagctcgaaattaaccctcactaaagggaacaaaagctggagctccaccgcggtggcggccgctctagaactagtggatcccccgggctgcaggaattcggcacgaggcacagcggctctgcttcctctctctgctcctcctcctcctcctggccgcagccgcttctgccaccgcagatgctgcggcggcggaggagttcacggaggagctgctcctccggccgctcccggaccgcaaggcgctggcccatttccacttccgctcctccgcgcctcccgcttccgccgccggccgacaccaccacctcttccccaaggccatctcccagctggtccaaaaatttcatattagtgaactggagctatctttcacacaaggaaggtggaattatgagcaatggggcggatatgatccaatgtcaacaaataatgcaaagccccctggtgttgagctgtgggcaattttcgaccttcctttggccgagattgatgccacatggaagaacctgacacacacattatcgggactgttttgtgcatccatcaacttcttagagtcttccactgcattttctgctcctcgttggggatttaaat

SEQ ID NO: 15569 - DNA, 384 bp, Triticum aestivum
  Clone ID: PAT_TA_15569
ggaaaattggtgctttggaccttaaacaacggccccaacatggtgggacattgtaggagtgcatttgatgaatcaggcttgtgggcagtcatggctgaagaggttgtgaaactctgcatgttagtggaggttgcctgtcttcagggggagatcacacgagctaccttatattacagtgtgacggctgtaatcagccgaatgcctgggatttggttgataaaaaggcttttgagaatcaagctgtcccctgcaaataagctactccgcatgagtgtcggtctaagacctagggggaatcgccagctttcccaagtggttcaccatggacatcatgttttgatctttggagccgctccagtctggccacttgtacgagatccgcag

SEQ ID NO: 15570 - DNA, 779 bp, Triticum aestivum
  Clone ID: PAT_TA_15570
ggtttgtcctgaccccccccgggaccggccgcttttccttaaccgcctacgccccaccaagttttccaaacctgggcctggagcctttggggtcccttttccccaacctgggcccggcgtcacgcctttccctgggccgggacttatgcctggtcaccctattcgcgcccttcaccgaggcggccactacgcgctgacctcctgggggagccggccgacggccctcccgggcccaggcggaaacgggctctccgtgtacggtgcacggctcttcgcactggctccctcctacgcccttgcgcgcatggaccgagctccgagcgtttctgcgctcccttcgctgccttcctgcccctggttcctccgtgcggaccgcggtccttccttggtcgcccgacctgggcttggggcctacaattcgccttctcacgcttggcccctctggccccttcagggtcttcttccgcctcggcattggcgtccggtccgtacggcatcgaggtaacccctcccgcttccttatacgtgtcgggtggccggatgcctgggttgcccttggcctttcgggttcgggaaccctaaatggggtattcgaaattcgccaatcagcaactggactttgggtacccggtgtctacaaaacgcccattcgttttcacaaatattggttttcgagatagagaaactcggagtcttagaatacttatgcccggaatatggcgcctggggggatacgcggatatcgatatgttcacaatatcccacagtcgggcaaaatt

SEQ ID NO: 15571 - DNA, 834 bp, Triticum aestivum
  Clone ID: PAT_TA_15571
gagagataggcagagagagtgagagagagagatatagatatatagatagtgtttgagagagacatatctgttatagagatccttttatactttccctcttttttcgatccattctcaaccaccttttttgtacccccgtcctccgacagctgctcctctattcgtggtttcgttatcttcccatctttttcccttgaaccttgttcttctccgtcttccttactactttttatttgccttcgcgctgcccctgctctcttcgcactcccttttctttccgattcctctcttgttccctttgtctgcgttttttcttatgcgtgactttgttttcttgtcctccgttctccccatgtatcgatgtaattggatctctccttctccccagtacattgcgtcgcctgcctgggtacgctgcgcctgctattatacttccacaatacacttggtccctcctcactactacctcgactcggagatcttgtcttctgttgtctctctctatactcactccttggtggtctctatatgcgtatcactcttgtgagattatctccgctccgtccgtattctcttcgctctccgtctttctctttgtctcccctccattcttctttcctcccacaccgtgatagctcagctacctgtaatatagattatctctccatggtacatgtggtactctgttctcgtctgcgtattctctccttattatatatccttattcactttattgtattcttagcgcttctcgtttgcttttcatccattagtatcactttcagagacgcgagcgtcccacgattatatcctctgtcgtgtcgtctcgcctcc

SEQ ID NO: 15572 - DNA, 595 bp, Triticum aestivum
  unsure (1)..(595): unsure at all n locations
  Clone ID: PAT_TA_15572
cggcggcgcgcgcataggaggcgaatcatcagaggaaccaagccgccgacgccaccatgggtatctcgcgtgactgcatgcacaagcgccgggccaccggtgggaagcaaaaggcttggaggaagaagcgaaagtatgagctcgggcgccagccagacaacactaagctttcaagcaacaagacagtgaggagggtccgtgttcgcggaggtaacgtgaagaggagggctctccgtcttgacactggtaacttctcatggggtagtgaggctgtgacccgcaagacccgtgctctggatgtggattacaatgcgtcaaacaatgagnctgtgaggactcagacccttgtcgagaatgccattgcgcaagttgatgctgcccccttcaagcagtggtacctgactcattatggagtcgaattcggtacgaagaagaaagctgctgcagctgccaagaaagaacctgctgaggagcaagaggctgaggttgctgctgctgccacaaaggaaagctaaaaaagagcacacaatgtcccaataggaagctttgagaagcgcccatcaggggacgtaacaactggaactgcgcacaattg

SEQ ID NO: 15573 - DNA, 956 bp, Triticum aestivum
  unsure (1)..(956): unsure at all n locations
  Clone ID: PAT_TA_15573
tttttattttatatccgttttgcgcactcatttaatgccacttgcaatctgaagtanaaaatatcataaagagcttgatgacttctatcattgttggtcatagtagcttgcttttgctactaattatgagttcctacatttgttcattttgcttacaataatataagtgtcgattcttttcattgtggaagtgattctaatattaatagaagtcctatcggtgcttggacggccttcccgtgcttgccggtgttaatctggtcgtccgttccccggacgacgagctcgagttcagggtggataaatcgtacaagctgactgtgcctacaactgggaacccgatatatgcccgaattaagactatatacaagaggttcagcaaaggactcaagtttgcaaccaccacaaaaataagtctatggaacaatagtgtgtggctgttctgtgcaatttttctctcatcgaggtatgcctccggggcactgggcgaggcctcgtcttgcctgacttatgttgtttttgtttgctgcacaatgttgtaagattggagtgtggtggctaggccattcttgtttcgaggtaagcaaagattatgcagtctattgcacaggttcggtttggtggggggctgtagatgatggttggaatggtttgttctctttcgatgacttatccagatgtttcaaagtaaatccaaagccatttgttgcctcttgaatttctggttctacctcatgcagaaaatctctcatggttctacttctacgttatgtagaaaagcgaatattatctgttgatgagtttgttgctatttggtactgaccatattagttccctagggctgtaaaaacaaaaacttcatttctaccctatgattatgtgtcaaggatattttgtagattgcaagtttgatttctttatcttcaacatggttgatttagtttctcaccttgcct

SEQ ID NO: 15574 - DNA, 553 bp, Triticum aestivum
  unsure (1)..(553): unsure at all n locations
  Clone ID: PAT_TA_15574
gagagagagagagagagagagagagagagagagagagagagagagagagagagagagagagagcgcgagcgatagagagagacagactgctttagtgcgagagggagaggcactgttctcgccgactcttatactgcgcttcgctggtttttactttcaggcgaggcgtcttctgtgcgagctctatcttctttgactgttggtgatcattctcagctctgcattccaggagcggactatctccttgtgcactatctctgtgctcatcttattctcagctttatatgtggagtctctactactgtacatgctctctgctcatcttctgggaggcttgttgttgacctcgtcaggactctgcgtgtcccatgtgctcctccgtcgggcttgtcacactccttttgtatctgctggagcccgactcgctcctggtcgtgaggagcgccttctgtctctgtgggcgacgctgccccttctctnagttcagatggctttggatccctgtgaacttagctggatctcccaactgacagatgtgttgaatcttattgtt

SEQ ID NO: 15575 - DNA, 707 bp, Triticum aestivum
  Clone ID: PAT_TA_15575
gtcgacccacgcgtccgcgcattcccccccacgccccaaaccctagcccgcgcacaacctctgtgtgccgccatggcgcccgccgcgaagaagcccccgctgaagtccagctcctcgcacaactccgccgcgggggatgccgccgggaagaccatcgaggagatgtaccagaagaagacacagctggagcacatcctgctgcgcccggacacctacgtcggctccgtccagaaccacacgcagacgctctgggtctacgaggacggcgccatggtgaatcggccggtcgcctacgtccccggcctctacaagatcttcgacgagatcctcgtcaacgccgcagacaacaagcagcgcgacccctccatggactccctcaaggtcgacatcgacgtcgacggctgctgcatctccatctacaacaacggggacggcgtgcccgtcgagatccaccaggaggagggcatctacgtgcccgagctcatcttcggccacctcctcaccagcagcaactacgacgacaacgagcgcaagaccaccggcgggaggaacggctacggcgccaagctcgccaacatcttctccacggagttcgtcatcgagaccgccgatgggcaccggcagaagaggtacaggcaggttttctctgataacatggggaagaagacggagccccggtataataagtgcaagcagtcagagaactg

SEQ ID NO: 15576 - DNA, 579 bp, Triticum aestivum
  unsure (1)..(579): unsure at all n locations
  Clone ID: PAT_TA_15576
gtggtcttcttcacacccaaagctcttgcgaggctacgcatagttctccttttgctccgaggaatctcagcaagcatactgaggtcaactacaatccttttgcgcccacagtttttcggcttccttgatcttacatcaacgggtcctcttctccacgggcaacgtcagcctcatgttcatattctacctcaagacatcgacccttgtttagattgaagtgacatgcgggttggagttcttcatccatggctttgaaaatcaaaagtcataatagaggtcctcttatccatgggcaacatcggcctcatgttcatcttctacctcaagaaacatgtgtagatcgaagtgaacaagaagaattgaacaaattagcaaggagtacctgngtccatgtttagatcgaagtgatgttcgggttggagttcttcgtgcaaggcagctccatcttcttcctgtacaactgctcatgcaaggcagctccatctttttcctatacaggctgctcgtccaaggcagcttcatcttctttctgtacaggttcaattgagatcaacaggttgccaattcagaccacgcaac

SEQ ID NO: 15577 - DNA, 719 bp, Triticum aestivum
  unsure (1)..(719): unsure at all n locations
  Clone ID: PAT_TA_15577
gaattcggcacgaggccaggccgggctctcgggctccagcgccatcgtctgcgccgcgctgagctgcctcctggatttctacggcgtcagggacaagatcagggtcgaggtcaggcccaacctcatcctcaatgccgagaaagagctcgggatcgtcgccgggcttcaagaccgcgtcgcgcaggtctacggcggccttgtttacatggattttagccaggagcatatggataaattgggccatggagtgtacacgccgctggacgttgatctgctcccccctttgtatctcatctacgccgagaacccgagtgactctggcaaggtccacagcagcgtcaggcaaaggtggcttgacggagacgagttcataatatcatccatgaaagaagtcgcgcagctagcgtatgatggccacaatgcgttgttgcagaagaattatagtgagctcgccaggcttatgaacaagaactttgatctgcggaggaaaatgtttggggacgatgcgctcggcgagttgaacataaagatggtcgaggtagcgaggagcatcggcgccgcatcgaagttcacgggaagcggtggcgcggtggtcgccatgtgcccggacggtgacgctcaagcagagctcctgaagaacgcgtgccaggaggccggttttcgggtggagcagattgagtcggcccccgtcggnactnaacaaaggaggagctggcaan

SEQ ID NO: 15578 - DNA, 698 bp, Triticum aestivum
  Clone ID: PAT_TA_15578
atgaggtagtagatgtggcttcacgaactgacaccactatggaaggagatgagcctgatcaaacaaactcaaccatggaagggggtgatgctgatgcgacaaagtttaccatggaagtagctaaggctgatagtacaaacattataaagtaatctgatgggacaagctctaccagagaagaatctgaggctggtaaacaaaactctaaaaagggacgcaagacaaagtttgacttatttgttgaacagtacaaacaagacactgtcaaaactcagggggtcctcgatatactggttggtaagcaagcagatatagttgatgattggtacaaagagatggctgagaaattcttagatgaaacctggatgaaaaggctcaaggtgatcaaagctgtagttcctcacgtggccaaaatctttttcctctatgtgtttgttaaaatgatgcggcaaagcaaagttcctatatggaaataccctgcggctgctcgagctggcaggttagccgcatcgcagaaaattttggaaatgcttgaggaggctgagaagctcgaaaaggctgagaggctgaagaatggcggagacagcaagctgttctcgaaaatgtgggcgatcttgaagagtggtggcactacttctggaaagggtgagcacaagccggggaaggatgtgccgaagcagggtggggatgaggacaag

SEQ ID NO: 15579 - DNA, 596 bp, Triticum aestivum
  Clone ID: PAT_TA_15579
gcatcacagatgaccaccaccatcttctctaccatcgtcatcatgcttctttcctcggccatcgctgctcagagcagtggtgacgttggtggcaagcccaaaccgacggacttcatggtgggagcgtgcaagaacgtttcgaacttctcccgcggacacaacgaaggagacaagtacgtgagccaagaattttgcatctcgaccctccagtccgacaaccgaagcgccaacgccaagaacctccacgacctagcgctcatacccgtcgacatcctcaaggagcgcgttgtcaccgccggtggcaacgtcaagaatatgttgcataacaccaagaacagcacatcgtcgacggcacgccatctcagaatctgtgagctggactacgcggctactgcgagcatcctgaacttctgcgacgccttgatgaggaactaccagggtgaaagaagcgcgggccacgacgatgacaagccgctattctccaagcttgcccgaatgtggtggacaaaagtgtacgagggtcttcaagctactgcggcaaattgcgccttctttgatatgccccgggggcggaaagccccttcttcaaaggaaaa

SEQ ID NO: 15580 - DNA, 444 bp, Triticum aestivum
  Clone ID: PAT_TA_15580
ctcccacccacccagccaggagcccgcgccgccaatcaagcaaggatgtcgcttctcctcggcggcctcggcggcggcaacggcgacccgctcccagccctaaaagacgacgcctggatgtatgccgccgtcgatctctcgcgcctccccgccgccggaacccgcgtgtgctacttctcccgcggccaccacgagcagtgggccgaccgcctcggcgctccgccggccgccgaccccaccaatccttacgcctcctgcacaatcatctccgtcgaggttcgcaccgtcgctcacgctccgtacgccagcatcatcctctcccccgctcccgacgaaccccaaggcggtgcgcccgctcccgccggggacctgttccgctacgccttcaaggagttgaccaactcggatgtcaaagagccaagattgatggtccgcaaggcaact

SEQ ID NO: 15581 - DNA, 437 bp, Triticum aestivum
  Clone ID: PAT_TA_15581
ccttgcacataaaattttgtcttgatgaactgtagagcttccgggttaagatcaattatgaatttcactgtccaggaaaatagtgggtttttgtacatgccctgagcctgaataccgcagtatgataccaggagattgcagaggacactaccctgaggttaacagttatgtcatgggaaagaaagggactcgacacactgtgtgacctgtcgagactttgcatcaccaagtgtcatctttggaacacccccgaaggggctggtaccgacaatgagggcaggccacacagttcgcctacgggactggccaaccttggcatatatgaggagtaatcagtttactggctataccatgactgttgtcgggattgagtcaacaaggccctgtcataacttgactccgaccagcagaaactactgcatcgatcgtcgtagggt

SEQ ID NO: 15582 - DNA, 450 bp, Triticum aestivum
  unsure (1)..(450): unsure at all n locations
  Clone ID: PAT_TA_15582
gattcatgtaatgactattcagtgtatatagttcattctctacaccttttcttttaaagaaaacactatttctttgtgtttatatttaagacctatgtttttattttagagaacacatatgaatttttgttggacatgaaatgagctaccataactactataatctatgcatatggtttcagtagatttttttggttttttttttcgagattgacgggggcccaaaaaaacccaccgcttgttatattccaactcgaaggtgacttggcagtcagtacagatacaagtaagcgcccaaaggcgcaaaagaaaattacaggggagagcaagagaaagcccaaaactagaagaaagaaacanaatggaggggaaggctggcaccagaaccaaactgaaacccctagagaccgacatctcgggtggatttcacgtgttgaatttcacatggag

SEQ ID NO: 15583 - DNA, 857 bp, Triticum aestivum
  unsure (1)..(857): unsure at all n locations
  Clone ID: PAT_TA_15583
gtcctctatccgggacgcgaactatccacataatccttcactatgtatcacttctctctcatcaactcctctttcactctactaaacacaatataccacataaaacatacctattttacataatactatttttaatacacactcacttatttttttgtctcctcgtcaccttcattattactcttttttaatttatgccacaatcaactcctaaaaatcccccattaatattatctcaccccatcacaatcaccatttagcctttacaataacttctatctaattttcggtttctctcatcctaacttaatcctttttccatctaataggaattccacacactttcacatatatactttctatcacagttcaacataacatttataatttacatctctcctcacaactccacttctatcctaaattctctgctggtataattttatacataattaaccacttctctatgatangagctatataaaacattctactcatattgtgatgcaaataagaggccgctgcccacccatagattagttctcctctaactttaaattttgcattttgttttttataaactcaagggggtgttttttcaatactcaggtttatttaattcctttccccactgcatatatatacattccctaaaaaattcctttcaacaaattatccccctccctataaacaaaaagtgtttgatcttcctccaccataactaacgaaagggcgcttttctctccccaccccaaataataaaaatttctcccataacgttttgtttcgcaccacaacctcaactttcgatatcttttctcctaaccaccccatacaggccatcccaatttttgctg

SEQ ID NO: 15584 - DNA, 578 bp, Triticum aestivum
  Clone ID: PAT_TA_15584
agcggagttcctgtctgtgaagcagagcgcaccttgttgatccaccagtcaagcattcacccttgcccatttagataaagctgtacgctattgctcctgctgtcatcaattgcttttggacccctccgactactctggatcttagtgctgcggtcgttcaacccattactctgaagacctggcgttgccacccacaattgactgaacccactatcatgtgtaacagacgactgaagccacgagagtgttcctaccatgctatgcctgctattgctgatagcatccctaagtctgaaacattcagactgcactcctacagttactgattgcccttgaactggaagggacttgccagagacctgactggataaacgtatccttgagacgacctgtacatttacatgggacgacgagggactgcaacctgacataagtacacccgtcctatgatgcggagcgagcacttcgacctgctagacaatgagacttccggcgctccaagcactaacgtctgagttacagagtcgatccctgagcatgagtggagtctatactttggtgtggatagccagaatgaa

SEQ ID NO: 15585 - DNA, 572 bp, Triticum aestivum
  unsure (1)..(572): unsure at all n locations
  Clone ID: PAT_TA_15585
gagagagagagagagagagagagagagagagagagagagagagagagagagagagagagagagagagagtgtgtgtgtgtgagatagagtgcgagagacccatactcatactcgcttgctcccccaccgtggtcgccgtctctcgcccgctccatcctttcttgtttcgcgctgtgggatcggagatcacctttccatcaaccacattgtctctttcaagggggccttcgtgctttgtctcatagacagagatggttgcctgtgctcctctgtgctgggcacagtcatgcgtttgctgtcgctgggcccaactccggctgatgtttatgcacgtgatcattgtacttgacgctgatggcgatggctccatctgcttttcctagatcctcatcctgatagcccgcgagatgaatgtgactgtctcttacgaggatctcttggaggccttctcggtgttcgtcatggaccttgactgttcatctctacttgttgactccctcncgctctgacgtcctcagcgtgatctctccccgcagacgggcgagatggtcctgatccgcgtcaccgtgtga

SEQ ID NO: 15586 - DNA, 582 bp, Triticum aestivum
  unsure (1)..(582): unsure at all n locations
  Clone ID: PAT_TA_15586
atcccctctctcacaaagtctgcaacatctcgccccgtcccacgccatggcaaccgtggacatgcggcggttggagacaggcgcgggcggcggttacgacgccatggggttgtccaagcgggtggacgacgacctcgacgacgatggccggccgcggcgcacgggcacggcgtggacggccagcgcgcacatcatcaccacggtgctggggtccggcgtgctgtccctggcgtggggggtggcgcagctcggctgggtggccggccccggcgtgatgacgctgttcgccgccgtcatctactacacctcggcgctcctggccgactgctaccgcaccggcgaccccgtgtncggcccgcgcaaccgcacctacatggccgccgtccgcgccactctggacgagtccaaggtgaaactctgcggcgccatccagttcgtcaacctcttcggcatcggcatcggcatcaccatcgccgcgtccgtcagcatgctggcgatcaagaaggcgggatgcttccacaaggaaggccacaagggcgactgcaacagttattccatgagcccgtacattgccatctacgg

SEQ ID NO: 15587 - DNA, 908 bp, Triticum aestivum
  Clone ID: PAT_TA_15587
cgccggcctacgcgtccggaaaaaaaggagcgagcagagatagctttgcacgggattcgccggcgccgccgcggagcagcacaagcacaggcagcagccagcagcagcagcgagccccggcgagcgagcgaggatgcactccttcgggcaccgcgcgaacgcggtggcgacgttcgcgctgacgatactcgccgccatgtgcttcgccgcctccttctccgacagcttcaactcccccacccccgccgcctccgtcaagatcctcaacatcaactggttccagaaggaggccaacgccaacgacgaggttagcatgacgctgaacatctccgccgacctttcgtcgctcttcacgtggaacacgaaacaggtgtttgttttcgtggcagctgagtatgagactccacaaaatgccctgaatcaagtgtccctttgggatggaatcataccggcgaaggagcacgccaagttcttgatccataccacaaacaagtacagatttatcgaccaggggagcaacctgaagggcagggacttcaacctgacgatgcactggcacatcatgcccaagacgggcaagatgttcgcggacaagatcgtcatgacggggtaccagctccccgagcagtacagataggccgccgccatctctgaacaagagctgctagccctatctatatatggtccgctgtgctgtgcaaacgcaggaagggtttagtggcagtggcagtggttgcgttgctggcgccgggccttttttgctctaaatcttggcgggacaggacatgtaaacttgctcatgagcttgtatgttggccgaatatgcgcgagacgaaaccgtaatgttaactgtctgaatgcgaaactttgatggtagctctttttactagtctctcgttatgatcccc

SEQ ID NO: 15588 - DNA, 603 bp, Triticum aestivum
  unsure (1)..(603): unsure at all n locations
  Clone ID: PAT_TA_15588
ccagcaacttgcgtcaactctctccagccatgaaacttgcttcacccaaacaggcgattcactgttctttatgcatgaaggattgcagcaagctcgtgctcccatttttgatgtttcatctgcgatagaagtcatacatacagggagctattggagattgcctaaatctgtagaggaaataggtactcagaatacactttttcaagatgagcggaggcctacattgaagaaattaagcacccttgtgcgggcaaaattacttgaaaccctagttcctaaagaaatgtctgaggtttcggtgactgatggaatagccaatgtacaggtagatggcgaattcaaagtactccttacgttaggttaccgtgggcacttctcgctgtggaggattttgcatattgagttacttgttggtgagaagaccgggcctattaagcttgaagagacaagaaggtatgttcttgggtgatgaccatcgaaccggagaaatggcttgtggcttgacaaatccccctcacaaattntggtataccaaattctcccatggagcctattgcaatcttcttttgggtatgggaatacccgtaaatttagaacaagacc

SEQ ID NO: 15589 - DNA, 421 bp, Triticum aestivum
  Clone ID: PAT_TA_15589
gttgtcgatgcggtcgttcattgcttgttgctcttggtgcaacgctcgttgtgcaccaaagaggtggctctcggtgacgtatgatgacatgtcatcgtcttgctcgatgaagagtgggttggtagaagtagtcggcctatccatcattctaagcaaaatgtgagtggtagaaagagaagaacttataccaatgtaccttgaccgatgttgacaatgaatcaagttcactcaaatgcgaccaatgaaatagcactatcggtaccaattcttgtcggttctcacacctacacaattaaaagcttatggtggagcttggttaggatggtggcacaaaatttgatgcaattgtaagtgcgcttcaataatgttggaaaagattcgcaagttagcaaagcaacacgtagaccaagcaaaatatggt

SEQ ID NO: 15590 - DNA, 169 bp, Triticum aestivum
  unsure (1)..(169): unsure at all n locations
  Clone ID: PAT_TA_15590
gatcccccactacaccaaccaccgncgncaccgcaaaagaacgagcacctgaggagagggccggcgcctctccccagtcccgacattatccttccttgcctagaaggctagaagaacagcgcggcgcatggatcagcgggagggcagcaggaagccgtcgcggggagag

SEQ ID NO: 15591 - DNA, 769 bp, Triticum aestivum
  unsure (1)..(769): unsure at all n locations
  Clone ID: PAT_TA_15591
agagagagagagagagagagagagagagagagagagagagagagagagagagagagagagagagagagagagagagagagagagagagagagagagagagagagagagagagagagcatacgcagctctcggccgtcgccgtcgcccgtgcaatggagcccgagcccgaccgcggcgtgtccctcctctcccccgccccacaccctagccacaaaccctgcctccgggcggccaagtccatggccttcacgcgcgaggagcgccgcacgctcattgagcataagcgggagcgcaagcgacaggataacctcgacctcgcgctcgcacagtggtgggcccttttggtgccccaccccgcccggccgccacctncttttccggngagccacccgatcacaaagcccttggccgtgtgaccccgccatcttgccgccggacgcgcgcgccccttacgacccgtctgggggtcttgggggtcgccttccgggccggtattaccctccggggcggcatcccccccccctgttccgcacgggcatagtgtttgcccccccccccatgccccgtatcctgcctcnnngnaggggggccggttcaactcctccggccggtttggtttttttgtttaagataaccaaaccccccctccttttgtgtccgtaacgtgtatccaaatccggggccctatggtaaatgggggggggttagcggtaatctatggggacatgtgggcctcattgtgttggggcccccccgggtctttcttttt

SEQ ID NO: 15592 - DNA, 578 bp, Triticum aestivum
  Clone ID: PAT_TA_15592
ccgattttcacaaataaagaggttatgcaaaattcccacgaaatttcctaccgaaccactcgccgtcgcttcccaagggtggtgatgccatgatgcacatgctgccggcctctgatggacgcggatgggagatgcacccgtacgccgacgtgccggcggatcaagagctggagctccaccgcgacaacgccgccgacgacagccttgacggccacgtccggtgcctgcgatgtggtatatatcgtaatgcgacaccgcatatgcgacgtggccctgatggccctagaactctttgcaatgcttgaggcatcgcttacacgatggggaacatgagaagaatgatataagctgaaccacctatagatgacgcttcacttgctaagcttgttcctgacgtggacatggaatttgagagcgaggaaatagcatatgaattctacaatctatatgctgggcatgttggctttagcggtcgaaaaagcacgttacataaatcgtctgaaaatatcaccaaagtaaggacttttgtgtgctcgagagagggttacaacagggatgaacaatcgttggacgcaagg

SEQ ID NO: 15593 - DNA, 576 bp, Triticum aestivum
  unsure (1)..(576): unsure at all n locations
  Clone ID: PAT_TA_15593
ccacccagacgttctcgcccgcatcttgctcctcttgtcgtgcatcgtggaccgcgtcagggcgtccgcggtcaacaagcactggcggcgggtctcgctgcagaatccgcccccgctgccgcgcctcctcaggccgtccacggcccagaccgagacctaccggatcttcggcggcttcggcgatccgcgcccgtccctctccgaggagggccgtggctcgcgtttctgcgggtccgctccgggcggctggttcgttatctcggccgagccatggcgcggccacgccctacttcacctccgcaccggcgagcgcgtcgccctgccggagagggtgcgtatcccgctcaactccggcgacatcacgtgccctatgatgatccgcgccgncgtcatctccgccgcgccgccgtctggcgactgcttcgtcgccgccatcacctccagccagacgaacatggcgttctggcgcccgggcatggactgctggttgtcgccgccggtggggatggggccggctcggcgcagcgccgaagacctcacttactacgacggatggttctgcgccgtcgactccga

SEQ ID NO: 15594 - DNA, 581 bp, Triticum aestivum
  Clone ID: PAT_TA_15594
tttttttttttttttttttgagcttgtgaacacccatgctgctatgactgactgacacacagtacatgaattaagatacaacagatttgccccaactacagcctgaacatgagcaacactggtttatctcttttacaatctccagcatttgtcccaactacagctacaagttacctaacatcatcctacattattacatcacatcactgtcaagaacagtgctacgaggccagaactatgcgcccctggaccacctccaccatgcttggcctcttccacggctggccgtgcagtccagggccatgccgagcacgcgcaccatttgcttcccgcaacacgcctgaaactggcaggcaaggatcaaacagctcgttcctcgtcccgcgagcgatcacccatcgtacccagccgacaaggttcccaccaccttccaagtcttcttgccctgtaggtggccgtcctgtaagcagctccagcatgacgacgccaacgccaaagctgtacacgtcgcctttcgtgctggacttcattgtctgcccgtactctggggggatgtatccaaatgtaccggcgatgtcggg

SEQ ID NO: 15595 - DNA, 893 bp, Triticum aestivum
  unsure (1)..(893): unsure at all n locations
  Clone ID: PAT_TA_15595
agtaagcccaccccgtgaaccctacctcccgcaaatcatcccgacctcgggtccctcccgtgcgccgccctcgcttccgccacgaaccggcctccttccagcgcgcctccgcccagcctctccccgagcgcgttgccgcccggcctcctccccgagcgcgccgccgcccggcctcctccccaccgcgctgccgccgggcctcctccccaccgcgctgccgccgggcctcctccaagcgcgcctacagccggcctctcccccaccgcgccgccgccaggccttctcccaaccacgccgcgctggccggccttctccccgagcgcgccgcctcccggccttctccccatcgccagacatatcaagttctttggttgtgcgtgtactaaccagaagtctaccccagttgagcaaaaaaatatttcgttagcagttcataccaaaaaaggttcagacgtctcaagccgctaaggcctacatctccctgccaatggttgacagccggtgccaacatggctgtggtgagttcgttggcctagtccctatgctccgatgaggtcaagcccattgtcatatttgtcgccgcaacttcagattgctgccgccaagggacggtggcatgaagcagttgagtaggtgtgcgtggccgtttactgcctccacacaaggccgttcgatgatgcaacgctcaagctgatcacccttgccagcaccctagactcccatgaaatatctagtcaaaaaaatggttgatcgtaagtgcaagtacactacacacgctgaagctgcaacgggacacgggtgacatcacttcttttgggtggtttctgtatgaatctgaattttgtaataaattcagtncaacgaaacacatgatcccaacnggtacaaattat

SEQ ID NO: 15596 - DNA, 604 bp, Triticum aestivum
  unsure (1)..(604): unsure at all n locations
  Clone ID: PAT_TA_15596
gaacaaagaggtcgggaaggaccatctgttcaagcggagcatcatcctgatcaaggcttggtgttaccacgagggtaacatacatggatcaaaccattggttgatgtctacgtacgcattggaggtgttgattctgaacatcttcaacctttttcacacctccatacacggccctttgcaggccctgtacaagtttctgctgtactacagcaagtttgattgggacaaccagtgccttactttagctggccctgtncccctgcgcaacgacaccgctgggcctagtggctcaaatgaagaattactgctgagccaggagcccctcaagcgctcactgcgtaaagctttttgagctttcaccaggttctgataggcgtgacccagacttacgcctgaagtacctgaacattgttgaccccttgaagggggataacaacctcggcacaagtatcagcgaagcaaactctcgtgtcatacgggatgcctttgcagctggcgcagagaagctcggaaatattctcaagctgccttgcgaacgtatcgcagaagaaagatatgtgtttttacacatacgctgcngnnaacatgacnggtgagaggcgga

SEQ ID NO: 15597 - DNA, 581 bp, Triticum aestivum
  unsure (1)..(581): unsure at all n locations
  Clone ID: PAT_TA_15597
cccccaccatgagcggccaccacgacgccagcaagccctaccagccccgccggggcccggagcgccccccgccgcagcagccggcggaggacgaggaggcggccgcggccgcggcggcgatggccgaggtcgaggccgcggcgggggcgatggagcagtacgagccgcatctggagcacggggaggaggttcacgcnnttcatcctgacggacaagttcaagtcatgcttctggttgatcgacggctacgacatgccggacgacgggcgcatgatctactggatgaaggccgngatcctgcagggcgacaaggagctggcggagaacccctactacgcggatgagctcatctatggcgaagccaggggctgtgagctcaacgacatagtgcacgtcactgggatcaccgagggaggcaacagcatggaggttatctattgggaccgcaccgatgacagtatcctcgccggtaactacgacatcaacaccgtcgttgtgagagaaagccctggaacaaggaggctctgatgcctatgaggggcctgccgtggtaccgaaaagtgctcctggaggcgttcagg

SEQ ID NO: 15598 - DNA, 580 bp, Triticum aestivum
  Clone ID: PAT_TA_15598
cgccgatcggcccacatggtcgcctctatcgccgccgccgccgacgccgcgtccatctcccacctactacccgcgccgaaacccaagcccagaaccccaccccgcctctccctcctcccccgcaggcgctcccgcgccgccggtgccatctccgcgtcggcgtccgacgacttcgacttactagcccccgtgcggtgcctcaagtgccgcctcggcgcgggcgacaccctctatggcctcttgctcctctgcttctacgccacgctcgcccagatcggcgcgctcgccggctaccactacatagtcgtcgacatggagcacggaccgggcggcatcactgaggccctggactgtctccgcgcactcgacgtcggccgcacccccgtcatgctgcgactgccggaggcctggcccgtctgggcgaagaacgcgctcgacctcggacccgcgggcctcatgcttcccgccgacgagtcgccggtcgctgccgcagaggctgtgtcccactgtcgctacccgtccaacggcgtccgtggcactgtctaaccaatcgggcgcacatacgagtacgggctcgacg

SEQ ID NO: 15599 - DNA, 1220 bp, Triticum aestivum
  Clone ID: PAT_TA_15599
ccgccgcggcgccgcatctctcgctcgaccgcgcatctgtccccccccgccacagcacctcgtccaaccctagccgccacgggcaggagacggcgcagtgctccgcgtccgccggccgccggcgctccccaccgccgcgaaccgtcaacctcgtccgtgcatcgaccaccgcagcaagcaggcggcgtcgatgctctgcccgacccaccaccccttcggccgcgccggccccccctaatcagggggcggggttgagcccggtggtggtaatcgggttgtcgaacaagatgcagaagtcggtggtggtggccgtccaccgcccccttcccaccacagggtccaaccgccccgacatccaccgctcctacaacttgacgcgcgaccaacgaggcagaaggctgcaacatcggcagcgtgcttaagggggcctcttctaggctagtggccaaaaccaaccatgggattgtgcccggggtccttgaaaaagctaagatgtatgttccgccgccacctgcaccaaaagcttctggtgctacaactcaacaaattagcagcaagtcatctgtttaaagatcctcaggaggaaaccacatcctcgtctttaaagcatctctcttcttaagcggaactgaacgacttgtccatcataaccatctcatcatgaaggcacaacgggcggcgacaaagtcttgttttcgggcttgcggttgttattttctactttgtgggttcttgattggtgccgtgacattgaatcactagcagaagaatcttgggaccgcatcttttctcatggtatcacctttgatgaatgatccgtgccccccccggaccatagacacctaggacccgcttttgattgctcctttatatttccttttatcccgaggggtagtacaaccctttagcgctacctaataatagttctccgtacatggtggaggccgtggtggcgtccacggcggagctgagcccctggcatgggtgagagctgccggccatgggatgtcactcgtagctagtgtgctcattgtgacttgctggcgcaacttatggcagcagaaccgcaagtttgctcacgtttgttgaatgtacccgcgcttggatataatgctgttaatgtgggccattcttgtgcaacgtgggataaaaacatggtaacgtcgcccaatgtggatcagtaggctgtttatttaagcatatataaggctgtacgattt

SEQ ID NO: 15600 - DNA, 677 bp, Triticum aestivum
  unsure (1)..(677): unsure at all n locations
  Clone ID: PAT_TA_15600
gaaaaatcctccaagcgcatctcgacctccagcgcatcgtcacccgctgccgcgagccgncagccgccggccccagccccgccacaggctacagcgcgccggcaccgcctaccccgccggcactcctacccctaccccaagtgcctcccacgctcgctacgttctactgccggcgacactcgacgccgcggccgttgccggctcccacacccgcgggcctttatctccacggcggcggccgccgccgccctgctcgtacagcgggctggccctgtccatggggcgtaggggctacccgcgcccttcgacgcccgcacgcgcctccttctgcccttccgccgcggacgatgccgacttctctgagtctaatgcgatcctggtggtggccacgccctgcgagagtctgctgctggctcagacccaagcagtcttggccgtnnggcgggcagccatttgtcgttgaggagctcntggtttgggtcggtnttccagaagnttccggggtgggttttcccaaccacaaggggggccggccattaattcccccgtttggtgccccaccccaaaatcaacctttaaatntttcggggcttcttcctttggaaggcttggcccccgggctttttcggggcgggggcgggaaaaagaattggaatgggggcggaatggccccttaa

SEQ ID NO: 15601 - DNA, 600 bp, Triticum aestivum
  unsure (1)..(600): unsure at all n locations
  Clone ID: PAT_TA_15601
gcagttgctgcctccccttcaacaccccactccacccatcacgagcatacattcctgccgtgcgccggcatcaggtccggcaacaaccgaagtgcttttatcccacctctagagcgccgccaagctggcgaataaccagcccccctgcttctactactgtgggttgtgcgcnctgctgaatgaagcgctgacgccggacatggagcacaccgcgatgtcgccgggccttctccaatctctcctacagccgatctgtaacgcaccgaaacaactgcaggtctggtcgcaagaacactctgctttgcaggcgtctgcacaagagggtctttttataggcgtctacacagcgcttggtgttacaagttctgatgttgaccccgtactaaccgtatgtgttcggcagcatcttttgtgagtattttcagacagtggggcagagcctcaccgcggtttgagagcaaaaagcagaaatatggctttgtggaacctgttcgtaaatttacaaaaagcttctcaacaaaaggacaaaaagccttgaaattggcccccttctggttggcgaccaaaagatagaaccccctgtccggacccctttgacan

SEQ ID NO: 15602 - DNA, 608 bp, Triticum aestivum
  Clone ID: PAT_TA_15602
gccgctactcccctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggacccaatccttctgctgaggggggggggatgatgaaggtgtggttgaccagcccgggaagggggtggccttggtggccaccttccgtctcaagaaccaacctgtttttgccaaaaagcagttatctctcacatgaagcgctacatcaagaacctctctggccagcttgaaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgatgctaaaatctatgc

SEQ ID NO: 15603 - DNA, 582 bp, Triticum aestivum
  unsure (1)..(582): unsure at all n locations
  Clone ID: PAT_TA_15603
gaggaacgccgccggctagctgttgatggccgggcggtacgcccggagtctgttcgtggacagcctcatggggcggctcaacttcgcgtgccccggcggcgccgtcaacggcgcgggcgggatgttcagcctggagttcggcagcggcgagatctcccccgacgagatgaataagatcatggtcgacgagaagctggccgagatggtcctcgccgaccccaagcgcgtcaagagggtgctggcgaaccggcagtcggcggcgcggtccaacgagcgcaagatgctgtacatcgaggagctggagcagaaggtgcagatcctgcagacggaggacaccacgctcgccgagcagattaagctccttcagcgcgactcgtcggcggtggcgacgcanaacaacgagctcaggttccagctgcaggccatggagcatcacgcgcacctccgcgatgctctgaacgacgcgctgacaggcgaggtccatcgcctcaagatcgcggctgtggagctcggtattggngactcctgctccttcaacgccatgggccagcagcacaacctcatgtttaagcaccagcaacn

SEQ ID NO: 15604 - DNA, 675 bp, Triticum aestivum
  unsure (1)..(675): unsure at all n locations
  Clone ID: PAT_TA_15604
ggcacatcctttgngcaacgttgtggaaatgatgagctgcttcagatcatcaatgaattatccaaaaagactcaagcaattgggaaaaaacagattgagtcagatgcagaaatacttgtattgagggcaactgtaaaggacatggaaagaaaaattcaggaactgcagtaccaatatggaaaattacagttggagtattcagcagcacttcttggtgaaccacgcaatattctggaagggccgtccgcccacgcgtccggtggccataatggcatcacctggttgccatccctcgattccttttaccctacagcagatagactagtgccgctgaggccaatgagctcagcccgttcatatgctgctgttgctgcattgaatgatcatctctttgttattggtggcggcgatggcgattcatggtataccacagtggaatgctacaacagggtgagcaatgagtggatggcatgcccatgcttgaaacagaagaaaggaagtcttgctggagctacattgaatggtaaaatatttgctattggtgggggcgatgagtcgagatctttttcagaagttgagatgttgatccagtacttgggagttggatatacagcccgtctatgcaacaatgtcgatttgctcctgctgcagccgaattaaatggcatcctctatg

SEQ ID NO: 15605 - DNA, 611 bp, Triticum aestivum
  unsure (1)..(611): unsure at all n locations
  Clone ID: PAT_TA_15605
atccaccgccgccgcccgccgcattccgagaggttcgagctcgccggagagggaggagagatggccaggaagggcggagagaggaagaaagcggtgacccggtccaccaaggccggcctccagttccccgtcggccgcatcgggcgcttcctcaagaagggccgctacgcgcagcgcgtcggctccggcgcccccgtctacctcgccgccgtcctcgagtacctcgccgccgaggtgctggagctcgccggcaacgccgccaaggacaacaagaagacccgcatcgtgccgcgccacctgctcctcgccatccgcaacgaccaggagctcggcaagctgctcgccggcgtcaccatcgcgcacggcggcgtgatccccaacatcaaccccgtgctgctccccaagaaggccctcgagaaggccgagaaggagtcccagtcgcccaagtcgcccaaaaggaaggcccccgnccccgcacccgccgccaagaagacccccaagaagaccgccgccgacaagagaccgccgccgncgacaagaaaaccgcgccgcgacaagaaaaccgcccgctgccaaaaaacccgcgccgcgacaagagggctgcgcgaccc

SEQ ID NO: 15606 - DNA, 395 bp, Triticum aestivum
  unsure (1)..(395): unsure at all n locations
  Clone ID: PAT_TA_15606
cagatgcagggagtatgctggtggagaccgcctgtattctgcatatgctggatatggaattggctgctgaagctcttaaaggcgtcaagatggagttgatcgatgccgcatttccacttctcaagggagttgttgcaacaactgatgttgtcgaggcctgcactggtgtgaatgttgcggttatggttggtggattccccaggagggaggaaggaaagggaaggatgttatgacgaaaaaagtttcaatctacaaagctcaagcatctgctcttgaaactcatgccagcccccaactgcaaggttttggttggtgccaacccagcaaacaccaatgctctcatnctgaagaatttgctccatctatccctgggaagaacatcagttgtttgaccc

SEQ ID NO: 15607 - DNA, 618 bp, Triticum aestivum
  Clone ID: PAT_TA_15607
aaaaccctacgagctagccgccgcagccgcagccgccggagccgccaccgccaccgccttctgtccgcggatacgatctacggccaggctcccacgcgcacccccagccatggctgaacccgaggtggcggtcgccgcggacgcggccatggagaccgaggccccggaggcgaaccctatcctgaagagggagcgggaggagggggacgacccctccgccggggctggggccgaggaggcggaagacgcgccggcctataacgcgaacgtggaggaagaggcgaagaacgcggaagatgtcctcgggaacggggaggaagagggggccctgggagaggaaaggcagcccgacaagctggtgccgaaagatgactgcacgggcgtatacatgcttgactacttcttacagctgatccactctgggtcggcgaacctcgagcccaatgagcacaaaccgaacgcggtagaggacctgctgaacaaaggccacgccgagcccacccaaaagatgggatcatgcggggaggactctgagatcctgaaccgctcggtgaggcatatccgagtgtactgtcctacgatggtctgcgggtacacccgatgattttagcttgcgga

SEQ ID NO: 15608 - DNA, 587 bp, Triticum aestivum
  Clone ID: PAT_TA_15608
cccccccttcctcccgccaccacaccaacctcgccgccggcctcactctccctctcttctccgccccaccccccgtcctcccgccaccggcgcgcgccgcccgccccgtcgacgaaactagaacccctcgccctccgcgtttacttgccggctcggccgcgatgatctccgccatgtcctgggtgccgaggggcgccgccaagagcgtccccatcgaggcggagccgcccaccaaggaggagatcgaggaggccatgaagaaaatcgccctcggcagagaggccgggagcgacgccgacgacgccgacggggacgaggacgacgacgccgtgatggaggtcgacggcgccgaggacgaggaggtcgacgaggtcgcccaggccaaggccgccgccaaggcgctcgggaccaagagcagctcggccgccgccgtcggcgacgtttccgacgggctcgccgagctcaacatggacgcctacgacgaggaggaggacgggctcgagcttttcagcactgggttgggggactggtactacaagagcaacgaagaggacccctatatcatcaagaatgacgacgatgatgat

SEQ ID NO: 15609 - DNA, 390 bp, Triticum aestivum
  unsure (1)..(390): unsure at all n locations
  Clone ID: PAT_TA_15609
gccgttcgcccgccgcctcgctcgccgcggcccgggcgccgtcacccgccgcctgctccacacgggcccgccggcgggcccgggcgtgctggcgagccgcctggcgtcgcgcgccgtggtccgcttccggggccccgaggcggcgcgcttcctcaactcgctcctcaccaacgacgtcctcctctcccacggcgcccccgcctcgtcccagccgcagcggtacgcgcccacgcccaacgcgcccgcgcgggcgccgccgccgcggtacgccgcgctgctcacgccgcagggccggttcctctacgacctcttcctctaccgncccgccccgcgctcccagatgctcgaccgcaccgggtccgcgccccagactggggagaggcccggcgg

SEQ ID NO: 15610 - DNA, 527 bp, Triticum aestivum
  Clone ID: PAT_TA_15610
gagagagagagagagagagagagagagagagagagagagagagagagagagagagagagagagagagagagagagagagctttgtcggcctgtttgcgatagcccggtcgatcacgacatgctaaagagggagggggagcagatagccttcgttctcacatcacgccgtcgtcgacgaagccagcatcgtcttgttctttgtgctgcttccactactcaagctagctcgctcgatcgcttttgctcgcggcgggcaggcgtacatcactaggggcggccgcacgatggatgggttgacatgcatcaaatagggagcgtcatgtacgtgtgcggccgggcgccggacaggaagcgggagcgggatgtgtcgttggggtcggtggccacgccggcgtacactggctgagacctgtcgcgggccgtgtagctgggcccgatgcttgatcgaggctctcagtgtggcagtctgacggggcgttctggggctcttctctcggcggaactcaggcgcctacgattctgcttcg

SEQ ID NO: 15611 - DNA, 1049 bp, Triticum aestivum
  unsure (1)..(1049): unsure at all n locations
  Clone ID: PAT_TA_15611
ctcagcgctagtgcagtccaggaagattgacacaaaacgtccgaagaaatcccgtgttcaagaagcagtgtactattacaacattgagtcgattcttgctctcatcgtctctttctttattaacatctgcgttacaacggtattcgctaaaggattttatggatccgacaaagctgataacataggtcttgagaatgctggccagtacttacaggagaaatatggaactgccctgtttcctgtcctctatatctgggctatcgggttgttagcgtctggacagagcagcacgatcactggcacatatgcaggccaatttgtcatgggaggtttccttaatcttcgattgaagaagtggttacgagcagtgattactcgaagctttgccattattccgactatgattgtggctttattttttgatactgaagatcctaccatggacgttctgaatgagtcgctcaatgttcttcaggtccattccagtttccatttgcactaattcctctcaccacccttgtttcgagtgagcagctcatggggtcattcgtggttggtcctatcaccaaagtgataagttggatcgtcacaatctttctgatgctcatcaacggatacctcatcctgtccttctacaccaacgaagtgcggggcgcagtcgttcgttcaagcttgtgcgtcgtgctggctctttacctcgcgttcgtcatctacctggtcctcacgcgcaccacgccgtattcccgccttcgctcatcagtctcaatgagctcatgagaaagagtgttagtcatttcatctccatgatgaagaagatgaacgggaatggatagataatattgggagaaagctgctccccaatgtacagcctgtacggctgcctatttgtatcagctccggggggctagagggctagctccggggtcaaagggcagattgtacatcagttgctgttgtataaccagacttgtggtttagcaaggctctcccctttaggattggggcaggacggtacaaattacccaataaccttgaanaancccttncca

SEQ ID NO: 15612 - DNA, 579 bp, Triticum aestivum
  unsure (1)..(579): unsure at all n locations
  Clone ID: PAT_TA_15612
ccagcaacaaccatcgttcattcagccatctctacaacaacagctgaacccatgcaagaatttactcttgcagcaatgcagacctgtgtcattggtctcatccctctggtcaatgatctggccacaaagcgcttgccaagtgatgaggcaacaatgctgccaacaactagcacagattcctcagcagctccagtgtgcagccatccatagcgtcgtgcattccatcagcatgtagcaagaacaacaacaacaacaacaacaacaacaacaacagcagcagcaacaacaacaacaacaacaacaaatcctacaacaaattttgcaacaacaactgattccatgcagggatgttgtattgcaacaacacaacatagcgcatggaagctcacaagttttgcaagaaagtacttaccagctggtgcaacaattgtgttgtcagcagctgtggcagatccccgagcagtcgcggtgccaagccatccacaatgttgttcatgctattattctgcatnaacaacaccaccaccaccaacaacaacaacaacaacaacaacaaccaccgttgagccaagtctnctt

SEQ ID NO: 15613 - DNA, 948 bp, Triticum aestivum
  unsure (1)..(948): unsure at all n locations
  Clone ID: PAT_TA_15613
ggcacgaggaatggtcgccgcccccctccgcgcaccaccatgctgctccgccgcctcctccacccctcccaccacctccggcgcggcctccagaccctaaccacgaccaccaacgccgccgctgcccccccgacaccgcatcctctctccgcccctctcccatttcgccgcctccccgcccgcctcctctcgccgcggctgctctccacctccggcggcgacgacgacacccgaagaccctgggccttcacgcaggactccggagatccggaccccttcgccgatgtggaccccgccgccgccgtccccggcgaagcgccgctaggatcgagcgccgtcgtcgagggcccgtggtcgaaggacttccgcgcggaggacagcgacaaggccgacgtgttcgaggagatctacaaggatgcggccgcggcagcgcctgccgtgaggaaggcggccccggccgagccgtggacgtgggatttggagggtgagaaagacgacccgttcgccgcgagaaaggatgcggccgcggcagcgcctaccgcgagaaaggcgggcccggcccgaccgtggacgttggatttggaagacgaagaagacgatcccttcgcgcggctgtgctttgatgtgggggttganggggatcgcggatgaaggtgcccaaaatcgaagganctttgttgattggggaaanaaaaaaaaagccggaacgttaaccgggcagggaaggacaaagggcnnangggaaccanccancctggatnggaaaacttttnaaagggncccgaatncgggcantttgggggaaactnattttttggcctttgggaattaacccgaaggatntnaattggacagtttggatcctttttgaaaggaggcccgggggagtaccaggaattgcctcttttaaggggaaaacaanaaangaggtttccaaaaaatganngt

SEQ ID NO: 15614 - DNA, 584 bp, Triticum aestivum
  unsure (1)..(584): unsure at all n locations
  Clone ID: PAT_TA_15614
tcattgtcttcggtgggaggtccttggatgccgactaacacacgacgcccgactaagagacagacgagagactaccctatggcgtagacacgattcacttcgcgatcattgatgcaatacgccagacacttcctgctcgagctctacacgactgctgtctgggctttcagtgacacgaggaccctcaagctctacacccctgtgtgcctgtaaccctaccactagacgcccacatccattgccgccaagcccttgtacctgcgagcgaagcacgacaacaggtacattgcttcccaggtgcttcttgaatcccgcttcagcagctcacttctgaccacggttcaccacctcaacaacgtattagatagtcatggtgttcagcaaggtggaagataactcgagaacgctgcttgaggcggccatgcgccagcagaatcatgctaaactgtgccattacataaccacaaccagggagctgatggagcaacttggagctgaaactacaccagaacgaatatcgagtgtttcataagctaagctcagtgagtattcataaaagatngaagcactagctgccacgctng

SEQ ID NO: 15615 - DNA, 576 bp, Triticum aestivum
  Clone ID: PAT_TA_15615
gtctatatctcatctcccttctatgttttctcatcccatgctgcaatttatccccaatcctcgtgatctcctccagtagcacaatatcacattgcagcccatgctgttggagaaacaagagcttgccgggagtccgcgggctggacgcgtcgtggtgggtgggacagctcttggtggcgccgccgtggcctcgaggtcgtcctgacaagcaaatgtgcatggtgccctctgccgcccaaggtatttgagaaaatcgcagccgggaatcaattcgtcacaacaaacctgcaattcacgcggctgagctcgatttggtgcaggaagattatcaggtatggcgggatttcggactggcgaggagacccaggagcggatggatttatggctgacccgggtcttggtccttctgagcttcgcggcgcatcttaccctggccctatcagccgggatccgtcgccgtaaagactctggcgtgcggaggtatctgttgtggttggcgtactacgtgaccgagatagtcacaccaatcaccctcggcaaggtgttcctcgacaccgcgtccgcgcatagcgagca

SEQ ID NO: 15616 - DNA, 619 bp, Triticum aestivum
  Clone ID: PAT_TA_15616
cgggggcaccttctaggatcactaccatgctactcgcgcaacctcctaaaccagttccaattcctgtaggacgaggttcaaaccctaagcagcacacacaaacagacgggctggaagtccaacaccggatacgctctccgccagtatctgattaccacggctgccaggaagtcttctctcgccgaccgtgctcttgaacataccccagcactacgacacccgacgaccgtgcgtctccagatcgactgcggagatacagacccgttcttcgaattagacccctgccccgccaacccctgttacgcgacattaggctcgagttcattactgaacgtcccttgcagaaacaacttgcgctcggactacaggaagacggccgaggggttctagtagatctacttagaggcagccacctttgtgccattcatgaagaaggcggttccatggcgagccggaggacattgaactttggctgcgtgaatatatacgagcacctgcccgcagaacgaaacggttgcgtttcgcaaacagtacatttccctggaataaaaggcagtgcttgctccgatgctcatggaaccttgttgatttggaagagactgagaggacaccaaccccc

SEQ ID NO: 15617 - DNA, 538 bp, Triticum aestivum
  unsure (1)..(538): unsure at all n locations
  Clone ID: PAT_TA_15617
gcaatccgggctatattatactacatcaccctgaacctgttggggatattagactacaacgacgtcgccgatcgctacagcgaatttgataagcccccgagctccgccgatccgatggccgagacgtactgcgaccttcacaccgccgacaggcttaatgccctcgaggcgcacctcgccggccagacctacatctacggcgacgggatcaccaacgacgacgtcaatgtgttcgcggcgatgcccgtgaagaccagcgccgagttcctgaacgctgcccgatggtacgacgccgtcatcgcggccgcttcttcaatgttccctgaccaggccttttgggcgagagcatccttatctactgctgcagctgctgctgctgcttccacagatgaagatgatgacgatgacatggatctgctccgccatcagacccaggaggacaagcaaacactagctgaccgcgagagctgacacgcctgcgttgaataaagacagcggcaaatccttcgtgctcattgacaataagtgatgcgacgan

SEQ ID NO: 15618 - DNA, 587 bp, Triticum aestivum
  unsure (1)..(587): unsure at all n locations
  Clone ID: PAT_TA_15618
gttagttaaacacatcaccccttcactctgccgtattcgcacggaggccctcgctgaggcaggcctagggacctccccacgaaaagacagatcttcaaggctctgctctgctcctcggaggcccaagcgaggggagaccggggtataaatcggcgcggttctcgaagcccctcttctccgccccgccccgccccaaatttctccccctttccgctttccctccctccctccttccacccaagctgctttcacagcgagagtgcgcgcgcgcgctggggaaggcaatggcggagcaagcgggtgccaggaggacgtgggccgcgctggcggcgctcggggccgtctccctgctcctcctcctcctcctcgtcgccctctccggcggcggcagcaccggcgtcgcggggctctccggcggcagcaggctccgctccgcgtcgacggccaaggtggtgaccgcggcggcgagcggcgccaggcggtggctgcgggactccacgtcacggcttgcggccacgactacagcgacggcggcgaggggcgaacgtgccgacgatcacgccgacggtgccgcggcggtggcagtn

SEQ ID NO: 15619 - DNA, 657 bp, Triticum aestivum
  Clone ID: PAT_TA_15619
cacaaactcccagctttataccctctttacggagccctcctcgggtgcgctttacaatggaggaagaagatctccccctccccatgggccattcggttgccccatcccccaaacaaccggatttccttccatggggggccatggttccgttcgaccccaggatttgaccactctccaaagcattggctggtgggagaccaaagccaaagccttcttaacacattctgctattggacaacggccacccgggcttgtttaagcacccaacacagcgggcttttttaaacattcaaagactacatacagtgcgccgggtattggacttcaacctgcacattctggacattttctccaaaaaatgcgtctcggccagacacataaagtgtgattcttttgtgcccagccattcctcccaaggttacagtcaaaaaagaacttcccaaacacagtcggtcgcacacctcaatccacgggtctaaatggtattgaagcctgggatttccattcctggttcaacaggacttttttgtttctaaatttgggaacaaaatagttgggcgaaccttcccgcaataattgggaaaaaatccggtttaccccggataaccgatttggcccctccccaggaaaatttttaaaggacttgtggacaatcgg

SEQ ID NO: 15620 - DNA, 431 bp, Triticum aestivum
  Clone ID: PAT_TA_15620
tctttctcctccgaatttgttttgttacttctcctcggctaacgttcgtggatccaattttccggaaaaaccagatttttggcacaaccaagcttacaagctcaccatatgcttctgcattgggatgacttaccttcttcaacagaagttgcaaacccaacccttttggaccaaaaactctccaagaagctttgtcacatcaatgttgggctgatatatttccttaacttccccttgttcaaggcacaagaatgctatgctccattacttccctcaatttttaattgccctcaattttactaaaaggaaacccggacttgaaactacactttgttttcgaatgaccgccgttggattaacttctttgtatgagcaaaatcgggacatacaaacaaaaattttttcctaattctcttaatcttattttcccc

SEQ ID NO: 15621 - DNA, 576 bp, Triticum aestivum
  unsure (1)..(576): unsure at all n locations
  Clone ID: PAT_TA_15621
gagagaactagtctcagtttttttttttttttttttcactaaataaatccgtatccttatagtaaaggtgttgtgcttctcttcacataacttttcttacattttgagtgccttttggcactatcagtaaccaaagtaaagtcacttacaactctgaatgctctagtgcagaaacaccagtgactacatttctcatgaaccttctgcttgaataagtcgacatcacctcgacagacgacgcctgaattcacagaccatggccatcgcccataataatttgtatgtatataagagaaataactgaggatgtgagtggacgaaagggacagcctcgattcatctgtcgtccaaagccgccatgaaaaggggggcagagatggtggggttgacttgcttggttgggtgagatgcggaagcccgttggcgctggcggcgtcatggggaatgtccagcacgaccatgaatcaattcatgtaagcttagggtggctagcctcgatcaaccaaacccgaggacgcaccagacaacaccgtaaatgcatcttggtcctcgttgtcgcaaacgagggcggggagn

SEQ ID NO: 15622 - DNA, 598 bp, Triticum aestivum
  unsure (1)..(598): unsure at all n locations
  Clone ID: PAT_TA_15622
gacgcttccgcccgggctgcaccagcccgccgcttttaggtgccgcccgcctccgcttttgcgctccttttcggccgggattgctgccggctcctcgcgaaagatcgcatctctggcctgtcggatcagatgagatgtgggggtggcggagcctctaggagacatggctgaagcggtctcgtcctcgcccggatcccccgcggcggcggcggcggccgcgtacccgtacccggtggcgcgccgcctccatggcgccttcgtcgccagggacgaactcccgtactcataccccgctgccgctgctgcaccgccgccgcccgcgccgctgccgcaggcgcaacagggttcctccggcgggggaggcggcaagattagccccgcggtgctcttcatcatcgtcatcctcgcggtggtgttcttcatctccggcctgctccacctcctcgtgcggctgctcatgaagaagcagcaccgccgccgaggcgggtcggctgccgccgcggcgcaggggcccggggaggccgacgcggcgctgcagcgccagctgcagcagctggtccaccttcacgactctggggctggacaaggccttcatcan

SEQ ID NO: 15623 - DNA, 612 bp, Triticum aestivum
  unsure (1)..(612): unsure at all n locations
  Clone ID: PAT_TA_15623
ccggcctgccgccccccgccgccgcactcctcgccgacgtcggcgccctccgccgctcgtacgcacgcctcatcgccctctcctccacgctccgccacctcgaccagatcctcgccgtctgcctcgcctccggccactacaccctcgaccccgccccggccacctcgctcctcctccgctacgccgccctccgcgcacctccccgccagctcctccgcctcttccgcgccgtccccagccccgaccgcttcattcgcaacgccctcctccgctccctcccgtgcctctgcccggacctcctcttcccctgccccgactccttctccttcgcgttcgccgccacctcgctcaacacttccagctcccgcggcggcatcgcttctagctccgcttccgcgcgcccgctgcacgggctcgccgtggccgcggggtacgcggnggacacgttcgtggcgtcggccttcaccaagctctactccacgctgtcgagaggcgatgacgcacgcaaggtgttcgacgcagtgccgtctccggacacggtcctctggaacacgctgctcgccgtgctgtccggctcggaggccatggaggcgttcgtgcggatggtaggga

SEQ ID NO: 15624 - DNA, 584 bp, Triticum aestivum
  unsure (1)..(584): unsure at all n locations
  Clone ID: PAT_TA_15624
caaacaccaacaagcattgctgcaacagaaatgtccatgaggctcgccgcctgcgctctcctccttcctctagtgcttgcggcgctcctccacccggctgatgtcgtcgctgtaggtgatggcacaccagaccgcggcggcggtggcttcagcctgcggctggtacccagccccggctggaaccgtagcatccacgtcgacgacgacggcttcgtgcacctgaatgaggacgccaccaccgcgcttcgcccccccatgcacacacaaattgggggcaagtacagcgtcgtcaccagcgttgggacgggggccggccgacgcacgtacgtnctcgcgctggatatgaccagcagcgaactgtggatgcagtgcaagccggtccaaaagcctttcgcacagcagccgccgcccttcgagcctgccaagtcgccgtcgttccgccatgtaccgggcaacagcaggttctgcttgccgcccgctcatgggcatcggcccacagttcaagacccatgcaagnttcgtagcatcggacttcacggcatcgatgcgagaagcgtnctgagcaacgagaccttagccttcgc

SEQ ID NO: 15625 - DNA, 598 bp, Triticum aestivum
  unsure (1)..(598): unsure at all n locations
  Clone ID: PAT_TA_15625
ccgacgctcaagcggccagacgccgcagcgccgccactccacccgcagcggcaaccatggcggtcggcaagaacaagcgcatctccaaggggaggaacggntnntngngaaagatngcatggntggccggaccgatcacataatatgggggggtggcggagcctgtacgatacataggctgaacctggctcagcctcgcgcggatccccacgcggcggtggcagaaggcgaagcctgaactcaggaagaaggccacgccatgtctcacttggaggcagggacaaactgccggactcatacaccgctgccgctggtgctccgacgacgaccgcgcgcgtgttcgaagcgcaacagggttacatccaagggtgtaggcctgacaggatcacgccccgggaaggattgcaaccaaccctgatgcccaccggtggcgcatcgtcatctaacggcctggttcgatttgttcggccggtgctcatgaagaaccaagctctccgtcgcaggtgcttggttgcccgcccggaacatggggcccctgaaggacacgccgctgcgataatgcaaggcggcgggggtattgccctctcaccgacccccc

SEQ ID NO: 15626 - DNA, 759 bp, Triticum aestivum
  Clone ID: PAT_TA_15626
gggggccacgcgtccgcccacgcgtccggccgcccgcgccgccatcgccgacgccaagccgctcttcgacccggagctcaaaatccagcgcctcaaggacgcaatcttcgcgcagaacgagctgctcgcgcgcgccaagaagcgcggcgccttcgcctcactcatcggcgccaaatccatacccaagccgctccactgcctcgctgtccgcctcaccgccgagcggatcgcgctgcctgacaagttcgcggacccggtgccgccgcctgcggcgctggaggaccccgcgctgttccactacgccatcttctccgacaacgtgctcgccgcctcagtcgtcgtccgctcctgcgtagccaactcgcaggacccctcaaagcacgtcttccatgtggtgaccgaccgaatgaacctcggggcgatgcaggtgataatccgcctaatggacttacaaggtgcacactatgaggtcaaagcatatgaagactacaaatttcttaactcctcctatgttcctgtgctccggcaactggagtcagcaaacctccaaaaattctatttcgagaataagcttgagaatgccaccaaagatgctagcaatatgaagttcaggaatcccaagtatctttctatgcttaatcacttgcgattctacttgcctgagatgtaccccaagctgcagaaagattcttttcttggatgatgatgtcgtggtacagcgggatcttacaggattgtggaagattgacatggatggga

SEQ ID NO: 15627 - DNA, 896 bp, Triticum aestivum
  Clone ID: PAT_TA_15627
cagaagtgtaaagtggttgacttgggtattgcaaaagatactgaagaaagtcttatggagcatatggatgcagctctacattctgatgctgatataatccttacttctggtggtgtttccatgggtgatagagatcttgtcaaaccttgcttggcaaagatgggtaaaattcacttcgaaaagatccggatgaaaccagggaagccattgacatttgctgagatcacatcaaatgacccaacaaagccatccaaaacagctcttgcttttggcttgcctggaaacccagtgagctgtatggtttgcttcaatctctttgttgttcctgcaatacgtcttgtctctggttggtcaaatcctcatctggagagagtgcatgtgcgaatatcacatcctctaagagcagacccacatcgtatggagtttcatcgtgcagtgatcagatgggtgctcgacgatggatccggtagaccaggttatgttgctgagagcactggccaacaagctagtagccgccttctaagtatgaaatctgcaaatgccttgctggaagtgcaatcatctgaccaaatattggcagttggagcattgtgccaagctatacttatttgtgatataactagccctcctcggaataagcggtgtggtgtttacagccccttataatcaaatctgggttcttgggcaaaagggtgctttggcgggatgcacccacaggtttgcagtcttcttcagaaatggctgaatgttaaaaggagccaatttcttcactggtaaggaaaccactgttttctttttggaagcaagggcccccgatgaggaggtggccccaaggagcctggattgttgtaggagaaccttctttcattcgggaaaaaaagtagggggggaagcct

SEQ ID NO: 15628 - DNA, 610 bp, Triticum aestivum
  Clone ID: PAT_TA_15628
taatcaccatcttggccaaggtcaagatactgtaacttagacagattaccaagatgaggaggcaccctaccggtaaatggtatgccagagaggttaaggtatctcaagttccccatggagcccagcaaatgaggaatttgactatttgtacctagtaaacagttcatgctgaggtccatgtgctctaaatgcttcaaggaaagcagagagggacttatctcgccgaacaaagcactggcaccaccacatacatcatactcgccataagtgtcgagtgccacattcggattgcgaagatgaagcttgatgacatggcctgttcggttgctgcaactgacacctctccaccggcagcagtcctgtccctgccacgaggtgaggatgttggcgtcgttgcttgtaatgccctttttgaaggagagcaaggtggccctctcgtcagggttgcagccgccgccatgggcatgctgatgctggggttgtagtgcgccatttgtgaagaatggaaatatgcttatgctgatgagggtgagcaagagattgttgttcgacacatgctggaagaacgagctgtctagctggggaatcaaagcagagtatgttacaggcg

SEQ ID NO: 15629 - DNA, 403 bp, Triticum aestivum
  Clone ID: PAT_TA_15629
ctaattctgggaatggaccaaccaaacaacagtggcattacatgcttaataaaggaagtcatgttggaggcaacaggagtaagtgaaaaacagtcggtaggaagacgacaaaccacagaattatcaagaactgcggaatttgtacttatgaagcgtataactagtaatggctaacggcagaaacacgtaataactgtcaaagacacacgtaccaaacgctagtcaaagatcacaaaaacaagcgcgagtgccaaacaaagatcaagggttacagattaaaggtggaagcacacactggatcttaacgcttattacagaattgacttgactagtgtggctcctgattgaaaggcatggtgagaggatcgtacttgtctatagcgctgtacaagttgctatttaa

SEQ ID NO: 15630 - DNA, 314 bp, Triticum aestivum
  Clone ID: PAT_TA_15630
cgtccggaggacgtccggaagagaggagcagaggtagcctcgtcttcctcgggattgggagggacgagagaggcggggagagaatgcaggagcagggggagagctcgcggccttcgagcagcgacaggtcgtccagctccggcaaccacatggggcacaaggaagggatggagagcgacgacgagatagggacggtgccggagctgggcctggggccaagcggcgcgtccacgtccggcaggagggaagccgacgggccggagcgcgcccagtccttcaccgcgcaaggcagcgcgcgccgccgcggacgcacc

SEQ ID NO: 15631 - DNA, 615 bp, Triticum aestivum
  unsure (1)..(615): unsure at all n locations
  Clone ID: PAT_TA_15631
gagaactacgctcgcagagcttcttttcttctttcaaagcgccgactgtgctattgattcatatacatactgtatccattacatagtaccaacaacacacatgtgcatccagatccatctatcgcgacatcaatgcgactgaacacgaaaaagttcatgactgagtccaaaacgaggccgaaggacacgaacgggactgacaccttcctatgtgtgctccttcactgaatcgagaacggcaaagaggactgctaggccgccatttatttatttggtcaggactaatgattcgaccacggtctcgccctgaacagccaatgggacagcttcagccatttggtggtactcgacggcgtcgagcatgtcaaggcagcgaccattgtcccgcctgatgaggttgaagacgatcttcctgataccatacacaccaaacagggtcgtcagactctcaaagnacagattccacgggtactttgtgtaaatgcgctagatgacatcctggaacatattaatgcaatggctcgggtcttcctttcactcnccaattaannccacacacacaacgnangccatgcctttctcctaaagatcgatgtggggaacgggcacaccatt

SEQ ID NO: 15632 - DNA, 527 bp, Triticum aestivum
  Clone ID: PAT_TA_15632
gagagagagagagagagagagagagagagagagagagagagagagagagagagagagagagagagagagagagagagagagagagagagagagagagagagggagacggaacgagctactcagataacggaagacattctggcactatcacaggcgcccaaccccggacttggggaggggctcctttgttagataaagagctgacgcggcctctggttatgatgcggggagcatgaaactcgcggacacacggatgcgtgcgcccacgcatgtgagctgctgcctatcaactttcgatggtggaaggggctccatgggggagggggaggaaataaggtctattcgagaggagctgcaaacggctaccatcgaagaagggggggcggcaataaccatctggacgggaggagtgcaataataagctaccgggcgcggtgaataatgaaaacaagggttgtcgcgacaaaaaaactgagggggggcgggggccaagtcgctatggggggtggttacagtatccggcgccg

SEQ ID NO: 15633 - DNA, 681 bp, Triticum aestivum
  Clone ID: PAT_TA_15633
caagagtgtgtgatgaagacaccagttctaccggctcctaacattcatgctcgcggcgacaaccaaggcggtcgagtatggtgcaaggagccataacagaggcccttggaggtggtgcgatccgccaacggcctacaaggggagcccactcaccacctgcccgtcattggtgaagctccagcgtatgagcaagaacctacccttacctgaactaagacatctgtgtctgatactggtccacgtcaacaaggatatgtgcacaatatgggtcctcaacagaccgaggcgctttgtctataaggatccccgagtgctggatcagaaagcggctcctccactttcccataaggaaagtactagctgagtggtggtgactactactaacagctgatcagctgcccatagcaaaccccgacacttaaaacaggaacacaaagtttttcttcctcgcgctcatcatgagcccgatcggccgcaatccaactcaacgggctccactaacttgaaaggattatcgcccccgagaccccatccgcccccttaatactttcagatttggcttttaatccttttattcccccttgccgggaggccaccggcccttcccttgagcaattaattattgagccaaatttcattctgcttccaaaacggataatattcttttcccccacaaccccg

SEQ ID NO: 15634 - DNA, 484 bp, Triticum aestivum
  Clone ID: PAT_TA_15634
acttgatatggaggtgggttgccgaaggttttattaagtgtgacaaagtagaaagcgggctattcgtccgcggaaagagctacttcaacgagcttatgaacaggagcttgatccagccagcggaaatcaattatgaaggaacagtagtaacttgccgtatacatgatatggtgcttgaccttatatgctcgctgtcaagtgaggagaattttatctccatattggataatgcggagtggaatgcacctaatccgcaaagaaaatttcgcaggttatcacttcataatatcaaggcaaaggttcagaaccatcagattgaaagcactagcctgtcaaaagtgaggacctttgctgttttttctcctgttacctgtgattggttgccatctctctcaagctttcaatttttgcgtgtgctggatcttggaaattgtgttagccatgaaagtagctctggcatcagcctcaagtatgtagggaattt

SEQ ID NO: 15635 - DNA, 829 bp, Triticum aestivum
  unsure (1)..(829): unsure at all n locations
  Clone ID: PAT_TA_15635
gccccaaccaccctacctctccccctnccctcgcctccgtccccaaatccgaccaccccctcgcctcgccggcggcccccccttcacgcaaccgtactctccggggcccgcgcgccggaatggaggcggcgcgcgccaaggacaccaaggagcgcctggccggggtggagcgcctgcacgaggcgctcgacgcggcggcgcgccgcggcctctccccggccgaggtcacctcgctggtggacacctgcgtggatctgacgcgggacgccaactttccgcgtccgcagggggggctggaggcgcttttccgccgccgcggggctggccggggaccaacttnaaggaatcaaccttaaacgcgccttggttcccccgcccgcccgtcagacccgccttttgggggaaccgggaaaagcaaaagcccctttccccncaaagggccccnnnccccgccacagcctttcctctnttttaaaaaggccttcaattggagaaggggggtttttttttcacacccaaacccaaaatttaaatttttcttccaaaaaaaagggggcgcccgcggggaaaaatatttttatatgcccaatgtgggaaccccttaaatattaaaaaaaaaatttggggaggagggggggtcttcggggggaaaaaaaagagttttggggacctcttttaaaccaggggggggccaaacactctgcccaantttggggggccccttttttttcccttttttttttcccggggaacctttttctatatattggccaacaggagagggttataaaacttttaaaacccccgtgtcccttaaaaagagggggag

SEQ ID NO: 15636 - DNA, 617 bp, Triticum aestivum
  Clone ID: PAT_TA_15636
atacggcgccgtccttgagtggggccggtcttctgcatggtctgatcgcctccgccggaggccgcggcgcgcgcctaggcccgtgctggcgcccccagcaacatggctccacgtgcagagaagaaatgggtgccacacttgtatgtgaacaacagtgactacatctgctgccactacattgctccctcttcctccggacccgacggcggtccggatgagcagcagcagcagcgcaaggcgagtgagattgctggcgaggtggtcgcgaagctcttcgtcacgtcgtcaaaaggcccacagaagttcatggaggcgcacgggctggagcaatggtggtcggatgggatggagctgctggctgtgtctgacagcaagaagcatgagcgagaaggccagtcacctgtggcagaaagtgaaggcaagcctgccattgaaggaagaagcagcgcttgactgtgcaaaagaggatggcagcatcaagaagagactacgcgcagagaagaaatgggtgccacacttgtatgtgaacaacagtgactacatctgctgccactacagtgctccctctttcttccgacccgacgggggtccggatgagcagcagcagcagcgcaaaa

SEQ ID NO: 15637 - DNA, 528 bp, Triticum aestivum
  unsure (1)..(528): unsure at all n locations
  Clone ID: PAT_TA_15637
cgttcgcccacgcgtccggaacgtgtttgagatagccagcaagttcatcaaaggagaccttgatgaagaaatccagggttcattagggcctgttgaagtgaaaaatagaacagaagaagggactgatagacttgagtctgatggtaaagggaaagaagcagaaaaaccccactcagaaaacagtgagaagacagatgttgaagtagagtcagctcatgatactgatagacatgagtcagattgtgaaagtaaagaagcagaaaactccacctcagaaaacagtgttaagacagatgctgaagaagaatcagctcatgctaaccaggaggagccaacaacatctgcatctgataccaacaaaggagaaagtgttgtggatgcacagggtaatataacagttgatgaaatgggcagtgcagcgagttctggagatgaagttactatcaaatctgctaatgatggtcccaccagattaacagtaaatacaacatttgatgaaatgggcagtgcagngagttctggagatga

SEQ ID NO: 15638 - DNA, 523 bp, Triticum aestivum
  unsure (1)..(523): unsure at all n locations
  Clone ID: PAT_TA_15638
gtgagagatagagatagagagagtgagagagactgagagagcgagagtgagagtctgagtgagtcagagagatttagttacctagatagaacacatagtgcgtgtccccagatgcgttagccctgttttgaacaagagtctcgacagtccgattgctatgtttatatactggtgtggttttggatacagcctgaaaagcccattactgtgctattactggcattgtcttctctccacggacgcttccaaactgtggagctcctgcctacattcttccgaccatgccggctgacatgattgtgaaactgttgtttgctccctgccagagcctcgcatgcgccactcttgttatcatccttccctacggcttccacatcatccttaccaacatctanncccctttttccacaccatggnnnctttgaccttccgagtatcccatagtcctggccatcgtgagttttacactaaagcaatagcttgctgatttttgtcaacgtgcattgtactagtaattattgtg

SEQ ID NO: 15639 - DNA, 575 bp, Triticum aestivum
  Clone ID: PAT_TA_15639
caaagccacgaggaaccgcagcaaatcagcaaaggtatcaaatgccatggatcaaaaaggggaaattttttagtgctagtgaacattaccagcacttatatggaagacagacgccctgaaggagaaaaccacctctaggacccgcgccagggctgccacgtactacctgaccatacagacgcgacattactagaccgtggtgcgaacggtggactaaacgaccggtgcaacatggagaagcccgacatcttatacaactgcgcgcgtgaggggaaaaaaaaaaacaaactccagggggggcctgccacccaatgccacagtaagggagccgcattacaatccatggcacgtaggtgcacaacggaggggaagagagacctctgcagaaagctaactctaccgaggtagagcacactgccgatcagccagaggaagccctactgaataggcccaaagacaccagcctgggcaacaaaacctcaggcggatgagcaagcgtgaaacaagtcgcatacatggatggttgaaatgggcacctgcataagggcccatcagggcagattattgccaataag

SEQ ID NO: 15640 - DNA, 581 bp, Triticum aestivum
  unsure (1)..(581): unsure at all n locations
  Clone ID: PAT_TA_15640
gtgccatggcggctccctcagtcgccaccacgactccacgaggagtgcgcgtccgcgaggtgtccggccagggcgaaggcagcaacagccttcttcccctcttcttcctacccctccgccacacctcccccctccctactatggcggctccctctcctgccttcgagtgcgcggccgcaaggtgtacgacctgggtgaaggcagcagcagcttcgacagtgtcgtgctgagctggaggtgtgccgacgcatggtggtgaggccgcgttgtagtagggcggtgcaggggagcctgctgcttcctttccctgctcttggcctctgacgggatgggtgcgctcgctttggtcgagccccgtcgctctgccgctggcctatccatggccagctcctccgaccccatctctccggtagcttgctgccatggctgagccgccccctccttccctcccccaccaagccccaccttacctatnttttagcaactcgtgcagtcgccaccacctgggagctcgatcccctcccattcgcgtatccccaagcgcctccagtcgtgagggaagagagctccctcgatcccag

SEQ ID NO: 15641 - DNA, 881 bp, Triticum aestivum
  unsure (1)..(881): unsure at all n locations
  Clone ID: PAT_TA_15641
gcgttgtctgactgtatatgccatattgagccctccttacancaattctataatcattttgatcctttaactcacctccgctcattgttataacatactcctcattggattacctatccatatgcgaccttaataattatattcttccaatctgctaccttgacacctaacaactaacggcatgatctttagctagcatttaatgcatcgtgaacacactatcccctttattctccattgaacttcttgcaggtaaaccaatcctcctgttttaatagatctgcttaggtgctttgagggtgttctctgtataacctaacaaataccatcaaacaagcagatgacaaacaaaaaattatctatgtcatcccagttttcataaatttcctaaaaatataactacaaattggatatctctaccctgtacacacacttgaatacactacactcttaaaccgcacacgggttggagtgtctgacatacgtaatatcctctgcatctttatatcgtaaaacgctatgtgatctctcatgaatattactcgtgttcgtctctttatctatcgtatctactccatcctctttgttcactccacaaaaggcaactacggtattgagtcgcatattccatatatgactttgaacaagaaaaaaacatgatatatatgatatactctctctcactatctattcgtagtattgtgnagtaccattattcctgtacatgtcgtacgatactccgcaatttgtaacatcataaattacttttcatttcacacgttgagcctacgttgagtgtcacttactcatctactcatcagtagtgcgataaaattccatactcgactacattcgagtgagggcgtactcatatcttgatt

SEQ ID NO: 15642 - DNA, 1306 bp, Triticum aestivum
  unsure (1)..(1306): unsure at all n locations
  Clone ID: PAT_TA_15642
cccacccatcccattcccacctccattcgaaagcggaaacctccctgatttccccatctcctccccctacccccaaaaccctagctccgctcctccttctccatgtgatgggatgccgaccaaaccctacccccagtccctgaccgccgctgcgtccttccccgcgacctggatgtccgcatggacggcttccgggccctgatcgccgccggggccaccgccgtctgctgcggcgtgggcgccatctgggcattccgctccccttccccccctccccccaagaagcagcagcccattccttcacgctgctgcgtctgcgcttcctgtggttgctgcgccaataccactttccccagcgccaacggcgagatggccgtcggcggggagatgaacaaggcgccggcgccagcacctgcaacgacgggcgcctccatgatggagcagctcgtgcctgagatcaccacccacgcgctcagttacctcgactgcactagcctctgccgcctctcgatgaccaattcagccatgcgccgtgccgccaacgacgatggggcttggaaggcgctctaccacaaggattttacagcggagcaggatactataactccacctaacggatggaaggcatactatgcagctacaaaggccatcatgaatgtgaatgccgagttctataatatcatcagggaaggatccttgccagcaatgagtcacttctggcttaactcagactatgtaaaatgtgtacatgctactggagaactttttacaggatacaatgcagtgatgaacagctggggcttgttattcaactggggccaagatggaggccagggcactgattttcagctacgggatgtcagagctcgtgtacttgctgatgtagcatgggttaacatgaaggttcatgtcgatgttgacccagggccgttccatgtgaccaatgtatacgagttccgtaatggcaggtggtatatggttcatcaccatagctcgctcatggctgacccggcgccacataatctgtttggctgaattcaacaaggtttcatccgcaagaaaacttcatcacagattgtcaggttgcctgcttctgcggtttagactggtagtagataccaaatgtgtccgtggagagcttttcttcaccctgttttctcggttcattcatcctgaatcactggtttctttatattttgcccatcagttttgtataaatgtgatgtaggagttcaagattggtggagggtatattgtccctgaccgtgaggctgtgactgacttgtctcgtcgattgtttaaaaan

SEQ ID NO: 15643 - DNA, 497 bp, Triticum aestivum
  unsure (1)..(497): unsure at all n locations
  Clone ID: PAT_TA_15643
gtcatcctcaacacctcaccactgcctcctcgcgccgccaccctgtcgccactgccacctcgtgccgccaccatctcgccactgccacctcgcgccgccaccctctcgcagcacaggtcatccgcggaggacgctaacgccggtgccggcggcgagcagcagcagtcagcgccgaaggaggaggagcccaagcagcagcagaggtcgcgtcggcaagcgtcggccaaggcggcccacagcagcgccgagcaggagccagcggccaaggcggagcctaggcagccgacgccgcagaggcagcagccgccgcgtcaggcgtcgatgagggacaaaggcaaggcgccaatggtgcaggagccccccgcggtggcgccgcacgtcacgcagagggcggccgccgcggtggaggcggtggccctaccgcccgtgccgctcgtcgcgacccagctcacccgcagggagaaggagaggactgatncgcgatgaccggcaccagg

SEQ ID NO: 15644 - DNA, 762 bp, Triticum aestivum
  unsure (1)..(762): unsure at all n locations
  Clone ID: PAT_TA_15644
acgcgcgatgggggaggtgttccctgcctaccggggctgaacataatcgtgccagcttaaccactttccttcgtctgcttgattggacaaggacatccgacactacgaggcctcaattacttcggactcccctacatgacggatcaactggggctttatgacggagctgccatgcacgaccacgattgtcgcctctcagtcaccctactgagtactaccatggcctgtccattctgtgcactgctaaccaccatgctcatttccatgaagggctttctccttctatgatgagaaaaccgcctagagatactgtggttcatgtgacgataaggttcgccgcatcgtcaaacttgtcccatcttgaccaagcctttagaaccaaaaaacttgtacggtccactttatacgccccaaaacccttaatcgttgttggatgacgaggaaacaaccttgtctcatgggaacaactcgcgtactcagggtttatccttatgccccttacccaactttgcaacatgtgtttcaatacgccaccatagacatttcgttccacatatgggcgttatgattgtgcaaccttgaataagagctcaactcttcgtcaacaaccgatatatatagttgtgggtgctcactaaatgtccttttagacgccatctcccacacgccgataatagtaacgcgcgggggcgtcattttgtgaaaaccttgtgntacaaatctgttaagtctattagtagagtgtggcgtgagccctttctt

SEQ ID NO: 15645 - DNA, 496 bp, Triticum aestivum
  Clone ID: PAT_TA_15645
ctgccacgtcgcgtccggccaggcctggacgcacaacggccgcgccgccggggtgctctacgtcaccaccaccggcgccgacaccgccgccgcgccgctgcacccgagccgctgggcgcgcatcgagcggctcgtcaacgccgtggtggacgcgcgcgagaacctgtcgggcgagcggcgctgggtgtgcatgtcggcgcccgtgcggggccgcgtccacacggagcgccggatgcaccagctcatgcacgacgaccgcgactatgagtcgggccccgccccgacgcccgtcgacgaggagcacttctgcatgggcgaccgggcggccaccgcggcccggtccgcgcaccgcacccagacgcgcgtcaccatcgacaactgggaggagcggggctacgccatcgtcaagatgacgagcagggaccgccccaagctgctcttcgacaccgtctgcgcgctcaccgacatgcactacgtcgtcttccatgccaccgtc

SEQ ID NO: 15646 - DNA, 616 bp, Triticum aestivum
  Clone ID: PAT_TA_15646
gagcgacgacaccggcgacatctccggcggcgggcgacgcgaggcgatggcgggccgccgctcccgctccccctcgctctcctcctccccgtcctcccgctccctctcctccttctcctcggtctcctccccgtcccgcagccgctcccctcccgaccgcggccgccgcagctcgtccgccgcgcggaggggccgctcgccgccgccgccgcgagagggggccaagggaggccggtcgacctctccttcgccgccgcccaagaaaccctcgcctccccctccggcaccgaggaagccctcccctgctccggtccccgacgagtcgtcgctcgtcctcctcgtcagccgcctctcccgcaatgtcaccgagggccatctcagggagatcttcgagaactatggcgaagtcgtcaatgtggagctgtccatggataaggcggtcaatctgcctcgtgggtacggatacgttgagttcaagatgagagctgatgccgagaaggcgcttctttacatggatggtgctcaaattgatgggaatgttgttaaagtgaaattcgcacctgcaccgggccaaaaagctgctgttctttgccgaaggctcttccccatcccccca

SEQ ID NO: 15647 - DNA, 1490 bp, Triticum aestivum
  Clone ID: PAT_TA_15647
gcgttcgacttcctcttccccctagcctgcttccgccgctacctgctcctcctcctccgctccgttctcccctccgccgtcgccggtacacgcccaagccaggacttgttttcggaagaatatgtcttgctttggatgctgtggcgacgaagatactcaaagagcaccagacaacaggaatcagtgcccaggaagccatccagcaaggaatgatgcatatcgcactgccgatccaactcccaaaggtcctcaacctgtgaaagtgcaacccattgcagttcccaccattcctatggatgaaattagggaggttactaagggttttggtgatgaagctttgattggtgagggttcctttggcagagtatattttggtactctaagaaatggtagaggtgcagcattcaaaaagctggattccagtaagcagccagaccaagaattgctggcacaggtatctatggtgtcaaggcttaagcatgaaaatgttgttgagttgcttggttactgtcttgatgggaacacccgtgtccttgcttatgagtttgccactatgggctctcttcatgatatgcttcatggaaggaaaggtgttaaaggggctcagccaggtccagtcttatcatggatacaacgggtgaagatagctgttggtgcagctaaaggcctagagtatcttcatgagaaagcacagcctcacgtcatacacagggacatcaagtccagcaacgttcttctctttgatgatgatgtagctaaaatcgctgactttgatttgtcaaaccaagctcctgacatggctgcccggcttcactcaactagggttctgggaacatttggataccatgcacctgagtatgcaatgactggccaacttagctctaagagcgatgtgtacagtttcggagttgttctgctggagctattgactgggaggaaacctgtcgaccatacattaccgagggggcagcagagccttgtcacatgggccaccccagagactgggggaggataaggttaggcaatgtgttgactctagacttggaggggactatcctcctaaggctgttgcaaagtttgcagccgtcgcggcattgtgcgtccaatatgaagccgacttccggccaaacatgagcatcgtcgtcaaggcgctgcagggcctgctgaatgcgcgagcagcccaccccggggctgagcatgccggacgctaagcaccactccggccttttgtatgatatagataaggaaaaatgagccatcaattgttgttcttgcggggcgcgtggcaggcggtttttgtacatttgtgattattcttcccaagttgtaaccctcgagattctagtaccagaaatatttgattctttgtatcggttgcaaggtcagcaagtatctagtacctagaacacttgtcatcggacagagagaaaaaggaagataataaacactgctgcgtgagcttatgccatctgcttccaagtccagattcc

SEQ ID NO: 15648 - DNA, 905 bp, Triticum aestivum
  unsure (1)..(905): unsure at all n locations
  Clone ID: PAT_TA_15648
cgtccggctactcccctcccccttccccgccccctcccttcttgcctgctcctccgctccctgctcctcctcctcccctccgccgtcgccgggacacgcccaagccaggacttgttctcggaagaatatgtcttgctttggatgctgtggtgatgaagatactcaaagagcaccagacaacaggaatcaatacccaggaagccatccagcaaggaatgatgcatatcgcactgccgatccaactcccaaaggtcctcaacctgtgaaagtgcaacccattgcagttcccaccattcctatggatgaaattagggaggttacaaagggttttggtgatgaggctttgattggtgagggttcctttggcagagtatattttggtactctaagaaatggtagaggtgcagcaatcaaaaagctggactccagtaagcagccagaccaagaattgctggcacaggtatctatggtgtcaaggcttaagcatgaaaatgttgttgagttgcttggttactgtcttgatgggaacacccgtgtccttgcttatgagtttgccactatgggctctcttcatgatatgcttcatgaaaggaaaggtgttaaaggggctcagccaggtcccggtcttatcatggataccaacgggtgaagaatagctgtnntggtgccgcgaaaggcnnctagagtatcttcatgaagaaagcacagncctcacgtcatatacagggacaatcaagtccanngcaacgttcttctcttttgatgaatgatgtnagctaaaatagnctgactttcgattttgtcaaacccaagctttcctgacatggcagccccggctttcactcaacttagggnttcctgggaaacattttggatacccattgcacctgagtatgccgatgact

SEQ ID NO: 15649 - DNA, 2794 bp, Triticum aestivum
  Clone ID: PAT_TA_15649
cgccacccgcgctactcccctgtcccttcttgcctgcttccgccgctacctgctgcacctcatcgggcaccaccgctccgtcgtccccccctccgccgtcgccgggacacgtccaagctacgacttgttcgcggaagaatatggcttgctctgggtgctggagtccttaagacagtcgatgcgggctggactccacgaatcaatacgcggggaagccatcccgcgaggtcatgatgaatctcgcgatcccggtcctgatcgccgaggtcctcgacctgacttagggcatcccgtggtcgaggcccacattcctctcgatgcaagaggagtggatgctgaagggattgcccgttcacgctttaggcgttgcagcgtgccgttgcaccggcgaatggtcgggcagctctgaagaagcggtcgatggcagggcgcacaatgccatgggattcaaggtgagaagtaatggcggtggatgggtaggaacgttttgtatgttcgtccgcgttaagcaggcgaaattttgttaccgtaacaagctttactgtggtggcgatgaagaaccaggtctttggatagaagccagtcctacaagtccttccgcaggtttctatgaatgtattgttaaaacataaaaaggttgtttgaggtactggtgtagtgtagtaacacgagctccggtgtcattgctcatgagtttgacgacatccggcgctcctctgtaaaggcgcttgtttaaatgacaatggatagacaggaccagccgaaagcggtgcttatcgtgcatacaaccgctctaaaaggagatgggctcatgtcgccacaagccactcgagtatcttcatggcgaaagcacagtcctcacgtcatacacagggacaatcaagtccatggcaacgttcttctcctttgatgattgctgtaagagaaaatagcccgattttcgattttgtcttatccaaagatgcactgacatggcagacccggccttcactcaactgagggagttgtggaaattagtttggatagccatcgcacctgagtatgcaaatgactggtcaacttagctctaagagcgatgtgtacagttttggagttgttcttctgggagctattgactgggaggaaacttgtcgaccatacattaccgagggggcagcagagccttgtcacatgggccaccccaagactgagtgaagataaggttaggcaatgtgttgactcaagacttggaggggactatcctcctaaggctgttgcaaagtttgcagccgtcgcggcattgtgcgtccaatacgaagccgacttccggccaaacatgagcatcgtcgtcaaggcgctccagcccctgctgaatgcgcgagcagcccaccccggggctgagcatgccggacgctaagctccactccggccttttgtatgatatagataaggaaaaatgagccatcaattgttgttcttgcggggcgcgtggcaggcggtttttgtacatttgtgattattcttcccaagttgtaaccctcgagattctagtaccagaaatatttgattctttgtatcggttgcaaggtcagtttgccatgagttccctccggtctctatccagcaactcataacaattgccatggatcgcaagaacagggagaaagagatggcatccgttctcctatcctcattaagcatggagctattctccagtgaagacatcgtcaagggattcataatgcttcttgaatctgcagaagatactgcactggacatattggatgcctcagatgagctgggactgttcctagcgagggcagtgatcgatgatgtgcttgcgcctctgaacttagatgagattggcagcatccttccaccaagctgcagtggggctgaaacattgaacatggcgcgctcgcttgcctccgcccgccactcaggagagaggctactgagatgctggggcggcgggacaggatgggccgtggaggacgccaaggacaagataacaaagctcctggaggagtacgagagtggaggcgatgtaggagaagcatgcaagtgcatccgtgagatgggcatgcctttcttcaatcacgaggtggtcaagaaggcgctggtcatggcaatggagaagaagaaagagtgcatgcttgctctgctgcacgagtgctttggcgaagggatcataaccatcaaccagatgaccaaggggttctcgagggtcagggacgggcttgacgatctggctctcgacatacctgatgccagggagaagttcctctcctacgtggagtatgggaagaagaacggatggctcgtaccctctttcggcgttgctgcttcgacttgaaccgatgaccgagcgagcagaaagcatcaagctggatcgcgaagacgcaggctgccatagtgtggtgcagcccacctagtttgcgtttgcgtttgcgtttgcgtttctgatgcacgtccctggacttgcgtcgtaggtaggtcaacgagcccctcttgcttgtggtggtggctcatgtctagatctttgcatctctggacataccctttgctgttcttgccgtgttccgttcaacatcttcatagacatttttcttgttacatcaagtagaacagaggagaaaaaataacttcatgtaaaagtttttactatgcctctgtctcccctgcgtttcaaacttctcatagacatttcacatcaagtagaagaaaataccttataaagtatttactacctagaacacttgccatcacacagagaaaaaggaagataataaacactgatgcgtgagcttatgcc

SEQ ID NO: 15650 - DNA, 1971 bp, Triticum aestivum
  Clone ID: PAT_TA_15650
cctccgcggacgcgtgggtgattctccaaggggaatggttgagtctgctttggaatttgctagagggatacataatttggacttccataacgttgccgtatgcgcaacacaaaaactgaatatgtctattgtccttccagtggacgaacgctcttcgacctcctagaaatcaggacgcagattacctagaagccctctcatctgcctggtgtctctattgctattatgggtggcattgttaatgggccaggagggatggctgatgccgactttgtagacgttggagatccccctagcaatatcgaaccttatgttggaaagacctttgcgcagcagggaactgcaatggatggggacactgaagccttaattcaagctaatcaaggaccatggccgttgggtggatcctcctacagacgagtaggctcatgctgtttccggtagttcatgtgtagcccgtaaacgatccgctagcggaaaatacagtgtatccacagaggtcatccccgcacatattatatgttagttgggaaataaaatagtaacaatgtcggctgcgatttgctgcaaagcttatagttggcatgcctttcaaggatttggcaactgtagattctattcttttgagagaactcccccctgtagaagatgctgaagcaagacttgcactcaaaagattagttgacattagcatgggcgtgttgactcccttatcagagcaattgacaaagccactcccacatgcaattgtgcttgtcacccttgatgaactatcaagtgatgcaaacaagcttttgccagaaggcactagatttgctgtcactcttcgtggagatgaatcatatgagcagctagatgttcttaagagtgttgataatataacgatgttgttacataacattccatatggtgaagagaagactggtagagtacatgctgctaggaggctgtttgagtacttagagaccaatggtttgaacttccctgtgatccatcacattgatttccctaaaagcatcgatagagatggtcttgttattggtgctgggagcaatgttggtgctcttctagttgatggtctgggtgatggtgtacttcttgaagctgctaaccaggagtttgaattcttgagggatacatccttcaacttgctacagggttgccggatgcgcaacacaaaaactgaatatgtctcttgtccttcttgtgggcgaacgctcttcgacctccaagaaatcagtgctcagattagagagaagacctctcatctgcctggcgtctctattgctattatgggttgcattgttaatgggccaggcgagatggctgatgccgactttggatacgttggaggtgcccctggaaagatcgacctttatgttgggaagactgttgtgcaacggggaattgcaatggagggtgccactgaagccttgattcagcttatcaaggaccatggccgttgggtggatcctcctactgaggagtaggctctggctgtttccggtagttcatgtgtagcccgtaaacgatccgctagcggaaaattcagtgtatcaacagaccagaggatatcccagcacatattatatcagttgggaaataaaatagaaacaatgtcggctgcaattctgcgacatcctgatgaagcataagcagcatagaagcttcttgaaatcacatcacggtatatcctaagcatgtaggagtacatttgtaaatgacatgcagaaaatcaaagtagtttacctgtatctagaactagatgataccccgcgcgttgctgctacagtgtattcacaaaggacatcccaacacatgttgtatatcaattgggaaacaaagtagaaacagggctgggcacgattctgcgacatcttgataagcataagcagcttagaagcttcttaaatcatgtcgctatacatcttaaagaaggttatgctattatgcaagtccataaaaaaaaaa

SEQ ID NO: 15651 - DNA, 543 bp, Triticum aestivum
  Clone ID: PAT_TA_15651
ctacagggccaggctgaggctcacaaaccaggacaagaacaaatacaatacccccaagtaccgttttgttgtgcgatttaccaacaaggatgtcactgcacaaattgtgtatgctaccattgctggtgatattgtgatggccgctgcctactcccatgagttgcctcgctatggtcttgaagttggcctcaccaactatgctgcatcctactgcactggtctgcttttggctcgtcgtgtgctcaacaaccgggaacttgatggaagagattgaaggcaatggtggaggccccttgggggaggaacttttttggttgagccctttttgaatgaggagggaagggccttttaccgtggccgcctttttggaatgtttgggccctttatttaggcgatcccatcctacttgtggaaatctcggtggttggtttttggtgtgccccctttataagggggagccttcttgggtaattgggttgggccctcttaggacaattatcactcctcaaccaggtgtggatcccaacgaagagatgtcttgcg

SEQ ID NO: 15652 - DNA, 575 bp, Triticum aestivum
  unsure (1)..(575): unsure at all n locations
  Clone ID: PAT_TA_15652
gcccccaaaatctggtgctgcatcgcgcgtccacagctccccccctcatgcgcccacgagaaccacattctcacccctacctctgctccacatgcttcctcgatcacctattcatgccatccattagcgaagatctacagtcttgcttcacgccgcttctctgagtaccgaattgtggcttgttgtcggggtgccttttctaacttacacatcttgggtagagatagccgaagcaaccacccgcaccttggcgacataagtcttgacactctagcatccaagataatctctggcgacttaatttggtggtgcggaagagggatagagaaaaggtaacttctcatacaaagaaagatgcagatatttgcgaggtatattgtgtttatatttgctaactagataatttagagttttttctagatgtataattagtaaacttaacttgcctataggctatatatatggagaaattgggatgatctttagtatgacgatgagtgctctacaagatctggtaattntattcctttccactttagctngcttgttcttgttaacactngcctaatctagtn

SEQ ID NO: 15653 - DNA, 580 bp, Triticum aestivum
  unsure (1)..(580): unsure at all n locations
  Clone ID: PAT_TA_15653
gcgcggcgcctcgtccccttccacctccggccgcccggcgcgcgcccgctcgccgccgttgcggcggctccccacagccgcaagcgcgatgccgtctcgtgcaaatccaccggcaagaccagggcgaagaacaaggccaaggacaccaccatgtggcggccgcagcggcgggagctggaggagcacctcaagcggcgcacccgctccgccggcgccttcgaccccggcctctaccgccgccactcccactcccaccacgtccccgtcttgctcggggaggtcctcgccgcgttccgccgcccgctcccgctccgctccttcgtcgactgcaccctcggtgccgccggccactccctcgccatgatggaggcgcacccggagatggagctgcacgttggcatggacgtcgacccctctgcgctggcgattggccagcgccacatcgaggctttccttgttagtagggcaactggngaagggggagaagatgctctgcaagggacactacgcgcctatactcacgtcaagaatttcaagtacatcaagcatgttgttggtggcgttgacgagagcctggcag

SEQ ID NO: 15654 - DNA, 568 bp, Triticum aestivum
  unsure (1)..(568): unsure at all n locations
  Clone ID: PAT_TA_15654
gcggggccaaccgaaaaacaagattcccaagaagaagcggcgaccgatcggctgaagatgccgtgtccgcggccggcggtcctgctctccgcggccgcgtggctgtggctgttcctgtcggccgccggcgcgctggcggacggcggcaacggcacggtgtgcctgtgcacgggcccgcagtgcgtgccgccctgccccgtccctgggacgacgccgccgacgacgtcgcccacgcagttccccttctgcccgcagcggccgccggcggtggggcccttcccgtgggagcagcagccgccggcgtcgccgaggtcggtgtcggggttcccccaggacgcgggcttcctcgcggcagctgcggcgagccccactaggaatccggcggcgtggctggcggtggccgccgtgtgctctgctttgctgctgctcctgcagcagtgaccctctctggctcgccccctcctgtagatcagtagattgagttcaggctgcaaggtggtcaaaagatgctgaacttataaaaatattaatctangncttaanttaantcaaaaaagtaggcaagggn

SEQ ID NO: 15655 - DNA, 586 bp, Triticum aestivum
  Clone ID: PAT_TA_15655
aagccaagcaagctgcgggcaattcatatacaccatgaggacctttatcattcttgccctccttgctatcgtagggagcaccgtcacaactgcacctagagggccagtgccacaatagcatccactaaatccatctcacgctacaggcacaagagcaagttgcattggtacaacaacaacaatttttagggcagttacaaacatttccaccacaacaaccatatccacagcctgagccatttccataacaacaaccatatctgtaactgcaacgatcttcacagtcgtagctaccatattcgcaaccacagccattgcgaccacgacatccatatacacaaccgctacctcttgattggtaacgccaacaacaaattttacatgaccagcttgaacaacaacaacatcatctgcttcaacaacatgaacaactatgtcttaaagaaattttgtaacaacatctgattccatgcatggatgttggattgcagcatcgcatcatatcgcatggaggatcacaggatatgcatcagagtactcagcagctgctgcatgaattgtgttgtcaccacctatggcagatgcc

SEQ ID NO: 15656 - DNA, 490 bp, Triticum aestivum
  unsure (1)..(490): unsure at all n locations
  Clone ID: PAT_TA_15656
gagggnnnnttttttttnnttttttttttttttttttttttttttttttttttttttttgggcctccaaaaatttttcttcagcagttgttttttcggggccaccttttccaacacaaaagcttttcttattttggactttactttcccttaaaaaaaaaaaaaaatttggactttacccatgccattaaaagcttttttttacatgacccattttttttttgcaaattgggaggttacttgtttaaaagctcggtccagggaaacaaaagtttaaaaacatttttttttcttccattaaccttgggtggaggggttttcggcgggggttgtttccgcctcctttttttttaggtttttaaacttgtcgatggcgacctggagcttattagtgctgccaaccgctttcatggtgttgttgtacaccccaaagacgaacccttttagcccaccgcccaccaccaggttttttgtttttggcccaaggtttc

SEQ ID NO: 15657 - DNA, 601 bp, Triticum aestivum
  unsure (1)..(601): unsure at all n locations
  Clone ID: PAT_TA_15657
ccgcacgagagaggggggagtgacggcgagatgcttcggagcggccgaccggcagtggccacggcggcggcgctgctcctctcgccggcgcctcgcctccaccgccggttcctctccctcaccgccaccccctacccgctctactacgacctcctcgtccaccgccccgtcaaaccccccaaatccaccccttccgacgccgacgccgccgtcccccgccccccgccagcagaacccggagggcgccgacgagaagcagcagcccgctctcgaccgcgcgcagcggaagtacctccggaagcgccgcagccggcagctcccggacccggacgccacgacgggcaccaagccgacgaccacgtcggagatggtggagctgcggccggaggtggtggacttcccgcggctgcacgcgcgcgaggaggcgctctacttccacgacgccttcgccatgccctgggagaaggacaagcactaccgcatgctctaccgcctcgagaagaagtacttcccgggagcagtccctcgacaacgccttcgtcgccgcngacgccgccgccccggcccagccgccctccgacgccgncnnnnnacttgtntn

SEQ ID NO: 15658 - DNA, 781 bp, Triticum aestivum
  Clone ID: PAT_TA_15658
ctacgccttccttcctcggcgccctttccttcaccgctaatgcaccgccactcctccgcccaagaggcgcaggcgatgggcagcaacggaggcggcgccaagccgccggcgtgggagttccacaccacggggcctcgcaacctctccagccccggccgctctgcctggaaaaatcccaactacagaagaattgcaatttcatgtttagtgcaggcagcgtacgtattggagtttgacaggcaagagaacagaactggtgaaactgccattgctcctaactggtggaagccatttaaatacaagctggtgcgccttctaattgattccagagacggatccatatatggggcacttctagaatgggaccaggttgctgcactatcagactggataatgcggagacctgttggtgctccaaaggctgtcctggcactgaggggaactgtcctgaagcagtcaactgttgcgagagacttggaggatgacctcaggtactttgctcaagagagcttgaggggttctgtcaggttcgctggagcactggaggtgctcaagtcggcaatcgataagcatggaagcaacaatgtgtgcgtgctgggcattccctaggggccggatatgcattgcaggctgggcaggctgtgccctaggctcgagtcctcgcagtaccccggctggtttccccaccatcggtgtcactcggcctctgcctgaggaagcttcaggataaagtcgacaaggtcttgaagcgatacatcagcggcagctcttcaaatgccgt

SEQ ID NO: 15659 - DNA, 507 bp, Triticum aestivum
  Clone ID: PAT_TA_15659
gagagagagagagagagagagagagagagagagagagagagagagagagagagagagagagagagagagagagagagagagagagagagagagagacagagagattgagatggtgctgtcggccgccggcgcgctggccgaccgcagaaacggcacggtgtgcctgttcgacggcccagaatgcgtgccgtcctgccccgtccctgggacgacgtcgcccgcgacgtgggccacgctgtgcgccttgtgaccagagcggccgtacgcgacggtgcccttcccgggggagcagcagccggcgccgtctacgtagtggggtgcggggttcccacaggacacctgcttactctcggcatgtgcgcccaagcccgcttagtaattctgcggcatggctgggcgggggcccgccgtgtgctctgcttttagtgcttggtagtgcatcattggtggcttttctggcttaggcaccgtcttgttaaaatcagcagagttgagctcaagtctgcg

SEQ ID NO: 15660 - DNA, 756 bp, Triticum aestivum
  unsure (1)..(756): unsure at all n locations
  Clone ID: PAT_TA_15660
gggacagggggagagagagagagagagatagagagagatagagagagagaggctcggtgaagccccaaaaccctgctcttcccctctggcgcgagaggccgcccccaatcccctccccactcccaagtgcccgccagtctcctccattcccctccccacctttcccaaatgtgaacccccagatcctcgggcgcctccccatcaatctcgaatgcatggaggccgcgcaagaagatgctgtgggtggacaatccccgctcgaaaaccctacacaagggaatggggcatgagcaccgggcgcgagaacctcaataaaattcgtaggcggagcaagaacaggcctcaccctggcttttttatgaggcccacccggcggtcccggcacagaaaaacctctctatccatgggggccggcattcaaagcaacaatgtttcgggcggccccgggtagtggtacgaaatcggtggaaattatggggagcaaaataaaggaacgtcgtgaaagaattcgtcataccgtggggtgaccgaaaagaaccaatgttntgagtatctgttggaacgcttaggcgcggatgggtttggaatccagagtttgctccgcacacccatcgctgtggtagtgaatttgaaaaccccccccacgcgcatatatgtccttgggtgttgttttctaagacgaacgacagggccaatatggtcttcgcgttcaaaacggaatcgggtcctttttgtcataccacagaagcgaatcgt

SEQ ID NO: 15661 - DNA, 333 bp, Triticum aestivum
  Clone ID: PAT_TA_15661
ctctctcttcctctcaagtctaaccaaagcccaacaaaccaccacctcggccatggcaaccaccctcgcacgacgtccgcttcatgcacaaccgttgctcgctgctcaattatcactattgtgcaatgcgcttcgctcttatcactacttgcgtcgcgcaggcatcgacatgtgccctgacgcagcaggatcccctgcacaggtcgtggtcccactctcatgggcgggtgcttgcagggttgggacctgtgtctaagctcttcagaatgaggtgaagtcaagccggaccaatcgggcttcaaactagccgtgaagtactactaagtgaattaa

SEQ ID NO: 15662 - DNA, 494 bp, Triticum aestivum
  unsure (1)..(494): unsure at all n locations
  Clone ID: PAT_TA_15662
ccgcgcgggacggcgtcgaccgcatcagccgcctccccgtcgggatcctccgcaacatcgtctcccgcctccccgccaaggacgccgcgcgcaccaccgcgctggccaagcgctggcgccgcgtctggcactcggtgccgctcgtcctcgtcgacgcgcacctcctctccgaccgcagcgtcgtggggcgcggccgcgggtccacccagttccgcgagatgggcctcgagtcctggtacgccggcctgtttcgcatcctggacgccatgggctccctcgcagacaacgtgtcccacgtnctcgccgcgcacccgggccccttcgccttcgtctacctcgccggcaacaacatgttgtatcacccggacaagttggagctctggctcaaactcctcgccgccaagggcgtcaaagaactcgtctttgtgaacctcgcatccaagttcgacgacgagctgcccatacccgccgagctcttcaagtgcaccgccctc

SEQ ID NO: 15663 - DNA, 574 bp, Triticum aestivum
  Clone ID: PAT_TA_15663
cttgaaagaacacacctatatgagttctgactgtaaacgtcgcagtctatgagatttgggtgatctctagtaagctcacgaagagaccagggagtatgacgtataagctccaaaccgcggggtagcctactggcggtcaggtactggttaagactttgagtgaaacctgttcacacaaaactagcaattcaaggcatagtccattgtcaagttgtgaatggatgtagcttaaagttctaggcagaagttcaacttaacagtctctgctgcaacactggtatattaaacaagtggtgagagaaggcaaatctctaaatgggtatttgagatctggtgggggattggtagaattaatgggctaggcccatagcaatttctgaaatctcaaagcccatgtgtaaaatggcaagtggtggtgctaagtttaatcccaccttggaagttgaagaagagttggacctttttatatagtgggttctctccaccactctaagtggtgtgtgagaagagaaagggaaaaccacacgcgcgcgctcgctcgcctcgcctggcctggcttggccgggccgggccg

SEQ ID NO: 15664 - DNA, 488 bp, Triticum aestivum
  Clone ID: PAT_TA_15664
gtcgtaccccgtcccatattccctttacccgttctcgcctcgtcgccggctatggcggatcccggcgtcggagcggacgctcctcgcctgtctctgctgctgctgctcgcagtagtcttcgcgggcccctctcgcgacataccgaccgatgcatgccgtgctgacgcgcacgtacacggtgaaggtgaagactagctgcgcgctcccggcgcggatcgtcgactcagacagcgaggcgttcggggacgcgtaccggaacgaggcctacggggcgcgcctccctagcgcgcaggtcggcagggccttcgagcggtgcggcaccgactccttgcgcgtttacggagtgtgcggctactgcgtgtgctacctatacctccgccgttccatacgtgacggatggacgcaccagtgggtccagaacaccgagtcgtgccccgccactggagagatgtctgacatttatatttccgagcaccccttgcggacgc

SEQ ID NO: 15665 - DNA, 575 bp, Triticum aestivum
  unsure (1)..(575): unsure at all n locations
  Clone ID: PAT_TA_15665
gtacactaaaacgtacagttgatcgagaaaaccaatggagaacatctgggactggatctgaagaatcatcctcaacaaacatgtctaagaaagaagctcaaactgatcatgggaagcttgaaaggtctacaaaataccgtgagatttccatctacacgtgcaatctgtaaactcctgattaagggttaattctgattttaaccatggttttttgtcaaaatgaccaatctgtaagtgggtctggaactgtggggttacgttctccaaaagcttttaaggtttaccaagcaggtcctaatcacagttctaagcctccacaacaattctcttaatcacaaaatatgtatatcagtggaacagtggttaggattcaatctgaagacgcagacacaccacgatcttcaaggtcaaggtgtgggactctagaaaaaacatcaaaggctacattggaggatagcgctactaaccttgcggaggcaagcgctgctatacaagctgggttcaaaaagggatatgctcgagaaagaccagcccccaacaaacatgaagaggaatcacgtgaacctagattttgn

SEQ ID NO: 15666 - DNA, 702 bp, Triticum aestivum
  Clone ID: PAT_TA_15666
agagacaggtacacagatctgtgaatggactctgtatctcgcgagcagcatctgcagtaccaatggcgtccccgctacccttccatatcctgcgcttcggcgatctcctggaggagacggcgccgacctgccgccgccacgcgccgctcgatgcgtgcgcttcggggcagatcacctacatggcgcccagctgccgagagcacacagcctctcttacagactttggtggtgtgggcgacaggtacacctccaacactggggcgttccgcaaagcgggggatcccctgttccagaattcccgccaaggccgctgggacggacttcctttaacttcccctccccatccgttggatttacacccgggccccctttaaaccaatcaacgatctcactttcaactgctttttttggtgaacacagcgcgatccatcccgaatgattctcggtagggagaacggcaaagggaaacctatcccgccttcgcgtgagggcaccgcgaatcacattatcgacaccccgcgactaggctcgctatcctgaacagggtcctcgctgtgcccatggtgaaaccctactcccaccgcgtttcggcgcaggcggaactcgctagagcgacctcgtatcgccatcgggaatttcacaaacataatcgcatccgccatctggtggtgtggaattctgcattggcgggagaccataacc

SEQ ID NO: 15667 - DNA, 576 bp, Triticum aestivum
  unsure (1)..(576): unsure at all n locations
  Clone ID: PAT_TA_15667
gtgcaacaggacacggagccggccgaggaggtgcacccagaggagaactacgtctacctaccccgcactatctaccatctcttggggtttgcataactatttatataggctaaatgccctgtgtaactggatgcttgacaagcttgcaggagctttagatctctaaccatgatctggtgctcacaagatcagggagtgcctgcctatgatcctcatcctgaggaacagactgtaatatgctctcacctaccgtgatgtgcaatctatgcttatgcagngtcatatcatggacgatggagatgtcaccactgtcaagacctaccctgctgggatgatggaccatgatatgaatccccaatactgctgagaactacaggctattttatgacaccaacggtcgattccatcttcactctgttatggatgaggatgctaagatcaagctctgcaatgtcaggtatacacagttcggtcagtaaggcatcccctatctgaacacctatgatggccggaccatcctgtaaccaaaccacgtcataatgtcaatgacgccattagctcgacctgatgacaata

SEQ ID NO: 15668 - DNA, 497 bp, Triticum aestivum
  Clone ID: PAT_TA_15668
gagagagagagagagagagagagagagagagagagagagagagagagagagagagagagagagagagagagagagatatagagagtgaccgacagggctctcttgtatgttgcctgtattgatgcctgagatgctgctggggtatgctagactgatgctgctgctggtaagaatgggtgccacaaacgcgcggagatgaacggcacgatgtgcgtgatgaggtgccgtggtccatagtgtgaggagtcatgaacgggctgaagcaggtctagatgtgcgttgagacctactggattgatatctcactgtgctgcggcgtatgcacactaccttatgaatattgtgtaatgtgtggtcctaatgaaatagttcataacgtcatccaggaaaagctagagcgacagtcgtgtctgcttctcgaggacatctagctgacaaccatcgtctcctgggagatgcagagctacgtacgtcttctgatcctcggcgagttggac

SEQ ID NO: 15669 - DNA, 1900 bp, Triticum aestivum
  Clone ID: PAT_TA_15669
gcgtcccccgccgcttcccccgcgcctaccgcgcccccgcccggattccagtcgctgacaagacagagttgccttggaactttgagctcttcaagatgcctagacggacagaagacgctgaaccagccctcccaaaggaatgcttggagtttgatgataatgaagaggaggaggtagaagaggaagaaattgagcatgtaggtccggggcgggtgctaggcgcccagggggaggaggccgcaacagctgcagtggcagccgacgacgccggggttgagggcggccctgtagggtggggcgtccgtgctggcgccggcgcttggcgtgacaggcacaggaaatcggaagctgttcctcttcctcagcaggatggtcccagagatgggagcgataaagagaagcatgccgaacttcttgctcttcctcctcatggatctgaagtatattttgggggcatctccagcgatgcatcttctgacgatctcaagaaactatgtgagccagttggcgaagttgtggaagttagaataatgctgagcaagaaggatagtaggggatatgcttttgttactttcagaactaatgacctggctttgaaggccatcgagaaattgaacaaggcaactttcaagggaaagaagctaagagtttcttcgtcccaggctaagaacaagctatttgttggaaatatacctcacagttggtcatttgatgattttaaaaaagcagtggaagaagttggtcctggagtattaaaagttgatctgattaaggatccacgtacagatcgcaatcggggttatggtttcgttgaatactataataatgcatgcgctgagtattcaaggcagaagatgactgcaccaaatttcaaattagatacaaatgctcctactgtcagctgggcagatcctaagaatggcgattctgcctctacaggctctacttcacaggtcaaatctgtatatgtcaaaaacctgcccaagaatgttactcaagggcagctgaaaaagctgtttgagcgccatggtgaaatcataaaaattgttctcccccccttcaaaagatggtcatgataataggtatggtttggttcactttaaaagaccgccaacatgggccatgaaggctgtgaagagcacaagagaaatatgagcttgacggtcagcccctggactgctcactcgcaaaacctcctgcggataaaaaagacgatacagtatcattgcctactgccaaagcaggtccgttgctgcatgctccgcttggatatggtatgccacggccagatccttatggtgcgcctcctgcttatagtgcccctcctgcttatggtgcacctcctgcttatggtggacagcctctgctctatgctccaggagctcctccaggtgcagcaatggttccaatgcttctaccggatggccgtcttgtatatgttgtgcaacagcctggagcgcagcaacatttcgcttcccctccgccccaggtgcggcaacatcagcatttcacatctcctccgccacaggcacggcaaattggtcgccatggtggcagcggtggcggtggaggcagtggtggatcaagtaggtccgggtccggtacaaagcgcccaaggggagatgacaacaacagcagcagtcgcaaccgacaacgccggtattgatcgcaggaggtgtatggtggtgcttcggttctagcgccagctaattgtgtaataagtacttgtcgccccggtcggattttcctacaaacctgcttaacccggtgaactgtgaaacccgcatcactattcgttcggaactgtgttaggtcacctcgaggtagttttggtttgtctaggcgtaatttcgtgtactgtgatcaagtttagaaatggcaagaacagcatcggtgtctg

SEQ ID NO: 15670 - DNA, 577 bp, Triticum aestivum
  unsure (1)..(577): unsure at all n locations
  Clone ID: PAT_TA_15670
tccaaattgtatattctcgctgtcgtatggcggcaacaacacctatggcttccatggccatctcaaccatcgttgtcatgctcctttcttctgccatggctgcccacgccagcggtggcggggagaaggacaacacaagcctcgtggtggaggcgtgcaagaacatctcaggcgagccattcaaggtgggcttcctgccagaattctgcgcatcgacgctcctatcagaccaccggagtgccgaggcgaaggactgccgcgaccttgcactcatcaccgtcgacatactcaaggtgcatgcagccgccatggtaggcaaggtggacaacatgcttcgccaaggcgggcgaatcgncacgaaagataaggtagcagctcgtgccctcaggttgtgtcgggcggactatggcggcatggtgaacacactccaaatctgccacaacatcatccaggacttcagccgcaaaggtaagcatgggccgacgccctctgagctaccagagtgcattgagaagacgaaccacaacatcaaggactgcactgccgaggtctgtagcacgtcggtggtggggacgat

SEQ ID NO: 15671 - DNA, 534 bp, Triticum aestivum
  unsure (1)..(534): unsure at all n locations
  Clone ID: PAT_TA_15671
gttgtacaatgccggtcaacattttctgaaagaattagtcagtttagtaagcaatgacaatgatcgttgtgttgctgttatcatcaacttgcagaagtatagctttggaagatttgacagcctgacaaaaacaaaaactgttaaagggttgatcgccaagatccagaatggtcaagattgtttgcatcttgtgcaaaatttgatggcactctttgtggatgaaggttctgttgcagatgaaccatctgatcaaagtcagacaactgatgagaattcagaggttggctcaattgaagataaggaacttgttggcgaagggaacgctgaccttctgaagagttgggtggtgaatacaattccatttggcttgaaaaatctaaagcttacatctaaaggaagttcgctgacagattctgagatgatcaagtgtattgagaaaaattcaggtgcagactgagatctaaaatcttgcatcaagctgtctagctttagactgaggactattgatgagaagtaatgcaagcattatgctgn

SEQ ID NO: 15672 - DNA, 674 bp, Triticum aestivum
  unsure (1)..(674): unsure at all n locations
  Clone ID: PAT_TA_15672
accacctccattttatgcttcttcaagttcagctacacacctagcaccacctcctccaccaccgccaccgccaccgccaccaccaccactggcttcagtatgcttgtcaaacatacctccccctcctcctcctcctcctcctcctatgtcttttggagcacaaacacggcactttgcacctccccctccccccccacctccgcccccagggttaggggtccgtggaagcattccaccaccacctccacctccgccaaggttaaatggcagtgctgttgctccacctgcgcctccacctccaccaccgaaaccaagttcaagtgctccgcccccgcccccacccccaccgncgnctncagttcaatccttcacaacacgtccaggtgctccacctncaccaccaccaccaccttccacatcatattctactgctccgncaccaccaccacctncgatgacccgttcaggagcaccacctnccccgncccctnctnctggtgcacgccctggacctncacctnccccaccatcttcaggagcacctgctgctcctccacctccaccatctactggaggaccgacagctgcttcacctacctctacttctgcaggaagaacaagatctactaccaccccatctacttcagggagaagacgatctccacctcctcatc

SEQ ID NO: 15673 - DNA, 590 bp, Triticum aestivum
  Clone ID: PAT_TA_15673
ggcgatgcccccacgacaggccccttcgcgcggagcgggtcttccccggggccagccttggaggtggggtggccagtggcgtgatcttgttgctggtcgccggagcacggcggagagcgcggtggtgcaaaggaaccgggtcaggaggctgttgcgcggaggaggaggaagaaggcggtgcactggcgctggtgggcggcagcggcgcgagcgctctgccatggaggtggcggcgctgagaggccctgccaggaaggagatcctggcgggcagcaggcggtcggccgtctccatgcggtgggcgtgaggtgatgcccccggaagcgctggcgccggagtagtggatggagatgcggtcaggtccagatccgtttcgatctgggcctgtggggttggttccgtcgcgcggcagtgggaaagaccaccgctttttttctcgcgggacggcgccggggactcgcaatgtggttggaggcacagcggagggcacgacgagggcgttcgccggatcctggcgaggagcgccgctggtaggtggcgacaggtgagcgctagcaacggcggtggcggcggcgtttgatcaaccatgg

SEQ ID NO: 15674 - DNA, 846 bp, Triticum aestivum
  Clone ID: PAT_TA_15674
tgcgtccggacttcttcgaaccggtccgcgggacgagggtctccaactccacgtacgacagtgacggcgtgtccggggcgggggcggcggcggctcccgcgtacgatgtgttcacgagcagcaaccgctcggctccgccttcctatgacgacttcctagggggcttcggcgggaagccgcaagcggaggagataaagaggtcggtggtggtcgaggacgacgacgacctgctgggagggttcggaatgaagccggccagggagaagaagtcggtggtggaggaggaccagcagggcaacgggttcgatgatctgatcccaggtttcgccagtagcagccctccaaagagtaggaacactaatgacgataacaaaaagaagccagcagttccagcttcaaaatcaacagccagcttcgtagacgatccatttgttgtcctagaaagagtttctgttccaggttccgcatatccatccccggggagattcacagatcccttggaagatcttgataagtctgcaaacgctgaaggcatgaatgttgatagtgctgctgctgctgatagtttatttgaggattcaagtgcttttgaccaggccccaaaatcagatcctttgtttacctcggaaatgaatggcgacaccaaggatagtcatctacaaagcaaagcccgagagtcaagttctgtacaaagctcggtgaagagaaatccagcaagcagatcttctctggaggacttcggaaatggcatggcgaaaccacaatctgcaaggtactctgatattcatgtcgatgacagttcagagagatacagtggcaattggtatggataatcagtcaccgata

SEQ ID NO: 15675 - DNA, 917 bp, Triticum aestivum
  unsure (1)..(917): unsure at all n locations
  Clone ID: PAT_TA_15675
gtgagagtgagagagagagtgagtgagtgagagagagtgagactgagtgagagagagagcctcatcatttctctccctattcatttcgactcccctttcactccggccttttattctcgttcctttcttcacaccccctactccttctaacaaaattttctctttttctttttagagctctttttacctctgctctctctttctcccgccccttccccttttctctcttctgctcccccccctgcacactaccttcctctttccttctccccaatcccgtcatactctctattgccatttcgtctttctccgaatctctctttctgtttccttgcattcccctgtcttttctccccttttctcccacggattcttgtttctctttgcagtctcttttttttcttctcacttctttgtgcactcttccccagttgcctatttcccctattccctccttttggttcccctctttttcgcattcgtctatgccttctcatctttagtccttcgctgttgtcctcctttttctttcatatcctcctcacttttttatcacctttttctcgggtcgtgccacctcaccccctattcctttatttcaccgacacccatccctttcttctttctcccctcttgtttttgtctctttctccatttctggtctcccccccgcctcattttttctccctctctcttgcatttctctctctttttgttcccctcttctttctcctaaccctctatatactgcgcccccctctttttttagcactgccaccctccctctctcttgtttagcggctccttcttttctcactccttggcgcaatttttctcccctctcccccccaaaaattttttttttaaagggttttttctctccacncctcncccggggctaactttttttctatctt

SEQ ID NO: 15676 - DNA, 1778 bp, Triticum aestivum
  Clone ID: PAT_TA_15676
atttttttgtatttttattgccccaatgcacattgggggacccgagaaggtcaccctaatttatacgggagaggcgcattcgagtctaccagaatagtttcatcattcacacattgtggatggagaaaagatctacttcctaaggatgttccatcctctgtcgatacaatgagagttgcttcacaagacatagtgtatagtgccctggaagatctcctcactcattaagtgcaggtccttttaattactatgcatgcgtccccagagagtgtagttattcgcgtcaggtcctgcatggtgggcttgaacggtttttcccccactttgcacttggctttctcagcaggattcaagtacttccgcgaaatgatatagaacccattcaatatcgcgataatttattttgtggatacatttacgataagcactaagcgaatttcttacgtatcggttgcccctttaaccttaaacaatttatttcgtaccaaaatttcacgcggatgagattagaaaattaacgtaggaaggaagatcaatattgatggcgcttcagtggaattgaaaaataattatttgcaatgtcatttgcacccatggcagtaaagtaaatgccttcagagataacacgtgtggtttcctcctctccgactaaagtttttagcttctccttatattcaagaaataattcaagttgcccagtacttgaagtagcagttgcgggtattgaagttaaggggtcatatccactgcctccagaggcaaatgcgacaccagtaagtaggtcacttagttcaagatcatctccattgtacggtggtaagaactctttgactcctaatttagaagctagcatgtccccaggaaccctgccattggagaacctcccggtggccttcccgccagggaagtcctgcccgtacggcgggaagttggccctcgcctccgtcagccggttgttgttgttgcctggatcgacgatcgagtcgccgaacatgaagacggctgagatcttgctcttacccgtgcctactgctccatcggcgcgcgagagatgcgccatcaccaccagcagcatgctgctcagcagcgcatggccaggcattgtacttgcgtgcgtgcgtgcgtgtacaatgtattagcggtatatgttattgggaaggtcatttgcccccatgactgtgaagtatatgccttcagagataacacgtgtcatctcctcttctccgactaaagttcttagtctctccttatattcaaggaataattcaagttgcccagtactcgatgtagcagtcgcgggtatcgaagttaaaggatcgtatccactgccaccagaagcaaagacaacaccagtgagtagctcacttagtggaagatcatttccatggtagggtggcaatagttccttaattcccaacctagaagctagcatgtctccgggaaccttcccgttggagaacctcccggtggccaccccgccggggaagtcctgcccgtacggcgggaagttggccttcgcctccgtcagccggtcgttgttgttgccgggatcgacgatcgaatcgccgaacacaaacgctgcagagattttgcctctagccgtggttgctccatgggcggatgggagaagcgccatcagcagcagcagcaggcctcggtagagagacgccattgcttggctccgtagtactaataataatgcaggagtagtatcagctagctagctagcggtgtagtgtgtcgctggctctggctctggctgcccagcccgggccggc

SEQ ID NO: 15677 - DNA, 643 bp, Triticum aestivum
  Clone ID: PAT_TA_15677
ggactatcaattgatccccacctctctctcacctacaaagcctacaatacaatgccagctatccttgcagcaatggcaaccgcacggacgaccgctgccttctcctcggctgccatcatgctactatttgaatgcgtaggcgcacatgccggcggtctcggttacaaggtcaaggaagtggacctcgaactagaaacctgcaagaacgcttcgagcacctgccgaaacacgcacctgaacgacacccaagaatactgtttgcagactctgcggtcgcacaaaaggagctccaaagccaaggacctacgcgacctgtccctcgtcgacgtacacatcctgaagatccatgtggcagctgtcggcggcaaggttaacgaagcactgcagacagccaacaaaggtactgacgaagcgctcggccttaagtgttgccaaggtgtactaagatgcccgatatcgagcaccctcaggtcttctgcaaccgccatggcctcaggggaactttccatggatccccagcaggccgatcgcagaacacgtcccgggggtccttttcgaaaccttgacccgacgtgttgaggcaaaaaagcatatattgacccaatgttcaagcggaccggcttggcaatggaatcttaaaccg

SEQ ID NO: 15678 - DNA, 600 bp, Triticum aestivum
  Clone ID: PAT_TA_15678
atcagctctgttctttcaacaccgcaactttgcaagtccactagtactagacacagcaatcacaaatcagtttccactctctcttttggttatatttccgttatgtcgcagtaatggaaaggggtaatgcccggttaaaaaaaaagtttccactctctagcaacgcggcaagaacaagaaggcggcgatggctggtccggcgaaggcgtcctagatggtggcgatgagcgtgggcgctgtggaagcgctcaaggaccaggcagggctctgccgctggaactatgcgctgaggtccattcaccggagcaccaaggccaaggccaatgtccccggcggtgcatcgcaagtcaagaagcagctgcctgcctccgcagcagccgtggcggagaggcggcgagcgcggaaggccgaggaggggctgaggacggtcgtgtacctcagttgctggggcctaaattaggagcactggtagctagggaagcatgcagccatggcccgcgacttggctggctgccccctgatcgattgtaaagataccatgacgacgacgacgacgatgatgatgatgaaaaaattgggctagagtttataatttaaaaa

SEQ ID NO: 15679 - DNA, 681 bp, Triticum aestivum
  Clone ID: PAT_TA_15679
gagttttttttttttttttttgactgtatacaattcctttcgaatcaaatcagctaaatgtcacacacacactttctgcctacagctccaaaactccaagcatccaaataaaacatgacttggggtcacacatggcaagtatacacttcctttcaaatcaaatcagctaaatgtcacacacactttcttcctacagctccaaaactccaagtcatccaactaaactcatgacttatggtcacacatttcaaggactggcttaagcatccagattattggtgttatagcagttctatcatttacacttatcatgggagattcaaaatcgcatgcaaagactgattattatccaccgcgtcgctccgcttccgcgttatggtcagtttgagcagagctctgctcctttgattgcacctccttgtccttcttgtcagcatcttctacctgggaatctgtcatggaatctgataacgagctctcagatgttatggcgcccggaacatgcttcgccatcctctccatggcaagaacctagccagagacagggcattgtacctagagctggctttctttgggcccccacccgccttagtggccggaattttaatttgggggaagccccctttttggaaagagagggaaccccccgacccttccggagtgacctttttaatatttttt

SEQ ID NO: 15680 - DNA, 593 bp, Triticum aestivum
  Clone ID: PAT_TA_15680
tctcgccgggctcatccgaccgtccgccgcgagttacccatcccacgcgagcactgccagccaccactcgagccgagcgcggccgcttccgtcccgcgcccactaccagtaaagacgacggccagtagtccacgcgctgtcgtcctccgccacaagcaaccgcgtgcgaacggaagtcatcgcctcacccgccgcagtccacaaccaccaccaccacccgaagccgcgtgcggggagctggaaacctcgtccagatcggagccagccgcagaccccccgtgaggacgccgtcttcccgcgaccgacccgcacacccacccacccacggggcgccggcgatggcggaggacggcgaggagaagctgctcgcgacggtgcagcacatcgtgcagacgctcgggagcagcgacaccatgaccggagacattcttaaagttcttcttcaactacgacggccgcctgtcgctcgacaagatctacgccgagcgcggcgccgtggtggtcgcggcgggcggcggctggggaggtggaggcggaagggaacgttcgattccgacgtgatttcaatccccaaaacttcctgtgtcttaacg

SEQ ID NO: 15681 - DNA, 540 bp, Triticum aestivum
  Clone ID: PAT_TA_15681
cccaacttcccctcggcggcgaaagtccgtcgcgatcgattcgagccggagaagcggcgtccagcggcggcgcaggttcgtccccatctatcggagccggagaagtgacgagcaggtcgatcccgcctacatgtccggatgcgtcgtccggagggggccactgcccgagttctcctccctcgccgtccgggacaggatcgaggctgaggatggtaaggatgtccactccctcgccgtccagcacggcctgaattctgagccaagggagctctctctcgccgtaaaggtcgggctggaggcgggtgtggacttgggggacgcgtccccggccgaggcggtcttctgcctcgccgtccagaggggtctcaaggccgaggaggtcatccacctcttcgtccggagcgggataaaggcggaggatgccctcgccatcgccttccgtactggcctaaaggccaaaggagagatacatgctcttctgctcgagcagctgctcgcctcatttgataagcgacgccaggacccttggactatatgaat

SEQ ID NO: 15682 - DNA, 415 bp, Triticum aestivum
  unsure (1)..(415): unsure at all n locations
  Clone ID: PAT_TA_15682
gttctgacgaacacgcggaggggacggaggtacgaccggtagaccagccagcccgcagcaccagcatataacctcgctcgccgccgcggtggaccgacagctacagacctgtgctactcctcctctcctcttgctgttcgcgtactgtctctcgcctcgcgtgcggacacccaccagactgttaaaaatatgctgtttggatgctggggtaaatactaagaaccaacaacagaatcaataccagaagctcacaggaatgatgcataccgctgcatcaatccaagtctaactggaagcacccatgantcaccttctagtgaattagaggtacaaggttgggagagttgatgggaggtcttgcaagattttggacttagaaggagaggcacaataaaactgactcatagcagcaacc

SEQ ID NO: 15683 - DNA, 381 bp, Triticum aestivum
  Clone ID: PAT_TA_15683
tctatcttgccctcttgctattggcaccaccgccactgcagtgagttccggcccaatgcctcaaacattacacagccaagacagtcaggacaagacacattaggcagacaaccatttcacacaacagctatcgagcgaccatttcataccaccatattgagtgaccatttcacagcgactatcatatcgagcgaaccattgaccacaccattcacagcgaccacagatcgacccacaccattccacacacacacacacacacacacacacacaatctcacaatttgcacacactgatctgcaggagtgatgcacacacacatcgctgaactacagttgcagaagactacactgtgcacatggtgcacagtggcaatcccac

SEQ ID NO: 15684 - DNA, 596 bp, Triticum aestivum
  Clone ID: PAT_TA_15684
gccagatttgtcaacaggcgaagcatgaattgcataaaccagcgggcaagttggcacccctgcccattccgacagccccgtggcgtgatctgacaatggacttcgttgagggcttgcccaagtccgaagggtatgacacgatcatggtggttgtcgaccacttcaccaagcttgcacactttgtgcccctgcgacacccattcacggcgacacgagtggcaagagtgttctgggacaacatcgtcaagctgcacggcatcccctcctccatcgtctccgaccgcgacaaagtgttcaccagcgtgctttggcgggaactgctagccagcgcgggcaccaagctcctctactccactgcctatcacccccagacggacggacaaagcgagcgcgtgaaccagtgcatggagatgtacttgcgctgcgctgttcacgacactcccacgcaatggtgtcgctggctgccctctgcagaattctggtacaactcctctttccactcttctctgggttgctctccgttcaaggctctgtatgggtggatgccaacgagggcagcatggcaacatggccggcaacacaagcatcattgccgg

SEQ ID NO: 15685 - DNA, 549 bp, Triticum aestivum
  Clone ID: PAT_TA_15685
agcagccgaggcggcagccgtaccgtcaggcggcggacaaggcggctcacggcagcaacggcgagcaggagccggcgcccaaggcggagcctaggacgccacagccgcagaggcagcagccgccgcgccaggagtcgatgaaggagaaaggcaaggcgccaatggtgcaggagcccccggcggtggcgccgcacgtcgcggtggaggccctggcccggctgccgctgccatacgtcgcgacccagctcacccgcagggagaaggaggaggactggttggcgatgaccggcggcaggctgccctaccgccccctgcagcgccgccccaaggccgtcgaggacaagctccagaaactgttcccggggcagacgctgcctgaggtgaccagggcccggtacatggtgcgccagaagaagcaaaagaagcgccccggcctgcgagcaatggcggaggaggacgccctaagctccaagaggcgcgactccgacgatgacgccgccggagaaaaaaaccattttgccgttaccgttgcggaggatcgtggtagcc

SEQ ID NO: 15686 - DNA, 576 bp, Triticum aestivum
  Clone ID: PAT_TA_15686
caatccattctacatctcaatcaccaacaatcccaagaaatctcccccaaaaaacacccactactgatatatgtccactcacaacccacaccattcatcaccaacttccactaattcaaaccattcccccctcccacaccaccaaaacatatcatactcaaactcaacaaacacatccaaaaatataacccaccactccaaccttacacctaataaaaaaccacacccccgaactgcacctcaaaaacttttacctatatgtctacccccccgatacaaaaaaactaaatttccacaaacaacaatctcccaaacattacaattaatgtaaaacaacacatcttcatatcacaaaacaatttatctccccataaacccactttcaatgtcaccccccccaactgtctacaatcgcatcatcttctactatcaaaaaactccaatcccacacttaaataatccatatatacattcattacgctacaacttactcacctaatcataaactctcatccctcgttaactccctacacatattcattcaatctccagaccaatcttctcactcaacaaacc

SEQ ID NO: 15687 - DNA, 541 bp, Triticum aestivum
  Clone ID: PAT_TA_15687
ggaatgcaaaaaaaaaaaaaaatctagggtttgtcttgcgtgggccgcccttgggattcctcaggcgtcttccccccgtcgacggcagctcggcgcacgcatccagggatttccgcccccttctccggcgctggccaggaggtgccccagagccgattggtctagcacggacgacggcggcctccggcaaacgcctcgccggcagcgctgacaggctaagtgacctccctgatggcctcctccacactgtcatgtcgttcctcacggcccggcaggccgtgcagacgtgcgtgctgtcgcggaggtgggaggacctctggtgctccatgccctgcctcaacatagacgagcgggagtttcgcacctcagcgtccgattccgaggatgaggatgaggctggccctgactgtgctaggtttgaggatttcgtcatcaatctgctgatgtttcacagtgcggcaacattggatatgttcagggttcatactgtttctcgacgaaagattaaatttgccgaccaatggctacgccgtggcatcaa

SEQ ID NO: 15688 - DNA, 346 bp, Triticum aestivum
  Clone ID: PAT_TA_15688
ctcagattagtaaacccagacaccaagtgttccggcgatggcttctaagatcgccagtaccatggtcatgtacgtattcatactggcactccttgtgtattcagatgcaaggcgttgtacacaacacccagttaaggatccagattgcatcggtcgaattaacagaacctgtgttaaatgttgcaatgccgaaggctaccgtcatggagtatgtgcacccacatgcaaatgctctcactgcggacctgaatcccgtcctgatgaacgtgcaaaaaaacagtgagccttgaatttgtaactagcatggaccaataaaaagatcaagagatcaagtacattacaactt

SEQ ID NO: 15689 - DNA, 605 bp, Triticum aestivum
  Clone ID: PAT_TA_15689
aaaatccccccccacacacaacaaaaccaaacacccaacaccctcccacacgcacaagcctgtgccactgtacacaccgaccagggcaaacccaacaccccaacacaccccaacaaccaccacaaaaaccacaccccacaaatcaccacacaacaaccccaacccgacacaccacaaacaaaaaaccaaacacaaacacacacaacaacacaccacatccataacacacccaacacacaacccaacaacactacacaacaacctccacaacacacacgaagaaccacaaagcactcacaaccaccacatcacaaaccaacaagcaatcaaacaccacacaagcaacaaaacaaaacaacccaaaaccaaccacaccagacgacaccccaacccacaacccaccaaccgacactgcaccatccaccaatccaccaaacaacaaccaaaaaatacaaacaaaacatcccccacaccatcaaacaataacaccccgaccaactacagcaatcccccagaacagccaaccccatgcctggggagcgccccgctaaagaaccgtgaatgcgctaactaaaatccaacacccgttaactgatccacgaaaa

SEQ ID NO: 15690 - DNA, 704 bp, Triticum aestivum
  Clone ID: PAT_TA_15690
gactattgaaatcccattaaatacaacttggttcaattccaccaagatcaaccttgtaaacgttactattcctgacaaggcttcgaacggcgataacgacaatcagcaactatatgccggttgcctatatcagtggaccacactgagctcatctacaaccatacctgacgatttgtccaccattctcacaaaaaccatttcacaactccatcataaggtcgacacatcattcacatattaacatacatcgatctcatataactgactacttatgtacgccaggaccacacggattcctcaaacgtaccattattaacggatgtccccgaaaaacaacacttgcaatctacaccatatttccctgacttacacacttcaacctagaacccaagtctgccccaaaaccttatttcccacacccggtaacagaaacgaattcgcccaccagaacccaatgttatcccgcgcatcacaaagagtttttcttccattaaaccccctatttgtaccctccagaacgacaaaattaattctactctgggattggagagaaaaccaatgacgaattgtattgaaaaaaaaatgagttttccccttaggacccaatttcgaacccgcgcttggtaaagaaaatttgtgctctttttggacatgactagtgtgtaacaccccgtgggtccacgaaaagattgtcgattcttacc

SEQ ID NO: 15691 - DNA, 1305 bp, Triticum aestivum
  unsure (1)..(1305): unsure at all n locations
  Clone ID: PAT_TA_15691
gccgccgccccgcggccgcccgcccgacctccccgacatcccccactgctgttcccccgcctcccacccccccgccctcctcccccggccccccggcgcagcccccgcgcgcccgcggccgcggcgcccacgaggtcgcggacggcgcgtcctgccgctgctgcggccgccgcggcgcccgccgccctggtcctccgcctgctgcacccgcccaacctccgcgcggccctggctgccttgcctccccccttcgcgcacctctcgtacctccccttcgccctcgacccccagccccccggtcccaggctattctgccgagcctgtggccccggcagcctctgcgtcgtcttcctcctcctccccctcgcacccggctacgccctctgcctcggccggttcggcatggtcggcaaacacataagcggcttgggctaggcggtggaggtgctcagggggcctgagtcactaggcattgttgttgggattgtgtacctggtcattgctattctatttcaacatttcaacttcacagcggtattccattcggcttgttgaatataatgccagcatgagcatcagtctgctttatgattcttcctggatttatggacgataatcttgttggccaagcccattttaggcccaattcaaggttccttggccttttttaatgggaattccctttcctttgggggaattccatcatcattccaaagcctctagcatcctatgtcggagtagaagttctggagttaggttggatgtacaagctcttcatgcttttgttagcagttttttgtacaaattcaatcaacatacatgctggcctgaatggtcttgaagttgggcagacagttgtcatatctgctgcggtatgaagtacatggctcttgaattttgtgcaccattcgtcaactgatgattgtagcattttccaggttttgatacataatgtaatgcgcataggatcttctaaagaccttgaaactcagcaagctcatgcattctctatttatcttgtcctgcctttcctgaccacttcattggctttgctgggttttaactggtatccttcatctgtttttgttggtgatacatacacctattttgctgggatgactttagctgtggtgggtattttgggacatttcagtgagacattattgctcttctttttaccccaggttcttaatttcttgtgctcagtaccacagctcttccacttcgttccttgcccaagacataggttgccaaggtttgatactcaaacaggactgctgacaggcaccaaagatggtanccttg

SEQ ID NO: 15692 - DNA, 542 bp, Triticum aestivum
  Clone ID: PAT_TA_15692
atttaagccaagcaagctggggccattacaaatccaccatgaagacatttgttatccttgccctccttgctatcgtggcgaccaccgccacaaatgcagctagagatccagcgccacagtcgcaggcacaaaatccatctcaacaacagccacaggagcaagtgtcattggtacaacaacaacaatgtatagggcaggaacaaccatttacaccacaacaaccatatccacagacggaaccatttccatcacaacaaccatatgtgcagctgcaaccattttcgcagccgcgactaccatattcgcagtcacaagcatttggaccacaacgacgatatgcacaaccgcgaccacagtattcgcaaccacaacgaccatatgcacaggagcagcagcagcagcaacaacgtctacaacaacaacaacatcaacaacgagaacaacagatgcttcaacaaattgtgcaacaacaactgattacatgcatggatgttgtattgcagcaacacaacatagcgcgtggaagatcacaagtcttgcaa

SEQ ID NO: 15693 - DNA, 1035 bp, Triticum aestivum
  unsure (1)..(1035): unsure at all n locations
  Clone ID: PAT_TA_15693
gcctcctcccttctccccgcatcccgccgccgcctctccccccgccccggccagccacctgctccggcgagcgccgcgcacaagcacgggggagccccgcgcgcggagacgtttaaggggttcgaggggcacaccgctctgggggtcaatatcctacaggacagccgatccaacacccccagggcagcctaccgccgatccgccccgacgccacccgcctccgagatgccacgtccgccctccaggagctcaccttctccccccaaggacagaggccgctcgtgcaccccgcggcgtccctctatctgcgcgggacgccggacgactccgcacaggtcactgccgacgttaacacaggcctcactgcattgagaaaactatgactacaaggaaaagaatactgtgaaaggaaaattaatttgctgaagtccaacttcgatgaactacttgagatggcgaccaaaaagaagagcatagcagatgaaatgggcatgtttctgcaagccaagctgaggcaggcatcaccgagctcgagttcgtgagagcggaatgcgcgccctgtcccttgctttgttgccttgttggagcgccggggtggttcgctcactcgcagccctcagggaacataggaggttctttagctgttttggccgtttgtgcaaggttctctgagatgatttactgaaacagcctgctccatcgtcagacttcatcctcgagtaatttggaattcggtatcaaacgtgtgtgtcttggatgcacaatctgctttaatggctttgacaatcaattatgagtttgttgcatttcaaggcccgagagcgtggtttggcttgcctcctgctgtccggccccggggttccggcaactcggtggggtattctatactttcctgctttacaataaaaaaaatcacgtccagggggccggacaatcgctaaggatctatacccccatgcgcnttaantctacggaacctggtacactaacctgaaaaccttcacggaaacaagcnccattctcaatgacgaggag

SEQ ID NO: 15694 - DNA, 639 bp, Triticum aestivum
  Clone ID: PAT_TA_15694
ggggggtgacttttgttgagcatgattcgaacacaaacactaccaccgcattgcctatgaaatgggacactcgggtttactataaccattcaacaaatcacatggcctggcggtaaccaagtacgaccaaagacaaagttgaacccaggggcacttggcctaaaggcatatcagctgcttgatcataacacgaagctaatacataaaggtgagaaagaagggtggagtaaggccattggaaaggcaacgatggataagatgtattaaagccacacgatctgagtggggtggtgcacatcgtcctaaaacgcctgtggattgctaccacagttgcaataggcttcaatgacagggaccacttgggttaaaatgattggttgaacaaagtacaatgccacttttgttgaaggagctaaacatggttcctttagagagatctctggaacattttgggaaaccctttggacctttattattggcgcgtgtattcctcgcataattcccggagggctgttttctattgtggcgaaaatataatttgagctctcattctttgtggaaaagctgtgggagaataacttttgttgtgcccccaaaatatacccccacattgggggagacaatatggccctcaacccc

SEQ ID NO: 15695 - DNA, 552 bp, Triticum aestivum
  unsure (1)..(552): unsure at all n locations
  Clone ID: PAT_TA_15695
gcccgttcccgttcccctccctctcccccgcttccttcccgacgacgtcgtcgccgcagtcttttggtggtttttgtcccgcggcctctgccgcccgcccgcgcgcgataccttcccctctcctctgctccactcccccgcttagagctcacagaggcccgaagcagccgagcggcaccacagcggcggaaagccaagccgtcccaccgacaaggcgagcggcctctccagatctcgcatgcgcggccgccgcaggggcaggagaaggagggggagcggctagggaggggctggtggtgccgccggcggcggccggtttttcccagatgcgccgggagccgctggggaacttggtggtggtctacaccgggatgtcgggggacaacatcaagggcctgcttgctgcggtctncttcagcctcttcatcggggccagcttcatcgtcaaagaagaatggccttaagtagggccggcgccttccgccgttccgcgcaagtggtgggtggctactcttaccttgctggagccaattggagggtgattaggactgg

SEQ ID NO: 15696 - DNA, 664 bp, Triticum aestivum
  Clone ID: PAT_TA_15696
ctcctctcctcttcctcccgcctgcgcctccctgccccgctcccgtccagggccagccccacaccgccgtcatctcgcctccgcgtcctcttccttcctctcctcccatggggcgacggcggcaaggacggcgcgctgcgcccgccccctcggctccaccagagccttccccgtccccgtctgcgccctcgagctcgaggacccccggtcgccctcggccccggcgtcctaccgggtcccgctcgccgccctcgcctgcgccgccctcggcgtgctcgtctccgccccctccacttcgtttcctccgtgcttcgatctggtacctccactcctctccatctccgcctctcacccaccccctcgccatgagagtgggtgcgctgtttgggcaaccgctcgggttgggtccgggccgcttggtttcctcccgaaacaaggttgggtccccatttgaggcccccctgcggtaggaacccttttaaaggggggttttagggggaacccggggaccccccacaaacggaaatatgttggagagggggaaatttcggaagaccaccaaaaggggggataaaaaaataagcgccgggggcggcgccttttttttgaaaaaaaacttttttttttcctgtggggggaagaaaaattttcaaaaaggggggcc

SEQ ID NO: 15697 - DNA, 1393 bp, Triticum aestivum
  unsure (1)..(1393): unsure at all n locations
  Clone ID: PAT_TA_15697
ttttcaggcacgaggctcacacttgcggttccaaatccaacaccgccaccatcaccttcctgctccccgagcccacgccccccctgccccgcagcaccagcaccaccagctagcagccatggacggcaagggctacaccacaccgcccaccgcccccgcgccacaggccgaggccggggcgccgccgcactcctaccccccgacagagcacggcaaggacgccgcggcgccacagccgggatcgcaggtttcctatccctccatggaacacaccatggacggcctggacgccaccgcgccacagccgggcgcgccgccgcacccgtcctcccccctgacgcagcaggccatggagatggagggcaagtacgccgccccgcagccgggcacgggagcgccgccgccatcgtcctcccccctggcgcagcaatccatggacggcaaggacgccgccccggcaccgcccgcggacgccgagtcggcgaaatggggcacgcggcagatgggcccgccggcggccccgggggcgcaccccgagaaccagcaggcggcgcagtggacggcctcgcgcggcgaccaggagctgccgccgtacgtccatcatgggggggccggagccggcgccggcggcatcggcccggcggacggacacggagaccaaggacagccccatggagcacatcctcgacttcttcaacgtctggagccgcaaggccgaggagctctcctccaacatctggctcaacctcaagacggcgccgtccatgtcggacgcggcgatggggaagctgagcctgggcgccaaggccatcacggggggcggcttcgagaagctgtacaagcagaccttcgcctccggccccgacgagcacgtaaagaagacgttcgcctgctacctgtccacggccacgggccccgtcgccggcacgctctacctcaccaacatgaacgtcgccttctgcagcgaccgcccgctctccttcaccgcgccgtcgggccagaccgcctggagctactacaagatcatgatcccgctggccaagctcgccgccgtcgagcccgtcacggccaaggagagcccgccggagaagtacatccacatcgtcaccgtcgactcgcacgacttctggttcatgggcttcgtcagctacgacaaggccgtgcaccacctgggcggggccgtctcctcgtcgcagcaccacggcgccgctcccgccgcggcgccggcgccggcacccacctacgagtgattggctgattgccgccgtgttccatgttcgtggctctctgcttttcattgccgtgtgtgtgcgctctgcttttcgggcgggatctgtttagtgagtgctctggtgtgtagtggattttcgtgtgnnnatgtgctgttgtnnnn

SEQ ID NO: 15698 - DNA, 542 bp, Triticum aestivum
  Clone ID: PAT_TA_15698
gacaagccctcctcctcctccgctggtccttcccctctctcgcgtcggcgctactcctccgatactgcggcggcgggcgttcggcggcgaccggcgacacacagaagaaggagaaggatggggaagagcaagggccgggcgtccagcagcggcctggcggcgtcgctgctgcccgacgcgcagggcgccgccgtacccgccgtcggattcgggggctaccacggcgcctcccgcgtagagcccgccggcctgcacccgattccctccgacgaccccgacgccccaacccgcctgccccccgatgtggacacccaggtgctgcagcaccttcggacgctcggtcgcaaagatcccaccaccaagctcaaggcactatctacgctctgcgtgctgtgtacacaggaacctgccgaccaagtcgtgcaaattgatcctcaatgggccttcgagtacaagaggctgctgcttgactataacagagaagttcgtcgtgctaccaacgataccatgtctagcctagtcaccgcagtcaagaagggcct

SEQ ID NO: 15699 - DNA, 408 bp, Triticum aestivum
  Clone ID: PAT_TA_15699
gtttcccattcctctccagggcaagcaggcgacggcgattttggagagggagaagggaaaagggggtagagacccgctccgaaaccaggatgttgtgctcagtttgcttcgttcattgtgagatgaacaacggcaggagctttggcatgttttttcgggatgtcaatgaaagctttgcgttttgtaggtcgtacccgtattgctcgcttgatccgtcgtgctaggtcgtaatcttgccagtcctgtgagttgtggagcccagctagagttgttatgctaccaaatcaatacttacgccgccatttttatcagactttcgctgtcatttaatagccttagggctatgccagataattgtattcatcaatgatgtaatctcatatacatgtatttgatgaatatttttgt

SEQ ID NO: 15700 - DNA, 984 bp, Triticum aestivum
  Clone ID: PAT_TA_15700
cccacgcgtccgcccacgcgtccgcccacgcgtccgcaccagagctcagtccgttcgttcgttcgttcgttcgttcgagcggaggcgaggaggaggaggagatgaggatgtcgctgctgagatccgcgtcgcagcacctgcgccgccgccgcggctactcgtcgacgcccgcgcagccggagcggaaggtggccatcctcggcgcggcgggcggcatcggccagccgctggcgctgctcatgaagctcaacccgctcgtctcctccctctccctctacgacatcgccgccacgcccggcgtcgccgccgacgtatcccacatcaacacccgcgccctggtgaaggggttcgtcggggacgaccagctcggggaggcgctggagggcgccgacctcgtcatcatccccgccggggtgccccgcaagcccggcatgaccagggacgacctcttcaagatcaacgccgggatcgtcaagggcctctgcaccgccatcgccaggcactgccccaacgctctcgtcaatatgatcagcaaccctgtcaactcgactgtcccaattgcagctgaggtgttcaagaaggctggtacctatgatgagaagaagctgtttggtgtgaccactcttgatgttgttcgtgctaaaacattctatgctggaaaggcaaacgtgccagttactggggtgaatgttcctgttgttggtggccatgctggaatcactatcctgccactgttctcacaggctactcctgcaagtaatgcattgtcccatgaggaccttctcgccctcacgaagaggacacaagatggtgggacggaagttgttgaagcgaaggctggaaagggctcagcaacattgtcgatggcatatgctggtgctgtttttggagatgcatgcttgaaggggctcaacggtgttcctgacatcgtagagtgctcttttgtccaatcaaccgtaacagagctgccattctttgcctcca

SEQ ID NO: 15701 - DNA, 1028 bp, Triticum aestivum
  Clone ID: PAT_TA_15701
gcaaaggatggaaagggatctgcaaccttgtccatggcgtatgctggtgcagtttttggagatgcatgcttgaagggtctgaacggagttcctgacattgttgaatgctcgtacgtgcaatcaactgtgaccgagctgccattctttgcttccaaggtgaggcttgggaagaatggagtcgaggaagtgctcgggttgggtcagctgacgcagtttgagaaggatgggttggaagctctcaagggcgagctcaaatcttcaattgagaagggtgtcgcgttcgcaaatgcaagttagttaggtcattttgcagattatagcaaacccaggtctcgttgaggggtctgttggtttggtccagtgctttttctgcccatcatgtgggcatggaagatttgagctttgcaataaaatttccggcggcgcaatgccacacataacataacttgcacgagaggaagctagttttgtgtcgagctttgaactgataatgaagagttgctgataagtggttgaggcaaaggctggaaagggatctgcaaccttgtccatggcgtatgctggtgcagtttttggagatgcatgcttgaagggtctgaacggagttcctgacattgttgaatgctcctacgtgcaatcaactgtgaccgagctgccattctttgcttccaaggtgaggcttgggaagaatggagtcgaggaagtgctcgggttgggtcagctgacgcagtttgagaaggaagggttggaagctctcaagggtgagctcaaatcttcaattgagaagggtgtcgcgttcgcgaatgcaagttagttaggccattttgcagattatagcaaacccaggtcttgttgaggggtctgttggttttgtccagtgctttttctgcccatcatgtgggcatggaagatttgagttttgaaataaaatttccggcggcgtaatgccacacataacataacttgtacgagagaagctagttttgtgtcgagctttgaactgataatgaacaattgctgatgcgtgg

SEQ ID NO: 15702 - DNA, 1631 bp, Triticum aestivum
  Clone ID: PAT_TA_15702
cccggcgacgcctcctcacccgccccgcggcgccaacaccacacctcggttagtgcggacgcgagtgcgaggggacggcccaagagcagctacggtgaggcccctcgcgtgctcctaccccgccgccggctccacccccccgccgccgactccgccgagcccaggcagcacccgcgagggcgtggggtggtgggatcggcccgcccagttgcgcagccgctgcagctcctcccgcgcgtctaccccctctgcctccacgcctgcccctccacgaccgcggccgccgccgcggcgtcccagccgatgtctcgcaccctggtgcagggccccgtcggggacgaccctcctcggctacgcatcgcggggggccgccctgggcttcggcccgcccggcgtacccctcaagcccggcctcctcacggaggacctcaccaggacctccggggcgatcgccacaagcttctacaccgagatcgccaggcaaggcctgcacaccctggtcaatatgatcggccggcgtctcgactgcagacgccgaattgcacgggaggttttcaagaacccaagggcttatgacgagcagaagctgagaagcgtgacgcctccgcaaatgctaagtacttaggccatttttcttagtaaagcctaaccaggccactttctggggtgtatgtgattggtccagtgctgtttgtgggcatcaatagggtggcgcggttttggggtgtgaactcataattctgttgcatcattgcaccacctagcttgtcctgcacaagatgcaggtgcattgggggagtgtgacggaagttgttggagcgaaggctgaaaaggggtcagcaacatttttgatagcatatgctggtacagtttttggagatgcatgcttgaagtgtctcaacggtgttgctgacattgtatggtggtattttgtccaatcaaccgtaacagagctgccattcattgcctccaacggtggaggctggggaagagtggagtggaggtagtgatggggctgggcgagctggcggtcttgggagcatggaggggctggatagcctcaagggcgagctgctgtcttccattcggagcagggggtcaagtgcgcgcaggagagcggaggcggcgaacatgtagagccgagatagctacgggtcatagttgaactcaggcaatttttgtgcgcccgtgttatgttccctccttaacccggttgtgcttcggggcatcgacgcgttggcttgctccaaaataaattgtactgcgttagatggtcccgacagaaactactgaacctgtagttccatctgacttcagacaccgcctgcccaggaggcttcgcggagtatcaaaaaatcgccagacgcgaaactaaaaattattacggcattttaatcttacagcacggaccgaatgtgaacaatctgtagggataaaaatgcaaacaccggtgtcctatgtgttcacagacattcgtaccctgaagatcacgaagcgaagaaccgaagattctgcgggcattatatttgggtttgtacgtgcaggggcgggtttgtcgttcctcttttaaattgtcgacaccgtttgttaacctgctagctatggggcggggcgtgcttcaaaaaaaaaaa

SEQ ID NO: 15703 - DNA, 771 bp, Triticum aestivum
  Clone ID: PAT_TA_15703
gcctccagctccaaaccctcatccccccatccgagctcactgcccccgaccctctctcgaaccgccgatccaggacatggcggggacgatgctggccgaacgtggacgtatggacgaagcggcggcgtgcgttcgggaccgccgggaattcctgagcgacgagccggcttcgacgttggcacgcgctgagacgcgaccaatggggcctcccggagcagcagctccggctgttttcaacagcctcgcacgtatgtttttggaagggaaatggaattgaccatatggacttgatggcctgtattactcggcgattacttagcccgcttttgctggtcctgaccggttacccaggatccaaagaaccttgttcacgtgctttggcttgctaacccgggccgtttgcttttatagaaaaagcccggtccggccaagtttttggttgggaatttctgtggccaaagtatagccggccttatgggcctttttaatccccaatcccttgggccttccggttttggcacccatttgccctataaaccctttactttggccgccggtttctgtaagcttgttccaggcaacaaggctgggctaggcaagctaaactcaaggcctaagggaaagggcccccatggcgggtgcactgggtcccccccgggaagtcttgcaaccgtggcgggtttccgtggaaattcccctccttgtccccccacactttgtggtggttcccccctaatgtatgacttcacttccggaaaggccaaatttcct

SEQ ID NO: 15704 - DNA, 779 bp, Triticum aestivum
  unsure (1)..(779): unsure at all n locations
  Clone ID: PAT_TA_15704
cggcacgacacgcgggtgggttccttccaggcctcctactccccctctcgatccggactctcggcactctcgccctctccaacgccgccggccgccgcctctcccccgtccctctctcgtctctccctctccgatggcgtggtagacctagcggagaggggacggcagcggggaggcacgagcggctgcggcggcttctacggcgggttagcagtgggctagcagcggctgcggcggtgcagagagggtggcttttgacgtaacaatcatgaaggtcaaaattcttcagtggcatgcggtggcttcttggacatgggacgcacaggatgagacatgtggcatatgcaggatggcttttgacggctgctgccctgactgtaagttccctggtgatgagtgcccaatcatttggggtgcctgcaaccatgctttccatcttcactgcatactcaagtgggtcaattctcaaacatcaaccgccctttgccctatgtgccgtagggagtggcagttcaagggctaaggacatctcaaactgtgtcagtaccaagcattttcatatctcatagagaactagaatggatctttaacaggaatgtagttgtgttgtcttgtaagtggttgtcatactttctggaaatcaggatgattggcatcttttaagcgaaactgtgagacattgagccacaaaaaataaacatgctcaaaggctgaccatgcaaatgcaatgattgacttgaaagncctaagcaacctgagattgtggnaaaaaaaaaaaa

SEQ ID NO: 15705 - DNA, 588 bp, Triticum aestivum
  Clone ID: PAT_TA_15705
gggactctcgcacaacaagaggagcctacctccgttcccactcctttcccgtgctaggaacaacaaccggagccacggcacgaaccaacaggccagcatcgagtaaggcttcctgggactgggcatgacacgcaaagctgttgccagaaaactacttcgtctctgttttcgtagaacaggccgacaccgtaccctgggcagagcgacgagctcgttgcgacgggtgccgccgcaggtgacacaccgacggacgacgttcctgctgcaggtacacggaggccctgctctacgatcacagctacggctatctcctgtccctccacatggaagctgtgcccggcctatgctccagggcccgggatacgtgcatatgcctactgcaaaggctgccactgcttgcaagattatcgacgccgggatacgcgagggactaccttctgtggcagcctccagttcagggaccacgataccatgggttgaggcacaatggcctattctaggtggtcgctacagaggaactaatgaggatgtggtacctgtgtatacagttctgtggaaagagactaatggttgctccagcacgcaggt

SEQ ID NO: 15706 - DNA, 514 bp, Triticum aestivum
  unsure (1)..(514): unsure at all n locations
  Clone ID: PAT_TA_15706
cgctgacgggacagacacatcccgagctccacgcaggagcagccacgctccattcttgtcgctgctagtttactctcctctcatctgctcgcgtgtgtgctgctatggaggcggcggagcagattgcggtggtgtggaagcaggtccgcggcccagttatcgtgccgctgctgcgcgcatccgtgatggtctgcctcgccatgtgcgtgatcctgttcgtggagaaggtgtacatggccgtcgtcatcgtggcgatgaggctgatcggccgccgccccgagcggcagtggcggtgggagcccctccgcgacgacgaccccgagctcggcaacgccgcctaccccatggtcctcgtccagatccccatgtacaatgaacgcgaggtttacaagaagtcgatcggggcggtgtgcggnctgtcctggccgtcggatcgatcgtcancangtgctggacgactcactgaaccgcatcaggagctgtgcangtgagtgcangcgtggcgacanggtga

SEQ ID NO: 15707 - DNA, 603 bp, Triticum aestivum
  unsure (1)..(603): unsure at all n locations
  Clone ID: PAT_TA_15707
atttccaccacaacagccatatccgcagccgcaaccatttccatcacaacaaccatatctgcagctgcaaccatttccacagccgcaactatcatatccgcagccgcaaccatttcgaccacaacaaccatatccacagccgcaaccacagtattcgcaaccacaacaaccaatttcgcagcagcagcagcagcagcagcaacaacaacaacaacaacaacaaatcctacaacaaattttgcaacaacaactgattccatgcagggatgttgtattgcaacaacacaacatagcgcatggaagctcacaagtttggcaagaaagcactaaccagcgtgggcaacaatggtgtggacagcagcgtgggcatatcccagagcagtcgcggcgccaagccatacacagtgtggcacacgctatatattggatataaaaaaccccccccccccaacaaaaaccaccaccaccaccaaccccnccgggtgagagcaatgtccctttcacagagctcggagacactatacatataggcgacagctttttccaaccatctcagcaaaacccacaggcccagggctcttttncagctcaacaactgccccc

SEQ ID NO: 15708 - DNA, 663 bp, Triticum aestivum
  unsure (1)..(663): unsure at all n locations
  Clone ID: PAT_TA_15708
ctctctccctctccgccgaatcccggctcctcccgtcgccctcgcattgcgtccggctccggcgagtttcctccgcctcctttcccaatccgaacagccggagaccgcggcttcggccgtctttgtctttcccgcacgtctgtcttgtgcacccgagagagccatcaggaatcatccagactaggagagccgcggcggccttctagggaagcggtgcaggaagttgcctttcttggtttggttgggtccgaggaatggggaggaggatgcggcaggccattgccgcgctaggcgtcgcgtgcgcggccgcgttcgccgtcgccgccgccgaccgtgggctctcgctgcccagcgaccgcgccgtggtggcggcgccggaggagatcagcctcctcaacaagattgccaatttcatgttggcagaccgacggggaacctcgtacnncagcatggtttgggcccgcccgatgggaaattcgggatgggaaaaaatgggtggcctgggggggtcgccttggaatccggaattcttttcgggggcggccgttcaattttggggaaagtggttccgggggggggccgttttgggtgggggcgggcccgggggaaatcctttttggtggcccccgattggttttaaaacaatttgggaataaaattttg

SEQ ID NO: 15709 - DNA, 482 bp, Triticum aestivum
  Clone ID: PAT_TA_15709
gtaaacaattgtgtgggttaatttatcaaatgtttttactctgagcttgaactacagtgttgcaatatttcggcatcaacacttgtaaagtattagcaacaaaatggtaatgacccgaacgatttgtgtgcaaattagtgacagaagagatcaaacttataggcccagaaataattaatcatatgacatcgatgttaaacatgtaaagttagtctcgagatctatattctggacagaaatattgtgtgctgaacacctttcttatttagtcactccatttttgttgtagacagacaaaattaagctgaatgtatatcataatagcattgttgttctgagatgggataactagagcttggggttatggttttccagataagtaatgctgcatgcgcactagttaatcagttatcagtcactccattgtgttaacaaatcgcattcatagatgggaatatccgaagtctattctctgttctctt

SEQ ID NO: 15710 - DNA, 483 bp, Triticum aestivum
  unsure (1)..(483): unsure at all n locations
  Clone ID: PAT_TA_15710
aaggtattggaggactttccctgggtgcacatgccttttgaatggttggtgcaattgacgccgccgttgaagaaaagagcattttcggtatcgtcgtccccattggcacatccaaaccagatacacttgactgttagtgttgtatcatggcttgctactcctttcaggagaaagcatggtctctgctccacatggctggcaggactcaatccaaatgaagaaactcgtgtaccatgctggatacacctaggatccctgcctcctccagattcgtcgactcctcttgttcttattggaccaggaacaggatgtgcgccattccgagcattcgtggaggagagggctgcacagagggcgaggcaacccacagctcagatcctattcttcttcggctgtagaaacgaagacgatgattttctacacagggacttttggtcacaccatgcccaggacaacagagttctgtccctgaaagagggtggn

SEQ ID NO: 15711 - DNA, 529 bp, Triticum aestivum
  unsure (1)..(529): unsure at all n locations
  Clone ID: PAT_TA_15711
gcgtgatcccctttcagcccactccatgttttctcacccaccggccaccgctgcaagtcttggggcggcggagctgcaatggagcgcccccggcgatgcaatggagcagttgccggcactgcaatgactgagagcttgctggcgcctcctcccgacactgcaatggagcactcgtcggcgctccaatgcagcgcttcccggccaccggggctgcgatgaaagcccccgtcaccggccgccgggtgctgtacaatgaagccttcctcgccgtccaccagtgttacgatggggtgctcgccgccgctgcaacgagcgctcgtcagtgcttcgtccagcgctgcaatggacgctcgtcagcgctgcaatggagcgcttgccggccaccggtgctgcgatgaaaggcctcgttgcccggtagccgagtgctttaatgacgccctcgttgtcgtccaccagtgctgcaatggagcgcttgccggtgctgcaatgaagacctcgtcgccggcgttgcagcatgctcggggcatgn

SEQ ID NO: 15712 - DNA, 606 bp, Triticum aestivum
  unsure (1)..(606): unsure at all n locations
  Clone ID: PAT_TA_15712
attcactcaacttgagaacaaacattatctaacacaaatcaaccatgaagaaattcctcgtccttgccctcattgtcatcgcggcgaccaccacggccgccgaaccctttactgcattccgtattgcttcggagccgcaacatccatcatctccagagcagcaaccaactctgcagccacaagaacatccagttccacatcaaaagttgaacccttgcagggatgccctcctacaccagtgtagcccagtagctgatatgtcgttcctccggtcacaagtggtgcaacatagcagctgcttggtaatgtgggagcagtgttgtcagcaactaaaagcgatccccaagcagtcaagatgtgaggccatccacaacgtcgtgcacgccattattttgcaacagcaaaaacaattggtacaaggtactttcacccaacctcagcagcagcaaccaccaaggtcaacaagaacatgggtcaggtntcttagccaggcacaacaacccnaccacacaacaggcaacttgaataagggttggatcgttggccgattggggacatggggtgatttcagaaccggttcccgggcaatggtgcggaccgtggcat

SEQ ID NO: 15713 - DNA, 585 bp, Triticum aestivum
  Clone ID: PAT_TA_15713
gtgcaacaacaacaatttctagggcagcaacaacaacattttccagggcaacaacaaccatttccaccacaacagccatatccgcagccgcaaccatttctgccacaactaccatatccgcagccgcaaccatttccaccacaacaatcatatccacaaccacaaccacaatatccgcaaccacaacaaccaatttcgcagcaacaagcacaactacaacaacaacaacaacaacaacaacaacaactacaacaacaacttctgcaacagcaactgcatgcatgctaggatgtacgcttgcaacaatctcacatagggacatgcatgctcacaagcatctcagcaaagtcaccagctcgtggactattatgatctcagcaactggcgcagatccaggagtagtagagctgaccagtcatgcagcatgcaatcatggtaatggtttgcatccttcaataatgaccgcaaccgcttgggccacttcgactactgcggtctcaacgacaacagcaacaacctcatcctcgatctttggagccacgggtttttcaaacatcgtatggaccagtttcattgtggcaaagg

SEQ ID NO: 15714 - DNA, 589 bp, Triticum aestivum
  Clone ID: PAT_TA_15714
gggagatgcaggggctcttgtgagacccacctagctagctgactagctttgctgcagctgctcgacctcttcgatatccttcggctatggtagcccatgtggatcccctcccagcagatacggacaacgcggacgcgatggacatgttcactcgcaatatcgcagcggaccatgcgctattaaacgaacgacccgacaaacggatgggaaatcaagccgtacataggcgacgcggagccctacattcaaatagccggccgggcccgcgatctcttaaacctggttatgactgatgcggacacaccgacatggaccacgagaaacggtaccgactggcttcgctcggtggtggataacttgcctgacggcacagatacctcctaaggggaggaagtggtgccctacacgatggcgatggaaatggccgggaggaggacccgtgttgtcgttgaagagaagaacccgccgacgaggtgctgctaccgggggaacgcagatgggcttggcctttcagaagagaagatgaagtgggacgagctcctggcactacccccgcagggctcggagggtattgtcgggggcctccccc

SEQ ID NO: 15715 - DNA, 537 bp, Triticum aestivum
  unsure (1)..(537): unsure at all n locations
  Clone ID: PAT_TA_15715
gtgggtcggtgggtgtgcagcttgtcttgtttgtcaattttccaaagtactctcgtacttccgtgtccgagccgtcgtttggaccggccgccggtggtccgggccggaccggaccgagcaacatgacggtcctgatttctgggaccggaccggcgacgacgaagcccgggccggaccgagcggaccgaccaacgggcaccggcggcgaggtgtgcgacgtgcgtggttgctctggcgaggtgggtcacatgcgcgagcgccggcggcaaggtgtgcgctgggcggcgcgactgttattaatgaactgcgagcgttagccattgtcgttgctaaccatgaacctgcaacactcacaccatgcacgcatgggacgtgccgatctaaacggcatgcacgcatcacgcatgagaggtgcccgttctaattaaacggcatgcccgcacatgacgtgggggtgcggcttttcagttttcgctctctttattccttgcgtcacagccgtgcctaatctatacgcgcgccatcctcgcacaggan

SEQ ID NO: 15716 - DNA, 703 bp, Triticum aestivum
  unsure (1)..(703): unsure at all n locations
  Clone ID: PAT_TA_15716
gagaaatctttaccctcgcccaaaacctagacgacgccatggccgacgccacctcccccgacggcgaattgtccggcggcgccgccgtcgacgacgtcatgcccaagctcgcccgacagcctgttccgcgccaacagaccgcctcgngccaagcgcttcccgtcctgtgttgcaggtgctgtgccgagcccatcggtgctggcacatacgacgcgcgccccgacaccgcacttcgggcctggggcccgttcgagacccgtaagggcgcacgacatacatcggctagggggccagagcggctgtggaactatggttcaccggatttattgattaccccccgggcagggaaccgggtccatagggagataatgaacacaaaggtggcgtgaacggaggcctatggggcccaaatagattttaactcaaaaaccacctcttgatttcacctctccagctttaacccagagtgggggaagagacaattttcggccagggggggcccctggataaacgccccctgccggcggttaactggtgccacaggttggggaaaaattgtgcataagaaaaaaatttcccgagcccgggggggggaaaaaacaaatattttcccggggtttggttggggggccttcttaaacatgctttcccaggggggggcaatgcaccggaaaaaggttccccgccggatggaatcggaccg

SEQ ID NO: 15717 - DNA, 936 bp, Triticum aestivum
  unsure (1)..(936): unsure at all n locations
  Clone ID: PAT_TA_15717
cgtccgtgagatttatgatattgtagttgggataggagaattgatggttacaactgaaacagagtctatacgtcagcaatgtatgcaaattctattacagttttttctaaattacccactctcagggaagcgcttacaacagcatattgattttttcctgacaaacctgaagtatgagcatgcatcaggaagagaagcggtgctccaaatgctccatgatattcttaccagattccctcagaggattattgatgaccagggtcaaactttttttcttcatctggtagttgccttggcaaatgaacagcaccagaaggtgtcttctttgattgtcacagcaatcaagaagctgttagggcgcattggtgatcagggaaagaattctatttttgagtactctctttcctggtacactggtgaaaaacagaatttgtggagcgcttcagcccaggttattagtctacttgttgggaatcgctcattaggaattgggtaaacatcttgaaagtattttggctgttgcgaagcgaataatggaatcttcttgcaccgcttcctggaggagtacaactagacttaactgggggaaactgatctgccattttgggaaagaggcttactgtcctatcctaatgatgggataacttacttggacacttcccagagttgtatttcaaaacaaaatacaggaggcgatatggatgacaatttgcaagctgctgatacatccccattcgaagttccgcatttattctagcgctctggtatccgagtattgcgcttcagtagagcagaggaaaaaagagaagttggatgtcacatcatcgttccttctcccaccgcgctggctattccgtggtccttctgcgtgcttgagacaggtcaggctggaccttcgtctgacggcggacaatatgaccatggtgcacctgtntg

SEQ ID NO: 15718 - DNA, 515 bp, Triticum aestivum
  unsure (1)..(515): unsure at all n locations
  Clone ID: PAT_TA_15718
taagagggtccttaaacaactggatctggtatttggtaaagaagactctactttagtcatggctctatgaagcattctagcacactactaaaaaagaaataaatccattctagatcgtcgaaggtgggcggcgcgcaacctcctctccggcatgggggtgcatgaaggccggatctggctggtcatggtcggatccggcacgggcgtggcagggtgcgtcctcgccggtggtcggcggctgcaggccactggtcggctgcgcggaccatgctgatggatgttggctggcggtgggtgagttcgagggccagctcggccagcggtgatgccccggcggcgctgcggtcctctccttcgccttctgtctatggcggcgatcgaggtcagctcccctccaaccatctgagccggccgtggccggaggctgacttctccangtgttgatcgcaccgaggctgtgattcatgcggcacgatcaccnctctccttctgtgctgagtgcaccggtgctagcc

SEQ ID NO: 15719 - DNA, 540 bp, Triticum aestivum
  Clone ID: PAT_TA_15719
taagagggtccttatactactggatctgggatgtgggctagaaaaatctactgtatggatggctctatgaagcattgtagcgcactactaaaaaagagataaatccattctaaatcgggcaaggtggacggcgcgcaagctcctctctaggatgtgggtgcatgaatgccggatctggctgcgcatgggacgatcccggacgggcgtgagacggcgcgtccttggcggtggtcagtggctgcatgtcactggtgggcatgcgcggaccatgctgatggatgatcgctgggcggtgctgagttcgatggccacctcggacagcggtgatgccccggcggcgctgcggtgctctacttcaacttctgtctatggcggcgatcgaggtcagctcccctccaaaccatctgagcgggccgtggccggagggctggacttctcccaggtgttgatcgccaccgagggctgtggattcattgcgggccacgggatcaccccctccttccttctggtggctgagtgtaaaccgggtgctcatgccca

SEQ ID NO: 15720 - DNA, 435 bp, Triticum aestivum
  Clone ID: PAT_TA_15720
cgtccgcccacgcgtccgcccacgcgtccgctcatacgtagcttccttccttccttccagctctctccctctcccgtgtggttcttgcgaagctgttcgatcgaccgaggcgagatggcgagaaagcggaagggcgccggcgacaatactgagccacggcagcggcgtccgcgtgtagcgccgccggagactacagccggcccgcaggcgcctgcagcaggcgattttccaggcccgtcttccctgcaagggcagttcgctctgctcaggggattcgatcctctgctgggaaatccagggcggacggcgacttcgcaggcgctcgcacgggtgtcgtcggctaccgtcaacgcccaaggcttcggtggaggtctcagtcgcggcggcgggttggcacggacgacgatgcttcggcagtcgctgcgcaatgcatat

SEQ ID NO: 15721 - DNA, 515 bp, Triticum aestivum
  Clone ID: PAT_TA_15721
aagaattagccatcatgtactttctatggttgtattaggcttttttaagcaaagacatgttgtaaacaagctgaatttgttgaactctatctccaatgagagttgtactgtacttttgtgttggaagcatgacattgtctgtttatccttgttcaaaaaaaaaaaaaaaaaactcgagactagttcctggtgccgaattcggcacgagcactcaactggagaacaaacattatctaacacaaatcaaccatgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtggtgcaacatagcagctgcttggtaatgtg

SEQ ID NO: 15722 - DNA, 1409 bp, Triticum aestivum
  Clone ID: PAT_TA_15722
cgtgcggcctaaccctaaccctagctaagaatcccctcccgcaaccaggtcgtgtctcagggcgcatcgccgaaggccaagccctccctgcgctagcagcgggccgcccgttcccggcgggacgcgccgctcaagctccgtcgcgctttcgacggcgagggatggatccgatggacatcgtgggcaagtccaaggaggacgtctccctccccaaatcaacaatgaccaagattattaaggagatgctaccgcctgatgttcgagtagcaagagatacacaggatcttcttgttgaatgctgtgtagagttcatcaatcttctttcttcggaatccaatgacgtgtgcagccgggacgacaagaaaactattgcccctgaacatgttattagggctttgcaggatcttggcttcaaggagtatgttgaagaagtttatgcagcctacgaacagcacaagcttgaaactctggactctccaaaagcaaccaagttcactggtatagagatgactgaagaagaagctgttgctgaacagcagagaatgtttgctgaagcccgagcaaggatgaacaatggagctgccaaaccaaaggagcctgcattagaaccacagaatcaaccccaacagcccccacaacctcatctgcagctgcatccccaagcacagcagcctccacaacctcaaccgcaactgcattatcctcaatcacagcagcccctgcaaccgtttactcaggctccaccacagcaacccctgcatcctcaactgcaacagtatactcaggctccaccacagcaacccctacaacctccactgcagctgtatcctcaggctcaacctgagcaaccgctgcagcctcaatcctcaggatcaaccacaggaacctgtgtaatctcagctgcagctccatctgcaaccggcacactgctgctgcaacctccgccccagcaatccccgcaatctcaactgcagctccatcagcaaccccagccgacgctagtgccgccgccgcaacctcaaccccagccacttgaactgcagcagccccagccgctaacacaactgcaagcggaacatggcctggactgggacagttagtggttcggaacatgtagcgtcactataagttaagactctgcctcctttaaaattgtgcgttaggtttgcctgcatcttgtacaatgtaaatcgtgtgtgatttcagccaccgtgtctaataatctgaagctctctagtaagcgatgtacttactgcgctgggtactgtgtttatgactgctgtagtctcatggtattgtgtgtgacgtgtcagaagctactccattaccagtgtaatcaattgcctaacttaatgttcacccgtgatgataaaaaaaaaaaaaaaaaaaaaaaaaaaaaaaaaaaaaaa

SEQ ID NO: 15723 - DNA, 3306 bp, Triticum aestivum
  unsure (1)..(3306): unsure at all n locations
  Clone ID: PAT_TA_15723
gcgttctagcagtcagtctgattctgaaaatcgatcccttctgatgccatcattgatgaaaaggaaattgaagagacagatgagcctgagattgacccatagcaattaagttcaaggaaatgcttgaggcccagaagaaggctgcactggagaatgagatgccggttggaccgatgccactcccgcgtgcagatggtcatattagctatggtggcgcactgagacctggtgagggtgatgccattgcacagtatgtacagcaggggaagcgtatcccacggcgtggtgaggttggtctgtctgcagatgagattcagaagtttgaagatttggggtatgtgatgagtggaagtaggcaccagaggatgaatgctatccgtataaggaaggaaaaccaggtttatagtgcagaggataagagagcactggccatgtttaactacgaggagaagtcaaagagagagcacaaggttatggctgatttgcagcgcttggtttcaagaaccattggccaatagacaggaccttcgcatgatccatttgctactacagatgactgagtaattatttctatctattttacaaagaaatggttgccactgtgaatctgagagactgcccacaccgtgcacgcttcttcctcgcgccgcgccgccgccgccgccaccaccaccatactcctctggtctctctgcatccagtccaaatcgaatccgcccgctcaaaaatcacccagtctcttgattctgcagctgtgtaagtgctgcgagggagcatgagcatggccttctcgtgcgcgagcgttcgcctgcacggccgcgtcgacaccgtcaagtgccgggccgttctagctaggccgagcggctgttcgtacccgactggaaggaggcggatcgctagaggaatccgttgccagctgccgccgcaggccagtgcggatgggagcgcagccaccacctccggcgcagctgtggtcgcccgagaggcggggaaggttgctggttctgccgaggacgtcggcgcggttacccagccgactgcgcttcaagagaagggcgcggaggttgctgacgttagtggatcgggtgggaatgggaagttccggcctggtggcggcggtggtggaggtggggatagtggtggcgattcgcatatctggtatcttcttggaaaccatcactaccggcaatgcgctacaggttgacccatggagctgagcgatcatgagatcattcattgtcaatgctcccacgcgtccgcttgtcctgcgtctccgaggtggtatgcttgaagaccctcaccggcaatcactctagagctcaatacgtcaagatccaggggagggcattcccccggaccagcagcgtctcatctttgcaggcaagcagctgaggatgcccttgactacaacatccagaaggaatccactctccacctggtgctccgcctccgccctggtaacgaaccgcactgccgccgtccccgtctgctccggccatcaaccatggcgaggagttccatggccgcggtgctcccctccggcgtcccgggggcgtccagggcgccgtcctggccgtggcggcgctccggcccgcgccggccgccgcggagctcccctgagtagagcacccggccaagaacgacgggtcgctcagcctgctcgtcatcggggactggggccgcaagggcacctacaaccaatccagggtcgcggagcagatggggaaggtcggggagaagctggacatcgacttcgtggtctccaccggcgacaacttctacgagaacggcctgacgggcgtccatgaccagcagtttgaagaatccttcaccaatatctacaccgcccagagcttgcagaagccgctggtaccgtcgttagcggccacggcttggaaaccatgactaccggggccatgcgtgcacagccgttgacccagtcctgcgcaagctcgatgagcgattcgtttgcatgagatcattcgttgtcaatgcagagatcgtggagttcttcttgggcctcgacaccactctccagcttggactcccgaaagacgctaactacgatgctggagaggtcagcatctggcgcctcgagagctcaaactacatagccaaggacgaggcaatgatcagcaccaggagattttcccccggccagcagcgtctccactttggcgccaagcaccaggaggacgtccagagcacgctacccaccacatcctgatccatccccctcaccagtccgatgagtcgccccggaaatctactgcaaagtggaagattccgtgttgggcatcactctcgcttgtgtgaagtagtaccatcaggtcatggtgaagctcctgcaattgcttcttccagtcctcaaggttaatggcatcgacttctacatcaatgggcacgaccactgcctggaacacattagcagcagagacagtccaatccaatacttcactagcggaggcggttcaaaagcatggaggggagtctaccagccaaatgatgataagctccagttcttttatgatgggcaagggttcatgtccctccagctaaaccaggaccaagctgacttcatcttttatgatgtttctgggaaagtcttgtacaagtttacctcgcgcaaaacaaactacttccagccctccatctatgtcactgcagaatgagggagatgcagatcatggcaggagaattagtttggtagcgctatttgtgaaaaaaattgaatgtgccactgtggtaacagtggtaaaggtaatagattggtattaagtatggtgcgtggttcagcgctgaagaaatattaaactggctgtgaattgtctacaataaaggagcagagatgctcagtatggtgtccattggttctgatgcatacaatagtaacagggatctattgatgcgatgtgcatttagagaaatatatgcataaactctaatattgtactctggtgggtgcccctgtcgctcgtgtgaagtgttaagtctcgtttgtgtcaagtcctaccgtgtctggtttcatggaccatcgagtccctgtgagatgtgttggtttcgtttaaacagttgtgagatgtgttggtttcgtttaaacagttgtgagatgtgttggtttcgtttaaacagttgtgtgatgtgttggtttcgtttaaacagttgctgctatagcagtacctgcccgggcggccgcagttatgcatgtttttcctgagtactaagtgatgtcgagtttgcatctttgtaaccttctgggttgngctgtacttagcttatgcttatcagatattactncttttgttc

SEQ ID NO: 15724 - DNA, 520 bp, Triticum aestivum
  Clone ID: PAT_TA_15724
gggcggttctgtctggcatgatacttcaggtcccagcaccggagacgacctggtccaacgaagaccatagccatccgcgcttatgcgcaacatctatttacagtggttgctgatcccaaactcgcccgggcagaagatgcacatcatggtgtcttttgttcacaacgagtataacctggcctacgaagccaccatcggtgtcgagttccatacccgcacgctcgtcatcgaccacaatttcgtatggacccagatctgctacacctgacgccataaaaggtgcacagatggctctagctcataatacaaacgcgcttaactaactctgatacactatgacatcacctaatcgccaatactcttaatatataccctgctgactggtggaactgacctgccatgcaaaccaaaacactgacatgatcctgtgtggataatacatctaccgtcaagatcagcgctctgccttgcactgacgtagccacagacttgggggagaaagagaacactctttttgccg

SEQ ID NO: 15725 - DNA, 513 bp, Triticum aestivum
  Clone ID: PAT_TA_15725
gatctattcacggattccttcatccccaattctgctctgcctagggttacgagagagactcctcctccgccgctgcgggatccctccgcagccgattgctgtggccatggcacccctcccatctcctcgacgtgatacactaccggttcgctatgagctgctccgggactttgtcttcgctcccatggcgagcacttgcgccacgtccgccggctttgctccccgttggaaggtcgcgccggtgatggtggtggttcaccagccagatttcgtcagagaggaggaggttgaccggccagatcctgatcctccttgcaccatcgccgtgccgttgccccaatgctcgtctcgatgcgccgccacccgcatcctagtaatttctcgatccaatcttcgtctcgctttctcatctcagagcatgacgcctccccttttcaagatggggagcccgagcgacctcgagcaactgtcaccgtcgccgtcacgtatggcctggcgagctcgtacagcgtg

SEQ ID NO: 15726 - DNA, 1116 bp, Triticum aestivum
  unsure (1)..(1116): unsure at all n locations
  Clone ID: PAT_TA_15726
agcagcagggggttcaatggtgcatccaaatgtcccatgtatgctgttcactccaatctgcccacactcgctgtcatttagacctgtcatccttcctgactctgcacggcttgaattgaagatcccggacgacgcgagaagcaacgcgtgggtgtcgttcgacggcaaaaggcggcagcagctgtcgcgaggagactccgttcatatatccatgagcgagcacccgctgccgaccgtcaacaaatcggaccaaaccggggactggttccgcagcttgatcaggtgcctgaactggaacgagaggctggaccagaaggcgctctagaccctagcatgttcctgtacatacatagctctatacatagataacctccttgtgttagaagatagatgatctttttctgtagcatctgtaacatcacaggagacgagcagactttttgacctgacagtgacagtgacagcaggtgatggtaacactgatagtgtttgtaattatctgctttgtaaatcaacagtatagctcattatctctgggcctagcagaagatgacagcccacgcgaagatgatagcccattgtaatgaacccctctatttttgctcaaacatatatatctaagctgatggctacttttcttttttcaaaaaaaaaaaaaaaaaaaaaaaactcgagagtacttntagagcggccgcgggcccatcgattttccacccgggtggggtaccaggtaagtgtacccaattcccctatagngagtcgnattacaatttcactggccgncgtttacaacgtcgtgactggggaaaaccctggcgttcccaacttaaatcgccttgcagcacatnccccttttgcccagctggcgtaataacgnaaaaaggcccgcacccgatcgcccntttccaacannttggcncaanccttgaaatgggcgaaatgggagaatcccaatttttttaaagnggtnataaanggggggttaaaaacnaacgggattcnntaaatngggnnnggggggnntttttaaaaantnnncaaannccccnaagggggttttattttttnagggcccccctnnannnncctttcnaaagnntnngnttnnnttgannc

SEQ ID NO: 15727 - DNA, 820 bp, Triticum aestivum
  unsure (1)..(820): unsure at all n locations
  Clone ID: PAT_TA_15727
ggggaggagcgggaggatctggggggagcgtggtcttccaggagaaatttggcgcctcaaatcttgaagattagttctgattagattcagttgaccaggcatacgtcggcctgccccttgtgcctcgtctccatccccatcttcggcactcctaccactgctcaagtccgcgtccgtgatgcagctggcgaagtattattttttctgtgttttctccatgtggatttaaccttacatctccagcgacaaaccttttgatggacccgcataatgcagagttgtccctggctgactagggccaagttcccaacaaattcaagccgctaaagcttggcaggcattggggtactattaaagggaaacccaagttcctgcatataattggatttgccgagaagcgccggtggcgtgcacggttccggcgtcttttcagatttttgtggggtccttccctttgtgtgttccgcggcctctaaataaaaggttacctaatcccgtttaggtaccaatggaggggaaaaaaaaggtacgcccccctttacccttaaatcaagcaataaccttttggtttggnttcattaatggcttattcaaggaaaatggcctttaaatggcttttgggcccaggaattaaaaaaacccattgttttaagaaaaaatgggcttttattgggcttgggaaaaaaaaacccggggttttttccttttctaaatggaaaatattttttgggccaaggtaaattgggccttttgggccttttgaaaacggttctttctttttacccctggggtgaacccacccaatttttttaaccaattt

SEQ ID NO: 15728 - DNA, 483 bp, Triticum aestivum
  Clone ID: PAT_TA_15728
gacggtcgacaacatatatggatgttgacgcagacggctgcctagttacgacccataccccaaccctgcatatctacatctgccgagcgttctccatgaggcccctgaccccgaccggaggcctggcaaattgggtcctcgctggtagcgacgcgtgcgcgcctaggctcaccagggcgctcggcgtgagccatgacacacggatcacatagcccagtgccgacattgctacgcacaacgatctactcattgtctgcccaggagtactaacgcgactgctagtcgacaagaggatactggaacacccaggctgctgagtcgttgttcagacctgatgcacagaccatcacagagagctaagcgagtttggcgtcatttgctgcttgaacggatccactatctcttaaccagcggcatatgacatagatctgcactccgacatctggatctgatgataaccctagcgatcagagaggattcgct

SEQ ID NO: 15729 - DNA, 744 bp, Triticum aestivum
  unsure (1)..(744): unsure at all n locations
  Clone ID: PAT_TA_15729
ccatggcggaccgcggcggcgagcgtggcgtcggcgagcgcggcggcttcggacgcggcttcgggcgcggcgggcgcggggaccgtggcgggcgccaatgctgctccccacgagcaccccccaacctcttactcttactagnctctagctcggtcttctttttttatgtctttgatcaccagacatacgtagcccctctcccagagacgcttgctcatcgaagtgagcacgcacggcatgcgtatggcccataattgcaacaaaagaggtgcgcactggggctgactgttgtatttccttgccatggaatacccatcgttttaattcaactattgcgggtttactttaaaaatggctcgcgaaatagtggttttacccaaccaatatatattctttggggcccgctttaaaatcggcaaccttgcttatagggatttttaaagccccttgtgttgtggattaggtgggttgtcaccaagcctttttgcatctattaccggaactccaaacccgaattaaatattatctttggcgccgcgtttttctcttaaaggggtaagaatagacctgtttccgataacatcggaatccccggttgccagaaatccaaggcaaggtttcgtttctcggttatccacttgcaccttgttgtagcgaaaaatagcgtttaaaatgtaatcttaaatataaggccctttctgttcttgaccgctgtctacttaagataactggcttcgaaggggg

SEQ ID NO: 15730 - DNA, 1076 bp, Triticum aestivum
  Clone ID: PAT_TA_15730
gaaactatacttaagtctctttgcgtaactcgagtactcgaagcctccattcgcctccgccccttcgcagcgccgctttcgccaccgtctcatcgagacatcatacatggcggcggtcgcagcagctcgcgccggtgcagcacgggccgggttccggcggatgttctccgtctccgccttcgctcccccgcctccccccacggctcgccccgcggcggagccctgcaacaacctcttcgtctcaggtttgaataagcgcacgacatctgacggactgagggaagccttctcgaaatttggccaggttactgacgcaagagtcatcactgatagaatatctggatactctagagggtttggctttgtgagatatgcaaccgtagaagaagctggtgcgcctacgacagttcgcagcgccgctttcgccaccgactcatcgagacatcatacatggcggcggtcgcagcatcgcgccggtgcagcacgggccgggttccggcggatgttctccgtctccgccttcgctcccccgcctccccccaccgctcgccccgcggcggagccctgcaacaacctcttcgtctcaggtttgaataagcggacgacatctgacggactgagggaagccttctcgaaatttggccaggttactgacgcaagagtcatcactgatagaatatctggatactctagagggtttggctttgtgaaatatgcaaccgtagaagaagccggtgagggcataaaaggcatggatggaaagttccttgatggttgggtgatattcgcggagtacgccaagcagagagaagcccagcagccgccacaatcagctgggacacagtcatctggctaccaataccctagctagttagttctctcgatcagaaatggcttgttctaaatttatgctaccaattggaagtagatttccaataaaattgttggggaagggataaaatctagtgttggtcgctcgaactattcccagtacggttatggacttaattatagtttcacttgtgtgcttggctgttgcctgctggctaatgctactttgtgtacgtgtgtgtgtg

SEQ ID NO: 15731 - DNA, 620 bp, Triticum aestivum
  unsure (1)..(620): unsure at all n locations
  Clone ID: PAT_TA_15731
ggggcccttcgctccccccagaggccagagacggacacgatggcggcgcccacctcctccgcggcatccaccctcgcccccttctcccaccccaaaaccctacccgccgccaccgccgccggaggctcatcctctggcgccttctctccggccgcctcccaccccgcatgcgccctatcagnctcgggcgcccgccgccgtgcggtcgccgccatggtcgccgccgcggtcaacgaccgcgccgacatgccgacgctcaggtaatacagcaccttctgctacaaagagtaccgtctcacgtggccgtggcacacatgagctccattatggcggcggcccgcccactgccctccctttccggctaggcttggaaggtacgttcacctcgaggggagcagataaaagaacctcctttttggcgctatgaatagtggattgggaaacccaccccgccagtttgctttttcaaaaaaaccacagggggctcttgagggaacccgccttggtgtagagccacagtctcgcatataaaaaaattggggaaagggggcgaccccaatgtgcctcgcgtctaatattccatgtgggtgtaaaggagaaaaacccaccccggagaaccc

SEQ ID NO: 15732 - DNA, 950 bp, Triticum aestivum
  Clone ID: PAT_TA_15732
gccttgctggtaggtccctaggtggaagttctgacgagtgtcactgggcagatggctttccattcaatctccatatctatcaaatgttggtagaagcttgctttgatagtgagaatggtactgtggttgatgaaattgatgaagtgatggggttattgaagaagacttgggttattcttgggattaatcagatgcttcacaacctctgctttacctgggcgttgttcaaccattttgtcacatcggaccaagtagatattgagttactttctgctgctgagaatcagttaaatgtagttgtaaaagatgcaaaaaacgcagaagatccagattactgtgacgtattgatctccattttaagttccataacgggttggacagagaaaagattactagcttaccatgaaactttcaatgctagcaacattgtttcgatgcaaggtattgtcacaataggagtctcagctgcgaagattcttcttgaagatatatctcaaaaacaccccgtccgaaggaaacaaaagactgatgtggtgcgtggcaagatcgaaacctatatacggtcctcgctccgtactgcttttgctcaaagaatggatgaggcagactcaaagcgatcatcaaggaatcctgtgccagttcttgcaatcctcgcaaaggatattagtgaccttgcttcgaaggagaaaaatatctacagtccaatactgaagaaatggcacccgcttgcttctggtgttgcagttacaacccttcattcttgctttggtaatgagctgaagcaatttatggttgggcgtacaaagttcacacaagacacggctcaagtgcttaacgctgctgacaagttagagaagagtctggttaataatgcagttgaagactttctggacagtgatgatggaagcaagtcattgattagacagatgccaccgtatgaagctgaaaat

SEQ ID NO: 15733 - DNA, 1093 bp, Triticum aestivum
  unsure (1)..(1093): unsure at all n locations
  Clone ID: PAT_TA_15733
cccgccgcgccgncgtgcttgcccgccccaccgccgccgcggcacttctccgccacgcgcctgccggggcgcggttctcgtcgttggcggactgcagagccttggttcgaggcctccgcgacatctccgaatacctccgcgccgagaaggacactttttcgccccttcggcgcccgcttcgngccaantccgattccctccgcgccgncacccacgacggagagatcgtcggcgtcctcaactccgtgatccagtcccaccaccgcgacctgattagggggattccgaaggacttcctttcgaaatcagcaaaacggatgggattcccgacattactcttacaagaagtttgaagggcgagcanattgaggtcttggtttccatgcaccaggatgaggagtgcaacgttggcctgcaggaagactcaaatcaggaaggcaaaagccgagacctccccagaagaatacagctttcctgtcagggtcattgtatccaaggccgacggctcaagcctagaanttcaacctgcacagcttaaccctgataatatcgtcatcgagaccttgtccatgaggcagaagaagtcaacaggggcagaggaagcagacgatgtggttgcgtcggagggcacggaaaatgatctagctgtatatgatgagggtcctcatttccatgagctggacaagagcctgcaggaggcattccataagtatctggaggtgcgtggagtcacacccatgacggcgaagttgttgcgcgggcacatgatgagcgaggacagccacctttcgccaaaagagaagagtgacgtcaggcgcaggcgtctcgtctggctgttgaagctgtgggatttcgtcaagaaagattaacactatgtatgtcttgatccatcctgtgcattggatcagaggcattgttttcttcggctgttctgtttcctcggagctgtgacactcatcctctagactagctaggatccttttttgtaattgtgtaggttgagaaaaaaataatgccttattttttagagtaaaacttgtcgcgcaagttcagcttcatatacatcaactttntaacgatacattgtttaagn

SEQ ID NO: 15734 - DNA, 516 bp, Triticum aestivum
  Clone ID: PAT_TA_15734
cgctcgatcaaatctggatctcggcggcggcgcctcctccctctccccacgcaccgacgcatcctttggagccctccccgccacctcccttccgagcgcccacgcgactgcccctcctcgccgtatatcgcggccgtgagagcctcaagaggctgggcatggaggaccgcttcaaggggatgatcttcttcgagactctgaacccgctgtgcctgctgactgctgttgccgtgcgaccaggcgcccgagatcttcgacatcgctggtcacttcgctgggccaggcagcgccaacgacctgcctaggatccccgattccccgtcatatgcaagcccaacgtcggcgccatggagccgtccctcaagatcgccaacgtcaacactacaaggcggtaagccctcccctcgagctcgactccagcccggcgacgacgacgacctgattcctaccggtggacgatgatgtgctctggcccaaccgcctcgacctcaacaagcctcctcaagattcgtcacc

SEQ ID NO: 15735 - DNA, 452 bp, Triticum aestivum
  Clone ID: PAT_TA_15735
gggtcgacatgcatgcgccaggggaaccaggcgacttgccgtacgcggtaggttgccctgcgttcactcgtgagctgcggcaagtccagtggcccagcaagaagaatttcaagccagatgtaccggagaagtacgacggcaagtcgcatccgtcggagttccttagcatctacaccattgcggtgcaagctgccggggggcgagacgacaagatccttgccaactacttcccgctggtgctcaagcccaacgtcaaatcctggctcatgcacttgccggacgactctatatcctcctgggcagatctatgccatcagtttgtcagcgcctttacaggcggccacaagcctcatggccaagaaagcgatcttcatctgctcgcccagaaggaaggagagcccctgcgcaagtatattcagagatcagccgtgtacagcacaacatcccagatg

SEQ ID NO: 15736 - DNA, 516 bp, Triticum aestivum
  Clone ID: PAT_TA_15736
ctctcccccaagctgtggtacctccgcctcagcgtcatccaggcgcaggacctgcgcctgccatcgccgccggacgccgccaaggccaagcagcagcacttcggccccaccttcccggagctgtacgtcaaggcgcagctcggcgcccaggtgttcaagacgggccgcatcgcgctcggcagcgccgcggccggggcgtccaacccgagctggaacgaggacctgctcttcgtcgccgccgagccgttcgaccctttcctgacggtcgccgtggaggacgtcttctccgggcagctcgtcgggcaggcgcgcgtgccgctctccacggtgcaccgccgctccgacgaccgcgtcgagccgccctcgcgctggctcaacctgtgcggcgacgaggcccggccctacgccggccgggtgcacgtccgcgtctgcctcgagggcggctaccacgtgctggacgaggcggccaacgtggccagcgacgtgcgcgccgcctctaagcagctctccaagccg

SEQ ID NO: 15737 - DNA, 1697 bp, Triticum aestivum
  unsure (1)..(1697): unsure at all n locations
  Clone ID: PAT_TA_15737
cgtccgaaaagtgtaagcgtactgacacatgggtatgggagttgcacgaaatgtccatgaacctgctgaaaagggtggatgagtgtccttcggggttggaaatggatctttcatctttgtcatctgacactagggggggcatagaaaatcaacctatctgggtcacccgattacatatccaagccatattgacagaactggatttcatctcaaggatatttgaggatgtggcacacaacctgcggttcgtgttgctggcacacaaagcacctctcaatgcgctcgtgcgctgttccaagaggaacgagcatctccactggctcatgaagcataaggatctgctctgcttcgaagccagaaggaactcggtcttaatgttgttttctgaggggaaaggatgactatgggggagctgcatgagatgttgatcgacccgtcacgtttactggatgagtccttcgagtacatcacacaggccaaacccagtgagcttcacagtggtctgtttatggagtttaagaatgaggaggctactggccctggtgttctgagggagtggttctgcatggtgtctcaagctctgttcagcccacagcaagtactcttcttgccttgtcctaatgatcaacggaggttctacttgaatggaacatctgttgttgatccactgcacctgaaatactttgttttctcaggacgagtaattggattagcattgatgcataaagtgcaagtagggatagttttggaccgcaccttatttttgtatcttgccgggagaagtattacattggaagacatttctgctgcagaccctttcacgtatgcaagctgtaaaagaatcttatatatgggtgctgccgagattgatgatttaactttaacattttcccgagatgttcataccttagggtctcgaaagactattgagctttgcaaaggagggcaggatatctctgtgaacatcagtaacagagagcactacattgatcttcttattaagaatatctttgtcgactctatttctgagcagctggccaattttgcaaaaggatttggtgacatattagctaatccgaaactccgggaggtatttttccgggtgtttgggatctaganagactttgaccgaatgttagggggaaagcaacaatactataaatctgaaagattggagatcacatactccaatataatgggctacaaagaaaaagatcgccatgttaactgggtcccgggggccgtcgagagcatgacagttgagcaacagaggcagctcctcttcttctggacgtcagtgaaatatttgccctcagaaggctttggtgggctgagctcaaagctgtacatatacaagacaacggagtcagccgaccatctcccgtcttcgcacacatgcttctaccgcctctgcctccccccatacccgtccctcaaggtgatgcagagccagctgcagaagatcacacaggagcatgtgagctgcagcttcggtacgtggtaggatgcttggctgtgggaaacccaaagtggtacattttgtacatatcgagttagcaacaacccttatctatcccatttaaatctattgccagtagagagcttaaaaattaggctgccgtggtttgatttgtatgtaggaaagttagcgtccccggtcgtttaaccttnatgtaggggaatcagaagagtgcaag

SEQ ID NO: 15738 - DNA, 648 bp, Triticum aestivum
  Clone ID: PAT_TA_15738
atccatctctgcaatacacatccttctctgtctatttttctccacctccctctcagcgcttcagtacttcaaggcttctagctagccctgtagtaatggtagcaatgccaaggactaccatcgtcctctccaccatcatcttcttccttttttccgctcatgctagtggctctgacactggcaagcccaaggcgaccaagctcatggtggaagcatgcaagaaggcctcgatcaacaacccctgcaacaaatctatcacgcaagaattctgcttgtccacccttcagtcggacaatcgaagtgccgaggctaaggacctccgtgacttagtgcttgtcactgtcgacatctttaagagccgtgtcactgccgctagtcgtaagatcaagcaaaagctgcaagatgccaagaagggaacaagtggcaatgcacgttcttagttattgtgaggtggagtatgaaggtgtggtgagacgcctcaacgtgtgccacggcctgatcaaggactaccaaggtgacaagagtgggcagcagttcttgcatctgcccgactgtgtggatattaattacacccccaccctcgtgtgggggtttgagcttccagacccccctgctgccgatgcgctcttcggtgaaaacgaggagttg

SEQ ID NO: 15739 - DNA, 482 bp, Triticum aestivum
  Clone ID: PAT_TA_15739
gcgatttgaaaagatgaagcctatggtgaggtccaacagtggcggcggcagcgaccgaaggggttggctagcgtggaggaagacaaagtgtggcaagaactccaacatgcccaagcagcctcccagtgccttctttttgtttctagaggattttagtctggagtacaagttggaacacccgaacgtcaaggtgtcctcagtgatcaacaaagcaggtggtgatcgatggcgagctatgtctgatgcagataaggcgtcgtattgcgtcatggctgagcaccgtagagcagagtacgccaaggcgatggaagcgtacaataacccaggggaacccggccagcatgaggtggcccacaaggtggagccggctgatgtgatgtacaaccaaggggaagtcggccagcgtgaggtggtggagcatgacgcgctggcgccatcgacgaccacgaggtcgagcctgcggatgagatgtcgaatggtgc

SEQ ID NO: 15740 - DNA, 516 bp, Triticum aestivum
  Clone ID: PAT_TA_15740
ggagcacccgcgctcgatccccatggcgcgcctcccctgtcaccaacgccgccctccttcctcttctgcgccagcgtcgtccatcctcgtcgccccgctgcatcgcctgcttcctcgtcgagtgcctccttgccaatccccgtcacccgagcgcccgaggagaggagcccctcgagcacctgcacccgcaaccatcgtcctccacgcccagcaggaggcccgcgtcgctcgcctctcatcgccgacttgcccatcctcgcatctccgacctcgtctcccggcccctgcctgccggacccggcctcctcttccttgggtctcccccacgaccagccgcctcgtcggcaaccagacgagccaccggaggtcagcaagtcaccgtgccttgaccctccttttgctcctctgcttcctctctctctcttactcgactccatccctctctgttttcctacagaggagttcatctgccgtcatggagcttcgccaccagccaggatccggcatcccgagtct

SEQ ID NO: 15741 - DNA, 483 bp, Triticum aestivum
  Clone ID: PAT_TA_15741
ggcatctcttaagtccaaccctctcattcccaacacaaattcaccgtgtacagcctattaatcctatcaaggcttgcgagagcatgacttctcgggagggcttagatactggttgcccaaaaccgccaaatgcaggcgccgcatgatcaacgatggcccgcagccacaataaccattattccagcagacacaccagacatttgaggattcttagcaaacatacccccatgaacgacaacaagattttgcgcaaacgtagcgaatcacaactacaatatcctgagtcccagcaccatgacgaccatgattcctgtccggacgaggatgacgactatgacgatgacaaccagaacagacctatgactatgacttagcagcagcagcatccattcaccgagtcagcagaaccacaacaactttattctgactcttttcttccgcacaattctgtggcttgctgcatcaacattatcgaccagtttt

SEQ ID NO: 15742 - DNA, 1538 bp, Triticum aestivum
  unsure (1)..(1538): unsure at all n locations
  Clone ID: PAT_TA_15742
cgtccgcccaggtggcagctagcataccacactcgatcgatcatacacatacaccatgccggccgcgcagcacatcgaacgagaccaagacctcgccatgagcagcgacgagttacttcaagctcagctggagctctaccaccacggcctcgccttcgtcaagtcactggcgctcaaggccgccacggacctgcgcatccccgacgccatccaccgccgcggcggcgccgccaccttgtccgagctggcctccgacaccgggatccaccccacgaagcgctccaacctccggcgggtcatgcgggtgctcaccaacaccggggtattctccactgtgactcagcccagcgattccacaaagaccgccggtgatggcgctgcgtattacaagctcacgcgggtctcccggctccttgtcgagagatcaccgcacaacctgtccccgatggtgggcaccatcgtcaacacgttatgctggacctctctcctcaaaatgcctgaagtggtttactcaatggccaagagggagactcggcacagtcgcactcgctcgtccagctggccaacggctgcacgttctgggacaccaccaaggtcgatggcggcttgttcaacgatggcatggccgcggacagccgcatcgccatgaaggtcctgttgaatgagcacggcagagcgttcggggaagtgaaaagctcgctggtggacatcggcggcaaccatggcgccaccgcgtcggccgtggcgagagcgttcccgcacctcaagtgcaccgttctggacctcccacacgtcgtcgccgcggctcccgccagcgacattttgaccttcgtcgccggaaatatgttcgagtatgtcccacctgcggatgctgttctactcaagtggattttgcatgactggaaacacgaagattgcgtcaagataatgcgccggtgcaaggaagcgatcccagcgaaagaagccggaggaaaggtgataatcatcgacatggtggtgggatatccggtgactcagcccaaccattccaaagaggcgcaggttttgttagatatctacatgatgggctccgatggaatggagcgagaggaaaacgagtggagcttgattttctccgaagccgggttcagcgactacaagatcactccaaccaatgggattcgatcaattatcgaagtatacccttaaatgtacttacttccacttcggagatactatctccttccgtccgtacgtgtttattagtcttgcacgtgtaattaacttggtaaattagcagccaagatacacgtgcaagacttataaactggaaaggaaggagtcgtcatttgatttgtaataaatctcaccaggaactctctgtattattgcatttaagttttactttttgtttatagatttttcaaatttgcttctctttagtttatttcattttttccactcattgtaccaatcctatgaaatctacataaattgttcttttctttacataaaaaaaaaatgcccgtaccgacccccaaanatcttacccccacggc

SEQ ID NO: 15743 - DNA, 604 bp, Triticum aestivum
  unsure (1)..(604): unsure at all n locations
  Clone ID: PAT_TA_15743
gagaagacgagccccaaaccctagcctcgatcctcgcccaccccggttcaccatggcgctatgcagcctggccgcgaggatgcgagtccctgccgccgccgccgccgccgccgcccggctcccgtcggcccctcgtgtttcgccggcgtccggcagtcgggccctccctttctcctcctcctccagtaagagcgctagagactggtacctgcttcagcgagaacgttatgacagtgtgacaagagagttaaaaaactacagccgtgaggttgtgtggactgaaaggctagctaagctgcttaatgtggtatacgtgctgggtatgccttttatcgttggccctttggtcttaaaagggattgccattcggagaatgtgagggggtagcagccatccactgcttcgcttattactgctgatgcatgtgaaactcgtagttcagcactccccttggggtttctgcctgacttgcaagagcagataaccatatgggaataatggcttgttgcgtctgtgtcttgacccgcattgcgtcgcggataacctcgtgattatggctntatgtagatttgtgcaagcgtagttgtttgctggtatggtttct

SEQ ID NO: 15744 - DNA, 675 bp, Triticum aestivum
  Clone ID: PAT_TA_15744
gccatgggagcatggtgggcgatgaagaagagcttactagtgaagctgagtgtgtatctgctgatcatcgccatggctaactgcgctcgggataaccctgactccgttgccaagcaccctcccgtatccgtatacacctgcgacgacattagcgagacgtggcgcggggggttgtgcgccaagcacggcacctgtaacaagccgtgccgggcggaagggtacgactcgggcttctgtgccgccttccccttcctgttctactgctgctgcaagaagaactgtcccgaggctctgcagccacgcaggagcagcttcgtgtgcggataatacgtctacattattagtgtacatgccatgttctagtagtatggatgcgtgcatgcatggttggctgaaaataaataaatctcatttcgaccgcgttggggcctcctggccgacggccatgggatcccctcccggcctttggcggttctgctggctctgcctcactgtcctcccacccctggttgttggattgcagctccccgtcatttcgcatggttgatctcttgtcttgccacccggtacttaccaactgcttcagggggggcgcgtcaccacataggcctatagcgaggcagttcaatgccctgcccgcctttacaacgtctgcctgataaaacctgcgtcccc

SEQ ID NO: 15745 - DNA, 1262 bp, Triticum aestivum
  Clone ID: PAT_TA_15745
tatgcttgtctcaaggattgatcccccagctcgaaattacccccactaaagggcgagaaagctggggaggcgaagcgaaagcaaaaccgcaggactagcaggagagacagagatcccccgaaccctaaccctaccagcacctcccgtcgccggttgagatggcgatggacgcggagcggaggcaggcggagctgatcgagcagttctcggcgcaggcggcggcgctctcctcggctcctcagctggcggcgctcgtgctcgaggccacctcccacccggcgctctttgccttctccgagctcctcacccttccagccctctccaagctaacgggcacgcagtacgcctcgtcgctggacctgctccgcctcttcgcctacggcaccctcaaggactacaagagtaattctagcgccctccctgcattgttgcctgatcaagcccggaagctgaagcaactcagcgtgctaactttggctgagtcaaccaaggtacttccatatgatcagctcatgcaagagctagacgtttccaatgtgagagaacttgaagatttcctcatcaacgagtgcatgtactcaggtattgtcagaggcaagttggaccaactgcggcggtgctttgaagtacaatttgcagctggaagggacctcacacctgatcagctaaccaacatgattgagaccttgtctgactggttgggaacatcagataatttattacaccacattcaggagaaaatcaagtgggctgatacaacaagtgaattgaacaagaagcaccagaaagaatttgaagacagagtggaagaagccaagaagtcagtcaaggcagacaatgacttacgggggcatgacgactttctctctgaatctggaggaataatggattttgaggaggaccgcatccgaccaaaaaggaggcgacaaccaatggcgtagtttgactgaagtatcacacctatggtccctgctcgcagaagtgccgatgctgttcttgagacattttgtcaccggagtttaggagcatcaattagggtgcttcccatgaagcgagtctctgttgagaaaacgcttgtttttggtatgagatgttacaaagagatgatttactgccgcatttatttagtagcacgaagggcatatgggtgacttcgcactgtaaagattaggttctgaaaaggttgggacctaaggtgatcgctcagtttggtttggttttaaaaaaaaaaaaaaaaaaaaaaaaaaaaaaaaaaaaaaaaa

SEQ ID NO: 15746 - DNA, 825 bp, Triticum aestivum
  unsure (1)..(825): unsure at all n locations
  Clone ID: PAT_TA_15746
ctcgcgcccattgcggctcgagcgaaggccgccgcaccctggaatgtagggccgggtaaagaaaaggagcaagactccgcccccccccccccgctcccccccctccgcctttacccccccgcccccccccccccgcccccccccgctctcatccgcagcgtcgccccgccgcctccctccctccccagacacaccaccatcctctgccgtttcttccattggatgtgaatggaaggtcggaggacactggaatgtagggccgggtaaagaaacgccagcagagaaccccccccctgccgccgcgcccgccggaaatctctccgcctttactcgccgggaatctgatccgatctgattcggactgatttcttttcctaaccgcccgcccgctccccttcgccgaggggacaagaaaagaaaagaaaagaaatgaagagcctgcatgtgcttcaagcagggcgggccgcgtgggctccgcccgcggcggcggcccgcgcggcgccccccgccggggggcttcagcccggccccgtcgggggccacgcccccgctgcccccgcccggggcctcgatcccgccggcggcccggccctcccgagcgcccgcgcccctccctcctgccccgcccgcccggcgcccccacccgccactgccccctccccccgccgcttccccgcccnagtcgcatcaagatggtcagcagccaggaggacccgcgctcgccgcgaactcacgcattnctccaagnncctctctcggctcgcacaaaatctcncttctcnagttcagaacacanatcgtntaacgatntgagggtcctagatt

SEQ ID NO: 15747 - DNA, 639 bp, Triticum aestivum
  Clone ID: PAT_TA_15747
gcagatcaaggaatgccaggagctgggggtgctcgtcgacagggacgaccactggagtcagcgcgcattgtaagatcaagacagctgggggtgctcgacagggacgaccaaggggtgttgctccaaatcttcaccaagccagtgggggacaggccaacgccgttcctggagatgatccaaaggatcgggtgcatggagaaggacgagagaggggaagagtaccagaagggtggctgcggcgggtttggcaaaggcaacttctccgagctgttcaagtccattgaggattatgagaaatcccttgaagccaagcaatctgctgcagttcaggcatcataggatagaagctggaattggagccggagaagctgatccagtgctttttatcatggtctcatggagcaaaagaaacaatgttcattgtaatatgcgacgcacaattatatccgatgttataattggtgaagctgaagacagatgtatcctatgtatgatgggtgtaatagatggtagagagggggctcacacatgaacaaaatgtactgttggcattgttgtacaatcttgcttgcaagtaaaataaagaagaaccgattttgagttctgcaaaaaaaaaaaaaaaaaaacggaacgcgtggg

SEQ ID NO: 15748 - DNA, 926 bp, Triticum aestivum
  unsure (1)..(926): unsure at all n locations
  Clone ID: PAT_TA_15748
ttttgaagaacgaacggcgactataaataaatatcagttatacaaatttacatgagcaacggtgagtcggtgactgcctggttgctgaagcagctttgctcttattagtacagtattacattgtaaggcaaagaaatggctccagcttattgctattatcacatgacactaataatgaagcccacccaattctgggaggacaatgtaatgtacttactattcccaatcccagctgcaaattggcagagggaccatatcaaccaccagccatccatgcctcttcatgggctcaggcaatgctttcccggctcggtgtagttcacctccagctgctcaaccttctcaaacttgaatccgcggatcctcgtctcttccatctccgaggtgtccctgtggtcgacgtgctggatagtccagcctttgttttccacatgaccggtgactttcacctctgcttcgtcgacggagttgacaataagagcgccgtccaaggaaagaccgtcgataacgacattccggccattgatgaccagaaccgatctctgggaaactgaagaattgccgtgcacctttcgtttgacgtccttgaacgtaagaccccacctcgggctccaggtcacgcgtggccagacctctacctcttgaccattgaaagtgctgactacagggtcagatatttgtgccccggcctttcttaaaatgaggctgtttgccctgtaaattgccatctctcctgaggttgcactatgaaaaggattgccttttggaactttagctgcatcttcaggattgttctttacaggagcatatgcaagccaagcatccatcaccgtaaacccaacttttgccgttggaggtagtgtttcggatatcttgcatcatgcactcaagacgagtggaggatttaaatgtgtnttggtagagnc

SEQ ID NO: 15749 - DNA, 795 bp, Triticum aestivum
  unsure (1)..(795): unsure at all n locations
  Clone ID: PAT_TA_15749
aaaaaaaaaaaaaaaaaaaaaaaaaaaaaaaaaaaaaaaaaaaaaaaaaaaaaaaaccccggagccactaccacacgcagacaagaagcgaacacacaccatgcggcccacccccaccaccccggcagccaccggcgccgccgcggtgacgccggagcacgcacggccgcgcagaatggtccgcttcaacccgcggagcgaccgcttccacacgctcgccttccaccacgtcgagttctggtgcgcggacgccgcctccgccgccggccgtttcgccttcgcgctcggggcgccgctcgccgccaggtccgacctctccacggggaactccgtgcacgcctcccagctgctccgctcgggaaacctcgccttcctcttcacggccccctacgccaacggttgggacgccgccaccgcctccctgccctccttctccgccgacgccgcgcgccagttctccgcggaccacggcctcgcggtgcgctccatagcgctgcgcgtcgcggacgctgccgaggccttccgcgccagcgtcgacgggggcgcgcgcccggccttcagccctgtggacctcggccgcggcttcggcttcgcggaggtcgagctctacggcgacgtcgtgctccgcttcgtcagccacccggacggcagggacgtgcccttcttgccggggttcgagggcgtgagcaacccagacgccgtggactacgggctgacgcgggtcgaccacgttggtggggacgtnccgggagcttgccccgcgccgtgggcctacggnggcggggggcacggggg

SEQ ID NO: 15750 - DNA, 2748 bp, Triticum aestivum
  Clone ID: PAT_TA_15750
tgataaggaccaaacccaaaactcctctccattgttcagcgtgcacttctccaagtccaaaagccaggcacggaatgtccagattggcacgaatttttgctattcgtaccacacgctgcactcgagacgcttcccacccccccccacttaccgctgccacgtcctggttctcgaagccgcgttgaactgtctgccgcgggagaggggccgaggtctggctgtcgccccttgcaagtaagggcgggccccggtcttgtcggccgcctccgccgcggccaacccagtgctcttcatcccatctccagccgcgggcagagagaggagacatctcaagcacatgaccccgattgcgactagcggaccgagctcgcccgtaccggcgggcgtggccggcgatggcgaaacctcgatgtccaaagattcgcaccggaagatgccactgtatacgtgctgcttgtttccttccttgttcatgagctgaagcagaaagtgttgcacattgaaacgaatcctgctgcccctcgggatctggttcttgctgttggtgttgggctccagttcagtttccaaggtctcgatctgaacttgtatgctgaatttggagtaagatgtggctcgctatcctttcgtgtgttatattgtgatattgaaagtgtgccgctgtagccagttgagtatatggcgaaaagatggaaaagggtgcttcagtccattcaggctaaggacgaagaagcaagatatcttggtgatattgatgccatgtacagcattgaagactcgatcttaagttccagcttcagggctcttcagcacagtagctaacgcaaaccttggatacaaccccgtggaaccacagattggcttcggtcactgtctgtaggtcgtgctttaagtagtgcacccaaaaagcgagcaagaattgcagcaagcatgcggcgacaccatcaggcctgccttgatgttgttgaagaaggccgacatgggggaggtcgtgctggtgtcacgaaggcagcagagggtactaaaggagtttgttggtcaccaccacatcaagggcacctgtccatgcattcttcgcccaccattccatgggtaaggtaccagacggtactgacattcaactcaagccaaagaacataagaaaacttgctgggattggggcttatctgatcgggtatagaattcgaacaacccgtttcgtggataatttatctattggggtaaagaaagtaaacgctcaattttggcgaaggggacaaaaaaaacatagcaggaaatgttgaggtcctagtcgaaaaatgcgcattgaccaaggaagcaatgcaatatggccatatcactgcgcatagggtgaataagctttatacaaggttcctaatggatttgtgattttcattgttgagggctgttaaatgaaaagatttttttctaagcatgcaattttcgctgacattgatgaatatttgcacacaacattgcatactttgaacgaaatcttgtatgcagggggttagaaatgttagagggcgagaacacaaatcctcaatgaatagattttattgtggtgcaattttttcagcccgtgctgacaataaggcccttgccacatgaaatcttttccggcctggaaatggcaaaaacaacaaagaatctttgtattgtagttagaaatgtgtacaatcttagcgataaaccgtgtagtttttccttaactccaaggtcctcatattctagtcaaccttggacatctacaagaacaaattcagcattgcatgcttctcttcgccctgctgcttccagcaatacaacgttttcatctccaaagctggatactagccttggcagtaaaggatatatatgcagctgcctttggattagctctgcctttgaatcttctagtggatttgtggcattctggatggatgctggccggcagggaaagatcgaggaaaagattacgtttatgagaagggtggaaagagaaatcctgaccgtaatgttcaacatgtgattgacgagtacagaaaacagacaaagaatgttccgggtggaaagcctgttactttatcggatcaagatatattggagatggttttcttcccagtcgttaatgaggcatgcagggtcatggatgaaaatgtggtgatcagggctgctgatcttgatattgcatctgtccttgggatgggctttcccaagtagcaggggtggcctcatcttctgggcttgatacggttggagcatcttatatacattcaaagcttagcaagtgggctgaaatttacggtgatttcttcaaaccatcatcatacttggaggagagagcgaaaagcggccgaccactgggcgcgccgaagacggctcagcaagctccgacgaggtcacgcatgtgaggttcagcatacgaggcacttggcacggtttttgcttgaacagcgtcaacactgccttcggcacatatgtggtggtactcagaaggacctccagggctgatacaacaatcagaataaataaatgtctaagcatactgttctgattgtagttccataactgtaaatctgtaactatatggtattgtgattctgtcgcaagtagaataaagaccccgtgtatgctgtaaaaaaaaaaggttgtaatttaatgcctcataacagtgcaagtctgtaactctatggtaattgtgccgccattccaagtgctggtttatgctgtaatacaaaggggcaatgcgaaatcccataaaaaaaa

SEQ ID NO: 15751 - DNA, 782 bp, Triticum aestivum
  Clone ID: PAT_TA_15751
ccacatcagttttcccatctctgcaaactccccgctagtgcgatgcagaaatcgcattggcaactgacctcaaaaaaacaacggaaaagaaaacggagatctggatccaagctcaacatggccagaatgtcacaacaattgcatgtgtgggcattgcatacgcccgtgctgagataataccaacggccatgggcatatgcatcacaaaacccatcctcgcacgccagatcgcatctccagttcaattgcaaagcaggtactacatgcgtgagaatattccacacgtatcacaagagttttagcccacacaaaacatcctacagcagctctacagtatgtatatgtcgcgcacacagaagaaaccgagtcaggttttagtcagaatccgatgttagtcccgccctcggggtgaaacgcgcggaccatcttggacaggtgctcgctcatgtcccccctctcctccctccccagcccccggtcgcggcctgtcgccggcccccgactgccccggccggcgccgtacgtctcggggcgccgcgggcgccgctctccgtagggccggtccgcgtggctcgacctgcggcgcgcagccatcggtatcgactcgacatcgagtgaaccctttggctgggttccctctgcgtggttactgaggatctcgccgtgctggccgatgcggctcctgaagatcgacgggaacggcaggggtatggggagcgggcagggcgatactgacagatgggagaactttggttttgtagctctgccttcataagctgagt

SEQ ID NO: 15752 - DNA, 1054 bp, Triticum aestivum
  unsure (1)..(1054): unsure at all n locations
  Clone ID: PAT_TA_15752
ccccttctattcaaatcattgctataaacgcgtgtctatttttttgacttcttttttggtctctctctgtgtttttggtacttggtttttgtgacgagcaaccaagaaacaggggaccggtagttcaaactccgagttaagcattcagtgcgcccaaagggaagtacagagaagtttgatgtgtgagaccgccacacccccccaaaaccagttgaggagattgttgatttgacaacacctgaagttcaaatgtcaactgggtggaatcacaggcaaacttgctactccccatgcaaaaataataacgagtacacagccgagactcccccactcaaaatgaagaaggactactccatggttccaataataggaaaaaggttatttccagaggaggaaagctgtcaacaagaatccagcggcagcaaaaggaatccagtacaactaatggaagaaaaaactataaacagccgtttttttaattttttaagtgctctctgtttgttaatcgttcttttcttttttctgaatttctttttttgtgccatatgtatagtcaggataactcaaaattcatggaggaaacatgtttaggcaagagcgcagcacattggtcaacagaactgatgatttttacaacacaaatctctcgttaggaaggccaagcagtttccgtggaaaagaaaatgtaccaccaaagaggattgtccaaccaagcaggtaccgtagctcactatacggctgcagtgagaggggccaaataatgccacatgagagaaagatgtatgagaacataacatccttggccaatgttgaaggatccaaacctgcagttttgattgacaaaaccatcgccacatttggacagttgggtaactcgaagaaaataggtggccgggtccaggcctatgtcataaatgtgtactgcaggcacctatttaatgaaaatcatcctaggaactcactcaagcactatttcttccatgctgcatctgaatatttcctgggcaaatggaaaaaatgatgaggcaaagaatttgggtggagggaagaaacn

SEQ ID NO: 15753 - DNA, 458 bp, Triticum aestivum
  Clone ID: PAT_TA_15753
cgttcgggtaatattaccaggcaagaggctgtcagcatggtcccgcctttgtttctgaatgtgcaacctgaccatcatattcttgacatgtgtgccgctccagggtctaaaactttccagttacttgagatgatccaccagtcaacaaagcctggagtgcttccaactgccatggtggtagctaatgatgtcgatgtgcaaagatgcaaccttctgattcatcagacgaagagaatgtgcacagccaacttgatagtgacaaatcatgaagcccagaattttcctggctgtagccttgcaaagttctgtccagaagcatgtgcagagtccaagctgcagaggctggaatttgatcgtatactgtgtgatgtgccatgtagtggggatggaactgcccgtaaggctcctgatatgtggagaacatggaatatcggcatgggctatggacttcatcgtct

SEQ ID NO: 15754 - DNA, 1043 bp, Triticum aestivum
  Clone ID: PAT_TA_15754
cagcgaatccccacctcccatggccaccaccgccctcctcctccgcgcccaccacgcctgccggccgccgcaggccccacggcccgcgccgccggggcgggcggcgatcgtctgcagggccacggcgtccgtgtcggcggggcaagcgctgcgctcgctggccccgccgccgcggcccgagctgctgtccctcgacctgccccgctacgacccggcgcgctcccggcccgtcgacctcgccgtcgtgggcgggggcccgcggggctcgccgtggcgcagcgcgtcgccgaggcgggcctctccgtcgtctccatcgacccctccccgggcctcgtctggcccaacaactacggcgtctgggtggacgagttcgaggccatgggcctctccgactgcctcgacaccgtctggccctccgcctccgtcttcatcgacgaccacacctccaagtcgctccaccgcccctacgcccgcgtcgcccgccgcaagctcaagtccaccatgatggaccgctgcatcgcccacggcgtccgcttccaccaggccaaggtcgccaaggtggtccacaacgaggcatcctccctcctcatctgcgacgacggcgtcgccatcccggccaccgtcgtcctggacgccaccggcttctcccgctgcctcgtgcagtacgacaagccctacaacccgggctaccaggtcgcctacggcatcctcgccgaggtcgacgagcaccccttcgacatcgacaagatgctcttcatggactggcgcgactccccacctccccgaggggtccgcgatcaaggaccggaacagccgcgtgcccaccttcctctacgccatgcccttctcgcccaccaggatcttcctcgaggagacgtcgctggtcgcgcgcccggggcactccatggacgacatccacaactccatggacgacatccacaactccatggacgacatccacaactccatggacgacatccacaactccatggacgacatccacaactccatggacgacatccacaactccatggacgacatcc

SEQ ID NO: 15755 - DNA, 997 bp, Triticum aestivum
  unsure (1)..(997): unsure at all n locations
  Clone ID: PAT_TA_15755
gccagtcattgcaagctgagattattaagctcatagaagagaactcctcgcaggcaggaaaactttatgactcaagggagaaagagaagtcgtctgaagatgatttcagtaatctgattggtgaagcaatcaggacagatntccttgggtntttgttttcaaaagccttcacgatgagaggacatcagaactgcaagctttgcatgatgatttcggttgcctccatgcggcaggcaacgagctttaccaagagatcaggctgatgaacaagaagcttggcgatctgcaactcgagaataactaccttgagaaggagctcagcagaaactttaagcatctgtgatggctctagtccagaggttggttctgcaagaaggccgtccgtgcgaagagataccaagctgttgaaatctggcaggaagagcctacaggagagtgcggtgaacgtggaacagcgcaaagaagtcgacaatgctggtcttgaaaaatcaaatgaaatgttgagggaggagcttcacaagctgcagagtgaaatgcaactgcttaagaacaacgagcagccagtgattgatgtcaggtcttgcgacgcagagatctcgaaattgctggccaacatgcaaattgccactgccaacgcagctctctttaaggagaaggtccttgagctcatcgtagcatgcgagagttctgagataagtgaaatagtccagaaggaggtattgaaagaggagatcagtcgaagggaactcctatgtgcgatgcactcgaaaggaccaaagctaaatgcctgtttgaagaattggagaaaccaggaaggcctggaagggntccgacccttgnaatgggtggacttttcaccaggtgcttaggggcgccatttggcaaaaccttgaaagtcaagtgggcctttgggagagaggaacaaaacccccttggtcaactgggccccaaggcaaattggggttaccctttccggaaaccaatactttcaaaaaaa

SEQ ID NO: 15756 - DNA, 672 bp, Triticum aestivum
  Clone ID: PAT_TA_15756
ccacgcgtccgtggagctggtaggttccatgagttgcacccccagtttgtgggttatacacgtggtaagctgcatgaactagtcatgaagtatttcaagagcagggagcttactttagccataaacgaggtcttggatccatggatcgcagctaagcagcccaaaaaggaaatagaaatgaactttcttaacaattcagcttcaaggaaaatcctgccagaagatgctgggtctgtaaaaagggcaaggctgctacctaatcaaagtgacgaagatatcaatatgtatgaggacatccttgccagtcagaatgatgactgcgtccgtgaagacttatgtcatgatgctgctcttgttgaagagaactctactaattccgtagctggaagtgacagctggggtttactgaatgtgcatgtgttagcaagaatcttccattttctgagggcggacatgaaatcactgatttcttctgcagctacctgtaagctctggaacactggtgttcagtactacaggaacacatgtagatttgttgattcgtcttctgttggccttcactgcaccgattctgtgtttcatggtattatggctggttattagtaagcttaagtacttagcacacttgtttttaagttgcatgttcataatcctaaccttgctattttttgg

SEQ ID NO: 15757 - DNA, 510 bp, Triticum aestivum
  unsure (1)..(510): unsure at all n locations
  Clone ID: PAT_TA_15757
cacttgtctagccttccacacgctagacaacaaacgcgaacccgcgcctccccctctgctctgcctgcgcccgcccgcccgctcacaggcgctgccaggcagtgccattactgcccccacccgtctctccgggcccgagcacgccagggacaccggattcctcgtcatggccggtgaccgccgcggcggctcgcccacggcggagcgccggcgggggatccggcgcctcctgctgccccgcggggaggcctcctcctcctcgtcgtcctcggtgccgttgcctcccccggccgcggccgaggtagggcggaggaagggcttcgccgccgcggcgctgcgcgggctgggctgcacgtcggccgcggcctcgcaggcgtacgcgccaggggcgggctccgcggctgcggcggccgtgcggtcctcggccgactggcacgggcgaagggaagaaaggggaagggacaagaagggaagggagaggggggggggnnnnnnnnnnnnnnnnnnnnn

SEQ ID NO: 15758 - DNA, 895 bp, Triticum aestivum
  Clone ID: PAT_TA_15758
gcctcctcctcctcccccacctcgcccccaaatcccgtagcaacaacctcatcaccctacttcctacccgagtcatcccccagatcgcgagttgcctgaccaccctctaggatttcttcgccatccgcgcaacctaccgggatctcctccctccatcgtcatccaacctcgcctcccaagccccccacctcctccttgtccccggatctcgagccatgttccacctccccctccgtcgtcgcctgcgcttccgcctccccctccatgattttgatcctaaccctgccgccttctactcttttggctgtcgcatcgccatggccagccccagccaccatgagctcagcttcgtccaccttctcacaggcgagcgatttcgcctcccctatccaccggcacccttctgtcgcctcctcctatctcgcgatctcgtccttgccttcgttccgacggtcggccgtgccgtccagtactgtcgccttggggatgttgagtggcgtgtggcgtcatgcactgaaccctatgtcctggaggatttgatctttctcaagggcaacctacacgcactggtcagatctgaagatgttggcggcctatgttaccgtctcgccgtggccaatctgtcagacaagaatacagtgaaattaatgtttcttggaagataatttggatacacaggcccgcacatggggagttcggattttctggtctcgcaaaaggggtcttgatgaagttggttggcttatttaaccgctggtttgggggacttgccccagaaaaagttttcattggttttcccgtgggcaagtcaaatgggaagggggaaggtgggaccaagggaactaactaagcccttgggtcacctgcaacaattggttctctggaacatattttt

SEQ ID NO: 15759 - DNA, 647 bp, Triticum aestivum
  Clone ID: PAT_TA_15759
ccggcgccgcccgcgccccagccggcgcctgacgcgacgcgacggcatccggagcggcgaagcgacggcgacgggaagtggaggcgcgcacggcgacaactgacagcatcgacgacgacgctccgccgcacagagcctcaacgatggatgatgaagactctactgatggattattctcaaaacagttttcaacaagacgcatacacgtacaattgctgagaaaagtctgaataaggatatcatggcagtcttaagtgattactgctaggtagtggctaggctgctgctaccccgcatgagctgctccatggggcagacaacgaccactagtgacgcccttgtgttccaagttccaacagcccccgaggtgccgacgggccggccccttcaagctgccgcacgcccagccccggcgcccgccgccccccttcgccggcggtcgccgccccgcggcgccgggcgtggaaattctgaaaaattattcccgcgggggatcttatgttgtgtacccgcctttgtcccactgaaccagtggtttactagtttcgtgcatggtttgaactgaaatcagatattgagaatatctactcatggtatttctctcactcgtagacccagcttcttgacgtaggtgcgctatctccgct

SEQ ID NO: 15760 - DNA, 783 bp, Triticum aestivum
  unsure (1)..(783): unsure at all n locations
  Clone ID: PAT_TA_15760
ggcagatcancagcactgagaagactgacgctatntggaagagcttcttccagggcaagctcacctccccgcagtggatcaaagggggcgaagccatggcccctgtcgtggctccgacaggaggaaccgtcctcgtcagaaagctcgccactttatccccaaaagaactctttgttggggacatcgtcttgttgaaggacccagagaaatccgacgatttaattgtccgacgactggctgccgtgcaaggctatgagatggtctctactgatgagaaggatgagccctttgtacttgacaaggacgaatgctgggtcatggcggataaccaagaactaaaggcaaaggaagctagggacagccgcctatttgggccggtccctatgactgatattgttggcagagttatatactctttaagaactgctgttgatcatggcccagtggacaacagccgtgtagccatgttccaggattcaccggttttggcggtagagctcgacgtggaagagatggtgaagaacaataaaatgtagataatgacatcctgtggtgtatcatttcccttgtgcggatcttttaaatttgtcgcttcaagtagaaactgcacgtggatgattgtcattcgatgttcgcttgtgatgtggtgaagtcaataatatctcatcataagaaataagcacacatgtttgctgaattctgatcatccctgggtctgggttattattactccatctttgtttgcgctatttgatgtgtgtgtgcttatgttgctattgctgt

SEQ ID NO: 15761 - DNA, 1262 bp, Triticum aestivum
  Clone ID: PAT_TA_15761
ttcggcacgaggactagccaccccgcccccgcccccacgcggtcgcgtcccctcccccactctccccctccccccccgtcgcatcccctctctcccaccctcgccgtcgccgcctcctcctcctcctcctccggtgtccgcccgccaggcagcccccctccctccccccctccgcgctccaggatttccggccgggagcagcagcggtagccgccgtcccaatcgagcgggagagaggggatcaggacagcgggcggaggaggaagagcgaggtcctcctccgagggagagggaaagaagatggtttcgctgtcgacttggttccgctacgccgcccacaagttcgagtactccatctccctctcctggaagaagtacaccgtcgggcagatcaacagcactgagatgactgacgctatctggaagagcttcttccagggcaagctcaccttcccgcagtggatcaaagggggcgaagccatggcccccgtcgtggctccgaccggaggaaccgttctcgtcagaaagctcgccactttatccccaaaagaactctttgttggggacatcgtcttgttgaaggacccagagaaatcccgatgatttaattgtccgacgactggctagcgatgcaaggcttggacatggtctctactgaatgagagggatgagccctatgtcctagaacaaaacgcaaacggggtcagggccgatagccaagaactaaaggcaacggaagctaatgacagccgcagatttgggccgtttctaatgactgatattgatggtagaccaatgtacacttgacgatctactcatgatcatggcccagtcggcttcggcggtggagctagacgtcgaagtgatggtgatgaggaagaaaatgtagatgttgacaagcctgtggtgtatcatttacccttgatagggtttttctgtatttttctgtttcatttcctttgggaggattcttcaaattattcgcttcaagtagaaactgcacgtggatgattgttattcgatgtttgcttgtggtgtggtgaagtcaataatatctcatcataagaaataagcacacatgtttgctaaattttgatcatcccgtgactgggttattcttgttccatttgcaaaatggcggggacttaaaaaaaaaaaaaagcttcttgcgggagagctcaaaaaaaaagctttttttatacgaggcctaaaattaacactggccggcgttttacaacaccgtaactgagaaaaaaccgggg

SEQ ID NO: 15762 - DNA, 880 bp, Triticum aestivum
  Clone ID: PAT_TA_15762
gaagctcggggtcacgcgcgcccgcctcgccgccttcgtccgcgcgtacccggcctgcctccacgcctccgtcgccgtcgacctcgcccccatcgtcaaggcgctccgcggcctcgacgtcgaccgccaggacatcccccgcgtcctcgagcgctaccccgacgtcctcggcctcaagcccgacggcaccatcagcacctgcgtcgcctacctcgtcggatcgtctgcgtacgccccgcgacatcgtgcccatggcgacgcactaccctttcttccttagcatgcgtgttggcaccacgatcaagccgttctgtgattacattacatctctgggtctgccgatgcggattctcgcgaggattattgagaagcggccatacattcttggctatgatcttgaggagaacagtcaaaccaaatgtcgaggcattgctcagcttccgcattcggaaggaggtgctgccactcatgattgcgcagtacccatccattcttgggttgcccctgaaagtgaagctagccgcacagcagtacttcttcaacctgaagctcaaaatcgaccctgacgggtttgcccgtgccgtcgagaagctgccgcagctcgtgagcttgcatcagaatgtgatactgaagcccgtggagttcctccgcggccgggggatcaccgatgatgatattgggcgcatgttgatccggtgcccccagattcttctgctgcggaacgagctcatgaagaacagcttttacttcttcaagagtgagctgaagcggccaataagtgagcttctggagtacccagagtattttacatacagcttggagtccaggatcaagcctaggtacatgagagtggcaagcaaggggatcagatgtagcttgg

SEQ ID NO: 15763 - DNA, 2045 bp, Triticum aestivum
  Clone ID: PAT_TA_15763
cgggctgcgggccgtgcccggactgcccgccggccgcttcttggcctcctctcgtcccgctgccctcctcctccctcctcccccctccctctcccactcccccggactcccccctctccaccctcctccccgtgcgctgcaggtgggggttcctcttcccgatccatcttccgcggacgcgtggggccgccgccgccgcattcaaggcgcggtttttgaccggacccgagttaagagggggcgtcggtggggagcagcaaggaaggggaagaagatctgtcgccgccggcaagatggggagatccgcgtctgtatttcaagcccttttggttttcctaataacaataattgagacccaatggtccagcgtatccggcatgtactgcgcggacatggcatcgaccgtctaccgaccacatagtgtcactataactgagtttggtgctgtcggggatggcgtgactctcaacaccaaagcattccagaatgccatcttctacctcaattcatttgcggacaagggtggcgcgcagctctttgtgcctgctggaaggtggctgacaggcggttttagtctgatcagccatctcactttgtcgctggacaaagatgcagtaataatcggatctccgcactcatctgattggcctgttatagaccctcttccatcctatgggcgcgggagagagctccccggaggaaggcaccagagcttaatttttggctcccatttgacagatgtaataattactggtgctaatgggacaattgatggtcaaggagccatttggtgggattggttccataacaacacactgaactatactaggccgcatcttgtcgagttgatgtactccaccaatgttgttatatcaaatttgactttcaagaactccccgttctggaatatccatcctgtatactgcagccaagttattgtcgagcacgtcacaatcctagcacctttgaattcgccaaacaccgacggcattaatccagattcgtccacaaatgtttgcatcagtcattgttatgtcagaaacggagacgatgtgattgtcatcaaaagtggttgggatgagtacggcatttcttttgctcagcctagctccaacatcagcatcagcaacatcacaggggagacaggtggcggtgcaggaattgccatcggaagtgagatgtcaggtggcatatctgaagtccgggctgaaggcctccgcattgtgaactcattgcatggaatcagaatcaagaccgctccaggacgtggagggtatgtaaggaacgtctacatagctaatgtcagcatgcacaatgtttcgatggccataaggatcaatggaaactacggcgaacatcctgataacaattatgacaggaatgctctccccattataagcaacatcacaattgagaacgttgttggcgttgatgttggtgttgctggcatcttggagggcattgagggcgacaacttcagcagcatatgcatctccaatgtctccctcagcgtacgatccaggcatccgtggaattgttcgcttatccagggctattcaaactctgtgactccagagtcgtgcgagcaactcagaacagattgtgaagagacatcgatctgctatgacggtggcagttctttagccgttggttcacgggcatccatacataataagcctagtgccaacatattactaaattcattattgcagttggtgtcgctgtaatgtaggtagatatagatgcttgttatttgttgcaaaggggcttgcgtcatcggatgcatcgtgttagccatgtatatcttatttttgcaatcagttttgcttagaatgcaatttgtttctttgtatatagatgtggagatgaatgtcagtgctagcttgttctgtcatgatcttcgatttgttctctgtttccaaagccttgtggagcatagaacaaaagcaaaattactgtaatatttcagttttgagtcgtagattttaagaacagaacaattggatattccccaattttgtgagtaggcttccttcgttgcaagt

SEQ ID NO: 15764 - DNA, 841 bp, Triticum aestivum
  Clone ID: PAT_TA_15764
gaagaactagtctcgatttttttttttttttttttttttttggcaccagcaaagtagagtatatatatgtatatcactgtaggtattcgttccatgttcatatatcatccacgaaatacacgtacgtatttatacgcggtatactacgatctcacagtcgcggaagcgcgctaaagtaccccgaaaaacctgccccagccactcctcctcgcctcctcctcagcggccgctgccgccggcggcggcggcgcagccggcgcctcttcgacgccccagatcccctcgagaacctgggccaggctcgccgggacgccgtaggtgtcggcctcgggcgcggcgagcacggagtcgaacaccttctggaggccgacgacgcggcggctgacggcgcgccgcgccttccgcaccggccggtcgtgccccgggacggcgtcgaggcggagcagcacggccatgagcgcctccgagaagcgcgcgcgctcgcggtcgtcgccgcggacggcgtccacggtctcctgccgccggagcagccgctcgagccgcgtcgcctcggcgtcggcggcgcgcacggccgccacgtgcctccggacccggcggctgcggaacgccgcctggatcctggcggccgccgcgtcctgaggcgtggtgacggggatccggacggttctggcgggcttgcgcgcggcggggctggggccggggccggggtcgccggcggcgaagaagaactgcgaggcggagctgtagtggtaggagcccatggcggccgccctgggtcagtagagcgaggtgaggtccagtgtgctacggaggacaatttcgtgggatctgtgggtgccgg

SEQ ID NO: 15765 - DNA, 1425 bp, Triticum aestivum
  Clone ID: PAT_TA_15765
ctggccagtggttaagtaccaatgaaaaagttatgcatgttaatcaaataactggtgaagcacatgcacgtggtgaaggtatagcataagtgatttttaaaggcccaaatctgaagttgcgaacaactgtcaatgtgctcaaggtgaaccagatagttgttgatgctcctgcggagattctgacgaatgttgctgccccacctgatgggtacaagttctctgtgaaattaagtgattcagccgggcatagcacagagtcctctgtgaatcagataaatgccccatttgactgcaaggtcgaaccttcttttgttgggtttgttgagccatggagtgaccgtgctgtgaagaaatcatactgtgtatttcatccgtactcgcctgcacagctgttgcctgttaagtcgaacccaaaagacggaattttacacatttcagttcgtgcaaatctaaaagaagattcaatggtgaccggatctgcacatgcactgtttgtcaaagggttttacattaaagaacctggaatgttaaacttgactccaagctgcaaccatagcgtcatcattattggcgggaacactgatgttgagttattttggagtgctaaagatttaatgtcggtcagtcttgttgacacaaatgagaacattggtggtcctagtcaagttgtttaccgggttgaagcactcaaaaggcaaccttttgctgacaaggtcactataattcttccagccactggccagactgaagaattagaagttaattatgttacaggagacagaacagagccatcgtcgtcgtcaggcttaaccacatttggccttatcctcacatgcatcatcgtgccagcaggtacactctgggtcatcatgaagctgctggagaaaccggcccgacaggcaccaccacggcacgcgccggcaccagcagcggggccttccgctgcgcctgaccctgcctccccggctatcggcgaattctctcctcgcacaccccagcctttcatggagtacgtgaggaagactgtcgacgacacgccttactacaagcgtgacgcgaggaggagattcaaccctcaaaatacgtactgagcgcatgtaaactgggcagtagagtcgcccctgccgtgtttcccccctagtgtatgagttagacgggtagccctgtaacccctgtactgtaaaatccgtctatcgtcgatactacgctgtcaattttcaagtcgtggcggcatctgtacgagcaatggttggttctgttttagctgagaaagctatagagctagataggtaactcaaccgatggcagttcctctttgtaatagtagctttgtaattgtaagaacctgggagcgctgtatgtaagttggagtgtgtatttccacctctctcctaagcaccacccagccctgttttatctaactat

SEQ ID NO: 15766 - DNA, 947 bp, Triticum aestivum
  Clone ID: PAT_TA_15766
tcgagccgtcgagctccgccgccgtaaacgatggccgacggcaacgcccccggctcgccggcttcttcgctccagagccaccgctacgccatcaaatcctcagtgcacaatacggcagctagccggaggcgtgaacaggctatagcaatagggaaggaaagaagggaagccttaatgcgtgcaaagcgtgtgtgccgtgccccactttctggcagtgatgaggctacaattgaagatggtgatatggttattgatgagaaagcagatcttgaaacaagaactgctcaagctgttgaagaattgaaatcagctttgtcaagccagggaaaaggggcccagaagaagaagatagaggcacttcgtgcagtgagacgcgtgctgccgcccgcgcaggtacctcccattcaagtagcaattaaagctggggcagttcctcttttagtgcaatatctgtcctttggatcttcagatgaacagttgctagaggctgcttggtgccttacgaacatagcagctggggagccagaagaaacaaaatccgtgctgcccgcattaccattgcttgttgctcaccttggtgagaagagctccacacttgttgctgagcaatgtgcatgggccatcggtaatgttgctggtgaaggagcagacctgagaagcacattaattgcacagggtgctttgtggcctcttgcccgcctaatgctatcaagcaagggttctacagcaagaactgctgcttgggcattgtcaaatctcatcaaggggcctgatcccaaggctgcgtatgagcttattaacatcgatggtgtgctaaacgcgatcataaggaacttggagaaggcggacgaagagttagcaactgaggtggcatgggtagtggtatatctttcagcactttcagaaaaagctatcagcttaatagtacctcggccgcgaccacgcta

SEQ ID NO: 15767 - DNA, 520 bp, Triticum aestivum
  unsure (1)..(520): unsure at all n locations
  Clone ID: PAT_TA_15767
taccggccccccgtttgtatctgaccttatggagtcgaaagccattcttctttgcctcatgttgattctgcagctaggaaactccattcatgttgagcagtgcaggcaggaagcttcttttacgagcccccaattgcacaaaagcaacttgccaaagtgcttgccagaagtcgtggggagatgacgtcctgcatgtggtatgtaggatcacaggcataaccttggaaacttgttactgcatcgtatgtgcctagagttgcactaaaccatcgtgtaaggcaatggatattgatgtgatacggtaataaaagtcctttcgcaacatgcttgcgataaactacaagcgaccaccaaaatttcggggtgttctattttgatttagtcatgtgtgatcttaaatttgggtaatttggtggtttgcaagggctcccngattcacaaagtttaagaaacaaatctacacgacatgaataaaaccaaagcttaantggttcnggcaaaaaaaanaaaaaaaaaaacn

SEQ ID NO: 15768 - DNA, 570 bp, Triticum aestivum
  Clone ID: PAT_TA_15768
gaattcggcacgagcactcatcctcctccgcgctctcgctcacatcccaggacccagccgcgcgaccccgaccccgacccctccggcggccaccaccgggcgctcccaccgccggctcgccgacaccgcaccgagagattgctcctggcgatgggtagcgcggtgagagaccaccagcagcagctccacccgtgcgattcgctcctcctcgagctcaacgtgatctgggatgaggtcggtgagcccgacacggtgcgggacaagacgctgctggagcttgagcaggaatgcctcgatgtctacaggaggaaggtcgaccaggccaaccgctgcagggctcagctgcggcaatccattgccgaggccgaggctgagctcgccggcatctgctcggccataggcgacccaccggttcacgtcaggcagtcaaaccagaagttgcatggtttaagggaggagttgaatgcaattatcccatatttagaggagatgcggactaaaaaggttgaaagatggaaccagctcgttcatgtcctagaggagattaagaaaatctcatccgaaatcagg

SEQ ID NO: 15769 - DNA, 705 bp, Triticum aestivum
  unsure (1)..(705): unsure at all n locations
  Clone ID: PAT_TA_15769
gtcgtccctaaattgttctagcacacagtgaatttcttctggctattctgaaatccaaattagtagaataaacagctctaactagcaataatggaaacagtggaagcacacttgatctaacatggagtgcctgtggagaagagaggaacacagatatcctcccatccgtccataggttaaaaggccggcacccgcacaacaccgagctccatctcctatcctcctccacctccccctctctccaccccttccctcgccctcccctccctctccaaacccccggcagccatagccaccgggagggctggagctggggaaggaggcattccttggagcctgcgcgccccctacccagatccgctttttcgggtagtcttgggcgatctggactctcccccaaatcgtccgttgcagagacaagaagttgccctcgcctctgctcgttgttcttcgtagcctcggatcaaaagcagccgccttttgcattcattcttcgtcggccccttcggagaccgccctcgtcaagatttggtgggaacccaattcgcaggggttcctcgtggaaaggcgccgcttcgattcttgtttctccaacggttttccaaccccccctatatatctccaacctcctgtncaacctactccgcctaaacttccctttttactttgaattcgccccgtccngggtattncgatttgctgtnn

SEQ ID NO: 15770 - DNA, 638 bp, Triticum aestivum
  Clone ID: PAT_TA_15770
aagaagttcaatctctctcttgctctcttgtggaggaggaattagaagaaggatgaggggggtgagcatgttgacgatggcgcgcgcggcgtgggcggcggtccggtacgcggtggtggtgccgctgctgcagctggccgtgtacctctgcgccgccatgtccctcatgctcttcgccgagcgcctctacatggggctcgtcgtcgcggcgctatggctccgccgccgccgccgtcagcgccgcagcccaagcaggaacaaggggggcgacgacggcggcgccggcgacctggagtccggcgccgcagaggacctgcccctggtcctggtccagatccccatgttcaacgagaagcaggtctgcccgctctccatcggcgcgccgtgccgcctctgcgggccggccgacgagctgctggtccacgcgctgggcggctcctcgccccccgcctgccccgccccgcgggtgcccggctgccggcgctggcccggcaagggggtgcagatccggtacgagaaccgcaccaaccggagcgggtacaaggcgggcgccatgcgggagggcctcaagaagggtacgccagggactgccaacttgtggcggggttcaacgccgacttcagccggacgcggactcc

SEQ ID NO: 15771 - DNA, 643 bp, Triticum aestivum
  unsure (1)..(643): unsure at all n locations
  Clone ID: PAT_TA_15771
caaattagccaccccgcctccccacaccggcgtatggccgccgccaaggagaactaccgcgtcgagctccgagccgccgctcgccagctcggcgaccgttgcctctactccgcgtccgcggacgcgtgggagctgctcgtcggcatcgagccggacgcgacgccgtcccagtcggcggcaatggacaccccgtcctcctcgggcgccgcccccggcgggcggctgctgcatctgcaccgcagcggcgggtccagtttccggcgccgcatgcgatcgggcggcggcgccgcctccgaggctgggacgccgctcggcggcgtctcgtacgtgagcacgcccatcccggacgacgacgcgttcgacgcaggggccgacaagtacctgctcgcgaagacctacttcgactgccgggagtaccggcgcgccgctcacgtgctgcgctcccaagtcgggcgcaagggccgtgtcctgcgctgctacgcgctctacatggctggagagaggcgaaaagaggaagagancaatgagcttgaaggatctttggggaagagcaacgttgttaatcaggaacttgttgcattggagagagagctctcaacacatcgcagaactggtgctatngattcctttgggtctgtacttg

SEQ ID NO: 15772 - DNA, 754 bp, Triticum aestivum
  unsure (1)..(754): unsure at all n locations
  Clone ID: PAT_TA_15772
caccactcggccaattcaaggcttgcagaccttgcaataatggcaacatcacatatgaccaccatcatcttctctactatcgtcatcatgcttatttcctctgccatcgctgctaagagcagtggtgacattggtggcaagcccaaaccaaccccctttgttcttgaagcgtgcaagagtgcctcggacaactcccgccgatacaactatgtgtcccaagaattctgcatctttaccctccaatccgacaaccggagcgccgacgccaagaaccaccgtgacctggcgctcatacccgtcgatatcctcaagggccgtgtcgtcaccgctggcggcaacatcaaggaagtactgcacaacaccaagaacatcacgtcatcgatggcgcgccatctcagaatctgtgagctgggctacgacgccaccagaagcatgttgaacttatgcggcgccttcatgaggaattaccagggtgacaacatgagcgaatacaatgacggcccacattcttccgagctgcctgtttgtgtggaccaggtgaacaaggtctctgactactgcgcgttcgcgcttttcgatatgccgggggtgggaaggtactgattcgaggaaaccgttgaactgcaaaactgatcgatctcaacatggccntgctatcaccatacaaaattccctgatnttttttttgtccggttaaaaataaactattaatgttcnccatatcaattccaccttccatttggaaataataata

SEQ ID NO: 15773 - DNA, 618 bp, Triticum aestivum
  unsure (1)..(618): unsure at all n locations
  Clone ID: PAT_TA_15773
ccacgcgtccggnnnggtggctacgccgcggcggcaacaccagcgccaagtgccctcagggcagtgaagggttcaagcacaggcacatcatcaatctctactcgtcggtgcatctctggaacgattgctacctcaaagaggtccccgctcctcggccgggtcctcggtcttctcgcctccctcctccgcaggctctgcctcttagggtctcccccctcggggcccgggtcgaggatgccagctcgcgtccggaggctgcctggcgtgggctggaggtgcgcggcgcggcactgtttcgcttctgcccggagtggttcgcgcctccgtttcctctccccgtgcccgggctcgaggctcagagtctttccggcatggtgcaatgggcggctctgcgtcgtggcggcgcggagagcggggccgcacatcatccttcattggaggtgtgcaccgctcgccccttcttggagagcagggcggcacagcatcaattctttgnnnagaggatggcggcactgagtctagccttcaaggagatgctggcggcacagagtcaagccatcgaggagaggattagtcaaggcatcnnnnngnnnntggaggcagaacgagctctctacc

SEQ ID NO: 15774 - DNA, 2230 bp, Triticum aestivum
  unsure (1)..(2230): unsure at all n locations
  Clone ID: PAT_TA_15774
gcacgctgcaccacccgcgtccgcttggaaaatattaatgttgttacacagcgtggttttattcctgttgatgagcggacgcaagtcacggatgctgatggcaatgtggtgccgactttattttgcattggagatgcgaatgggaaactcatgcttggccatgctgccagtgcacagggaatgtcaggccgttgagcaaatctctgggagggaccacattctaaaccatttaagcattccagccgcttgtttccctcatccgcgacagcagcatgctggggcgggctgaggccggcgccagcgaaaggggtggcagcgaggggcatcgggtacgggttcgactacgaaatcgtaagagccggagtcggcgtgcgcggcgacgcgccccgcgccgtacgacgaggaggagggaaccaccattaccgtgagagagtgttgcgggttgggcctgtgttgactggacctgtgttccgttcaatccactgctttttgtcagtggtcgggtgagatgacataatgataaacatcacatcaagtcccttcgcctgcacttttcttcacctgaacatgacagaaaagatgttgctgagcagacaaataatataacctccaaaataaaaagcaacttgactaattcaatgaaggctatgggagtggatatattaactggatttggcaaaattgtgggaaagcaaagggtacgatacggaaaagttggttttccagaaaaagaaatcactgcaaagaacatcatcattgccactggatcagttccttttgttcccaagggcatagaaattgacggcaagactgtatttactagtgatcatgcattaaaacttgaatcagttccggactggatagctattgttggaagtggttatattggacttgaattcagcgatgtgtacacagctctaggaagcgaggttacctttgttgaagctcttgaccagctgatgcctggttttgatcctgcaatcgcaaaattggctcagagagtccttatcaatccaaggaaaattgactatcacactggtgtttttgcaagcaagattactccggcaaaggatggaaagcctgtgttgattgaactcattgatgccaaaacgaaggaacacaaagaaacccttgaggtggatgcagcccttatagccactggaagagcaccattcaccagcgggcttggcttggaaaatattaatgttgttacacagcgtggttttattcctgttgatgagcggatgcaagtcacggatgctgatggcaatgtggtaccgaatttattttgcattggagatgcgaatggtaaactcatgcttgcccatgctgccagtgcacagggaatctcagtcgttgagcaaatctctgggagggaccacattctaaaccatttaagcatcccagccgcttgtttcactcatccagaaatcagtatggttgggctgacagagccgcaagccagagaaaaggctgataacgaaggatttgaggtcagtgttgttaagaccagctttaaggccaacacgaaagctttggcagaaaatgaaggcgatggaattgctaagatgatctaccgacctgacacgggagaaattcttggtgttcacatcttgggtttgcatgctgctgacctcatccacgaggcatcaaatgccattgccctaggaactcgtttacaagaacttaagcttgctgttcatgcacacccaacgttatccgaagtccttgacgaactcttcaaagcggccaaggttaattcaggtgtctctcattctgtaaatgaaccagttgcagcctaaagacgggcaggagcgtgagccaaatcatccaccccagccgctcttgaaggtccttagtttcatcacgagcctgctgtcttccccgcaacgagatcggcaaccctagccatacaaggagcttttgcagcctgctggtgccacatcatggtacccagggaaaaaatagttacacattttgtagcgtgttcagatattattagtcatggggtggtgatttggttcttgttgccttcatttctttgttgtttcacctattgagtgtaagtctagccagggttgttcaaataatcggcgttctcgccgcaatgtatttttaagactgctcaattgatgtctgaaaagaagtttgcaggttgaaggactcgnaaaaaaaaaaaaaaaaaaaaaaaaaaagaaaaaaaaaaantactcgaggggggggcgtacca

SEQ ID NO: 15775 - DNA, 801 bp, Triticum aestivum
  unsure (1)..(801): unsure at all n locations
  Clone ID: PAT_TA_15775
ccagggtccacccccgtcctctccgatcgccgccgccggaaccctacaaccggcccgccatggctgatccgccatccctagcctccaccgcaacgccgcagcccgaccagctcgccacctctgcttccatcccgcagaacgccaacccccaaatccccctgccccccatcgtttcctccgcgcaggtcaacccgggctcggctgctacgggaggcagatccacggacccgccgcagttgcaggcgccttctcccacgcaggcggctgaaggagccggaggattcggtgcgatccaccgctcaggcccggcctccctcgcccccaccgtcggccagcctccacggtacgcgacagtcggcacgacatatggcaacgcagatggccttcccgggcggcggggggcagttgggccagcagccggggctgcgcgcggccatgtttggacaggggcagcccgaaggatgctgcaagggcangggcaacgcagcctccgcgggcgcagtacgggcttcagttccagccaacgatgattgcgcatccagggcagaggggcgtggtacaaggcgtgcaattcaacactcccactgcacaagcgcaatccatgggtgcttccctgatgaaccagatgaggcctaatggaattgctaccccatatggtgctcaaactcagcaacgttctgcatatcatgcacaaatgatgccacagcagccacctggatcatcacanaatgggcctgtggtgcaaatgttaccaacgcatcagatgcaatcgtcaatggcctcggctgtttctcacatcan

SEQ ID NO: 15776 - DNA, 637 bp, Triticum aestivum
  unsure (1)..(637): unsure at all n locations
  Clone ID: PAT_TA_15776
ccacgcgtccgcccanngaaaacccatcatcagccgctctctctctctcggctctccacttcggcctccgcctcgctcccaccccaaattcctccacggctggcggcctgaagccctaggccaccgccgggacccaagagcaagcatacagacgctgcgatcggaagcagcagtagccgccgccatgcagggcttccccggcggcgtccccgatccgcagcagctccaggccaccatgctcgccatcgagcaggcctgctccctcatccaggtgcacatgaatccggctgaagcggaaaaagttctaagttcactccattcatcgctgatgccttatcaagcatgcagatttattcttgggacgcccctgttgccctgcgcgcgtctccgagctgctggcgcttctcgtgatgccgcaagatggccgcggggtggttgtgcagtgctcaacaggacctgcctcttcccatatcggctggactgcccgtcggtgcatcctgggtcccctgctggcttcctgccttctgatgtttctcctgtggcagctaggttactaaaaagnnnctggcttgagtttccggaccaagaaaannncgctatcttctttgnnnttgaacagtccatccggggcatgcat

SEQ ID NO: 15777 - DNA, 632 bp, Triticum aestivum
  Clone ID: PAT_TA_15777
cgggtcgacggggatctaaacagtactattcttctgcttatgtaaacaccttggtgtacaaccatgtcagtaagaccctgttacttttgttgatgacattccggtaaccaccgatggacgagaactttgcctattggtccgcctcgttcaacgagcaggaaaatggttctcttcgtccctcgcccttggtaccgacgttgttgccgacataatcgataggctatcctctgacatgccttgcttgcatgatcatgcaagacgtcaccacccttcctacttttaacccacatggtgggcccataacccacagttccacaggatcaaaacctgactctcctgtacacccctgttgtcaaagttattcctcacgcttggcttcgtatttaattcacgggccaccttcctaatgctctattctggtatcagacgcaatacttactctcgttgctctgaaaccctttctcactctggttcagacttcgagcaactatctatccacttggaacctcttattgtaccttcgtaccttactcttgatgtattcgatatgttcaactcgagagataatcttatgcccattcatgggttaacccccagattgtctctctcataagcattctgtcgtagccgag

SEQ ID NO: 15778 - DNA, 548 bp, Triticum aestivum
  Clone ID: PAT_TA_15778
agaggccctggaggagcagaggatcacggtggcggctgccaattctacggccaccgagtcgtcgccacccgtggccaccaccccgcaagaagccgagaaagtggacaagatctacgagcccctggggatcaacatccagcagcttccacgggacggctctgccaactcgacggaccagccctttgggcccgacgagttccacgtcgacacggtggatggggtaaacagcaacgtggaggagcggcagttcatcccaaacctgatgggcatgtccccgatgcgcgacgagcaaggaggcaacggcgagctggaaaacaactgcaacctggagagctcggcggaggacatctgcttctcgctgcacctgggcgagcgggagcccaagaggctccgctccgacacgacgacggtggacatagacctgcagaaatgagagaggggccgtggcatcttgttcctttcatcgtgcccctctgtatgcgttgttgttgttgttggattggaggcgattgcgatttgtggatggaaaaataaaaccccattgatcg

SEQ ID NO: 15779 - DNA, 1252 bp, Triticum aestivum
  unsure (1)..(1252): unsure at all n locations
  Clone ID: PAT_TA_15779
tgtacgcctgcagtacagtcccgattcccggggtatggtatctatgcgggaacgaacccagaaacatttgtccgggctgatggtgcatttataccatttgcggacgactttgacattactaatgtcagcacttcagttaaaggagttggactcatcggtgacatcaaggcaatcgatctgcagtccccgattggtagtctcatcgggaagcaagttgtgaaagttggaagaagctcaggccatacgacagggaccgtcatggcatatgctcttgaatacaacgacgagaagggcatatgctttttcacttacttccttgtcgtcggngagaaccagcaaacgtttgatcttgaaggggacagcggaagccttataatcctaacgggacaagatagtgagaagccacagcctatagggattgtatggggtggtacagccgcccgcggaaggttgaagctgaaaagtgggcagggcccagagaactggacgagtggtgttgatctggggcgccttcttgacctcctcgagctcgatctgatcacgacaagcgaagggctgcaagaggctctggaggagcagaggatcacggtagcggcggccaattctacgggtaccgagtcgtcgcccgtggccaccaccccgcaagaagccgagaaagtggacaagatctacgagcccctggggatcaacatacagcagcttccacgggacggctccgccaactcgatggaccagccctttgggcctgacgagttccgcgttgacacggtggatggggtgaacagcaacgtggaggagcggcagttcatcccgaacctgatgggcatgtccccgatgcgcgacgagcaaggaggcaacggcgagctggaaaacaacaacctggagagctcggcggaggacatctgcttctcgctgcacctgggcgagcgggagcccaagaggctccgctccgacacgacgacggtggacatagacctgcagaaatgaggggctcggtcgccgtggcgtcttgttcatttcgtcgtgcccctctgtatgcgtcgttgttgttattattggattggattggaggcgattgcgatttgtgccggcagtggatggaaaaataaaaccccattgatcgattctgtgaggatgagaacctgttgttgtattgctcgctgggacccgacccacagagttttactacagcagtagtttcaggtgaaaatgatggcgctgtcaaaaaaaagtcgacgcggccgcgaattcg

SEQ ID NO: 15780 - DNA, 940 bp, Triticum aestivum
  Clone ID: PAT_TA_15780
cacacgccgctcgcccccacctagcttccgagcagtggacgctctccgcgctggtggcggtggctgccatggactgccagcgtcttgatgtcgcaaaggattgtattggaatcctctccaagtcagttttctggcagcgctcgtgttggccggctactacgcgtcgtactatccagttaagtgggggcaagaacacgagagctctctttggcgtgtgcctgtgcagcgcagcgatcagccagctgaccaaaggaaggaacaaggaggaggagagctcggagctgcagagcctggccgcagaggcactgatgaaggattacaagcagcgcgcgccgtccatggaggcgctcgtcgcgggcatgctgaagaacatgaagctctcctgatctgacccttgttggctcacaagggctttagctttagctagctgagcgagcgagcactagtgcctcacgcatgcggtgggctctgctttggagacggcagatccttccagcagcattgtaaactttatttacgaaagatccttccttgtttccatatatgtcgtttttgggtttgtttttgttgccatagtagagcaataaggaaaacaacactgtaccattgtagttttgaatatagacgaaagtttttgatcaaacccttgttggcttacaagggctttagctttagctagctgagcgagcgagcactagtgcctcacgcatgcggtgtgctctctgtttcggagacggcagatccttccagcggcattgtaaaactttatttacgaaagatccttgtttccatatatgtggtttttggatttgtttttgttgccatagtagagcaataaggaaaacaacactgtattattgtagttttgaatatagacgaaagttttgatctgtaacagatgagtacgttaaatctctaaaaggatcacaaaaaaaaaaaa

SEQ ID NO: 15781 - DNA, 1178 bp, Triticum aestivum
  unsure (1)..(1178): unsure at all n locations
  Clone ID: PAT_TA_15781
accgttcgttcaatctaatctcgccgccgccccgttctctcctggcggcgatggcgaaacctcctccatccgcggcggcgtcggccgccggcggccgcggccctgcccaccaccggacccgcctcctcctcctgctcctcgtagccgtggctgcctccgccttcaccgctggttatgtcctccgcggcggccctgtcggcccatgcgatacccgaggggatcctgtagacgtcgttgccgcccgagctggcggtgctgcctcgagccccctcgggttcatgaagtccaagctcgtgctgcttgtctcccacgaactctccctctccggtggaccgttattactgatggagttggcatttcttcttcggcaggttggttgccaagtggtatggataacaaaccagcgacccgaaggaacaaacgatgtttcatatagcttggagcataagatgttgaaccatggagtgcaggttttacctgctaggggacaggaggcagttgagactgctcttaaggctgacctggttatcttgaacaccgctgttgctggcaagtggctcgatgctgttctaaaagataatgttcctcaagtccttccgaagattttgtggtggatccatgaaatgcgaggacattactttaagcttgagtatgtgaaacatcttcctttggttgctggagccatgatcgattctcatataacagttgaatattggaagaccaggactcatgaccgtctaaatatacagatgccacaaacttatgctgttcacctcgggaatagtaaagagttaacagaagttgccgaagataatgtcgcaagaagagtcctacgtgaacatatacgcgagttccttggagttaggagtgaagatctcctatttgctataataaacagtgtttcacggggaaaaggacaagacttatttcttcaagcatttcatcagagcctgcaactcatccaacatcacgaagttaaaagtggctaangtacatgctgtanntgtcngaagtgatatgagtgctcagacgaagtttggagacacagttacgtgaatttgtgngnaaagaatgggattcatgaccgtgttcacttgatnaacaaaacgttggcagtgggaccttatttgggtgcatngatgtgcttgtccaaaatcncaagcccttnggnaatgttt

SEQ ID NO: 15782 - DNA, 777 bp, Triticum aestivum
  unsure (1)..(777): unsure at all n locations
  Clone ID: PAT_TA_15782
aattncttgctcgaanttaaccctcactaaagggaacaaaagctggagctccaccgcggtggcggccgctctagaactagtggatcccccgggctgcaggaattcggcaccagaagtagagtgcatcattcaagccaagcaagcagtggtcaatacaaatccaccatgaagacctttctcatccttgccctccttgctatcgtggcgaccaccaccacaactgcagttagagttccagtgccacaattgcagccacaaaatccatctcagcaacaaccacaagagcaagttccattggtgcaacaacaacaatttctagggcagcaacaacaacaatttccagggcaacaacaaccatttccaccacaacagccatatccgcagccgcaaccatttctgccacaactaccatatccgcagccgcaaccatttccaccacaacaatcatatccacaaccacaaccacaatatccgcaaccacaacaaccaatttcgcagcaacaagcacaactacaacaacaacaacaacaacaacaacaacaacaacaacaacaacaacaacaacagccgcggcgccaggtgtgccaccagcagtctcagcagcattatccatcgtggcaggggtggcacccgtcttctcagccccacccactggaccgacgctttctgcatccgcagctgctgccgcaactggaggaaataatgaacctaacgatactaacgctaccagcaatgtgcaaagtgtacaatgatacatattgttcgtacagcattgcc

SEQ ID NO: 15783 - DNA, 773 bp, Triticum aestivum
  Clone ID: PAT_TA_15783
aagagaagaaaagtggggaagaaaagtgcagaccgcggcgtctgtcttccacctccgaattcgccccccaaaccaaaaccaaatccctcgacaaaatccccaatccccggccatggcgcgccgcgccccccgcccccgccggacgctggagctgccagacgacgtcatggaggagatcttcctccgcctaccggcggacaaccccgccagcctcgcccgcatcgccggcggctgcaagagctggcgggccatggtctcggaccccaacttcgcccccgcctaccgcaggctccgcgacgcgccgcccatgctgggcttcctctacaactaccgctccaccgacgacgagggagcgccctactggacgtcccacttccgcgccgccgcggccctccccccgcgggtgcgccgcgaccgcaagcactggcgcgctctcgactcccgccacggcctcgtcctcttcgacacccctgagggtgacgggcacctcgtcgtctccgacctcgtcaccggcgagcgctggaaaatcgacggccacctcacgttcccggatgcgtgtaatgctgcagtgctctgcgccagggacggatgtgaccaccgtgattgccatggcggccctttcctggtggcctgcgtggactccgtcgtggcaggggaccggaggatagccagcgccatggtctactcatcagttactggcaagtggatcgacccgacctttctcgagcacccgaatgtcatcgatggcagggggcacagtgctgtgctgggaa

SEQ ID NO: 15784 - DNA, 1591 bp, Triticum aestivum
  Clone ID: PAT_TA_15784
gcacgaggcagcaaatgcaacctcagtttcagcagcagtcataccttcaaaacatgaatggcaccactatccaaggccaggctcactctgagttccttcaacagcagctccaacgttgccagtccttcaatgagcagaagccacagcttctccaacaacaagaatcaaatcagcagcaatcacagggtatgcaagtccctcaacatcagcatatgcaacaacagaagaatatggcaaactaccagccagcatattctcaactctccccaggtcctcagtcatctcctgcagcactggaattcggcacgaggttttcgcagtctcagagcttttcggacacgaatatgagctcattgtccccatcaggcgcccccgccatgcataataccttggggccattctcatcagaaacagcttcacacctgagtatgtcaaggcctaccgcggtacctgtccctgactcatggtcgtcaaagcgagttgcagtggagtctctgattccttctcggcctcagtccaccacgcacatggaacagctatcctcaacaccacctagcatacctcaaagctctgcattggcgccacttcctggaagaggttgcttggtggatcaagatgggagctctgatcctcagaatcatcttctgttcggcgttaatatagactcacactcacttctgatgcaaggaggtcttcatgacgagaatgattcgacggcaattccctattccacttccaattttctgagcccttctcaacatgatttctccttggatcagacactaaatagttcaggatgcttggatgagtcgggatatgtgccatgttcacacactcctgatcaagtgaatcaaccacctgcaacctttgtgaaggtttacaaatctggaacctacggaaggtcgcttgatatcaccaagtttagcaactaccatgaactacgtagggaactggggcgcctatttggccttgagggccagttggaagaccctatgagatcaggctggcagcttgtattcgtcgaccgggaggaggacgtccttctggtcggcgacgacccttggcaggaattcgtgaacagtgtgtcctgcataaagatcctgtccccgcaggaggtgcagcagatgggcaagcagggcctggagctcctgagctcggcccccgggaagaggctaggcggcggcggtggcggtagcagctgcgacgactacgcgagcaggcaggagtcgaggagcctgagcaccgggatcgcgtcggtcggctcggtcgaagtcgagttctgaagagatggtgttctgaggcgaggcgaaggcctcggcttaatgctgtagcttcgccgcgtatgtttctgcagccttttttccctttctctcctagttttcgagaccccggaactggaaagcaagcacatagaccattcgtactagctctttaagtcatgtactaccgcctaataatcatgccatgtgatcatatcatgttaagaagaagtaggaactgtaccgtgatccgtaaacccccccttttggtaagcctgccaaaactctcttctgtggagtccttcttgcgaatcctgtgaatgtaggctcta

SEQ ID NO: 15785 - DNA, 1240 bp, Triticum aestivum
  Clone ID: PAT_TA_15785
ggctctctcctcgccaactccagggcacctcgagggcgtcggtggtggccgaagagttccggttggaagaggatgttgaacatgacgatgaagaagaggaagaggagttttctgcaggcaccagcgaagatatagaggagccccagcgtcataaaaagttgcgaagtcaaaatggccgaggtgctaagctgagatctgttgatgaaatccaaacaggtctcagacgcagcaagcgttcttctcgtccacgtataaactaccagcagtatgatttttcagacacggatgcagaggcgggaaaggcaggtaaatcagatgcatcagaccccgatgccaactctgatgcagaaaatggtatggaactctcgacatcaagtcaagggctacaggaagaagaggatgatggccccgaggaactaaaagttagtaatggcaataacgataaaatgtctgaagaccatgcagtggcagcaaataaagagcaaaaggaggagcagcggcaactgcagccagagtctgtagagaagatggatgctcccagcagggagagtggaaatgttggaagaacattcctagatctaaacgagcttgcgcctggaggtggctttgacgaaggccctagcctggcaatgaaagatgaggacatggataacagttaggaaaaaagttgtgatagattcgagtgttagggattgctgtttcgagcaaggtgtaaatgcgtgaagtcatggaccatgacaatcaatgggcctctgatgagatgtcgtgatatttggatggctcagtttgattgttagtacattgatgattcacagggtcaaaagtgtgagattccacctggaggggggcttcaggggcacccatcctcaaacatcatttgagcgcttgggaggggacgccatgctgacaaagtttaccatccgcttgtgtaaactacatgaaggccgcgtgttgatcaattactgctgtattattgttagattgattgattctatcttgtggtcgagaatgtaggatataaattttattgcctagccttgggcatgctgctgctgctgctgtgtggggtatcacagcagtatttcgcagggagcaaaacttgtacaagttagttgtccgctggtcggcatctgagctactcttttccacgtgtagtatgtggctcgagtctaagcatgagctgtaggtttgtatttataatactgcatgtgactacctgattagtttggcaaaaaaaaaa

SEQ ID NO: 15786 - DNA, 1013 bp, Triticum aestivum
  Clone ID: PAT_TA_15786
cttgcctccgcctctcctctccggtccacacctgcggaggcgccccgcaggcctcccgcgcggggggggggtggcacctgttcctgttgggcttcttgtcctctccagctcccctttcgccgtcgccatagaataatatcgccgattgaaccaagtaaaactaatatctttgctcgtattcaccgtgcgtgttccacgccccagccagcgccctccttagtgcccgccacgcccacctccttcgcgcccttgcagcgaccagttcttgcgtctactcttcgccacaccgaggtccatccatctaccaaaccaccctcctctccttgcaagatccgactccggccaagagattcgcttcttgcgccaagatcctgacctgagcagatagcaagagacgagggaagggggcggaagcggaatcattcgaagagagggcatggtggcggtcgcggctgggaggcggcccgtgctcagccgccggaggtccggctgcggtgccggccagcagcagctgcagcacccgcagggcgcagcaacagcggatgctcccggtcggcgtccccgcgcgcgtcgcccccgcgaggcccggggccaccgaggccgctttgtattttggcggcggcggcggcgacgggtgctgcgccgattttctcgtttgcctgctccgggggctcggcgtgacccccgcaagcgcggggcctgcgcagttcaagtgggccgctcgaccgctgcggcggaagcggaacgggggttcctcgccaagcggcgcctccgccgaggaaaggcgtcccgggccttaattaaggggcccgcccggacgcatcgccggcaacggcgcctgcgctagcgcctcactttacacgactgcatgggcaagaagggggtcaaccaggacgccatggttgtcgtggagaattttggttcgaaagatggtaccatcttttgtggtgtttccgatggccatggaccacaaggccatttggtttccaagatggtcagagatcttctccctg

SEQ ID NO: 15787 - DNA, 1096 bp, Triticum aestivum
  Clone ID: PAT_TA_15787
aaggagaatgatagagaccctgactggcaatgtgcgatacagccctaggaattttactgccattgatgccgggaaagcctgcttcatcaaacagaaactcgtcttcagcgttatcttgaacaagactgcctatagaagtgaacagctgactgacaggatgcgtatagcaacagaacgtttgtaactagtgatagattaatcatcaaatgcaagtaggtggcgtttgaatttgtctgtggtaattaccgttttttcctttcgtctgtcggccaccaatgtggttgttagcattctttccataggtgtaactcagcagtcgagaatattgattttgcatcggtgcatgcttaccctgacagctggctaccaaaggcaagcatggaagaaaaactcagatacctttccagttgggttgattcacaccataatgacagcgaacacatcttgaagaaacccgttctgttctcagaagtaggttacctgcagcacgtagatggtaacagcacagttgatagagatattcttctaagagttgtttacgacaaaatctatgattcagcgaggaagcttcaggcaggcggtggtgctcttatttggcagttgatggtagaaggaacacacatgtcccacgaggacttctccctggtggcacgggatcatccctcgacttataagttgataacggagcagtcttgtcgattccaactgcttgtccaaggatggttagagacccttgactggcaatgtccggtacagccctaggaattttactgccattgatagcgggaaaccccgctttatcaaacagaaacttgtcttcagcattatcttgaacaagactgcctatagaagcgaacagctgactgacaggatgtgtatagcaacaaaacgtttgtaactagtgatagattactcatcaaatgcaagcaggtggcgtttgaatttgtctgtggtaattaccgtttttttacttttgtctgtcagccaccaatgtggttgctagcattctttccataggtgtacgcaacttgttagctactttgtttcttggccacatgaatagcaagaagaatttcagaaatatcggatttgcttt

SEQ ID NO: 15788 - DNA, 727 bp, Triticum aestivum
  Clone ID: PAT_TA_15788
tctgtgtctgtactcagagcgaggtcacgggcccaacaatgcctcgctccggcgctctccccctcctcgccgcgctggtcctcgcccttgcggccgcggccgcagcctcctcgggagcggcgaagggcgcaccggcggccaccgacttcatccgcaagtcgtgccgcgagacgcagtacccgtcggtgtgcatgcagagcctgtcgtcgtacggcaagccgccgccgcgcagcccgcagcaccgggcgcgcgcggcgcggccggtgggcgcggcccgcgcgcgcgcggcgtcggcgtacctggggcggaatctgcgggccggccccccgcggcggcggcggcgccaaggcggcgaagggcagccccgcgcgcgactgcctggagaacatggcggacagcgtgggccacctgcgcgacgcggccaaggagctggacgggagcctgggccggcccgggtcgccgggcgttccggtggcacctgagcaacgtgcagacctggtgcagcgcggcgctcaccgacgagaacacctgcctcgacgggctctcccgcggcgtggacgccggcacgcgcgccgccatccggagcaaggtcgtggaggtcgcccaggtcaccagcaacgccctggcgctcgtcaacaaggtcgggtccgggcactagcccggcccgtcccaggcccatccccactcgcttcgccttgctgcgtactactgcgcgcgtacgcatagc

SEQ ID NO: 15789 - DNA, 898 bp, Triticum aestivum
  unsure (1)..(898): unsure at all n locations
  Clone ID: PAT_TA_15789
gcacgaggccacctcctgccgctgctcgagtgctcgctcgctccctcggctactcccccgtgccgtcccgtcccgttctgccgttctactactccaagccgaagcctacccaccctgccgcccccatcctcccctcccctcgccgaaatccgccaattcccctccgaggccgccccgccccgccgatccacccgccgcaggcgcgttatccgctgggattccggcggctcgtcggttggagccagccgccgggatcgtgccgcggcgcggttcccggctgattcgtccccgcgtggatcggcttggcggtgggatgcgaggcggcggcgccggcgcggagatcgaccggaggctgtagcgcttctgcgcgtgcgaggtggtaagcggtgaggccgctggttagggggactaggggttcgtttgctccggaggggcggacggaatggggagcttctgctccaagggatcggcggtggacaagtcgcccagcgacaccacactcggtcccgaccgcgtgatccaccaccacgagcgtggcgcggtgaacgacgagaggaagaccgcggcggacgacgctgctgccaagaggatgcacgagcagccgccgcagcaacaccagcggccaccacaacatcaacaaccaccacaacatctacaaccaccacaacagcacccgcggcagcagcaccagcccccgcgtctctctgccccccagacgccccccgctggggccgccgctggcgctggctcggcgccatgggatggtgtgccttcgctggctcggaatccgtcccagaaagggatgggcatggcgaaagctggtgctgccaaggtttcngaagtaagctcaattctgggtagggctggtactgttgggcttggcaaagcagtggacgta

SEQ ID NO: 15790 - DNA, 611 bp, Triticum aestivum
  unsure (1)..(611): unsure at all n locations
  Clone ID: PAT_TA_15790
cacgataggaagaggcgaacagggccgcgacgcagagcttccggcggcgcaggttagtggattggtcagcggatctgaaggtcagtggatcggagccgagcagccagatcgaagttccataacatcagaaggctctcccctcttcccccaaaccccagccatggccaacgccgccgaccccgccgccgaccaaaaccctaaggacgccgggggccgcgtccccgagccctgggctggcgccgatggagaagtcgccgaggaggaggacgagtacgaggacgaggaggtgctccacgcgccggcggccgcggccctcgtgccgggcggggcgccgccggcccctcgggggctccccccgcccccccggcggctccgcgtccacgacgtcatcatcaggggcaacgccaagacgcgggacgagctcatcgaggcggaggtcgncgaccttcttcgctccgccaccaccgtgcaggacctgctgagcgccgctgccgacgccagcgcgcggttccgcgggctcgacgtgttcgaggccgtcaacatcacgcttgatgccgggccngnccgaactgnccgggaccaaccacggtggtcattgaaggtccgtcaac

SEQ ID NO: 15791 - DNA, 838 bp, Triticum aestivum
  unsure (1)..(838): unsure at all n locations
  Clone ID: PAT_TA_15791
cgtccgcccacgcgtccggaatatttcaaacaccgctccaaaatggaccaaaggatggattagaagataccataaagtgtggcatggaagttagtttgacgtcgccaaatagtgcaagtgtggtggcaatgggaaccattcagaaaactgatagaaaagctaaagctattgatggccaaccactagctgattgtgttgaagttcttatcaacgtcgtgctcaaagaaacaactgagctgcctcgtgcacaagggaaaataaacaggctaggaaatgcccaagctaggtgtattccatggccacgcaaaaatattatgcaaatagatcgtactaccgtgctgcactctaaggtttctagtgtttgtagtcaggtgtctttcaacaatagcgagaatgtggatcccaacaaaacaactactggaactcaggtgaccaaccatgagactggttgcagtacttcagaaggtgcagtgagtaatacactgaagagaaagaaggtttctaaaacaacaagaatgaaaaaagctactcaagcaatctctgctacaaccggaaacaacatacttaggaattcgggcagggaaacatgaaagatggtcatagaagcctagaaatgctggtacactgctcaaggttgaagttgaaggtgacacatcgctgatttgcttgcccttgtgtgtgcccgtctaagattggcttgctcttatgctggtacactgctgattggattgctcttgcatcaagctggaacacttgttcgtattgttgtcacaacattaggaagtgacctgtgtgtttctgattgatacttnatattgtttcgaatttgnaagatgtt

SEQ ID NO: 15792 - DNA, 788 bp, Triticum aestivum
  unsure (1)..(788): unsure at all n locations
  Clone ID: PAT_TA_15792
gacaacctcgcgcttctctcctcccgttactactcgctctacaagcaaacgtgactattgtggttcagcatcgatcgccatgccgactccgccgaagctgaacaaggacccgcacaaccactacttcgacttgcgggcggcgcaggcacgtgccgcagacgcacgcgtgggaggggctgcacgagctcccggtgggggacggcggcgttggcgctggggaggaacgccgcgccggtggtggacatgccggatccgctcgcggcagaggcggtggcgcgtgcatcggagcaacgcggagcgttcctgctccagggccacggcctgcccagggggccccgcgcgcgcgccgtggccgccagcgcccgctccgctgcgctgccgcgctccgccgagtggcgcgccccgcgcctgcgccgtccccccgacggctccgggcgccccctcgtccccctcttcttcgccaagtcccggggggccgggcgccgctccccgcgcccgccctccctccgccccgtgctccccgcgctctggcccgccgccggccgcggccccaccccatccgggtctgtctccattccacgtgttagtacgacacccgcgaaaactgccgtgaatgcgttagcccagaatcactcccgcatagacctttggccggccacaataggaatatctcttgaaagactacgccggaaacacacaaccggtgtcgcgcaatctctaaacagtggggccaaacgtccctcttaagtttnccttcagagcgggatattgtatgggggggccccaat

SEQ ID NO: 15793 - DNA, 805 bp, Triticum aestivum
  Clone ID: PAT_TA_15793
aaaagatttttgctaccagcacctaagctccaatggagggtgagaagaactcgtccggggacctgatgtccagcagcaagctggtcgcggaggcccccaagacggcctacgagaagaagagcgtcgagggcatcgacaaggaaaaggtagccgccgcctccgccgacatcctcgactccgccgccaagtacggcaagctggaggacaagccggtggggcagtacctcgagaaggctgaggggtacctgaaacagtacagctccggcggcaccgagaaggagaaaaccgacgcacctgctgccgctgacgcaccgaagccggatgcacccaaggaggcagcgcctgcgcctgcccctgccgcggaggaagagaaatcgtccgatgggttcggtctcgacgacgtcatgaagggggctgcatcgctgtcggggaagaagagtggcgaggaggagaaggagagcggcggcggcggcgggttcatgaagatggctcaggggttcatgaagtagaagtctggtttctacatctacatgcatgtagctcttgttaagtttgtgcgctgcgttacttctgtattttgttactctataacgttgtggttgtgcttaattatgttagctgctgatatctggttctgtaaagtttcttaagtcatgtctgtctgtattgatgatcaataatccagttgtgctagctacccttttttgttgacgaaaagttgtgctagctagctggttccccttcctgcttgcaggatttcggttgtttataagtttttttaaggaaaacttctgatttattcatc

SEQ ID NO: 15794 - DNA, 849 bp, Triticum aestivum
  unsure (1)..(849): unsure at all n locations
  Clone ID: PAT_TA_15794
gcgttctcgggccacgctacccacgcgtccgactaacctcactactcttaagccacaaaagatttttgctaccagcacctaagctccaatggagggtgagaagaactcgtccggggacctgatgtccagcagcaagctggtcgcggaggccgccaagacggcctacgagaagaagagcgtcgagggcatcgacaaggaaaaggtagccggcgcctccgccgacatcctggactccgccgccaagtacggcaagctggaggacaagccggtgggacagtacctcgagaaggccgaggggtacctgaaacagtacagctccggcggcaccgagaaggagaaaaccgacgcacctgctgccgctgacgcaccgaagccggatgcacccaaggaggcagcgcctgcacccgccgcggaggaagagaaagcgtccgatgggttcggtctcgacgacgtcatgaagggggctgcatcgctgtccgggaagaagagtgacgaggaggagaaggagagcggcggcggcggcgggttcatgaagatggctcaggggttcatgaagtagaagtctggtttctgcatctacatgcatgtagctctcgctaagtttgtgcgctgcgttctactgtataacgttgtggttgtgcttaattatgttagctggtgatatctggttctgtaaagtttaaagtttcttaagtcatgtatgtctgtatgatgatcaataatccagttgagctagctagctgcttccttctaaaaaaacaaaaaaaaaaaagtatcttatattaatttgcagagggggtaatttataaatttgcggtataagaccaaaaaaaaaaaaaaaaaanaaaa

SEQ ID NO: 15795 - DNA, 811 bp, Triticum aestivum
  Clone ID: PAT_TA_15795
atttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacgaggaggcgaccctgaacctgaacgccatgaacaagctccagaccaagaagccatggaacctgtccttctccttcgggcgtgccctccagcagagcaccctcaaggcctggtccggcaagacggagaatgaggagaaggccagggcggcgttcctggtgaggtgcaaggccaactctgaggccaccctcgggacctacaagggcgacgccacccttgccgagggcgcctcggagagcctccatgtcaaggactacaagtactgatctgccccccgctgggatggtttgggcattcctgcttactacctccgtctgaaaataagtgtctgacacttatttttggacggagtagtatctgtttggtttcatagtcttgatatttttaaatatcaatccttgtttttaataatataagcttctactt

SEQ ID NO: 15796 - DNA, 531 bp, Triticum aestivum
  unsure (1)..(531): unsure at all n locations
  Clone ID: PAT_TA_15796
cgtccgaaccaactggggaagatctacctacccaatcactccctccaccatggccgcgcccgcgcccaccgtctccaagtcgccgccggcgctcgtgcccccggcggggccgaccccgggaggcacgctcccgctctcctccatcgacaagaccgccgccgtccgcgtcatggttgacttcatccaggtcttccagtccgcaccctcctccgccgacgaccaggtggccgccatgcgccagggcttcgccagggcgctcgtcccctactacccggtggccggccgcatcgccgagccgtccccgggcgagccccttcgtcgactgcaccggcgagggcgtctggttcgtggaggccgccgccaagctgctcgctcgccgacgtcaacgggctcgaggaccggccgctcgccatccccaagggngacctcaatcccccgncctcccgccgaccacaangctcgagggaccaagatnctcctcgcgcaagattaacanngttcagctgcngcgggtacgccnttcggnatttg

SEQ ID NO: 15797 - DNA, 720 bp, Triticum aestivum
  Clone ID: PAT_TA_15797
ggcacgaggccgccgccgaccgtagcacagcggcagagaagtgcggcaagcggccatggacttctgcccggcgtgcgggatgctgctgcagatccagccggccaccggcggccaccgcctgcgcctcttctgccccacctgcccgtacgtctgccccatcaaaaacaagatcgtgaagaaggcgaggctggtcaagagggaggtggagtccgcggaatctgcccccaagactgagggtgagcccaaggaatcggcccccaagactgacggtgagcccaaggccgatggtcagctcaagcaatctgcccccaagactgagggtacatgaccaaattgacacaatggagaaacatacttttggcagatgtggattcgattagtacatgtctacaagcattgtgaaacttgagtatctggacatgcgaacatgtggagcttctttgatcaaattatgttgcagcacacaatgccaaaagccaccaatcttgtgcaaagtaaagtgatatacatctgacagtgcagaagctcacttcaatgttggtttgttaattggacgcttcctttttttgcggggtaattggacacttcctttatgtgacattgcaggctttttggtatggagatgctttttgtgtgtgtgtgtgcgcgcgcgctagaggtgttgatttggtgtatgaatactcttcttattcaaccagcacaagaatgggtatgattgtg

SEQ ID NO: 15798 - DNA, 622 bp, Triticum aestivum
  Clone ID: PAT_TA_15798
gactgggagcatttcaccctccgcataagtaacttctctggagagctctcgtctgtctactactcagagcacagcgggggcggatgggtggatgcttgcgatctggagttcatctcaggaaacaaggcgatcgtgtactcatcaaggaatgggcacgcaagctatgcgcaccctggctgctacctgcagggctctgaaaacctcggcgtcggcttaagaaatgacgtcgcacggagcgagctgtcaatcgattctagcacgaggtacaagatcatctccgcggagtacctgggggacgccgtggcggaaccgtgctggctgcagtacatgagggagtggggcccgaccgtgacgtacaactcacggtcagaggtggacacggtgcttagcttcctgccgttcttcctccggttcacggcggaggccatattcgacagtcttcctgcggagctgtacgaggaggaaggcccgaccggacccgaaggagaaaaacaactgggatggtgatgagcggtgctaggccgcgtcgcctttgcggtctatccctgttgcttattcatgtacattgtatgtggtgagaatgttggttggtacggttgatgtattgataaagctttgcaag

SEQ ID NO: 15799 - DNA, 1057 bp, Triticum aestivum
  Clone ID: PAT_TA_15799
atccacattatctcaggatacagtcaatagttctgaaaatttagttcatttagttgaactaaagagggtcggacggtacccacaagatttcaaatttgcatgcctaccgcaaagacagggcaataactatgccgatgccactaaatttccaccagattatttcttcccagctagtacagtctcttgcattgtacagtagttttacaaatgttgctacctaactaatggcaaacaaccaacttaactggccaccaccatctatataccagacaaacatgtatatatgcaccaccttccactctgagatgctgctacaacatagatgttacacacaagtacaggtaatcacctcttatcctggtgcaagggcgcccttgagctcctcgcagctgcggggccgcatgagtcgtcatcgtctcattaacaatccacaaaattctataataataaagactaatttctttcatactgctctggcacggccaggaagggtctgaatgtgaggacaagtccaaggagctcgatgatgttcagcagaaagaacaccatctgatcacctggaaagaagaaagcatgctggcgtttctgcgcccacgagaacacaatgccggcacctgcaggggcaactgccttgaaaaaggacattccagtcatggctaatccatttgctgctcctctttggttctgaggcacggcattgttttgaaggatgaaagtgcctgtgatgatagtaacaccaagattattttttatgactgatgcaatattcagtactatgaggctggtgcccgctttgccaagtggcgtgccgtcctgaagattggccctaccgagccatcacagctttccatcaaccagaatgctcagggtctggctcgttatgccatcatctgccaggagaatggtctggtgcccattgtagagcctgagatccttgttgatggacctcatgacattgaccgctgtgcttatgtgaccgagatggtccttgctgcctgctacaaggctctcaacgaccagcatgtcctccttgagggtacctgcccgggcggccgct

SEQ ID NO: 15800 - DNA, 571 bp, Triticum aestivum
  Clone ID: PAT_TA_15800
gacaacaactatgccgatgccattaattcccaccagattatttcttcccagctagtacaggtctcttgcattgtgcactagttttacaaatgttgctacctaactaatggcaaacaaccaacttaactggccaccaccatctatataccagacaaaacatgtatatatgcaccaccttcattctgagatgctgctacaacatatatgttacacacaagtacaggtaatcacctcttatcctgatgcaaggccgcccttgagcccttctctccgccgtggcggggccgcatgagtcgtcatcgtctcatcaataatccaaaaaaaatctacaataataacgcacgggaaggctagtttctttcatactgctctggcacggccaggaagggtctgaatgtgaggacaagtccaaggagctcgatgatgttcagcagaaagaacaccatctgatcacctggaaagaagaaagcgtgctggcgtttctgcgcccacgagaacacaatgccggcacctgcaggggcaattgccttgaaaaggacattccagtcatggctaatccatttgctgctcc

SEQ ID NO: 15801 - DNA, 960 bp, Triticum aestivum
  Clone ID: PAT_TA_15801
ggagtagctttttttccaatcaactggccgatgcatcacagaatcgccagctataaatcataatacactagtacaattcatctcacggaaaatttcttgtataattggtgctaaagcaaaactttctttaaccagagtaagagccaagatggtaaaagctcttagctagatatatataattaacacatgttgtcgttaagctctccctcctaaaccaaaagaccacgacacactactcactagcagtgacagcaaaactaaacagtaagcctggcctgctttttacccgaagttgaactggaagccaccggggaagcccccgccggggaacccaccgccgtggtggaacgtgtactgctgcccaccgcctccgccgaacgggtcaaagctgccgccgcctccccccatgcccatctcctccaggtcctctccccggtcgtacctcacacgcttgtcctcgtcgctaagcacctcgtatgcggaggcgatctctcggaacatgttctccgcctcctcgcggttctccacgttcttgtccgggtgccactgcagcgccagcctcttgtacgcgcgcttgatgtccgcggccgatgctgtctttgagatgcccaggatcttgtaccagtctttccttttgctcagcttgagctgcctttcagctttcatgagcgcctctctgattgccatgtcctgtggggatttctgggcagcctctttgaggtcctcaaccgcaccttcccaatcttctgttagaagtttagcctcacctctctgtgccaaagcatcaacaagttcttcatctatgctgagtgcttctgtacagctgttgattgcctccttgcctctcccaagtttaaccagagtcttacatagcccgagataaagttgtacgttgtacatagtgtggtctggatccattgctagtgctgccttgtagtcttcaacagccacgcggaactt

SEQ ID NO: 15802 - DNA, 858 bp, Triticum aestivum
  Clone ID: PAT_TA_15802
cctccctccctccctcccctgccaaccccaaatctcccctcgcccgtcgcagctctcgaatcccccccgagcatcgaccatgtcggcctactgcggaaagtacaaggatgagctcatcaagaacgctgcctacatcggcacccctggcaagggtatcctcgctgctgatgagtccaccggcaccatcggcaagcgctttgccagcatcaatgttgagaacgttgaggacaaccgtcgtgccctccgtgagctcctcttctgcacccctggtgccctccagtacctcagcggcgtgatcctgtttgaggagaccctgtaccagagcaccaagggtggcaagcccttcgtcgacatcctcaaggcgggcaatgtcctccctggcatcaaggtggacaagggtaccattgagcttgctggaaccaacgggtgagaccaccacccagggctttgatgaccttggcaagcgctgcgccaagtactatgaggctggtgcccgcttcgccaagtggcgtgcaggcctcaagatcggcgcccctgagccatcgcagctctccatcgaccagaacgctcagggtctggctcgctatgccatcatctgccaagagaatggtctggtggcccattgtggagcctgggaatccttggtgtgggacctcatgacattggcccgtgggcttacgcaaccggaaacggccttgttggctggttcaaggcccttaaaaaaccagaagggcctcctcgaaggggctcttccggaaacccaaaaggggccccccgggttttgaacccaaaagggggcccccggggggattgttgggacacccgcccggccccctccaaggaccggccctttttggc

SEQ ID NO: 15803 - DNA, 1277 bp, Triticum aestivum
  unsure (1)..(1277): unsure at all n locations
  Clone ID: PAT_TA_15803
acctggccgcgcccgcgcccaccgtcgccaagtcgccgccggcgctcgtgcccccggcggggccgaccccgggtaggcacgctcccgctctcctccatcgacaagaccgccgccgaccgcgtcatggttgacttcatccaggtcttccaatccccctcctccgactcctcctccgtcgacgaacaggtggccgccatgcgccagggcttcgccagggcgctcgtcccctactacccggtggccggccgcatcgccgagccgaccccgggcgagcccgtggtcgactgcaccggcgagggcgtctggttcgtggaggccgacggcagctgctcccttggcgacgttaacggcctcggggaccgtccgctctgcattcccaaggacaaccttaccatccgagcttccggcaaccccggtgagaccaccacccagggctttgatgaccttggcaagcgctgcgccaagtactatgaggctggtgcccgcttcgccaagtggcgtgcagtcctcaagatcggcgccaccgagccatcgcagctctccatcgaccagaacgctcagggtctggctcgctatgccatcatctgccaggagaatggctgggtgcccattgtggagcctgagatccttgttgatggacctcatgacattgaccgctgtgcttacgtcaccgagatcgtccttgctgccgtccccgccattgtcttcctctctggtggacagagcgaggaggaggcgaccctgaacctgaacgccatgaacaagctccagaccaagaagccctggaacctgtccttctccttcgggcgtgccctccagcagagcaccctcaaggcctggtccggcaagacggagaacgaggagaaggccagggcggcgttcctggtgaggtgcaaggccaactccgaggccaccctcggcacctacaagggcgacgccaccctcgctgagggcgcctccgagagcctccacgtcaaggactacaagtactgattgatctgccttcggtgctgtggcccgtttgggcgtcccgcttaccagtatcattgtcattgtttggtttcctgagtcctgatatatcctcggatatcgaacatcgtttttaataatatggaacttgtgttttcaataataccgttagtatttccttttgggagttgaaataccctgaaaaccgggtgctgcgtacctnaatgggacaagttttgttccaatggcccgtnatttacctgctcatacaagtttaaacctgtcatattctgagtaaaaaaaaaaaa

SEQ ID NO: 15804 - DNA, 1596 bp, Triticum aestivum
  unsure (1)..(1596): unsure at all n locations
  Clone ID: PAT_TA_15804
cggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgaagcccaacatggtcacccctggatccgacgccaaagaaggtggcccctgaggtgattgctgagtacaccgtccgcaccctccagaggaccgtccctgctgccgtccccgccattgtcttcctctccggtggacagagtgaggaggaggcgaccctgaacctgaacgccatgaacaagctccagaccaagaagccctggaacctgtccttctccttcgggcgtgccctccagcagagcaccctcaaggcctgggtccggcaagacggagaacgaggagaaggccaaggacggcgttcctgggtgaggtgcaaggccaactccgaggccacccttggcacctacaagggcgacgccaccttgggcgaagggcgcctctggagagcctccaacgtcaaggactacaagtactgatctatctgccttcggagctgtggcccgtttgggcgtcccgcttaccagtatcattgtttggttttctgagtcctgatatatccttggatatcgaacatcgtttttaataatatggaacttgtgttttcacaaaaaaaaaaacccttgtcgaggaagagtggtatccatgggaatcagttgtacctngcccgatgatgatacgcgtgagtttgtcaaagtaggtaatttgaagagtgccgagctctatgctcatgttaaactggctcatggagggaccttcaccgacattgccatgtgggtgttctgcccgttcaatgggccagcgacgataaaggttggacttgcaagctttgctctgcagaaggttggcaggcatacgggagactgggagcatttcaccctccgcataagtaacttctctggagagctctcgtctgtctactactcagagcacagcgggggcggatgggtggatgcttgcgatctggagttcatctcaggaaacaaggcgatcgtgtattcgtcgaggaatgggcatgcaagctacgcgcaccctggctgctacctgcagggctctgaaaacctcggcgtcggattaagaaatgacgtcgcacggagcgacctgtcaattgattcgagcacgaggtataagatcatctcggcagaataccttggagacgccgtggtggaaccgtgctggctgcagtacatgagggagtggggcccgaccttgacgtacaactcacggtcagaggtggacacggtacttagcttcttgccgttcttcctccggttcacggcggaagccatattcgacagtcttcctgcggagctgtacgaggaggaaggcccgaccggaccgaaggagaaaaataactgggatggtgatgagcggtgctaggccgcgtcgcctttgtggtctatccctgttgcttattcatgtacattgtatgtggtgagaatattggttggtacgtaaaaaaaaaaaaaaaaaactcgagacctcgtccgaatc

SEQ ID NO: 15805 - DNA, 917 bp, Triticum aestivum
  Clone ID: PAT_TA_15805
actatgaggctggtgccccgctttgccaagtggcgtgctgtcctcaagatttggcctcaccgagccatcacagctctccatcgaccagaacgctcagggtctggctcgctatgccatcatctgccaggagaatgggctggtgcccattgttgagcctgagatccttgttgatggacctcatgacattgaccgctgtgcttacgtgactgagatcgtccttgctgcctgctacaaggccctcaacgaccagcatgtcctccttgaggggcaccctcctgaagcccaatatggtcacccctggatccgacgccaagaaggtggcccctgaggtgattgctgagtacaccgtccgcaccctccagaggaccgtccctgctgccgtccccgccattgtcttcctctccggtggacagagtgaggaggaggcgaccctgaacctgaacgccatgaacaagctccagaccaagaagccctggaacctgtccttctccttcgggcgtgccctccaagcagagcaccctcaaaggcctggtcccggcaagacggagaacgaggagaaggccagggcggcgttcctgggtgaggtgcaaggccaactccgaggccaccctcggcacctacaagggcgacgccaccttgggcgaaggcgcctctgagacctccactcaaggactacaagtacgaggctgcggaagacggcagagaaaagcgacaaggagagcaagcaggagtgtggtctccagtcacatgtgagagcaccaaggaagaggggaggytcgcagcrcgsatgatcttgccagttctgtcggtggctcttctcgtccttgtcagcgttgggatctatggatgggcataatagctctcttatggtcagatttaatgtgtcacattttctccacatcggstgtgagcattgt

SEQ ID NO: 15806 - DNA, 1149 bp, Triticum aestivum
  Clone ID: PAT_TA_15806
gtctgatgtcaatgttgagagtagagagtgtatgaccagagatgaacatgaaggtgaagagtcagatattgtaacttcgaagtgtacgagtgaatctgttgagtcatctgcagatgtagatgattctgagtcaaccggggttactattatgacccggcgccgtgctctaactagaagtgtgccttccgactgtgatgatgctcaatcaacggggattacaattatggcccggcgccctgctccaagttcaaatatgccttccgatgaagctgatgctgaggcaacagggattgatattatgagccgacacacagctccaagttcaagcacagatagctcatttaacaccgaacaagggactgcagtgcgaaggttacggctacaatcgaaccttgatgcaggatcatgttccagtgttgatggttcgtcaagttgcattataaaacatggaagtgaaaacaaagggctggaagctgagattgaagagcatgtggacacaaacttccctgatgacgctggcaacagtcatgctgatgagcaaatgtacatgcctgatcatgaagctaattctggtatgaggctgcggaagacggcagagaaaagcgacaaggagaacaagcaggagtgtggtctacagtcacatgtgagagcaccaaggaagaggggaggctttgcagcacgcatgatcttgccagttctatcggtggctcttctcgtccttgtcagcgttgggatctacggatgggcataatagctctctttatggtgggatttaatgtgtcacattttccccacatcggctgtgagcattgtacatactgtgtcttgctgcctgcgtttaagacggttgtaagacagcgaagtgtttgttccccttccggcggggggctgtgaaatgaagaagtgaggtaacaaatgagaagcgggatgaagcaaggagcaagtgttgctgtagatgcctgtgacttagtacatgctagtttttgttttcctgtcaccgcagatgttggcaaccaggttgtagccatccattatgtgtgttgttgtgatgatgtaaggtctgaacctaattagatctgttgcagatcctttttgcattttatagaactttgcagttgcttaaaaaaaaaaaaaaaaaaaaaaaaaaaa

SEQ ID NO: 15807 - DNA, 1422 bp, Triticum aestivum
  Clone ID: PAT_TA_15807
accaaagccgccagcctccgtcccctgcctgccaaccccaaatctcccctccctctgccgctctcgaaaattccccgagcatcgaccatgtcggcctactgcggaaagtacaaggatgagctcatcaagaacgctgcctacattggcacccctggcaagggtatccttgctgccgacgagtccaccggcaccattggtaagcgctttgccagcatcaatgttgagaatgttgaggacaaccgtcgcgccctccgtgagctcctcttctgcacccctggagccctccagtacctcagcggtgtgatcctcttcgaggagaccttgtaccagagcaccaagggtggcaagcccttcgtcgacatcctcaaggagggcaacgtcctccctggcatcaaggtggacaagggtaccgtcgagctcgctggaaccaacggtgagaccaccacccagggctttgatgaccttggcaagcgctgcgccaagtactatgaggctggtgcccgctttgccaagtggcgtgccgtcctgaagattggccctaccgagccatcacagctttccatcaaccagaatgctcagggtctggctcgttatgccatcatctgccaggagaatggtctggtgcccattgtagagcctgagatccttgttgatggacctcatgacattgaccgctgtgcttatgtgaccgagatggtccttgctgcctgctacaaggctctcaacgaccagcatgtcctccttgagggtaccctcctgaagcccaacatggttacccctggttccgatgccaagaaggtagcccctgaggtcattgctgagtacaccgtccgcaccctccagaggaccgtccctgctgctgtccctgccattgtcttcctctccggtggacagagcgaggaggaggcgaccctgaacctgaacgccatgaacaagctccagaccaagaagccctggaacctgtccttctccttcgggcgtgccctccagcagagcaccctcaaggcctgggctggtaaggcggagaacgaggagaaggccaggaaggcgttcctggtgaggtgcaagggccaactctgaggccaccctcggcacctacaagggcgatgccaccctcggcgagggggcctctgagagcctccacgtcaaggactacaagtactgatctgccttcggtgtggtggcccgtttgggtgtcctgcttaccagtattattgtttggttttcagagtcttgatatatccttcggatatcgaacctagtatggaacttgtgctctcaaaatagcgtaggtagtttcgtttttagagtcgaataccctgttactcgggtgctgcgtatcgtaaattggaggggtggcttttgttctatggtcgtgtaattttgctgcttacaatggtaaaacctgttatatgctgaaaa

SEQ ID NO: 15808 - DNA, 1512 bp, Triticum aestivum
  Clone ID: PAT_TA_15808
cgggaattaccaaaaaaaaaaaaaaaaaaaaaaaaaaaataacccaaggccaccaccccatcacctgcctgccaactagccccaaatctcccctccctcccccgctctcgaatccccccgagcatcgaccatgtcggcctactgcggaaagtacaaggatgagctcatcaagaacgctgcctacattggcacccccggcaagggtatccttgctgccgacgagtccaccggcaccatcggcaagcgctttgccagcatcaatgttgagaatgttgaggacaaccgccgtgccctccgtgagctcctcttctgcacccctggagccctccagtacctcagtggtgtgatcctctttgaggagaccctgtaccagagcaccaagggtggcaagcccttcgttgacatcctcaaggagggcaacgtcctccctggcatcaaggtggacaagggtaccgtcgagctcgctggaaccaacggtgagaccaccacccagggctttgatgaccttggcaagcgctgtgccaagtactacgaggctggtgcccgctttgccaagtggcgtgccgtcctcaagattggccccaccgagccatcacagctttccatcgaccagaatgctcagggtctggctcgctatgccatcatctgccaggagaatgggctggtgcccattgttgagcctgagatccttgttgatggacctcatgacattgaccgctgtgcttacgtgactgagatggtccttgctgcgtgctacaaggccctcaacgaccagcatgtcctccttgagggcaccctcctgaagcccaacatggtcacccctggatccgacgccaagaaggtggcccctgaggtgattgctgagtacaccgtccgcaccctccagaggactgtccctgctgccgtcccagccattgtcttcctctctggtggacagagcgaggaggaggcgaccctgaacctgaacgccatgaacaagctcgagaccaagaagccatggaacctgtccttctccttcgggccgtgccctccagcagagcaccctcaaggcctgggctggcaaggtggagaacgaggagaaggccaggaaggcgttcctggtgaggtgcaaggccaactctgaggccaccctcggcacctacaagggcgatgccaccctcggcgagggggcctctgagagcctccacgtcaaggactacaagtactgatctgccttcggtgcggtggcctgtttgggtgtcctgcttaccagtattatcgtttggttttcagagtcttgatatatccttcggatatcgaacctagtatggaacttgtgctctcaaaatagcttaggtagtttcgtttttggagtcgaataccctgttactcgggtgctgcgtatcgtaaatcggagcggtggtttttgttctactatggtcgtgtaattttgctgcttatacaatgggtaaaacctgttatatgctgagtacatgtcttgagttgctctatttcgattgtgttgcatcgctt

SEQ ID NO: 15809 - DNA, 1542 bp, Triticum aestivum
  Clone ID: PAT_TA_15809
cccacgcgtccgcggacgcgtggggcccccaaatctcccctccctctgtcgctctcgaatcttccccgagcatcgaccatgtcggcctactgcggaaagtacaaggatgagctcatcaagaacgctgcctacattggcacccctggcaagggtatccttgctgccgacgagtccaccggcaccatcggcaagcgcttcgccagcatcaacgttgagaatgttgaggacaaccgtcgcgccctccgtgagctcctcttctgcacccctggagccctccagtacctcagcggcgtgatcctcttcgaggagaccctgtaccagagcaccaagggtggcaagcccttcgtcgacatcctcaaggagggcaacgtcctccctggcatcaaggtggacaagggtaccgtcgagctcgctggaaccaacggtgagaccactacccagggctttgatgaccttggcaagcgctgtgccaagtactatgaggctggtgcccgctttgccaagtggcgtgctgtcctcaagattggcctcaccgagccatcacagctttccatcgaccagaatgctcagggtctggctcgttatgccatcatctgccaggagaatgggctggtgcccattgttgagcctgagatccttgttgatggacctcatgacattgaccgctgtgcttatgtgaccgagatggtccttgctgcctgctacaaggctctcaacgaccagcatgtcctccttgagggtaccctcctgaagcccaacatggttacccctggttccgacgccaagaaggtagcccctgaggtgattgctgagtacaccgtccgcaccctccagaggaccgtccctgctgccgtccctgccattgtcttcctctccggtggacagagtgaggaggaggcgaccctgaacctgaacgccatgaacaagctccagaccaagaagccctggaacctgtccttctccttcgggcgtgctctccagcagagcaccctcaaggcctgggctggcaaggcggagaacgaggagaaggccaggaaggcgttcctgggtgaggtgcaaggccaactccgaggccaccctccgggcacctacaagggcgatgccacccttggcgagggcgcctccgagagcctccacgtcaaggactacaagtactgatctaccttcggtgctgtggcacgtttgggtgtcctgcttaccagtattatcgtttggttttcagggtcctgatatatccttcggatatcgaacctagcatggaactttaccttaggtagttttgtttttggagttgaatgaatatcctgtttttggagtcgaataccgtgtaacctgagtgctgcgtatagtaagttggtggtaaaacctgttatatgctgagtacacatgctttgagttttctatttcaaaaaaaaaaaaaactcgactcgtgccgaattcctgcagcccgggggatccactagttctagagcggccgccaccgcggtggagctccagcttttgttccctttagtagggttaatttcgagcaggggtatcaaa

SEQ ID NO: 15810 - DNA, 1455 bp, Triticum aestivum
  Clone ID: PAT_TA_15810
gccggccgggccgggaaaccgcctccgtcccctgcctgccaaccccaaattccgctctcgaatctttcccgagcatcgaccatgtcggcctactgcggaaagtacaaggatgagctcatccagaacgctgcctacattggcacccctggcaagggtatcctcgctgctgatgagtccacaggcaccatcggcaagcgcttcgccagcatcaatgttgagaacgttgaggacaaccgtcgtgccctccgtgagctcctcttctgcacccctggtgccctccagtacctcagcggtgtgatcctctttgaggagactctgtaccagagcaccaagggtggcaagccctttgtcgacatcctcaaggcgggcaatgtcctccccggcatcaaggtggacaagggtaccattgagctcgctggaaccaacggtgagaccaccacccagggctttgatgaccttggcaagcgctgcgccaagtactacgaggctggtgcccgcttcgccaagtggcgtgcagtcctcaagatcggcgccaccgagccatcgcagctctccatcgaccagaacgctcagggtctggctcgctatgccatcatctgccaggagaatggtctggtgcccattgtcgagcccgagatccttgttgatggacctcatgacattgaccgctgtgcttatgtcaccgaggtcgtccttgctgcctgctacaaggccctcaacgaccagcatgtcctcctcgagggcaccctcctgaagcccaacatggtcacccctggttccgactccaagaaggtggcccctgaggtgattgctgagtacactgtccgcaccctccagaggaccgtccctgctgccgtccccgccattgtcttcctctctggtggacagagtgaggaggaggcgaccctgaacctgaacgccatgaacaagctccagaccaagaagccatggaacctgtccttctcctttgggcgtgccctccagcagagcaccctcaaggcctggtccggcaagacggagaacgaggagaaggccagggcggcgttcctggtgaggtgcaaggccaattccgaggccaccctcggcacctacaagggtgacgccaccctcgctgagggcgcctctgagagcctccacgtcaaggactacaagtactgatctatctgccttcggagctgtggcccgtttgggcgtcccgcttaccagtatcattgtttggttttctgagtcctgatatatcctcggatatcgaacatcgtttttaataatatggaacttgtgctttcatgatatcgtagtagtttctttttggagttgaagtaccctggaaatcgggtgctgcgtatcgtatattggagcaggtttttgttccatggtcctgtaatttacctgctcatacaatgttaaaacctgtcatatgctgagtacacatgtgttccggcacttttttcttgc

SEQ ID NO: 15811 - DNA, 1482 bp, Triticum aestivum
  Clone ID: PAT_TA_15811
gaggaattcggcacgaggcaacccccaatctcccgtcgcagccctcgaatctcccccgagcatcgaccatgtcggcctactgcggcaagtacaaggatgagctcatcaagaacgctgcctacattggcacccctggcaagggtatcctcgctgctgatgagtccaccggcaccatcggcaagcgcttcgccagcatcaatgttgagaacgttgaggacaaccgccgtgccctccgtgagctcctcttctgcacccctggtgccctccagtacctcagcggtgtgatcctcttcgaggagaccctgtaccagagcaccaagggtggcaagcccttcgtcgacatcctcaaggcgggcaatgtcctccccggaatcaaggtggacaagggtaccatcgagcttgctggaaccaacggtgagaccaccacccagggctttgatgaccttggcaagcgctgcgccaagtactatgaggctggtgcccgcttcgccaagtggcgtgcagtccttaagatcggcgccaccgagccatcacagctctccatcgaccagaacgctcagggtctggctcgctatgccatcatctgccaggagaatgggctggtgcccattgttgagcctgagatccttgttgatggacctcatgacattgaccgctgtgcttacgtgactgagatcgtccttgctgcctgctacaaggccctcaacgaccagcatgtcctccttgagggcaccctcctgaagcccaacatggtcacccctggatccgacgccaagaaggtggcccctgaggtgattgctgagtacaccgtccgcaccctccagaggaccgtccctgctgccgtccccgccattgtcttcctctccggtggacagagtgaggaggaggcgaccctgaacctgaacgccatgaacaagctccagaccaagaagccctggaacctgtccttctccttcgggcgtgccctccagcagagcaccctcaaggcctggtccggcaagacggagaacgaggagaaggccaggacggcgttcctggtgaggtgcaaggccaactccgaggccacccttggcacctacaagggcgacgccacccttggcgagggcgcctctgagagcctccacgtcaaggactacaagtactgatctatctgccttcggagctgtggcccgtttgggcgtcccgcttaccagtatcattgtttggttttctgagtcctgatatatccttggatatcgaacatcgtttttaataatatggaacttgtgttttcataataccgtagtagtttctttttggagttgaagtaccctggaaatcgggtgctgcgtatcgtatattggagcaggtttttgttccatggtcctgtaattttcctgctcatacaatgttcaaacctcatatgcgagtacacatgtgttccgtcaccttttcttgctttgttctaagctgtcaaatggctatcgataagtttcattcata

SEQ ID NO: 15812 - DNA, 1556 bp, Triticum aestivum
  Clone ID: PAT_TA_15812
cttggcctctttataacccccaccctctaatcatccccgtccaccaaagccttcagcctccctccctccctcccctgccaaccccaaatctcccctcgcccgtcgcagctctcgaatcccccccgagcatcgaccatgtcggcctactgcggaaagtacaaggatgagctcatcaagaacgctgcctacatcggcacccctggcaagggtatcctcgctgctgatgagtccaccggcaccatcggcaagcgctttgccagcatcaatgttgagaacgttgaggacaaccgtcgtgccctccgtgagctcctcttctgcacccctggtgccctccagtacctcagcggcgtgatcctgtttgaggagaccctgtaccagagcaccaagggtggcaagcccttcgtcgacatcctcaaggcgggcaatgtcctccctggcatcaaggtggacaagggtaccattgagcttgctggaaccaacggtgagaccaccacccagggctttgatgaccttggcaagcgctgcgccaagtactatgaggctggtgcccgcttcgccaagtggcgtgcagtcctcaagatcggcgccaccgagccatcgcagctctccatcgaccagaacgctcagggtctggctcgctatgccatcatctgccaggagaatggtctggtgcccattgtggagcctgagatccttgttgatggacctcatgacattgaccgctgtgcttacgtcaccgagatcgtccttgctgcctgctataaggccctcaacgaccagcatgtcctcctcgagggcactctcctgaagcccaacatggtcacccctggttctgactccaagaaggtggcccctgaggtgattgctgagtacaccgtccgcaccctccagaggaccgtccctgctgccgtccccgccattgtcttcctctctggtggacagagcgaggaggaggcgaccctgaacctgaacgccatgaacaagctccagaccaagaagccctggaacctgtccttctccttcgggcgtgccctccagcagagcaccctcaaggcctggtccggcaagacggagaacgaggagaaggccagggcggcgttcctggtgaggtgcaaggccaactccgaggccaccctcggcacctacaagggcgacgccaccctcgctgagggcgcctccgagagcctccacgtcaaggactacaagtactgattgatctgccttcggtgctgtggcccgtttgggcgtcccgcttaccagtatcattgtcattgtttggtttcctgagtcctgatatatcctcggatatcgaacatcgtttttaataatatggaacttgtgttttcataataccgtagtagtttctttttggagttgaagtaccctgaaaatcgggtgctgcgtatcgtaaattggagcaggtttttgttccatggtcctgtaatttacctgctcatacaatgttaaaacctgtcatattctgagtacacatgtgttccgtcaaaaaaaaaaaaaaaaaaaaaaaaaaaaaaaaaaaaaaaaaaaaaaaaactcga

SEQ ID NO: 15813 - DNA, 1570 bp, Triticum aestivum
  Clone ID: PAT_TA_15813
gagttccgtttgctcgaaattaaccctactaaagggaacaaaagctggagctccaccgcggtggcggccgctctagaactagtggatcccccgggctgcaggaattcggcacgaggccacccccaatctcccgtcgcagctctcgaatcccccccgagcatcgaccatgtcggcctactgcggaaagtacaaggatgagctcatcaagaacgctgcctacatcggcacccctggcaagggtatcctcgctgctgatgagtccaccggcaccatcggcaagcgctttgccagcatcaatgttgagaacgttgaggacaaccgtgccctccgtgagctcctcttctgcacccctggtgccctccagtacctcagcggcgtgatcctgtttgaggagaccctgtaccagagcaccaagggtggcaagcccttcgtcgacatcctcaaggcgggcaatgtcctccccggcatcaaggtggacaagggcaccatcgagcttgctggaaccaacggtgaggaccaccacccagggctttgatgaccttggcaagcgctgtgccaagtactacgaggctggtgcccgcttcgccaagtggcgtgcagtcctcaagatcggcgccaccgagccatcacagctctccatcgaccagaacgctcagggtctggctcgctatgccatcatctgccaggagaatggtctggttcccattgttgagccagagatccttgttgatggacctcatgacattgaccgctgtgcttacgtcaccgagatcgtccttgctgcctgctacaaggccctcaacgaccagcatgtcctcctcgagggcaccctcctgaagcccaacatggtcacccctggttccgactccaagaaggtggcccctgaggtgattgctgagtacaccgcccgcaccctccagaggaccgtccctgctgccgtccccgccattgtcttcctctctggtggacagagcgaggaggaggcgaccctgaacctgaacgccatgaacaagctccagaccaagaagccatggaacctgtccttctccttcgggcgtgccctccagcagagcaccctcaaggcctggtccggcaagacggagaatgaggagaaggccagggcggcgttcctggtgaggtgcaaggccaactctgaggccaccctcgggacctacaagggcgacgccacccttgccgagggcgcctcggagagcctccatgtcaaggactacaagtactgatctgccccccgctggatggtttgggcattcctgcttactacctccgtctgaaaataagtgtctgacacttatttttggacggagtagtatctgtttggtttcatagtcttgatatttttaaatatcaatccttgtttttaataatataagcttctacttatagttaatttttgacgttgaatcccctgtaatacatttgctgagcagaatgtttttgctctaagcggtattgtattttttctgcttacaatgaaatgaaatggtgaaccccccctttacgctgaaaaaaaaaaaaaaaaaaaaaaaaaaaaaaaaaaaaaaaaaaaaaa

SEQ ID NO: 15814 - DNA, 610 bp, Triticum aestivum
  unsure (1)..(610): unsure at all n locations
  Clone ID: PAT_TA_15814
tcccactcctgaaccctaaacccagccgccgccatggccgccgccgtccgcctcttcctgcgccgccgcctcgccacggccaccgccacgcctccgaccccggcctccatcctcaacccttcctccccgaccaccccgctcacctcgcggcagaagacccgcctcgccatctccctcctcaagtcctccccgccgccgccccccgaccagatcctctccatctgccgcgccgccgcactctccccgaaagacccacctcgaccgtgttgctctctccctcgccacctcgaggctctccaccgccccggatccctccgagactcacgtcctctcttctcatcccccaccacgcccaccacgccatcgtgtctttggcaagccggcctcctccccgacccatctccacttccagtcatcccctccaccgtccctcaacgctctcttcgctgcatcgtcgccggaacacacgaggcggtcgctcttccagacttcccgagccacgggtcaacccaagccgagacctaagcattgaaatttctccgagtcggaaaaacccttcnatcgggttnatgaattgaagaggctgaaccacgcacanattangcggatt

SEQ ID NO: 15815 - DNA, 583 bp, Triticum aestivum
  Clone ID: PAT_TA_15815
acgccctcccgcctactcgaaacccccaccccgtcacgcgcacgccacaacccccacaagggaagcgagagcggcggcgggcggcggccatggcgcggtgcagcaacgggctgctgggcctgctgaacgcgggggtgctggtcctcgccctcgtcgtcctcggcggcggcatctggctgagccaccgggccgccaccaccgactgcgagcggttcctggagcggccggtcatcgcgctgggtgccctgctcctggcgctctccctcgcgggcctcgcggggtccctctgccgcgcctcctgcctcctctggctctacctcgtcgcgctcttcctcctcatcgcgctcctcctcgtcttcaccgtcttcgccttcgtcgtcaccaaccgcggcgccggcttccgtcgtctccgggaggggctacaagggaatacccgcctcgggggggtcccccccccccggccgctccggccccccgggcgccgcagctgcgcccccggccgtctcggcccccgggcggccccggctggcggtccccttcccggcgaatggggcggggggttccttgccccaagaaggttttc

SEQ ID NO: 15816 - DNA, 1122 bp, Triticum aestivum
  Clone ID: PAT_TA_15816
gtgaacatggttacaacctacctctccatttgcgaaagaaaaaggaaacctaccgctctccgaccgtccatggcgccgccggcggtccggtcgtggggggagctgcagcacgacctccttgtggcgattatgtcccgcgtgggcgcccccgatttactttctggcggcgcaccccgtacctgctctgcgtggtgggccgccgctcgcgacccgctcgcatggcgccgcgttgatctccgggactggacagcccggacctccgcccggcgcgcggctggggccggtgccaccagagggagcatctccgtccaggccgctctcaccggcgaccttgaggtcgccgcaacgcgggcagatggtcggatggaggctgtgctcctccctgagtttgccgatgaagagcacctcatgttcctcgccgagaggagcccaaacctgcactatttcagctttcctaccacatgtatgacttctgatgacttctgtatggcgatcaccaaacttcagtcacttaaaggcatggcggtggatgagagtcttgttaattatgatgtcctcctccatgtgcaccaatgttgcccagactttctggaactgaaagtgtttgctctctatgtggatgaagatatggcctccgtaatttgcgagtcccttccgcggctgaagaagctcgagataccaaattctgatatgtcctgtgctgcaatagtaaaattcctggattgcctagaggagcttgagtatctggatatatcaggttatgagacctcggccatctcaagcagtgtgcttcataaagcttcacggctcaaggcctttatctggaactcaaagtttgagcttggcgagttcatggactgctcaaattgtggagaacacaacattaatcctcaggagccctgtaagtgcaccatggataacaaagtcatggattggctggctgggccatcgcaaactgcctgacaccgggcatgcatgtgtagtctctgttgttaactaattataatttcctgtttgaaaattctaaataagtttgagttggtcgtagtacaatgtaatggatggtacattcgactgcatagtcgatatgacattttgtttgcttgtctgcctgttttttct

SEQ ID NO: 15817 - DNA, 1110 bp, Triticum aestivum
  unsure (1)..(1110): unsure at all n locations
  Clone ID: PAT_TA_15817
cgtccgggcttcatcatcgggggacaagaccgttcgttttttggatgtatttgagagcaagggtgctgtggaaacgtttcaacactcacatgatgttcttaccttggcttatcgtcctgacggaaggcagattgcatgcagcacactagatggcctaatcaatttctgggatccttttgatggcttattgatgtatacaattgaaggtcgcagggatatttctggtgggcgcctcatgacagatagaagatctgcagctaatacaggtataggaaagtacttcacgacgctgtgctattctgccgatggaagctatattttagcaggaggaaacagcaaatatatctgcatgtatgatattggagaacaggtgctgttgcgtagattccagatcactcgcaatctttcattggatggagttctcgattttctgaactcaaaaaatatgaccgatgctggtccactagatctaatcgacgacgaagatagtgatgttgaggatggaattgatcaacaaacaagaggtagcctggggcatggtttacctggatccatggcaaatcgtggaaggcccatagctcggacaaaatgtgtgaaatttgctccaacaggaagatcttttgctgcagcgaccactgatggtgttctgttgtactcggttgatgaatcatttatttttgatccaacagatcttgacattgatgttactcctgagaaagtggaggaagctcttgcagaaaaccaacaacagagagcccttctactgagcctccggttaaacgaagactccttgattaagaaatgcatctttgctgtggatccatccaatgtacgagcaatctgctcatcagtaccctttaagtatcttcagagattgatcgatgcattcgctgacctcctggaaagctgcccccatctggaattcatcctcctctgggctcaggagctttgcaaggttcacggaagctacatccagcagaactccaggaccttgcttcctgctctcaagtcgttgcagaaatctataacaaaactacaccaggatctggcggacacttgttcctccaacgagtacatgctcaaatacctgagctctgctgggacnaagnn

SEQ ID NO: 15818 - DNA, 535 bp, Triticum aestivum
  Clone ID: PAT_TA_15818
gagacccacaaggggccggtaaccgccacccgcatcacgatggacagcaccgtggacgcaatggcagcggcctacgacgcgctggtggacgccgcggcagcccacgtccgcgagcccggccgcgccgccgctgtggaggacctcaagcgccgcctcgacgccttccacgagtgctgcgaccgcgcggaggacctcgtccacacggccgccgcccgcctcgggcccgccgacgcccgtgccgccggcgatcgccttgacgcgctcgaccgcaccctgcacgccgtcggtgctcccggtgaggacaaggggatggcggttcacgaagatgggaaggatcccgcggcgcccacttcgccggtggtggccggagccgaggacaagtaggtcactcgttcggtcggtccatccatcgatctcgcctgttgttgttggatgtgatgttgagtaattaatcctctaggttatttattactcttaaaattgtgttaatcggccgagtcatatctatctatcaaaaaaaaaaaaaaaaaactcg

SEQ ID NO: 15819 - DNA, 507 bp, Triticum aestivum
  Clone ID: PAT_TA_15819
cgtccgggaagaggaggcgctcgtgccgcaccacgagctacccaacgggacgcagccaatggaagcggcccctgctgagctggctactactgtcgaaaaccagccaacagaggatacaccaatctcgagatttacttggaccattgataacctatcaagagtgaatacgaagaagctctactctgaaacttttgttgttggtggctacaagtggcgagttttgattttcccaaggggaaataatgttgaattcttgtctatgtatttggatgttgctgattcagcagtcttgccctatggatggactagatatgcacagttcagcctctcagtggttaatcaaattcacaacaagtttacaataagaaaagaaacacaacatcagttctctgctcgagaaagcgattggggtttcacttcatttatgcctttgagtgaactctacaatcccagtagaggttatcttgtaaatgatacttgtgtaatagaagcagaggttgctgtgtg

SEQ ID NO: 15820 - DNA, 619 bp, Triticum aestivum
  Clone ID: PAT_TA_15820
cccaccccccgcctcgccgccatggagccctccccgtcctacgcgctccacctggccgtcgcggcgctcggccccgccacccgcgccgccccgcccgcccgctacatgcaccgcaagaccctcgaccagctcctccgcttcgcccgctccctcgaccgcgaccaccgccgccgcgcccgcctcctccccgacggcgccgaggacagcgaccccgaccgggaggacgccgaggaggacgacgacggccctcccccgcaccgggaccacgatcgccgcaccctccccatcccgccggggctcccgccgctccacaccggccgagagggcaagcccactatatctccagctgcgaacaaaagagttgggtctctggttagaccaacgacaccaaaatcctctgttcctgctgtcagcacatttgagagcatcgaagactcagacgaggatgttgatctcgagccggattccaaaaatgatgatgctgtctacgttggcacaaatggggctattggatcagacccggttcctgttaaagcggatcagaatggggacataccagcaacgagcatgattagatctcacagtgcaactggcagtctccatgggatccagctaaatc

SEQ ID NO: 15821 - DNA, 324 bp, Triticum aestivum
  Clone ID: PAT_TA_15821
cgtccggcgaaaagaaaaataacaatccgagcgtagcgaaaccctaggcagcgcagcagaggaaccgatccccggcgatggcggcggcgatggaggagctgacccgcagcgggttggcggggatggatttctccatcttccgcggggagtccgagggcgagcggggtgccggggggaaccatgagtgtatcaacatcaggcctccatccccatccccatgcgccaacgaggagcagccgccgccggagaagatggagcaggaggaggaggagggggagggggagaaggaggagtgggtctacagggaggaggatcggatcacca

SEQ ID NO: 15822 - DNA, 370 bp, Triticum aestivum
  Clone ID: PAT_TA_15822
gcgacgacagggattccttggacgaggatgacctaacctgatcccaaactgcctggcgagatgcagagagaaccacagtcaatcgagtgaccacgccattgatgaacaggaaaggttgtaaaaacacattctgaatcgcatagatacttgtaggctgcatctgtatcatggatttcgatccccttgttttcgttgttccggacctgtgcacacacaccctacatctgtaccgctggtttgccgttgttgtgatagtcttattggtttgattacctcgacagtgttctgttatctgtgtatatataccagcatgtgttgaagtacagacgaatttcacaacttgtgatttgttgatcagtgttgatgatgc

SEQ ID NO: 15823 - DNA, 1420 bp, Triticum aestivum
  Clone ID: PAT_TA_15823
gccgcgcggccggccggacggaccgacgggacggacaccccctgcgaggaaccggatcgctgcctccctcccaaccgcagctcggcagctcagctcaacacctcaacgccaacccaacccagcccagccgtcgtcggcgaggagcagcagcggagaggaagaagaggaggagacggtggtctctctccgccatggccagctcgtctgccgacccggagaagctcatggccaaggccgacaaactaaccaaactgagctttacaagatggaatgctgattggaagagtgctaccgccttgtacgaacaagctgcaattgcttatagattcagaaaggacaatgagaaagcaaaggatgcatttgagaaggcttcaaaaggacaagaaatgatctcatcaccgtgggatgctgctaagcatatggaaaatgctggtgctttagcaaaggagcttggactctggaatgaagtttcggacttttatcgcagagcatcagaattttaccgtgaatgtggaagatcgcaacctgcctctgatgctcttgcaaagggtgccagtgccttggaagataaagctccagaagaagcaactaaattgtatgatgacgcttgcacacttctagaagaagatggaaaggagcagatggcttttgacttgtaccgtgctgctgcaagtttatatgtgaagcttgagaagtactcggatgccgctgcattccatttaagacttggttcagctgctgataagtgcaatgccgtcaacagccaatgcaaggcctatctgagtgcaatcattatctacctttatgcacatgattttcaacaagctcagaaatgctacaatgattgctcaaaggttcaaggcttcctgaatagtgaccagaatcgatgtgcaatgaaactgttgtttgtttttgaggagggggatgttgaaaaaatcaagggggctgttcatccagtgccctttatccccctggaccttggggtattcggggctcagcgaggctaccaacaggtggcctgcaggccatcaagaaagatgtaggaggcgacggacgggggtgattccttggacgaaggatgacctaactttgatacccaaacgtgcccaacgagatgcaaaagagaagcacaatcaatcgagtgactcaaactatgtgccgttgatgaacaggaaaggttgtaaaaacccattctgaattacatatgcacttgtatcatggatttcgatccccttgttttagttgttccggatctgtgcacagacaccgtacatatataccctacatttacagttgttgtttgcttttgctacattcttatttgttcgattacctaaacagtgttctgttatttgtatatacaccagcatatgctgaaggacaaacggattccaaaaaataaaatcgtgcataataaaac

SEQ ID NO: 15824 - DNA, 853 bp, Triticum aestivum
  Clone ID: PAT_TA_15824
cgtccgtcgccttcaaggccgccgcctccgtctactcccggttcatcgcgctctccgccgagcagctccgccaaatcggggtgtacgcgcgcaaggcctcctacctccatgacctcgcccgcaagtacgcgtcggggatcctctccgacgacaacatcgtcgccatggacgaccgctccctcgccgccatgctcaccatggtcaacggcatcggcggctggagcgtccacatgttcatgatcttctccctcgcgcgcccggatgtgctcccctccgcggatctcgggatccgcaagggcgtgcagatgctgtatgggctggaggatgtgccccggccgtcgcagatggagaagctctgcgagcgctggcgcccttaccgctccgtcgccgcctggtacatgtggcggctcatcgagtccaaggcggcgcagacggcagcggccatgcctgtcgtgccacctgcaatgcctgcgcccagtgaggagttcatgctccagcaacaccagcagcagcaccaccaccatcagcatcagcagcagcagcaacaagctgccatccaaatgctcgatccggttcagatgcttccaggattggggtgaattcggtatatactcgctctgctcatttgttcttgatgtgaaatggatgtcttaaacctgaatttgtcacttcatttgtgtatcattgttctgtatcggtcgagaagtgtagcattggacaggaggatctcgaggcaacttcattatcagttatagttggtgttgtgtcgttcatttgtaaatttctgctattttagacgtggttgccctagacatatttgtatccgacaaataaatttagaccaaaaaaaaaa

SEQ ID NO: 15825 - DNA, 798 bp, Triticum aestivum
  Clone ID: PAT_TA_15825
gtgttatttcatgaagaaaaggaaatgtgcagcatatctcacagttacacttaaaagatgccagccacttataagacaacaaatacattcacgttataacatccatactagatttatatgagataccaaaaccactatcacactctggttgtaggcgccccagatgattgagtaatcatcaccaaggagcagcgtcaaaagccatcctgcatatgccaaatgtcacatcaccacggagtcccatttctaagcatgtgatcctgttgggtgtcatagaatcatgcattgatcttgaggcaatgaacttcagttgctgcaaagcattctacagaatcttgcccttgttccactcctctaatagagcataaggatactctacctccttcccactaggatcaggcggacactcttttggcagtgccaatagtgagtcgtctgctttgtgtgcaaatacacccttgttgtgcacttcccgggataatatcctgatctgtttcaagatatcatccagtgatgttatctgataatcatccttactaataatgggatatttcccattgttggtcagttgcgcgtcgattgctttctttagcttcatttgaataatgtccgaaagttgcaatccaataagatgggggagggggctggtgatgaagcaacagaagcaggcctagtagcgcttcgaggtggaggaagcggttggcgaaaactgcgccttaggttaacttggagggagcgacttagccttaattggagggagcagattaagcctcagcctttgggtcactagaaggggcg

SEQ ID NO: 15826 - DNA, 991 bp, Triticum aestivum
  unsure (1)..(991): unsure at all n locations
  Clone ID: PAT_TA_15826
gcaaagtcgtcgccgtttatctcgatactcaaaggaaagtcgtcgcggtttatctccatattcgatctcgccaccgccgcctttctccgatcggaggcctgaagattagcgcgcggcgccgccgtcgaggcaatttttttctgctccggccggcaatcttgctcctggtcaccagatgaagacatctaagacggtgtccatgtgcaccccggtggaggagactcaaggcatacatgtgtttgatatcttgggttacagcaagcacaggggcatgggccacgacctcgacagtcacatacggtccgggattttctccgtcgatggccatgactgggaaatcaacttctaccctgatgggtttaatggatttggcccgtttaatggacatgggcaagattacatctcagtttttctcgtgcttttgagcaagaacactaaagtccgagcatcctgcgacatgaggctggttgaccagtacactggattctcatcttcaatgcataaaacagaacctaggtctttcggtcccggtgacgtcactatgttggctcctcagactccttttttcatgacgcgaagcgagttcgaggggtccccgtaccttagggatgatcgcctgacgatcgaatgcatcgtcactgttttcaagatgccacatgttactgaaaccaaatcattccccaaaatcgacatgccacaacctgacatgactgtgcatgtcagcaagctgcttgaaggaaatgacgggatttgatgtcagtttcatttgccggaggagagaccattggaaccccataggtttggtcttcgctatgaggccgccgggtttcaaagccaagatgctcttgggcgtcccatcaagcgagcgttgcggccggccttagccttaaccgtctggccacctgcccccctgccgggccttggcccctggctccttatccggccttggcccccccctttngcccnacnggcgaaggatacaaaagatgtt

SEQ ID NO: 15827 - DNA, 1288 bp, Triticum aestivum
  Clone ID: PAT_TA_15827
ctcttttttctcttcgtgtttcgcgtccagtcctccctccatgtgcactgtagcacgggtcaacacccgccttctgtttttgtaccagtcaagaaacagaacagagcaagtaagaacaaagaagagaagcaggagataggttccactgctgctgttccgctgcggcccctggggtagctccttgttcccatgctccccctccttccttaattcagcgtcttggccgtagtacaacttagtctgctaagctttctgtcgaacgttgattgacatattttgggaaggtgcgggcacctttaacggctttgtatccggtccttggacagtatcaagaagattggtcaactccatctggagagctcgtgtttcttcgtccaagagcagttcttgaactcttaagggcgcagttgatacctcccggtcttcaaccttcgagacatcagatttcaatacaaggttttgctcgggcggttccgtgggttttatttctggcttcttcttgatcttctttcttggcatcaccctattaatagcttcttgaaagcgcagggacctaaggcgatcaaattgtgcagttactgagtggagacgctcgctcaaaatcaaaaccacaccaatgctggtgagctatcaggtccaaccgggaagtctcatctcttgtgccaagccatgtgttcgctcttctattcctctcatcttcaaggatcctgttctttaggatatctatctgttccttgcatgcttttacaaaaataccaacttcatgctcaatgttgtccctctcttgctccgtggtgcgatgcatgtccacatagtccctcctgtgcttcactataaacttctcgagctccctgatgctctcaagcgtcttgattgctgcatttgtaaacggcgatttgggcgacggcttccggatgatgaaagacgacatgagcgcggccaattgcgactccgtgtagccatgggagagcgcggcgacgcgaacggactccttgaagtcctccgtcctgtcccggaccctcgacatcgcccaggcagcggcgcccacggggctcctcccaccagatccgcgtgcgctgaaattcaagagccggctaggcgcgtcaaccctgcaccctcgagctgataaggtgagcaaacctcgtacgggatctgcgccgcggatcagcgacgctcgagcgcggcggcgggtcgccggcgcgtcggatcgggcggcgtacgacgaggtgggaggtttggtcgaaggagaggaagacagacaggggcgcgaggaggcctcgtccgaatc

SEQ ID NO: 15828 - DNA, 609 bp, Triticum aestivum
  Clone ID: PAT_TA_15828
gggctgggggtttcccaccccccgatctagggttgcttttccccaccgcgcggacacaaaacgaagagcggcggcggcggggaggagccggcgtggaagacgatcgatctcgggggcggcgcgctggagacgcagatgggtggcggggttaaagccaaggaggagtaccgctttggctcgtccaaggtttctcctgctcctgctgaagaagtggctgctgctgccgctgccaaggggaagaaatccagggcgaagaaggctgctgctcctgctcctgctgctgccgctgccaaggggaagaaatccagggcgaagaaggctgcgtcgcggatagacttggacaaggctgaagccgttgtgtataaagccgatatgaaggcgagggagtctgccagggtagccaaggccaaggccgaggaggccgaagaagctgccaggatagccaaggccaaggccgaggaggctgaagaagccgcccgggccgccaaggcggatgctgaggcggccgccaaggcgatagaagccgcagacgaggcgatgcttctctatgagaaggagatggagtgggcgcagtgcgaggaagaattggacgcctccatgttccgcggc

SEQ ID NO: 15829 - DNA, 702 bp, Triticum aestivum
  unsure (1)..(702): unsure at all n locations
  Clone ID: PAT_TA_15829
cgtccgcttccccaattccggccacgccccagcgcctccgcctcccccttcactcccctcccagctcctccgccgcccccgtcgccgtctcctccgccgcgcccctccggccgggtatccaccagcgcgcttcctccctccctaccccccttccccagcgccgccgccttttccaccaactccatctgccaatctagaaacccctatttgttgcgccaccctcgctcgttctgattcggctgatctgatcggtcgctgagccgatgggcagcgacgccgaggaagtatcccagccggcgtcgtcgccggagtacgagcaggacgacgacgatgaggactgctacctgagcgatcaggaggacgatgccctagaggagtccgtcctccaggtcctcgaggacggcaacctcgaggactgccattggtcctcctcctccgtgatcaccaaggaatacctccgggcggcgcagagggaggatctgaggaaggtgatggagctgctagggttaaaggagcaccacgcaaggacgcttctaatccactaccgctgggatgntggagaggatattcgagctgctcgatcagaaggggagggataggctcttctccgaggctggtattcctctcggaaccgccaataatgctggctcgccctctgcgaccggaggtcacctgcaatggtttgttacgaatgatgtgccc

SEQ ID NO: 15830 - DNA, 818 bp, Triticum aestivum
  Clone ID: PAT_TA_15830
gaattcggcacgaggcacgcggcacaccacaacttagacagtccacccgccgcctcgcggctccaaaaccctcgcctcacccccgcccccctagggttcgcctcgcctcgccgcgccgcgccgccgcagccatgggctcctcgctcccggccaaggaggccaacctcttcaaagtcatcgtcaaatcatatgaaactaagcagtataagaaagggctgaaggccgcagattccatattaaagaagtttcccgaacatggagaaactttatcgatgaaaggtttgacactaaattgtatggatcggaaatctgaagcatacgagcttgttcgccgtggcttgaagaatgatctgaagagtcatgtgtgctggcatgtgtatggtttactttacagatcagatagagaatacagagaagctataaaatgttacagaaatgctttgaggatcgatccagacaatattgaaattttgcgtgacttgtcacttctccaggcgcaaatgagggacttgtctggctttgttgagactagacaacagcttctgacattaaagccaaaccaccgcatgaactggattggctttgccgtatctcatcatttgagttccaactcttcaaaggcaatagaagttctggaggcatatgaggggacactggaagatgattatcccccagaaaacgagcgatatgaacatggtgaaatgcttttgtataagatatcgttgcttgaggaatgtgggatgctggacagagcccttcaggagatgcacaagatggagagtaaaattgttgataagttctcattctaagggcaaatg

SEQ ID NO: 15831 - DNA, 482 bp, Triticum aestivum
  Clone ID: PAT_TA_15831
cccacgcgtccgggggcgcaaggagacggtgctggacctggccaagttcgtcgacaagggcgtccaggtcaagctcaccggcggcaggcaagttacaggaactttgaagggctatgaccagcttctgaacttggtgcttgatgaagcgattgagtttgaaagagagcaagatgatccactgaaactgtcgacaaaaaccagacagcttggtctcattgtctgcaggggcacagcggtgatgcttgtatcgccaacggagggaacagaggagatcaaaaaccccttccaagaggctgatggagaacaaaccgctcactcctaagaatgacctgagaagctggttggttaccccgtggagagacttgtacattaacttatagtaagaggtatggcactctatgttggagcactggtcgtctgaggttcatatttgtgccaagatgattatgagtccccactggacccacctgtgtatatgttac

SEQ ID NO: 15832 - DNA, 744 bp, Triticum aestivum
  unsure (1)..(744): unsure at all n locations
  Clone ID: PAT_TA_15832
ggtccccacggacgaggctccgccggccccggctccctagcggtctacccgtgcagtgttgcttccggagctgcgtccgcggtcgatctctaggcccaaccccccgtctcttcgcggggtggaggcacgagcaggtagacggaggagggtccggcgactgggatggcggggcgcaaggagacggcgctggacctggccaagttcgtcagacaagggccgtccaggtcaagcactccggcggccgatgagttacaggaaccttgaagggataaggacggctgctcgacttagtgctggaaaaagcacgtcgtgtatgaaagagagcaagatgacccattgaagctgtcaaccaacgaacagacagcttggtctcagtgtgtacagacgcactgctgtcatgctggtgtcaacacctgatggaccccggacgaggcttcgccaaccccttcctcgcaagcgggagggggcgttcattacgctttgatctaggacgagttcgttcggtgttgtattactcaaacacgtaccataagagcttttgtacttttgataagaaacttgctatttgttctggtgtttatcatatgttctttcactggtgctttgtatccacctaccttagatataccctatgtattcacctattgtgctctctgacaaacgtttatgcatatccccgcaaaaaaaacacattggctgcgtctatcttgcattctagcttnataaaaatcaggtaagatacaa

SEQ ID NO: 15833 - DNA, 688 bp, Triticum aestivum
  unsure (1)..(688): unsure at all n locations
  Clone ID: PAT_TA_15833
cccgcgctcagctccagcctccggagctgctcggaagcagcaccccatggcggccacggcggccgcagccgcagtgcgcccgtctctccccatcacgcctccgcggcgcgagcgcagcgccgcctgctgctcgcttgcgccggcgaccagcgcgcggtccacacgcttgccgccgtcctctagatggcgctgcaccgtcgtcacccatccccggagccgccggctccacgggccgcgctgcagccaggccgaagtggcgagcagcaccgtggacgacgacgaggcgtgcgagctggtgaggggcacggacgtcgtcatcgggcagggcgacgacgagagcgtccgcgcctacctcctcgaggccgtcaagaacaacaacggcacctgcgtcctcttcctctccgacgtcttcggcttcgaggactccgccacccgggacttcgcctatcgcatcgcctgccacggctacaacgttctggtgccggacttgttccgcgggaacccgtggaagaagagcctgccgatgggcggggcccaggcgcccctcgccggcccggccccggggccgggggccggcctcatcgacgcgtgccgctctgggcgggtcgccgactcccgcgggcngtctcacgggcgcctctgaanctggccaaccggctgttaaagggttgnttnggtccgtgactcn

SEQ ID NO: 15834 - DNA, 1095 bp, Triticum aestivum
  unsure (1)..(1095): unsure at all n locations
  Clone ID: PAT_TA_15834
agcacaacttcccccaccggcccccagacgccggccactaacccaaaatccccacccccgctcgaatctgatccgacgcgcatcgaatcgagtgagatgagccgcccggacgacggacataggtctttcttccctgtgggaaaccccttccgggtcatccttccagggggacctcacctgcctcggaagctccaggcgctgctcaagtcatacgaggatgccctggccttgagcttgaggaagctaaagccggagaatgccttggaggtcctcaccttgtcctggatgaggcttgctgtggattgcttgtcagagctgcatgccaacataggcaccctgataaccgagctcgagctgcctgtctcggattgggatgagaagtgggtggacatttacttaaacagcagcgtgaagctgctggacatctgcatcgcgctaagctcggagcttgctcggctggatcaagggcagttgcttgtgaagtatgtcctgcatgtgttggaccccaaaggtggtgtgccgtcattggaacagctcaagcgagctgaggtattacttaaggagtggatggacaaagtggacacgacgcgcccaaggctcgacagctgctcaatggccttgcaggaacttgctgggagcctttgtctgatgaaggtcaagaattctgctaaggggaaggtcctcatgagagctttgtatggaatagagtctgtgactgtcttcacctgcagcgtctttgtggctgcactatcaggtagtcccaagccattggtggagttgcatgtccctcacaaatttggttggtcacaggccttcaatgatcttcatgccaccatcagcggggaagtcaaaaggcgattgtccagaggaagtgtttcagctgtaaaagagctggaagaagttgaagcatgtgccagaaaactgcatgcattgactaggactgcgcagcttgaaaatgaaaatgacaacgtggcttgtgctgtcagcctctcaaagcaaatggtgatgccggtcagcactggacagaaaggagaccccaggtgtaatcttaagccagctgatgacagtagcccgnagtgtgaagcgatcatgaca

SEQ ID NO: 15835 - DNA, 1348 bp, Triticum aestivum
  unsure (1)..(1348): unsure at all n locations
  Clone ID: PAT_TA_15835
cccaaccatgcccgccgtggcggccgccgcctccggcccatccgcaagcgggggagggagaagggtacaggggacggtacgaccggctgggacgaggaggtggagtaccggctgccgagggggcaccggccggtggaggacctggacacggaggggctggagcaggccccggtcgacacgcggcaggccgcctccaacgtcggcttcaggctgctgcagaacctgggatggaagtccggcaagggcctcggcaagaacgagcaagttatcctagagccaataaaagctggtatcagggatgcaaaattaggaggtggggaatgcaagagcaggatgacttattcacaaatgaggacaatgttcaaagaaagaagcagaatgttgaacttgagcatggcgaaggagcagatcaagaaaggcgttaggggttcgggcaaacgttgagcagaaaatctggagcgaggtcatggagatacagaagatcttcttttgcagcttgtgtaataagcaatacaagctggcatatgaatttgagatccgtctaagctcatatgaccataatcataggaagaggttcaaggaaatgaaagagattcaaagcggcgacagtggcaaccgtgatgatagtccgaaacgtgagcctaggagcaaagagaaggagctggcaaaatttgcccaactggcagatgctcatagaaagcagcagaaagagaagcaagaacaaccagatatctcaggagagcaagctacgccaaagaacttgcctaccccgggcaatcaggatcagcgtcgaacattgaagtttggcttctccaaaatgaccccttccaaggcacctgttggcaacatgagcaagaagccaaagattgccacgaaagtcccttccgtcttcggaaacgacagcgacgaggaggcatgatcttcctttgccgtcagatgatacctcacacaggaggggaatgccggctttctcagcagattccagtgagtcatccctgagaagacgccatgcatgtaatgtgccgctggtttgaccagatgcggatagcggcatctttgacaaccccatgaacaaacagggacttggacgttgtggtgtcaattgtattgaactgatggtacactgtaagagcaactctgtctgtacttccacattgatcagagtctggaaactggcttgagccatggcaagctggcaactagaagaacatggccccccttttgttggggcacatttgtatcacccttgttggattcttgcgagattcctcngcggtcggtgggtggtgaaagtgttttttgctcactttttcacaaagcaagtaaaaaaggagggtgntttgnnggg

SEQ ID NO: 15836 - DNA, 772 bp, Triticum aestivum
  unsure (1)..(772): unsure at all n locations
  Clone ID: PAT_TA_15836
gttttttttgttttacatatcaacgaagtatctcgctggacatataattgacctaagctataaaactttgcatctttctctcatctgagtaacacactcctttataactaacaaaaatgagcaggaaaatacagagcagccgtgttgacactactgcacaataacaatatctccctttacagataaaccggtagatcgataaacatcttgctggagaaaggagatgttgcacttcaaacatcctgtcaagtactgtatgtatccggcatccttcaaggggncaccggtggttgcccaggtcatttcaaccagcatcactgcacaacggctatgcttaaaagtagctggactgcgtttgaagtagctgaaggtgagcaagtatcctgccgatcatcggtttcaggacagggtcgcctttctgagcgagatcgatgagcagagcctgcgcgatcccgccgtactgctctctgtgctcttcgagccggaagaacctctccagtatccatatcgccttgtcctgggaggtcaactcgcctgcctcggcgactctcagcagagcatggacacctgacgccttctctatcgccctgctcccgttctcccagatctcgtcctgcacgagggtagccagtgcttccagcaccgctccatctgcttctcgctcttcgccttctagtattttgaccagagggttgacggcaccagcttttaccaagcagaaagtgcttttgatagtgcactggtaatcatgaactatacagtaagattcggc

SEQ ID NO: 15837 - DNA, 621 bp, Triticum aestivum
  Clone ID: PAT_TA_15837
gttgttcgacccgactggcagcacgagcacaaggagagcacagaaagcagaggaggggagccatccatccccaaaaccccaagtcccgcgtgagcagcacccaccccggagcgggagcgacggtcggcggctcgtccccagttacagacttgaggtcacattgggtgcctactgatgacatccaacatgagaccgcttaacagcaaaaagggtgaggtcccttcccatggtcgtgagaactgtggagtttctgaccaagcttttcatggcaaatgtcaaagctgcgatggtgttggaaaaccatcttatcctagagcgaatggcgtttccctgaaagaaagtggaacatgcaattttagttgtgatcatgctaatgctttattagtagatgggcccaaaggttcgccagcaaggccaggacatattgacagcgcagtttgtgctcagcatggttgtcatgatgccaagattgcttgtaatgatctgcagcaagagtctgatagagaacaagctggagataccctggatgatctgtttttctttaatgatgaagaggatgatgatattgactgggaaccttctgctcgcctggctgaaaacagatggttttgcttgaactgt

SEQ ID NO: 15838 - DNA, 962 bp, Triticum aestivum
  Clone ID: PAT_TA_15838
cttcggggaataactatttagaagaacaagcgcaagctcgagaattgtacattcgatattatatattacttggccaaatcaaattaattaacagaagaagctagctaactctacgcacgtctacgatcaccatctacttatgatctatcaccgattcacagccgaaggctcaaatccatcttcttagtttgctctggcagcagctgctgctccgaggaaggtggctccgtctgcgtcctcatcctgaagctccccggccacgacgtggagccgagcacctcctcgtagacgagcggcggccaggggccaaccacgccgtcgtggagcctcggcgccgtggcctcttgccgggccggcttgtggaccgccgagcccgccgggttgaccctgagggcgcgcacgatcgcggcgtgcgcctcgagcggcaggccggccatgaccatccgctggtggtgcgcgtggtggtaggacagcgacgacgaccgcttggccgcgctgcgctcccgcttgtgcgcgttctggtgcccgcccagcgcctgcgagctgaagaacttcctcatgcagaagttgcacgagaacaccttgtggggcgtcgtcggcgccgccgcggcagccggaggcggcggtggcggctgctcctgcctgtgcttggccgccggctcttcgtccgagcacgacgaggggtcctccgccgccgccggctgcgagccgttcacgcctagcgtgaggtcgagccacgtcgccgcgtcgccctgctgctcgccggcgggggtaagcagccgcgccgggctcgcgctcaccgcctcatccgtttgctccatgtcccgatcctgcatgcaaccagccagaagcttagcgtttcttgggtcttcctgtcgacggcgaccctgtgctcagttttttggcgcagggcacgcactagtgccagccgcgatagctctggctgtgctcgtgccgaattc

SEQ ID NO: 15839 - DNA, 651 bp, Triticum aestivum
  Clone ID: PAT_TA_15839
agactaggaacaggaattataatttctccacgaaaaacatgcttcggtggagaaatataagtacaggtacacacaaaatgacatcactcaaggctcaacttctactctgccttgacagatagcaagcaactgtgctgctgctatgtagtattactgatacaggatagcaagccattggaacatcaaattgaccttaatttgttatcctcgggctcctccaacagcatgttctcgcgcaagccgccgtcattctcctctgcgaagacgccgccgtccacctctgtgcgctatatgcccggtggaacctgttccccgtgtatgccgtgccaagttctgatctcatcatcagcagtgccaaccaggctagacgaaccaaaaaggttaatgagcagcgacagagaggctgttgtatttccatgagctcggggcaccccactatgttcactttctttattttatcaacagctgctgcaccaccaatggacttgaggcctcgccaccgcggaggccttggggcctcccgggctgctcccctccccagcccgctcgcggcggggtgcccggagtcggtgccgtcacagcaagccaaatcgagcttcttaagagaggatggtaatatcatatttaacttgaaaagacatgattgaattt

SEQ ID NO: 15840 - DNA, 1295 bp, Triticum aestivum
  unsure (1)..(1295): unsure at all n locations
  Clone ID: PAT_TA_15840
nttttttgttggtgagcatggcaaatccagcttcgttcattttttgttaggaacttgacatgcttgcaaactaaatttaacatcctatatgaatatctttcaatttgccatgtacattttcgttaattaaaccacaatttttttttttttaaaagaaaacaactcctcttattggaatgtgcaataccgcgtacatggtgaggaaaggagaaatgaacagataacaacaactcaaaacacaagcccagatccctcaagcttttgttggacgatgcgatccaactcctcccccatcacgtggctcatgtggtttgcccagtcccctacttctccttttctgtaaaacacagagttactcaagaaaaatttatcaccgtgacgaacgccgccgacctgattcacttgcaggctggtaagcgtctcaaagctgcacaacttcaccacctcttgagcaacaccagagctctcctcctcctcggtcagcgggacgccgaggaatttcgccagcttcctcaccgcgggcaccggatcggacttgatctcttcatacttcaggaaaagaacattgtccggccttgccacgctctccctccagtactcaaggcagtgatcccagaaggggccatagggcgagaacccctggcagaacatgctgaaagcactatccatggacaggttggtgccctgcaacaccttgttctcgaagtgcagccttgacacgagggcgtccttggggtcccggcacaggtacactagccggcagccaaccgatctcgtgcccggcgggagcaacgacatgggcatgtgcgtggcgagaagcctcggaggcggaagtgtatggatgtcggtgtggttcgggccggcgcccgggatctcgatgaacggcacgacatgctgtgggtggcgtgtgcggagcgggtggtcgctgaagccgtagcgggaccggttggcgatggtgaaggcgagggctttgagccaggtggtgccgcatttgggctgcgtggcgaggatgatgtcgtcggcgcggggcacgaaggcgtgctggacgagcaggatctgctccaggagcctcggcctgaaccagtagttcttgtattgaaccagtggttcagaccacccctctcttactggaagtgcggctacgaaatccttgggtgggaggacatcttcttcttcttgtgttgttggaactctgggcagtagtactctctggatcactcatcatggatggagctactactgcttgagcagccatggctgatgtgggaggggaggcgaagctggcctagtttgcc

SEQ ID NO: 15841 - DNA, 715 bp, Triticum aestivum
  Clone ID: PAT_TA_15841
ggggacggcggcttatgcaagtattaagggccataagcatgcgcaaaggcatagcaaaactcaaagtattttctactctgttacaagactccccgagtctgaatgatgcagcattgtttttctacaaagacataagcaggtggtgcctggcaatctactctttgagttgacttgaagcttccgggttatccttctccgcctctccgccggctgctttgtcctggaaggatgatgaggcccagttaatgccactcaaagcctcaaacttagcttcatcatctattaaaccagttgggtcgacttcaggggcaaaggtgtgcttacggattggaggaatcaagctgacattatcataatgcggcgtggggattctttgattctccttgtcataacccggctgacacttggtgaggtcagtgtcatttccaatttgagtagccacagggcgtatatccctcacgcaggtggtgaaatccttttcatcaaatggattgccatcctcctttaaacttggatacccaagagcgatgtcggccgggtctagctctggtaaccaggctttggcccgactcaaagcggctattgctccggctcttgcagatgctcatcttaactcttggattcgctgaggtagcacagctagccgcttcagcacatcttgcaggagatagggaacatcatttgatcccacccacaacggcctcgtgccgaattc

SEQ ID NO: 15842 - DNA, 1648 bp, Triticum aestivum
  Clone ID: PAT_TA_15842
tctttgttccacgctcgcggtagccctgggcatgtgcgcccgtctagcggcggttctcttagcacctctccgtcgtgtcctcctaagctcccgtgcgggtagaataatcttctatagacacacgcacaactgccccgcatccgatgcgcacatggcacgaagctcacgatagcttgccggactctggcccccctcgcggctcaccctcgttagtgagccctccgatagcagcgccccatgctgcgagccgtgcccttcgcccgcccccgccacccgtgcgccgacaccagcccacccgcccccccccggccccgcgccccccgggctgctccagcccccgcccggtagcccacggccccggcgcccctccgcgcgtagcgctccgacaccgtccggtccgtggcgccgcggcgacggcggctgctagcgaggtaggcccgggtccactccacgaccttgatcgtctgctccgcacgcgcagtgcggccagggacgtgctccatggcccggccccccgtgagggcctccagcgccccctccgcccaggctctacccgtcgctcgtcaccgccagggtggcccgtctgcacctactcgcgcgccgcgtagccgtgggtgcccatcacgcgggtgctcacgtgtgtctcctccccctccggggcccatctttgccagtccaaagtccgacagcttcgccgtgaagtcctgttcgacaagattaactcaatcgtgactcgtgagtcccgactcttggtagatcttggtcagatccgattcgattgtgtcaattcgtgaacgagaacggagcgaacttaccgagtcgaggaggatgttggacgccttcaagtctcggtagatgacgggctgcttgccgccatggaggaaggcgacgcccttggcggcgccgatggcgaccttgagcctggtgccccacggcagcgtcgcggatatccttttaaagaggtggttgtcgaggctgccgcgcggcatgaactcatagacgaggaggcgctcctcgtcctcgcagcagtacccaagtagcttcaacaggtgctggtgccggaactgcccaaggaagatcacctccgcctgccgctccctgtggccttggtggccggcgatgttgagctgcttgacggcaacgggctggggctcgaggccgggccgcatgccggcgtcgacgaagcctttgtggacggcgccgaaccctccttcgccaaggaggtatccgctggagaagtcatgcgtgacgccacggagctcgctgaggctgaaagagtgcagctgctgcatggtgcccacgcccatctcccccacgccgtcggggttgtcctcgtcatccttgccgtccgtgggcgtggcggggccgttggccaaggccgataggcgccggaaggaggcgaggcggcgcgagaactcggagttgggcgggcggtagttcctagcgtctgcggcctcgtcgtcctcctccgcgctccagcacttggtagccgacgccagcacctctctccatggcctcggcatcctcctcgctacccttagctaggtagcttggattggcgagagcgtggtcggggaggagctagaggtggaggtggatatggaacagtacgtggtgcaggttcgtcgtggttgctcgtgccgaattc

SEQ ID NO: 15843 - DNA, 680 bp, Triticum aestivum
  unsure (1)..(680): unsure at all n locations
  Clone ID: PAT_TA_15843
aatcacgtgcagtaattattacatggtctaatcccctgttgaagttccaaccaaccaccaaaattggcaccaagggctatatggatattacgtgaagcccagaaactgtatcctcgtgtgatctctgcaatcaccaggattgcgggaaaagcttcttctcgccccagagtccctagcagcctttgagcccattttaagctacttcctgttagttgagctgcgcctattccaagctantaaatcattggaagaggccccttgattttgctcaacagtggccaggcatcaaacgtcacggggacatctntttatgcntgagagaccagacttgaatatgcaactgtagcagaactacaaaacccggaaacagaaagaacagacgggttgttgcccttttggcagcacagagggcacagcgtcctgtcagttggcaagggaagtccatctttagcaacctttggtagcggcggcggaggaggtggggggtatacagtcggagcttgacattctttcttcagcagattgataccaccacttccatcatcttgaaaaagaagaccgcagcaattaaacccagtttgtgcataatctagagtcgtgtacgtacaattaaggagcaccctctggacagtctttaaccatggaggcccgcgccgtctcccgcgcgcgcgacttctaat

SEQ ID NO: 15844 - DNA, 901 bp, Triticum aestivum
  Clone ID: PAT_TA_15844
agaacataaaatccagtctacattacaagttcacaacataaggaacaatgccatgaaaatgctagggcacatgatatttatgcaagacgactgatgcctgaaagcctaatgtctctgaaaatcacatagatcagtagatcacctatctggcatctgatacttacatctctaataaattagtatataaatataaccccggtaaaaaattagaaatgagccctataaagttaataagctacatcaaacatcttctggacaaacggcatgttgcaagagctaaaaagaatcgatgaaacatggtaagaaaaatgatgtctagtacattatctacccgtcgatgaagaagcttcgccttctatagatcttcttgtaagagtttgttcaacagggtggtcatgagcgaatccctcttctgagccccttgcttcttccctcatccttcgctgttcctctcgctctatccatgactgctccagcatcagcctctcctgctccagcttctgcatcgactgcctccattcttgttcgaaaatgagccgctcctgggcgcgccgctccatcgtctcatgccacagcatatcgacatgctgttgctgcactaggaattcctgcaacagatcatggatgcttgaactgccggcccttgagttttccgccattcgttgcgatggttgccccttatcaccagccttccgctttttgcttatcacgggtttctcatcatcgctgacttcaacgccatattcgttctcatcagactccccagatgactggtcaccgctaggtcgctttaatttctttttaactgaagttcccgattcagactgaaggagttgacgttgcatatttttagcacgttcagtgaagactgcatgtaattcttcaaagaagggacattgtc

SEQ ID NO: 15845 - DNA, 878 bp, Triticum aestivum
  unsure (1)..(878): unsure at all n locations
  Clone ID: PAT_TA_15845
tggctgctggggtcattttgatgaggctgaacagtttatagctagtatgccattcaagcctggtgcattagtttggcgatctttgctggaaagctgtagcaagcagtccaatatgacactgcgaaggcgagctatgaatcatctacttgccctggaaccacaagacccatccacatatgttctggcatctaatctgtactctgaatcagcaaagtggcattgctcagagaacacaaggctggagatgcgggaaaagggtatccgtaagattccagcaaggagctggacattttatgacaatgctattcactcatttttcgctcgagatagatcacatcctcagtccaaggacatctatgctggtctggacgtgctaactcttgagtgcattaaggccgggtatgaaccagacaccacctttgtcctacatgatgtcgaggaataccaaaagagacacttcctaatgtaccacagtgcaaagctggcagctacatatggcctcctaatggcaggctctgggaaaattatccgtgtcgtgaagaacatccgcatgtgtggtgactgccactcatttctggagcatgcctctgctgctaccggaaaagagatttcagtcagagactcnaatgggtttcatgtttttagggcagggatttgttcctgtagagattagtctggtaccataccaattttgactactttgcagtgtctttgtagcactgtagaatctatagaagatatccttgtattgagatcctgtacattgctatgagttctcagaagcatcatgccaacaagggcggagcaagctggccgcgtgcccgggccgctcaagcattcnccggattggcccncgtatagtacataatcncaaggat

SEQ ID NO: 15846 - DNA, 655 bp, Triticum aestivum
  Clone ID: PAT_TA_15846
tcgccgcagtcgctgatggcggcgcggtcgtcgatgatgtacgcgcagcaggccatgtcgccgctccagcagcagcagcagcagcagcaccaggcggccgcgcacggccagctggggatgtcctccggcgcgaccaccgggttcaacctcctccacggcgaggccagcatgggcggcggcggcggcggcgccagtggcaacagcatgatgaacgccggcgtcttctcggactaccgccgcggcggcagcggcgccaaggaggggtcgacctcgctgtcggccgacgctcgcggcgccaactctggcgcgcacagcggcgacggggagtacctcaagggcaccgaggaggaaggaagctaggccagcggcatcgtcgctagcaccggcatcgcagctgcagcaggaggagtagcaggtagtgttcgaggatggtagtagcggattagcagtagctaaggttgttgcgttggctaaggttaaggtgggtgagtttccatggaacctggaggtggtagtggcgtctgcatgcaggctcgcttgttttggatgtgcatggcaggttctcgatcaatcctaatcaagatgtagtggcgatggtttgtgaacactccctatgtagtgctgaatgatcatggtgttttcttcaacaaaaaaa

SEQ ID NO: 15847 - DNA, 742 bp, Triticum aestivum
  unsure (1)..(742): unsure at all n locations
  Clone ID: PAT_TA_15847
gactggggagggacgcctcagtcaactactgctaaacagcgaggcacagaaaattgtgtttcagacagacatacacacaagtaaaaaagaacaccttttcttcccgtgcttgattagatatatatctttccctcttttcaacaatatatagctacctcaaccatgttagggcacccaggttcatcacaccgtaatcaggaggcgttctctatcgcctcgatgcacccgagcacggtggccttctgcgacatggcggacaccagagcgtcgtgcgccgccttgttgttcttcagaagcgaggcggcaatcagcaccgcccatctcgtaaggttctgctgctgtgctttgcccagcggcggcttagtcctgttcaagaacctctgaagggtgaagaggtcggctgattggccgacgaccttgtcgtactccagaccttcagcagccagtccggccatggagattcacagctaacctgtccacttccttttggtcaagctgaccgctgtacagcagcttctgtagctggtcatcaacgaggttaacatgctccttcccgatgtccaaagagtacccaagataggtagccgggtcaaatagcaacaagaagagcgcgcacccccacccctcgcaagccgcccgcgccacgcaacaaggcactggcactccggagactgacaatggccnctcgtgtacactcgtagcgcgccagcccatccgggggcgtcattccaanntttacccc

SEQ ID NO: 15848 - DNA, 1180 bp, Triticum aestivum
  unsure (1)..(1180): unsure at all n locations
  Clone ID: PAT_TA_15848
atttcaggcttccattccaatacgcatattccagttgtcgttggtgcccaaatgagatatgaagtcaccggtgatgctctttacaagcaaattgcaacatcctttatggacatgataaattcttctcatagctatgcaactggtgggacatctgccggcgaattctgggccgatccaaagcgtttagctgcgactctgagtactgaaaacgcggaatcttgcactacctacaatatgctcaaggtttcccgcaacttattcagatggacaaaggaaatagcatatgcggactattatgaaagggcactgataaatggtgtgttaagcatccagagagggacggatcccggagtgatgatttacatgctaccccaggcacctggacggtctaaagcagtaagctatcatggttggggaaccaagtatgattcgttctggtgctgctatggaacagggatcgaatccttttcgaaacttggcgactctatttactttgaggagaaaggagagacaccagcactcagcatcattcagtacataccaagcacttttaactggaaaacagctggggttactgtaacccaagaactcgagcccctcagttccttggatatgaaccttcaagtttcgctctccttttctggaaagaatggtcagtctgctacattgaatgtgagaataccaacatggacatctgccagtggtgcgaaagcaactttaaatggcaaagatttgggatcagtaactccaggctctttactctcagtcaccaaacagtggaactcaaatgatcacttatcactgcaattcccaattgccctaaggaccgaagcaatcaaagatgaccggccggagtatgcatctcttctagcaattctattcgggccattcgttcttgcgggtctctcctccggtgattgggatgcaaaaactggcagtgctgtttcagattggatcactgcagttccttcgtcgcacaactcacagctgatgaccttcacacaagaatcaagtgggaagacattcgtcctgtcaagctcaaacagctccctgacaatgcaagaacgctctgcagtcgatggcacagacactgccgccaagcgacatcanggggcatcccaggaccancaagntgcacggcaccacgggcancctggnancactcngtgaaatgagcatn

SEQ ID NO: 15849 - DNA, 547 bp, Triticum aestivum
  Clone ID: PAT_TA_15849
acttcaaggccagtcttttcatgtcttgacaatatatgtacaagtagaaccgccaattgaatgtgtataagttaattacagtagtgagatcatatttacacgtagtatttcaggcagctcttgtagtcccgtatcttggccacttgtttttcccccgaatgatcttatcttcagcggtgtgaacgaatgcttatggtgttggtgatcaatagtcagagagggcaccatctgccggcgccgcctcagccgacgggtccatccacctgtagcgagcatacaggccagcagcgccgaccaaggccaccgccacggcgaggaggagcgccctcaccatcccgctcctgctccggtccctggcgaagccgtacgcctgcccaccggcagacgctgcctggtggtgtgcgccctcgccttcgtcgctggcgtagtcgtcctcgtcacccgcacgacgcctcctcgcgtcctcctcctccatctcctcgtggcgcttcttctcttctgcggcagcggcgtgccgcgcagcttccgcctcgtggtctgccgcggc

SEQ ID NO: 15850 - DNA, 678 bp, Triticum aestivum
  Clone ID: PAT_TA_15850
gaactcgaaaatcctccacctaaatggttgatttctctgttctggtttgatcactgctagggcctgtgcagtggccttcagtgattgaaagcttaaaatttccaagcatcagtatctgaacaaacgaagtaaaaaggatcagtatctcatctcagctgaattattcttcataggctagctaatcgcaaaatcttcactctctacgatgagcggtgccgacggcccgtcgagcagcagcgagtccagtgagctcggcacgttgattgggttgtcggtgtagcccggtgcgtcggtcgggtcctcactggcgagacctgccgtgctggtggtcgggagctcgtcgcggattgggggcaggttggtgacgctgtcggcaggcagcggtgatggatgctcgtcgttgctttgcctggtccgatgcaactggagcaccttgcggtgggtattggcatgctttgttggcacaaatgtagggctcgccacgggccggtactccggcagtagcctcccctgcctgtaccgcacgccgcacgcgttgcacagcgtggctcgcccctttggcccctccctccactgcggcgtctctgacgacccacagtgctggcacctcttccccttatttgccggccatggcgccgaaggggcttcgcttatcgaccgcggacgcgtgggtcgacc

SEQ ID NO: 15851 - DNA, 677 bp, Triticum aestivum
  Clone ID: PAT_TA_15851
ttttttttttttcgacatgcctcattctattatttaagaagaggatttgaatagataattaacagaaaatcaacaaaagaccgtcataacacaccctaaactgacgggaccggcaggtctagctactcatattcactgaatagagagaaatggtacaagagactgctcggttaattaacggaaaaccgggctaaaatccaaataaacatacgaatctacttagctaaacaaggcttataagcaccgatggactaacaagacacccctgacacatcaggatcctcgacaagactcatgagcccacggaacataaagatacacgcattcgttatccgatccaacggcatgtgctacattttgcacaagaagaaccaaagcacttgttatcatgcatcatcggttgtcatccactaactttggtgtaccactagcacggagaggcacggccttcgtgagtgtcaccccaaacttctcacacatatcaatcccacttctctccacctccgtcgggagcctccacttgaatcgatgcaacaacgacccgagaactagatgcaccatcctgatcgcaagcggcatccctgggcacatccggcgccccgcaccaaatgggatcagctcaaagtctccgcctctatagtccaccgccctcccgagaaacctctctggcatgaact

SEQ ID NO: 15852 - DNA, 818 bp, Triticum aestivum
  Clone ID: PAT_TA_15852
gttcatgtgattaggcatgatgcaaagaagcctgctggggcagccaaggaaatagagagttattttgactgctcagcttcagatcttgtgctggttggtgatagatactttactgatgttatctatggaaataggaatggttttcttactgtatttacagaaccattgagttttgtcggtgaatcttacattgtcagaaaggttagaaagctggaagcgtacattatcaattattggtacaagaaaggacacagaccaattaagcaccctttgctccctgatgcgagaacgattgtgaagtttgatccgtgtgaaggcccagtctcacctagagcatagcacagtgatatgtatatgttgttaccaactgatacgcttctgaagaactcactggattcttttatctgaacctcagaaaatttccgttccttattgagctgaatatggaggggaatatgatgtgtgcgtaaaaagaacttgatatcgttcgtgttcagcggcttcttttggttcaaggtcgtgatgttcttctctggtgccgttctgctgacgatcagctgaagtgcatttattttgccgacctgctgttgtgcttgaacagcacggctgctgctgcgcacgctccaacagcgtaggggtaatttccggagctgccgatctaatcattgtaacttgtaagactgtaacgcttgtaactgcatacgggctctgccccggtcagctctgggtccaccacagcctagggcatggattttcaggtatccaagtatatgtaaatttcatgatttttacatgtgaaagtttcacatggctccttg

SEQ ID NO: 15853 - DNA, 479 bp, Triticum aestivum
  Clone ID: PAT_TA_15853
acctgatggcctcccagacgatcttgtagagttcaatgtatcatacaacaattttcgtccgcccgttccaagcagtttgctgaaatttcctgattcatctttccatccagggaatgaactacttgttcttccccgctctgcgtcaccaaatagtcctgaaggatcaggtgggaggaaacatggtatgaagcgtggaattctgtatgcattgattgcatgtgttattgtctttgttaccgggatcattgtccttttacttgtccactggaagatctctaactggaagagtagcgaaaaaggcaagggccaaaataagaattctgcaactcaaggacaggatgcttctcagagacgtgcagaaattccaagttctgaaatgcacgatgtgtcgctaggatcatcaccgtctgcagagtatggaggcgtttccgtgcctcgcggcggcatggaaggacagcatgaagcacaatgtgtggatc

SEQ ID NO: 15854 - DNA, 699 bp, Triticum aestivum
  unsure (1)..(699): unsure at all n locations
  Clone ID: PAT_TA_15854
ttttttttttttatccgcaaaaaaaaataatatgaaaagagtatgttgtagaaatacaatacttcttcgccgatgagctacccgattcaaaaactgaaaaaccagacgggcatgattacattacactatccattttcaacgaccaagaaaattcagagcgacatggttcaagcagagcaatggtggcggaagctttattcattgggaaccccgagctcactctcgtccggcgatggattatagatcagggatggtccttgaggaagccgaggaggaggtcgttgatctggtccgggaactgctcctgcacgaagtggctcccctccgggatgtaggtgatcttgaggtccggcgcgaaggtgttcatgacgccgctcctcatggcggcctcgaaaccagggaacttgaagcagtagtccctctcccccatcaccatgaacaccgggacctggaacttggggtccacgtgcttcgtcatcctgtgcagagacctgcctggtatctggagagggtagcggaagccggacttctcgaagagcgcggcgtaagcgtcgaggtcctcctcggtgaaccacggcggcaggggcgtggagaggtcggcgaggtccatgatctcctgcccttcctcccgcgatngggacgtcgcttgcgggaagaagaggatgtanatggtgcgcaacacgccgcgggacgtcctng

SEQ ID NO: 15855 - DNA, 766 bp, Triticum aestivum
  Clone ID: PAT_TA_15855
cctttgcacaattcatcgagaaggtcatctgtgtggcgtatgtgtgcttgtaatggatggcttgttttttggtggttgaggtgccgtcacccctccatccggcgtcgatccggctccgccgctgcccacttgccctcccgtggccctccccggcaccaccacccttcctcctccctctcgatcccctttccctcctcatctccctcccctctaccagccctctgccagaacgctgccgcatctcgccggctcggcctcgtcgccccaaccgataggggcccgacggcgccaatcaggatgcggtcacccaccagtcttcttcgtcagcactatatcccccctcctcctacgtcatttatcaatctgcccctctttcttgaagctcctccttcaccaagcggccacctgatgttgcccagtcgaccccgattagccgcgtcttcgcccagaactaacaggattttctcgtgtctttcaagttgaatacccgggagatggaggagaatagatggtgccatggcgtaaaggaagggtggttattctggtggtcgaggcgcaggatttggacgtctctttcaagtggaatacgcgggaactatctgaagagcaataatgtaatgcttttgagctgaggcaaatgaagtcgtatttgaaagcggacgagatgatgtttgtcaacacgaaactgaaaaggtacatacttgcaatggtgcatcatcttttagccatacatccaatctagttatgcgccattctagttttagac

SEQ ID NO: 15856 - DNA, 662 bp, Triticum aestivum
  unsure (1)..(662): unsure at all n locations
  Clone ID: PAT_TA_15856
gttttttttttttgttttattaaaatggatctgtatattggagacttctgtctattggctacagggatttctcgcttacccagacctgctactcatacatagcttgcagccatacgacgtgcagataacacagcacttcctacctccctacagaagtaccaagttcaggccacccctacgtcggtggttcgcaggaggaacaaccggcaacggcagcgacttctccccacacgtacaccgccgcgcgctcatccgtcacaatcatcagcccgcgccccgcttggtcccgcacgacggcgtagttgatcacgcgggcgagggtgcccatgggacggccggtagttgggctcatacggggcggcactgcgctgcgatcctcccctagctcgaccgcgccggtggcaggctacttgtccccgtccctccggtcgatgcatccctgacctctgcccttcactcacgcaacggagacgcccactttactacgctgcgctggcccggcggcaacctccgctcaagcggcttcctgcccgtccctgtcctggtgacgcccccctctcggcgctctccttcctccaccgtcctcacgctatcccggccggctgccaagggccanctntcttngaccgttatcccantcgnggcngcnaaattttncggat

SEQ ID NO: 15857 - DNA, 738 bp, Triticum aestivum
  unsure (1)..(738): unsure at all n locations
  Clone ID: PAT_TA_15857
aagcaaatgtatgaagacatgaggtcttcaactcataattttacccattgtgaaatggtgtataagtatgttgtatatataatttgggatgaactgggggttaaaccgtaaagtttggttaacctgatggctgcacagaaaacctaacgagttatatggatcgtcacataacctgagggttaaattacaaattcgtcaaagagataagaaattcccaatttctttctgtgtggctagggattagacaccgccaccggccggagggcctgccgtgtcggccattgctgtgcgccggagggcgccgttggagcgtgtcgtctgctgcgcgccgggagacgccgcggccgtgcctgagagcctgctgccgcgggagtggccatgtccgctagcagccacgccgcagggtgccgtgggtcgcgtcgcctccttgatgccggatgagagggctcgggtgtcgcgtgccagtgctgcgacggaggtcctctccagtcaccacgccgcgcgcaggccgttcgtctggaggacggcgcaacatcgccggctgggaaaggcgaaggcccccccggaagaaggtgctgtttttcccaagccttctcaacaggntccnaagctgcccgctttcgtcctncgcaacatcccttggccaacanaaccccngggccatggtnaantccttnccaatngtgttcnagccttgggactttancaagattcttccccnataanccgatggganat

SEQ ID NO: 15858 - DNA, 552 bp, Triticum aestivum
  Clone ID: PAT_TA_15858
tttttttttttttttttttactagtacgtgcaagtatgtaaaactttaagatatagatgtgcaaaatctacacgcttagcgaatgttttcctaatggggccctgacatcctctgttatcccggtgggggggtacccgggctgcccaggggtggcgctacccacgccgctcagtgtggcactctgggcgttcgctcccggacggccgtcgtcggtggcaacctggtggccacggatctggccggacgaccgcctcacctttggccgccttcgtggggcccctctccgtcctaggttgcgccctggtcccattgcggcatttctgtcatctgtgtcttgtaaagaaacgaacgggactataaacccaggcagcaacttgcagaaagatcatcacctgcggataggagaggggcgcgccggcgcggcctgcgccgtcgagagctggggcggcagcacccacctcctgagctcctcgaccccgcgcccaagaaataatttttccaattactggacggaactttgtgtcacaaactgaagaaatggaaataaatccg

SEQ ID NO: 15859 - DNA, 775 bp, Triticum aestivum
  Clone ID: PAT_TA_15859
agggcacaatgtacccatccaatttatttaaatctcgttattcacaagatctacatattcatatccaagtcatgattcatggagccttaacttaacaggaggtgtcaccaaatacgaaacacgcatactggttgattcctaaattgccaagagaagcaattgacaaagaaagcctacctgcaccctatttcacaatattaacaactaattatactactggaatttctaaatgttggagtagaactatgctcatccacatgagtagcatgaggatggtcttccatcatgggaagattctgttaatggagtgcattcccttgggcttggaatgttccattcaccagaagttcaagtggaggtgctcaagggcgttcgcccacccaagggtcttacaagtctatgtctccatcaccactacgcccagtacctggaacgatttcttctcagaagctgtattcatgaaggaaattagaataactggagacatactcagaaatgcagtccttagatataatattaagagtttaagacaatgtttttttgttgcaagaacacattaatgaaaactgactggaatagaaattagaaactctaaatgatctataaatggatctcaccagtcatagtgaatcatttcctaaaattataagctaacatgtacagagaacatatttaattttgtatgacaacttaaatcatgaactaagttatactgactacatggttgcagtacacagtcacttaagaaggcagcaaccactctcgtgccgaattc

SEQ ID NO: 15860 - DNA, 910 bp, Triticum aestivum
  Clone ID: PAT_TA_15860
gatgaaaggcagatgaaatctattatgcaaccgacattcagccgttcatgtgaaaatccatagttagttcgagcttaacacaatactgaagctgagatgagattcaaaacatgctgagtaccacaaggaacatcgaaaacatcgaaaccatagctctgctatatgctcttggggggttccctcccgtcccagcgtcgggttcttttgtcttcagtttctccccctcgtgttagggccgcggcctcttgtttccggcttccgccggcctgagtccggcccctattcttttcgttagggtcttcatgctcgtccaccacaacggccccttttcccgcgagtcgaggtcctgacattctcattgctgaggctcttcactttgttgcacacgtactcaacactctcactgagagtggccttcctgtcctcttcgaaattccaaagctgggctacaatggttctgtcactcagcttgccacattcctttaactccaagaaactattcaccaaagccttcaccaaagccttgtaagactcttccccccatgtagcccgcagctcttgtagcttaacgtcatcgtcattaatagtcccctcagaaatcccgccgcccgggtcagtcttgctgggatacccctctggccgcgggacctgctcctgccgtctgttccacagcccagcggcccccgcctcggcctcctggcggagcaacttctgaaggcatgccagtaggaatggcctctcactcaactgccccatgtactttactgagatattctgtctaccaacaccacccatatcaagaaatcccttgatgagctcagcgttgatatttgaagtctcttctctaacatcgcgaagctccgcactcaaaccttgttcaagattgttcatagcacctcgtgccgaattc

SEQ ID NO: 15861 - DNA, 704 bp, Triticum aestivum
  unsure (1)..(704): unsure at all n locations
  Clone ID: PAT_TA_15861
tcggcacgaggcctcgtgccgattcggcacgaggccttctcccctcaccccatggcgcggctgccctagttcgtccacgcgacacctccactccatcgctaacctccccctcccctgctatacttctccggcgccctcctcgcctgtggtccgcgcggacctcaccgccccccgccccctgcttctccccggcccgccacccgtcatctgcacaaggcctatggtaagggcaaattgagctgcaagtggccattatcagaatgggtgaaagtaacgagaatatccagttttcgtggggaaagaagagagcaaaaggtggtgccaagatggatacacagttctatggttccttcacatttgacaatgtgaagtactcactgtatgactgtgtatatctttttaaaaatggtgaatctgaaccatacattggaaagatagtaaagatatggcagcagaatgaagctaagaaagtaaagattctttggtttttcaccccggatgagatcagaaattatttaagaggccccgtggcggagaatgagatatttcttgcttctggtgatggcactggccttgccgatatcaacccgctggaatctattgctggtaaatgcactgttgtttgcatttcaaaggatgaaaggaatcgccagcctaccccnnnnnnacanacnnncgctgattatatcttctatnnnnntttt

SEQ ID NO: 15862 - DNA, 676 bp, Triticum aestivum
  unsure (1)..(676): unsure at all n locations
  Clone ID: PAT_TA_15862
gctagggtganttggtagtggtaccacanacncggttatgncgtacggggntcatncattcagttggaatnttgaaggnatngtgggcttttnttttacccagttgcgaaggggnttctgaagggattagttggtaacgccaggttttccagtcagagtttaaangacgccgaggagcgcgcgtcatagctcttctgtggcggattggttctcggcccccccggaagattggcgattacaacaatcatctaatcacttcaaaattttaacctgggatgctacccggttgaggattgacgtggttacatttacagccccaaataatgtgattttccatatatctgaatatactggaccaaatcagactacattggccaccaacagatctttccttctggtatcgtcctgtgccgagtcccggggacatcagagcaacagccctattgttgtatgtacatcatccatccaggatagtcttgcgggtataaattgaccaaagaaatgcccctaggagatgtcactgtacatccctcgcagacttcctcttcagccaatgattcagtgagttgacagttatttttatcattccctgtggtctcctagggcgtgggggggctctgagtttggatgaaacaggaggacggctttctggtccaacaaaaacttcaagacccag

SEQ ID NO: 15863 - DNA, 633 bp, Triticum aestivum
  unsure (1)..(633): unsure at all n locations
  Clone ID: PAT_TA_15863
cgccgccccctctctcccccaccccagctgctctgtcctcaccggcgacctcctcctccgccgccggccatcaacccctcccctcaccatctctgccttccctttgccccagatccaccaatccatggtgctgccggcggatccgagaccaagcccgcctcctccttgtggttgttgctcgagctgctcttagacggatccacagcggccacgcggcagatctgcagcgtcttcgcctgatccacgcggatccacggtgccctgagccctccccaggtgattttctgcgtcaccccttggcctcggcggttccaccaatctccggcgccgtctgctcgccatcccctcgatctgacgtcattctgctccgagctctgaaaccccacgcacacagacctgaaccccactcccccctcctcgctcccaccgtggtcaattggcccccgcggccgccgtcatgaggcgggcccacttcgccagctcccgctcgtccggccggccggcggctccgcgggagggcgtctcgcgtctcgctggccccccgcgcgcccccccctgcgttaatgggtnatctttngacccagtttcangctttgtaataattgatcncagtaagaaatattaactctcttt

SEQ ID NO: 15864 - DNA, 1356 bp, Triticum aestivum
  unsure (1)..(1356): unsure at all n locations
  Clone ID: PAT_TA_15864
ttcggcacgagggttgcattcactgtagtggacaaggnagnagccgtgaaaattggcattggtttcttgagcaactaaaatattcactgtcggcatctcatgacataacattcatatctaatggagaaaatggattatgggatgaagtatcattggttttccctgacagtcatcatggatattgcatggactttcttattgaagcatttaagaggcaattggatgatgcgtggactgaagaagtaagagatgctatggttgagcttcttaagagggccatattttcatgcacaattgatgagttcaatcagtatatggagcaaattaaaagtgaatctgataagcttgctgaatggcttttggagatcaaacctgagcggtggtcagatgcccttttcatggggtcgtggtatggtcagtattcatgtaatatttccaacactgttgttgactggatccccacaagatatgagcttccagttgtgcagttggttgacacaataagatgcaagctcatggagatgatgtacacacgcagagagtcttgtaatgaatggcctgacggattaacgcctgtagctaaccagaaattgcaggaagaagttagcaaagctcactcactcaatgttatgcccacagaaagtgatggggatggtaatttattcaaggtatgcgatgactcagttaatgttgtcaacattgagacgtgtgactgcacctgtcgaaagtggaatatttctgggttgccatgcatgcatgcaattgcagtatttgagcgcactgggaggtatgcatatgacttctgtgtggagtatttcacgacgaaacggtaccgctcgacctattcaatgtccataaatccgatacctgatgttaccttaacggacaattctcagagtccagcgacattaccattcccaattcaaactcgtcgacgggttggcaggccgaaagagaaaccagctgatccgcgcatcacaattaaaagggcagtgcgctgcagcagatgtaaaggctatggtcacaacaaagcaacttgcaaaattcctatcagcggcgaagccttgcccgccttgccaccagctgagctctccgatgtacacaataaggtggagagttgctcttgatgttccctgtaagcaaacgctgctatttttctttgggaacctgcggcatggtagttgattctagctccaagttgctctgtattattcactgttttgcttaggctagcgacgtttgtttagtaaattaaacattgtgatgtgcaccattagagaaacaggggaaattctgccatgttccgatgcccagtctattgctgttgtatttaccttcctcctgccgtgcgtctgt

SEQ ID NO: 15865 - DNA, 1081 bp, Triticum aestivum
  unsure (1)..(1081): unsure at all n locations
  Clone ID: PAT_TA_15865
ctntaaggaagtatggnaaacgcaactgtgtgggaaaacctttacggatctgttcgactacttccccttgacagcattggttgagtcggaaatattttgcttgcacggtggattatcaccatccattgagacacttgataacatacgtaactttgaccgcacgcaagaagttcctcatgaagggcccatgtgtgatcttctgtggtctgatcccgatgatcgatgcggttggggtatttctcctcgaggcgctggatataccttcggacaggatatatcagagcagttcaatcataccaataacttaagacttattgctagagctcaccagttggtgatggagggattcaactgggctcatgagcaaaaagtggtcaccatatttagtgcacctaattattgctaccgctgtggaaacatggcatcaatcttggaagttgatgattgtcgggagcatactttcatccagtttgagccggccccgagaaggggagagccagacgtaactcgtagaacgccagactacttcctgtgatgatgcgaaatcggtgtcgacctctgcaccaaaggtttgataactagctgaagtttcatggctgcagacaaatctttttgctgaaagtcagtctcccgtgtgctattcttgttaattttttcgcccatgatgccccctggctgcttgcgagccgcttcgccgcatcgtgaccaaagtgtatacctacctacagctggaaggaaaggatcaattgtgttactcacctctctaattgatttgatgctctgcttggtggatgctgtggtagtgaacgaacttgagcatcaagcagggtttgtattgtgaaaggaagcctttttcatttcgttcccccctctgtattcattttttccccatgttcgcacgcttcgcctaatttttattttcttttgatgattatttgttgtagagatgaacactgtagttgtatgatcccgtgctgagagcccttgttaggtcttgtgaacccgtattgactttccgtatagaatacctgtacttgtagtatgctgagcagtgtacttatggtgtgtcctaccttgtggc

SEQ ID NO: 15866 - DNA, 1651 bp, Triticum aestivum
  Clone ID: PAT_TA_15866
tcccgtcctctcgttcccccctcccctccccacgcgcgcgcgccggcgagatctgcccagggtggacccccggcgaggatgagcagcccccatggcggcctcgacgaccagatcgagcgcctcatgcagtgcaagcccctccccgaggccgaggttagagcactgtgcgagaaggccaaggagattttgatggaggagagcaatgttcagcctgtaaggagtcctgttacaatctgtggtgatattcacgggcagtttcacgatcttgcggaactgttccgaattggtggaaagtgtccggatacaaattacttgtttatgggtgattatgtagatcgtggctactattctgtcgaaactgtcacgctgttggtgtctttgaaagttcgttatcctcagcgaatcaccattcttagaggaaaccatgaaagccgacagatcactcaagtttatggattctacgatgagtgcttaaggaagtatggaaatgcaactgtgtggaaaacctttacggatctgttcgactacttccccttgacagcattggttgagtcagaaatattttgcttgcacggtggattatcaccatccattgagacacttgataacatacgtaactttgaccgcacccaagaagttcctcatgaagggcccatgtgtgatcttctgtggtctgatcccgatgatcgatgcggttggggtatttctcctcgaggcgctggatataccttcggacaggatatatcagagcagttcaatcataccaataacttaagacttatccccagtgcgccccggggggccacggaccgattccactgggctcatgttagtatctgctcctgagttccacacttgtttttgtctgtggtccatactatatctagttaacacattactgcatcaaacaggagcaaaaagtggtcaccatatttagtgcacctaattattgctaccgctgtggaaacatggcatcaatcctggaagttgatgattgccgggagcatactttcatccagtttgagccggccccgagaaggggagaaccagacgtaactcgtagaacgccagactatttcctgtgatgatgcggaatcggtgtcgacctctgcaccaaaggtctgataactagctgaagtttcctggctgcagataaatctttttgctgaaaatcatcaacctcctgtgtgttattcttcttaatttttccgcccatgatgcccctggctgtttgcgagccgcttcgccgcatcgtgatcaaagtgtatacctacctacctacagctggaagggtccattgtgttactcacctctctaactgagcttgagcatcgagcagcgtttgtattgtgatgacaggaagccatttcatttcccccctgtattcataattttttccccgttcgcacatttcgcctaatttttcattttgatgattatttgttgtagagatggacaatgtagttgtatggttatggttcccttaggtgttgtgaacccgtattgattttccgtatagaatacttgtagcatgttgagcactgtctgtgtggtgttggctgtggtatgaatgtttgtatggttagtggatattttttgtttaggatggtgccaaggtggggggggtttcccccaaggagaacagacatta

SEQ ID NO: 15867 - DNA, 1492 bp, Triticum aestivum
  Clone ID: PAT_TA_15867
gaattcggcacgagatggtggtgcggggggacgcacccatggatgctggcgagagttacaaccatggcggctagatgctggaacccatacaaatttttgcttctattggcgttttgttttttgctgaaactagcgccgttttttaatgttttgctaccaccgttttgtttttttctggaaccagcatcatttttcgctaccaccagatttttgatttgctggaaccagcccctcgactatgcatctttgctaccaccacggcggccagatgctggaatcagcacaatttttttcttccatcgaagttttggttttgctgaaactaatgtcattttttgtattttttgctaccactgttttgtattttgctggaaccagcgtcaatttttgctaccaccggatttttgaaatgctggaaccagccctcaactttgcatctttgctaccaccggcgttttggaatgctagaataagcttcaatttttgctaccaccagattttggtttgttggaatggcgtctgattccgtttttttgctaccaccattatttgatttgctggaaccatggccaatatttgctaccactgccgtttgctgcgagaccatggagtcgtcgccattgtttctgcaggagggcgagggagggggatgggccgcgccgcaaattgagtgcgaggtacggcgcgagctcgacgacggggtgatgtggccatctccacaggggttgccatggccgatatgcgcgcgcggccaaggatgcggcggcccgtgggttgccggcgagcacgagcccgaggacgaacgtggggcggccaaggatgcggcggcgagcgcggattgcctgcgagcccgagtccgaggatgagcgctggcggcgcaagtagaagacaagcgcggcgccgaagtaaagctgcgcgagacggcgagatgcggagagctgcacgagcgcgaggaggaagatgtctagggcgaaccctttttttttgctatatccaacggtcagggctagtggcatccggtggctagggcgcgaccggcccaaatttgggccggcgtgccagcgcctagcgttgctcttcttgttaacggagtttcggcagagcttatctacaacaagagtgggtccctttccccgctccggcagcagcattggggaagaccccactggctacccaaccatgactccgagcttgtcaagtggtaggccgagaattttgagacactttggacaggtgtgacaccggtggcttggaaactttggaaacatcggaacagggtggtgttcaacgatgcttcaccttcggctagtgttgtgtgctcagcaggtacaactagagggacaaaactggagggcagcgtgttgcattctagggtacaagggttgtctgacagcgagttgtcagcgtgtgaagacgtgggctctaggagccgtgggtgtaatgtaaaacctttctggagccatctaggcgttgcttatctaaaaaaaaaaaa

SEQ ID NO: 15868 - DNA, 1399 bp, Triticum aestivum
  unsure (1)..(1399): unsure at all n locations
  Clone ID: PAT_TA_15868
cntaatattctagatctagtantttgactggtgantgtaanttgantggaccctttccatgacggatttaatctttccttctatttcgtgcctttagtaggcttagtattcccggcatttgcaatgatttctttatttctttatgtgcaaaaaaataagattgtctagtattttttagtgtaagtaatataatatggtagggtatgtggctttttctacacacactttctacacacaaatgaaaaacggttatggatgcggatataggctacgagcataaatgcatgaatatgcagagccaggtatagcgagttttattttatttattttaattgaatcaacgaatattttttgaatagaaagtcaatgtatctaacctattatttcacaggagtactagttgctgaaggcgatttcagaatcaaaaaaagtaaagtcaaaattatttagcttattctctcaatttcaatcgaccgctgctggatttagtatatctaatatgaattggcgatcagaacacatatgggtagaacttctaaaaggttctcgaaaaaggggtaattttttctgggcctgtattctttttctaggttcactaggattcttatcggttgggatttccagttatcttggtaagaatattatatctatacttccatctcaagaaattcttttttttccgcagggggtcgtgatgtctttctacggaatcgcaggcctattcattagctcctacttgtggtgtactattttgtggaatgtaggtagtgattatgacagtttcttcgagcggccgcccgggcaggtgttttttcgttggggattccctggaataaaacgtcgcgtcttccttcgattccttatgcgggatatccaatcaattagaattcaggttaaagagggtctttatcctcgtcgtattctttatatggaaatccggggccaggggatcattcccttgactcgtactgatgataaattttttactccacgagaaattgaacaaaaagctgccgaattggcctatttcttgcgcgtaccaattgaagtattttgaggtatcttttttgaactgagttgaatgaagaaaagaagaattgggaagaagaaaagttttctcaacacggggaaggaagtcccttcctaaattggatttggttattgtaaggggatttttaaagtatttatcctaaaggaaggaacaaacgaggataagagaaatttgcttttaatttttttttaatccaaagtggagatatatcccatacaatcctccctttcatccgaaagggctttttttttaatccaattcactattccantcaaccaagatcnangaaagaaccaatgcacngaaattcacaataactatatccaananagnagatnggtacagggt

SEQ ID NO: 15869 - DNA, 974 bp, Triticum aestivum
  unsure (1)..(974): unsure at all n locations
  Clone ID: PAT_TA_15869
gaattcggcacgaggtactattctcctctgtccatttggtgccaaaagaaatatcctacacactgcatgcgttgcccactgtcgtcctcgagccgccggggtcggcctcctccccgtcggctcctcccatggcccgggcctcgcctcctcctcttggccgtcgccgtcgccgtctccgcgatcatcccggcgccgatgctcgccgcggcaccaggcctcggcggctgcatgccggggcgatgcggcagcctgaccgtctcccgcccgttcggggtcgtcccgggctctgaggagaaccggtgcgcccagatggggttccaggtccactgcaacgaccgcgtcccctacctcgggtactacgagcccggcttcgggctgcggatcctccacatcttcgtccagcaacggctccctgctcgtctccgacgcccacaagctccgcggcttcgccggtaggtccagcccccaaggctgccacgtccccacggccgacacggccaccaaagtcggccacccgttctccatcagccccctcaaccagaacctcgtcttctacaactgcaccaagccgccggcgccgtggacggcgcgccgagcggggctgctggacacgagtgtgcccggaacaacacgtttgtccgcgcgggagggccgtacaacgcgtcgcgccgggttctcacggcggggtacgctcttgganggctgcaacgccacccgccgttgcccgnngcttcggggcgntccgncnaacntgaattgccaancgactaccaanaagcctcatnnnggggnatgggttttcctncctgannanggggaagnccnnccngagtgcccggccaacngggggccccgnnaaaaaatggganagnangggnnccatttttttaaaaaaantttgganccangacattagggnggcngcntttanctnantggcnnatgntntctggnttnnatncntcatgggcccg

SEQ ID NO: 15870 - DNA, 675 bp, Triticum aestivum
  Clone ID: PAT_TA_15870
gaatgcgcctcgcggttgtatgtggagggtgtttgtgaagagcttgagtggcttccattttactatgaagatgtgccaacggcaatagttgatactcaaggcagagaagaaatgcctaaaagagaactgatatcaagggtgctaaatgtctgcacttattggatgactagttttataaagtatagctcatggcttgagaaccccttaaatgtaaaggcagcacgattcctatctaaggggcatgccatgttgagcgactgcatgactgagcttgacatagcaaagtatgctgggccgtccggccgtagctgccacgccccccgtgccggggttgatgccgcccggcgtccctcctttctcgagtccctggataggctcgtggccgcttggggggggttagttgatttgcgcctagttttccttctgtccagttcctcccctggtttggaggatctattggctccacctcctgaccgagaattgtgcagaagactgaagaaggaagcagaatttcttgaggcttcctttcgagcaaaagcagaatatctggaggctgatactattagcagagtgttacctcctgctggcgagggagaacacggaaagacgggcagcatggttaatgaggttttaacaccacaaaaaccagtaaataggatggagaacaatcgtcgt

SEQ ID NO: 15871 - DNA, 940 bp, Triticum aestivum
  Clone ID: PAT_TA_15871
tcacatcagtaaacatgggtggaggagaaatatcatttcacggggcatcggtcaaggctgaacaaaacatcagcaaaggtattgtctgcgcatcaaccgagcttgcaaatgaaaacattccgaggcattctaatacgacgaaacgagtccagatgccatctgcgcctattttaagagctacttacaataaaattggtccacaagatttttcaaaccacatacgtacaaactatccatcaatatccgatgagaagctcgggatacttctccgcgcgcgcaatgctcgaggtctggcaaacatttcagagatgaggcggtctttccagtcatcaatgttcacatttgcggacaagctcatcaactgcatcgctgagaattgttcttgttgcaaggccaacggacgtaaacaatgcatcctgaagagtgaaaatcaaaacagttgcaccaacttggccaacactcctatgcaagaaaaaatagacaattcgtttgttacccctgtttgcaacaaggtttctcccaggctggctggacaactcccaaacgacggtagctcgtcggccaatagctccattgcaaggaagaggggagttgtgttcagcccggccatccagacggaatcatcaaaaaaggtgtgtcttcggctggacgacccactccaagcagtttcccattcagcagtagatactgtcaacaactcatctctgtctgggaagcaagacactcgccgagaggttgccaatacgatttattcattctttgatgacctgactgctagcatagtcatgtactatgtcgagcaacgaccgagctctggatatgttacattcggaactacaaacgacaccgcgccagccaaaattcagataacaaagtgcaacatcgcccgcgacccatgggcaatccggtcagttccgatgccaccggcagtcccagtcct

SEQ ID NO: 15872 - DNA, 739 bp, Triticum aestivum
  Clone ID: PAT_TA_15872
aaaaaaacatccatgtccatcgaacatcaactagcccgcacaaataaaaaatatctttccatcaatgggtcaaggataagaaaaaataatagtcaaacctaaacaaataaggaacctaaacaaaataaggacaaccaccagaccacgcgaggaaagttccaaaacagaaacaaatacagacaatttcacaatctgatctccacacggtctcagccacctcaacccaagacacctctaccctgcccgcggccgaggtacagccggccggacaagcacccaccaaacagttagaagtcagcaaccacgacttgaacaagccacacgcgactcgacgtccacaccaaaagccacctccagccgcttcaatcgacttccgacgaagtcacgccaaagcacactcgacgcccgacgaagttacgcccaactgctccaatcaacgtcggaagaagtgacccgaaaccacttccggtctgccgcacctgcttgcgaacgggtgcctgggaagctggcgccttctggttgcaatcggcatttattcgttttctgccagcaaattgttccctgttaattttcaagacataacactatggcatacaagaagttgagcgacttaactagaaggggacagaattggaacattcaagtgaaagtaatgagaatgtgagattcagtcaatcctacaacccatgagcttattagcctagatatgatattgatacctgcccgggcggccgctcga

SEQ ID NO: 15873 - DNA, 1085 bp, Triticum aestivum
  unsure (1)..(1085): unsure at all n locations
  Clone ID: PAT_TA_15873
ggangaaacctnnttcgcnattaaccctnctaaagggaacaaaagctggagctccaccgcggtggcggccgctctagaactagtggatcccccgggctgcaggattcggcaccaccgggggcgagggggggagagaaaagggagagacgatactggtgtgctttacgcgcaaccttccattatagccccaaaaatacgacacagacgagaaagcaaacaagtgtgggtgagcgcgccggcaagcgtccccctccctccctccctcctccctcctcccctccctcgaccccgatcgaatcgatcgtcgatttcgatccgcgtgggggaatcgatcgggggctccaattccaccacgccgcttcttccgatccccggagccggcgtgcgtgttatctttcttggatttttgggttttctggggacgttgggaggagaggaattgggaggagggcgaggctcctccaattttgatgctccagggccccgagatccgagcctgagcgcgggtgatctgcgcgcgcgggagctatgggcaacgcgggcagcaacggcgggggaggcggcccgggccaccgtcgtcggagctccggccacggccacggccaccaccaccaggcgccgccccccccgcagcagccgcgggccccacccttccgctgcttcttcccgcgncccgccctaccccccgcacctccccatccccccccccccgcaacactaccccgctgnacccgtccttcctcccgccgacgccgncggccgccaggcgcccctcccggtgcccctcccccgcctcccctagggcccccccgccangcggcccccctggccctcaaccaaaattccctgcccttccggctctcccccttttaccccccctgggctcntgcccctcccctagccgctccnaaccgtccttgcccttttccctatccaccgcacccaattcgccanctccattcccntatcgnccttaaacctctctcngntnnntatgnntttcnttnnntgntcctttttttctgngngnntattncngnntntntcttntaccttnttnnnnnnaatcncnnantttncnnncg

SEQ ID NO: 15874 - DNA, 1203 bp, Triticum aestivum
  unsure (1)..(1203): unsure at all n locations
  Clone ID: PAT_TA_15874
agcctcgcctcccctaccaccatcagcacctacccgaagccaagaaccaccttccgcccctccaccacctggccttccgcccctccaccccctggccgccccaacaccgacggatcaggcgatggcagtggaggccatggcagagaagaacaccggcgccggcgtggctggcggagtagccccggagagcggggacaggcgctcccgcttcaggcggatctgcgtctactgcggcagcgccaagggccgaaaggccagctaccaggacgccgccgtcgagctcggcaaggagctggtggagaggggcatcgacctggtctacggaggaggctccattgggctcatgggcctggtctcccacgcagtccatgatggaggacgccatgtgattggggtcatccccaagtccttgatgcccagagaggtcactggagagcctgttggggaagtgagagccgtctctggcatgcacgagaggaaggccgagatggttcgctctgctgatgctttcattgccttacccggtggctatgggactctggatgagctgctcgaggtcctcacctgggcccaacttgggatccacaagaagccgatcgggctgctcaacgtggatgggttctacaacttcttcctgtccttcatagacatggccgtgagcgaaggattcatacaggaggacgcgaggcacctcgtcatctcagctcctaccgccaaggagctagttctcaagctcgaggagtatgttccggactacgagatcgggctggtgtgggaggatcagggccagatcacgcacgggttcgcgccggagctggagcccggcattgcgtcgtcatgatacaattcatggtggaagcgtttctggactaagtaacatctgaccgtgcaaacaaaaaagaaaaaaaggatgggagtgtgctagtccttgtcagtcgtagcttttgtgtgtcactgccagtggcatgacagtgttagcattgagtagcaagtagtggtgcggttgatgatggcgttcttttggtcgtagcttaggtagtagaaggaatgaagggattgcatgtacaaatgtgttatgtaggagcagcagcagatgtgtgttccttaattatcaatcaagaatgggaaattcgtctcgctctgtgtgggtcatggacgatgtgaaacaaatganattcaagtcgtaacggaagaaacgaacag

SEQ ID NO: 15875 - DNA, 946 bp, Triticum aestivum
  Clone ID: PAT_TA_15875
cgacaccaagacgaacccagggataccgcccgcccttctggccaggtcgcgagccacggttcgcgggatcaggatggtctcagagtcgtttaaaactgaaggcagcacggaggctgccggcttgaggattgctgcacagtacatcggagcattcagtggactggttacaggtacgaacacgatgcttcttagcccagcggacgcaggcaacccgggggacaatgattgcccaggcgctcccagatatacaaccacacgtacaagcagaaactgacgctcgggaagcccccagcccccagccccaagcaagcgggcagaagaggaggctgatttcccccttgggaatgccatccgggcgcggacctccgccacctctggagcaccacaagtagagacagtatcttcccttgtctttgccttccgtgtccgttagcggcgagagggatgaatacctagactgggattagatagattgctggggaggaagtctttctttgtcacaagagaagatttacggatgggctaggagtgattaggacaactagttttttgtcttcctatctgtgcgggcgcaactggtgcccaacccacaaccttagagtgtgaggcaggccgggcggttttatcataagtgaaaatttactgcttgggtcggtcgtcaggtcggataaaacgacaatactctgtcggtaaggcttcgctctggaacccctccttttcttcgtctaactgaaacccggtctcccgcactccgcagccccctccactccgctccggcgtcacagctctgcccttccgggccgcaaatcacctgtaagtccgagggcgcacactcgaaagggttgctacaaatactcccttcgtccggaaatacatattttagttttagatacatttatttttatgcatttctccgacaagtattttcggacggagggagtatatc

SEQ ID NO: 15876 - DNA, 1002 bp, Triticum aestivum
  Clone ID: PAT_TA_15876
gtgactgatgctgtgtagagctatttaaaagggtacaagcacaactgcgagcgaggggaacctcagggaggacaagaagcctgaacctgcaaaatcccagggtgagaggggaagtgtggattcccttcttaatctgctcaggacgcactcggtggaccaaaaaccgatgaacagcgatgagaaagagcagaatttgatgatgctgatgagaagcagtgattctggaaacaagcaaagttcaaggatatttggcacccttcacgacgcccaggaagggcagaagccacctcctgcaaccttccaagggagcccttcaagcttcaggcgaaccggtcctgtccctggggttaagttccagcttgttaccaatcctactgctggtgccaagcctgtcgtcaatggcatgaccgatgctgtgctcgaacccaagacgccactggaggaggagactgctcaagatgaacctgattcagcctccccgtacgaacccgactctgtgatagcaccagaagatgcatctctggacgactttgttgtctcagacgatgaatcagacgtgctagataccgatgaacccgatgagtacctggaaccattcgataatgctgatgatgttacagatagcatcccatcccatgatgacagtctggaaggtagtccttccgtggaagcttccgacctgagctcgctcaaggtcatggagctgagggagctggcgaaatctcggggactcaggggctactcgaagatgaagaagagcgacctggtcgcactactgagcgacgtgtcctgatccgtcggtggtggcaatcctgcttgacgagcccaccgttttgcttcccttctgccatggccatgtgcacgaacgacactccattcctatttcgccaagaccaggcccttttttaggtagaaagttgtaaatgagcaaggttaactttctccgttcatcgccgatctgttgctgtctcctttcgctgtcatgtcccagcttcgttagtt

SEQ ID NO: 15877 - DNA, 621 bp, Triticum aestivum
  Clone ID: PAT_TA_15877
tcgacccacgcgtccgataaaattaaaacggggaccaaaggtgatgcctctgcactgaggccaacacttatgactgcggtacctgctatacttgaccgtgttcgtgatggcgtgagaaaaaatgttgatgcaaagggtggtgtagccacgacactctttgatatcgcctacgcgcctcggctagcggctgtccacgcgactgcccacgctgcatggggattagagaagcttgtgtgggacatgcttgtcttccagaaagtgcatgcaatcttgggaggccggattcgctttatactttcaggcggagcgcctctgtctggagaaacttagagatttatcaatatatgccttggggctccaatagggcaaggatatggtctaactgaaacgtgtgctggcgggacattctctgagtacaatgacacatctgttggtcgtgttggtgctccattgtcttgttcgttcattaagttgatagattgggttgaaggtggatacttgacatctgattcaccaatgcctcggggagaaatcattattggaggcccaaatgtaaccaaaggctatttcaaaaatgaggccaaaacaaatgaggtctacaaggatgatgagagaggaatg

SEQ ID NO: 15878 - DNA, 585 bp, Triticum aestivum
  unsure (1)..(585): unsure at all n locations
  Clone ID: PAT_TA_15878
gaattcggcacgaggccgcacgaactgcatgccagtttaagttcagtgctcaaatcgggcctgcagcagaagcgctccagacctaacgtgccgttgcttccgccgcattgcgctgggctgaacttgcacgtagctggctgtggtgggtagagtggccgagatgcttgccgtgtcctccgcgaggtgccccgcccgcgacgcggtggagcagtgcgccgaggccgcgcccgtggagacggttgggggcgcggtggtggtggcggacctggacatagacttcgacttcaccgttgatgacatagactttggcgatttcttcctccggctagaggacggagacgcgctgccggacctggaggtcgaccccgccgacatcttcactgatctcgaggcggcggccgcgggcgtcgaggagttgcaggaccagcaggtgccttgcgccgagctcttggccgccgtggaggacgtcggttcggtcagttcggccggtggtgtcatcgccgtagagaacgcggcgttcgctgaggcggngctaggagacgggaagcgagggtgcagtcaagccgaggtggacgaaagcatggg

SEQ ID NO: 15879 - DNA, 1120 bp, Triticum aestivum
  Clone ID: PAT_TA_15879
gaattcggcacgaggattggttatgttagggatccacctgtatggcagccatctgaagatgtgggcgatcttctcactgttcacttcacctactcagacaccatctggccttggacagggtaccttgccctgcacatgcaagttaaagacgaaggttctcagttttcaggcataattaatggcaatgttaccctgtcgatttacagcccagctgctgagggggaaagcagcccacggagtagtacgtgtgttctttacctgaaggtcagggtggttcaaacacctgttaggtcaagaagaatactgtgggaccaatttcataacatcaagtacccatctggatatgttccgagggattcacttaatgtgaataatgatatccttgattggcatggtgaccacttgcacacaaattttcacatactgttcaacatgctgagagatgcaggatactatgttgagacccttgggtcaccacttacctgctttgacgctagcaattatggtacactgctcatggttgatcttgaggacgagtacttcagtgaagagattcagaaactcagggatgatgttgtacacaaggggctcggccttgctgtttttgctgaatggtatcatgttgataccatggtgaagatgacattctttgatgaaaatacccgcagttggtggagtccgcttactggtggtgcaaatattcctgcgcttaatgaacttttggccccatttggcattgcttttggggacaaaatattgagtggtgatttctcaatcaatggtgagcagtcccactatgcttctgggactgatatagtgcaattcccagcaggaggttttttgcatggcttcgaactccaggaagaccccaaaactgcacagaatagctcaactccagatacacagaactcccagtcccaggagaagagcaagctctcctcgattcttggtatgcttgaagcaggcgaagggcgaattgcagtatatggggattcaaattgtcttgacagtagtcacatggtaacaaactgttattggcttttgagaaaaattgtggagtttgctgggcaatggactcaagagatcctgtccttttctcagaagcaactcggttaaaatt

SEQ ID NO: 15880 - DNA, 592 bp, Triticum aestivum
  Clone ID: PAT_TA_15880
gaattcggcacgagtcgccgcccgcccccggttcggctcgcggcgcccacggccacgagctcgccatggtcgctcgccaaatggtaagcgacggttacacccagtgtattatccaagcgttccatgtcgcatctcccgcaccagcatttggattcggtggcccggaccgtgctctggaggattggttcttcgagcttgacgtggactgggttcttcaaatccatagcgagcatggcttatttcaagcagcttcagctccaagacaagtcgccggcatggctccggccggcgtcatggctccaaagacttgggcccgagatggtggcgtgccctgccccttacccccttctgccccctagcggtgctcagcgccgcgctcctgacgccggcgctcgctcggcgggccggtgcccgccgggcctagctgctcattttcgtcgatgttattgcccgtgttcttagggtggagaatttacgggccgtgctagacatgtttgcttgtgtctccaatgcatcatacatgtttacgccggtcgtgatctctccggaagcccaaagcatattcagcgagataggcggctcgttggagaga

SEQ ID NO: 15881 - DNA, 787 bp, Triticum aestivum
  unsure (1)..(787): unsure at all n locations
  Clone ID: PAT_TA_15881
gaattcggcacgagctcacggacacgtaggggattccaaggagagaacctcctccaagtatctaagcacagtctccctcacgcagctgtgcaaacacttcaccacgacccctatttaagcttcctctcatggcgtggacaatcctagaaccaagctagataaaatcctctgccttgccttggaggctcaactcgaccatgccgtcgccgatcctgccggccaaggaggtggaggaggtggtcaccgccaacgaagaggtgacagacatcatcgtccagagggtgccgtactgggaccctccgacggtccgggcgctggacgcgagccaagctgaccacctggtccctctaccgcgccctcatcggcgagttcaccgcctccctcatcctcctctacgtgagcatcgccaccgtcatcgggtaccggaaccagtcctccgccgccgacgagcggtgcaccggcgtcggctacctcggcgtcgcctggtccttcggcgccaccgtctccgtcctcgtctactccaccagcggcgtctcaggtgggcacataaacccggcagtgacgttcgcgctgttcatcgccgggaaggtgacgctggtgcgctcggtgctgtacgtggcggcccaggcccccggcctcctcgcgtggcatcctnanggatatgaacaacctncacacttcgnggnggccaanccgttgccgggggtatcctcggggggctcgggaaaattttggacttgcctgccaaagtntntcgcaagaccaacgacgcgganctttccctggg

SEQ ID NO: 15882 - DNA, 624 bp, Triticum aestivum
  Clone ID: PAT_TA_15882
gaattcggcacgagctcaggaactcacggggatctcttaccgtatggtcaccgacggatacacccagcgcatggtccaagcattcgagtacggtggtgacccagaccgtgcgctggagatttggttcttcgagctcgacgttgactgggttctccaaatgcgtgagcaacatgttttacggcggaagctcccggacatgtcggcgtcatcgctgcaagacttggtcgggagatggattcgagctctcaccgtaatagtcttcaatatcagaaatctggccgtcgctgttcacaagatgccgcctattgcagtggcacagtttggtaaagcaagtgtttctgcaatgctcgtcttcgtcaacgctatcctgactgttcccaagacacacaagcttcgggctgtggtagacatgttcatctgtgtctcgagtgtatcatactacatgtttaccacactcgtgatctctcccgaagcgaaaagcattttcagcgagataggcggctcattggagggggaaggaaacaggttactcaaggccttatgcagcatgatggaggaggtcagaacattcatcgaggacgacactcctgggctgtccaaatccccagggaaaggcgaggttaa

SEQ ID NO: 15883 - DNA, 1374 bp, Triticum aestivum
  unsure (1)..(1374): unsure at all n locations
  Clone ID: PAT_TA_15883
aggctcgattattcttaaccctctctccccgcctccccccgtctcctccgccgcgcgcccaaccgagcaggggtgtcgccattgttgtcgcctctcacccgcaggccgcctccgcgtccgtcactaggccacgagacctaggatcccccgccccctcgctgtgacctcgccgcgatgtggtggagggcggtggccagggctcgccgccggatcccgggagcgcggcccgtgtcgacggcggcggcggggaagagcggccgcgaggtggtggtgccgcggttcggcgggccggaggtgctgcagctgaggcagggggtgcccgcgcccgatctgaagcccggcgaggtgcttgtgcgcgcgcgcgccgtctccatcaaccccctcgacttgcgaatgcgggctggctatggccgttgcatattcgagccactcctacctctcatcattggccgggacatcagtggtgaagtcgcagctacagggacttctgtgtcgtcattctatattgggcaagaagtgtttggtgccttgcatccaacagcgattagagggacatgtgctgattatgcagttctttcacaggatgagcttacttctaaaccatctacgctcactcatgtggaggccagtgcaattccctttgctgcgttgactgcgtggcgtgctttatatggtactgctggaatttctaaaggacaaagattacttgtgcttggtggaggaggagcagttgggctttctgctgttcagcttgcggtagctgcagggtgtagtgtttcagccacctgtggagcccaaagtattgagcaagttttggcaagccggtgctgaaaaggctattgattacgccactgaggatgctgaatcaacggttacaggaaagtttgatgctgtgttagacacaataggagtggctgaaactgaaagaattggcattaatcttctgagaagaggcgggcattatatgacccttcagggagaggcagcttcactagcagatagatatggattatatgtgggacttcctgctgctaccgctaccttactgaagatacagatccatatcttgttccaaggaataaagtactggtggacatacatgnaactgatctgacgncttcananatcanagntgtccggaactggaaactacagtaccgtcnagaagactttcctacaaccaantaagagaantcatgaggcaagganaaaggtgtgcctggaaggnggtcnatagtcgacatgtaacaggnttgtcnacaccacggaagnacgacntcctctaattgncatgagttaatttgccttctcaaaaaanttgtgctaattccntcttagannaccaagntattgcaggatatnaatnataatatg

SEQ ID NO: 15884 - DNA, 706 bp, Triticum aestivum
  unsure (1)..(706): unsure at all n locations
  Clone ID: PAT_TA_15884
gctgctctctcttcctccccccggctcgacctctcctgtaacagatctcacctctcctacccccaattcctcctgtaccgccatggattcaagtcaatagaggtagagatcgtaacatatggtatcagatttgccagattatctccaaaaacccaccttctccacgcgtcagcagcgccacaccgcccaaatggagcaagcgggtcgatgaactcgccgccactctcaagttgattcaggagcaaaacgcctcgatccagaaggcggttgcgacgtccacggccttgttcgaggagatcaagccgtcggtgctccgatctggcgggagtgggcgaccaaacgctcgagcagtcccgtcgccgatcttgcgctccggatctggggcgggggtacggcgcgaacnttggattccgtcnatcaaagcaatccccgcgctnggcgcttccaagccggaccgattcttccgccggctgaattccacggcgaggcggggcatctgcgcctgcgccctgaggccccaggccccccccccgcccccccgtcgtccgcccccgggggctgcgaaccggggtagtgactaccctcgttccacctccggtcacgggtacgttaccaccgtccaaatttcattctcgtcctcttgcgcgtgcacctgaacctcagtcgtttccgtttggtccgtcccacacacgccattcgtctcgct

SEQ ID NO: 15885 - DNA, 1419 bp, Triticum aestivum
  unsure (1)..(1419): unsure at all n locations
  Clone ID: PAT_TA_15885
gcacggcccaagagcgctccatgctccaagaacacaccaaatcaaggggagcgcgcagagcggggtcagagcaggagaaagccatcatggtgcatccggtggcggaggccgacgagcggagccccttcggccggctcaccgccgaggagtactacgcacgccacggcgtcacgcactcctcatccaccttcgtcaacccgcgggggctccgcatcttcacgcagcgctgggtgcccagcggggacgcccccatcctcggcgccatcgccgtcgtccacggcttcaccggcgagtccagctggatggtgctcctgacggccgtccacttcgccaagcaaggcttcgccgtcgccgccgtggaccaccagggccacggcttctccgagggcctccaggcccacatcccggacatcaccccggtgctcgacgactgcgaggccgccttcgcccccttccgcgccgactacccgccgccgctgccctgcttcctctacggggagtccctcggcggcgccatcgcgctgctgctgcacctccgggacaagccgcgctgggcgcgacggcgccgtgctcaacggcgcatatgtggggagtcagcccccggttcatgccgccgtggccgctggagcacctgctctgggcggcggncgccgtggcgcccacctggcacgtcgcctttaccagggggaacatccccgggcggtccttcaaggtggagtggaagcgcgcgctggcgctggccagcccgcgccgcaccacggcgccgccccgcgccgccaccgcgctggagctcctccgggtgtgccgggagctgcaggcgaggttcgaggaggtggagctgccgctgctggcggttcacggcggcgacgacacggtgtgcgacccggcgtgcgtggaggagatgcaccgccgcgcggggagcaaggacaagacgctgcgcgtgtaccccgggatgtggcaccagatcgtcggcgagccggaggagaacgtggagcaggtcttcgccgacgtcgtcagctggctcaaggcccgcgccgccgccggtccgcactccgcagtagttggttagtggttgggtcacgcgtcgcgcgcgggccgtgtcagtcaggtacaggcaggtgcgtcgttcctgttgggagagatggatcaatcatggatcatggatcatgggcagggcgtgcttggtgtgtgtggtccgtggccggtgcaagtacggccgcaataaaagaatttgttgacttgccgtacgtcttgatgaaatgagatctggtcctgctgtggtgttgtgtactgtaggagtatcttcgtgtatttgcaagtgggcatggcttctcatcaatgaaaatgtcggcgtggtctccatatccatggttagtggttgggagttggggctgcctatcttgccgatcaaaanaaaaa

SEQ ID NO: 15886 - DNA, 569 bp, Triticum aestivum
  unsure (1)..(569): unsure at all n locations
  Clone ID: PAT_TA_15886
gaattcggcacgagatcaaaacctcccaacgcagccgctgattcctccactactcccgctccacacctcccacgagcgtctccgccagctctcgactcagatggacgtcgccgacatcgcctccccgtccggccagcaggagcagggccaccggacggtgtcgtcggagccgccgaagcgccccgcggggcggaccaagttccacgagacgcgccacccgctgtaccgcggcgtgcggcgccgcggccgcgtcgggcagtgggtgtgcgaggtgcgcgtgcccgggatcaagggctccaggctctggctcggcaccttcaacacggccgagatggcggcgcgcgcgcacgacgccgcggtgctcgcgtctccggccgcgccgcctgcctcaacttcgccgatccgcctggcggatgctgcccttctcgcggcggtcgttcggttttacagccgcggagattaagcgcctcccgtggcgtctccntcaacggaacantcatcantcccgtnccgtcntgcctcaacaacagaagttcgtccatggcgtgtgggtcacanaacagtccgtn

SEQ ID NO: 15887 - DNA, 1377 bp, Triticum aestivum
  Clone ID: PAT_TA_15887
cgtccgatcgaatcaagtaactcgcaggtttcagaaaaaggagttctgcaaatactgctagatctccgtttcattggtgatatcctatccggaggcaaaaactcttcggccaatccttctgaaacaaagataaaacaggacaatgctaagactaccttcaggagaaaacaatcacaattccaggcagattcagctaccatagagcctataaacaagctgatcaataaattctcgcagagattggatccaatagactgggctacgtatgaatcttacttatgggagaatgagaagcaatcttacaagcgctgcgttgttctttttggtttcttggttcaactgaatcacatgtatactggtgcggcacaaaagttaccaacaaaaacaaatacagattcaaatattatgaggtgctcccaggttccaagattcaagtacctaccaatcagtgccccagctctagcatcaagaacacccaagtcatcactacagtctccatctgatgattcaacatctaggaacccttggaaatcatcatattcaaatggggaaagatctaccatatcagaatatgataataatgcaagtcttggaagtgcagctccattgctcaagtcctttgttacgcaggttgggagcaaatttggggagaacacatctagatggggttccatgctctctgatggccaggtagggctgagcgacattcttcctggaccagcagctgggttcttctcatctttcacatctggggcccgatatgattcatagtcaaagtagtgtgaatgaaggtctcgagtccatacgtcctcttatacatcaacaaacgaaaatgcacataacaagataatggcatcaccactgctgatgggtgagatctgtcattgggaatctgttgcttacagaatgatgacacatagttggcctgtcgatggtcagcacatccatgcttgcctcttacattttatctgatcggtgggcatccggggagaagctcaagcagatctgacgacgcggcctgcttccagcctgtagagatggaggaggcgctgatactaggaggaatcagatgctttttctacgtgttttctgcgtgcaatttgaaggcgtatcggagagagcaagtgcagctttgtaatgataccagctcaccatttttggtgcgtctcgatcaacttgtgtacctgcccggccccccgcgcgcggccgctcgattttggagtccattcttttctcctgtttttggtctcggcggtttgggaggatgttattatatttgaacagttgtgaggctgctgttgtggtgtttcccaattgatgtgtagtaagtagttgtgtacactgcaaatagcaataaagcaagccctttattttttc

SEQ ID NO: 15888 - DNA, 705 bp, Triticum aestivum
  Clone ID: PAT_TA_15888
ctttgcattgctgcctttcctccccttttggttggctcgcctattgttattcctacaaaaggatgcggtctgctccatgagcatgaggaggagagggagccttgctgctgctactgctgctgcatccggacgcgtgggcttcttcttcctcgcaattctcccatgctcggccgccatctgcagctgcgaaatgagtaatgggtgctgaggagagcttgcgcccgttgtcagtgcccttgctggtgtatggaggttcccagtgctcatgagctataaccgaagtccagaggagagtgaagatgcgagataagcagccgcagcatgagtcgccgattttcaggaatggctactgatttgttttgtactcatagaatcctctttgccctgttggagaaaggaggaataaccatcattagagagctagaaagtagaggttctgttcagaaactagccaaaatattgctgaaagctagtgggggagagcttttgaacgacatcttggcagatataatggacaggtattccaaacacgacagcaaggaatcacttcggagaacaatcatggaacatgatgaggtcttcagacaacaggtgcatgaattgcatcggctatacagggtacagaaagcactgatggctgaattacgtggtgagaagcacagtttccaactcagaacagaagatactcgagaaatggtgcagggc

SEQ ID NO: 15889 - DNA, 493 bp, Triticum aestivum
  Clone ID: PAT_TA_15889
cgacgatacggtcctctcctcactgaccagatccgccactcctagcagcagcagcagcctgatcatcaagaagaggccgaggaccgtccgcccacgcgtccgcccacgcgtccgcgtggacccgccggttcctaggaaattgagatcagccataatcaagcgcgtcggtcaggctgttccttcgtcgccgcggcatgccaagaagaggcgtcatctttcagctatcagtgctcagatttttcagatggatcgtgaaacaagaaccgacgagaccatgccatcgaattctttcacaaaggaggaggaagtacttgctgatactttgctagcactatcccaaatagccccaccttctgagccaaaagccgacacggcgacggagcaagatatctcaaacacaaatgttgcctcaacttcttgttcagaaggtgtgattactcctactggagctatcaaggaggatgacagaataactttgttgccaactgatgct

SEQ ID NO: 15890 - DNA, 972 bp, Triticum aestivum
  Clone ID: PAT_TA_15890
gcacgagccccgcccccggcctcccccagaacctccctctgcttcttcgtcgtctctctctgcttctgcatccacaatccacgctcgcctcggtacaagaaacaggggagggcaggcatgggggcacgccggcgcctggcgctcctcgcgctcgccgtggccctcgccgcggcggcggccaccacgggccacgccggcgtgaccagcccgtaccggcgcaagctggaggccaccgccgacatgccgttcgacgccgacgtcttccgcgtgccgccgggctacaatgcccctcagcaggtgcacatcacgctgggcgaccagacgggcacggcgatgacggtgtcgtgggtgacggcgagcgagctgggcaacggcacggtgaggtacggcccctcgccggacaagatggagatgtcggcgcagggtacgcacacgcgctacgactacttcaactacacctccggcttcatccaccactgcaccctcaggaacctcaagcatggcgtgaagtactactacgcgatggggttcggccacacggtgcgcaccttctccttcaccgcccctcccaagcccgggcccgacgtgcccttcaagttcggactcatcggtgacctggggcagacgttcgactccaacagcacgctgtcgcactacgaggccaacggcggcgacgcggtgctcttcgtgggcgacctctcctacgccgacgcctacccgctgcacgacaaccggcgctgggacagctgggcgcgcttcgtggagcgcagcgtggcgtaccagccctggatctggaccgccggcaaccacgagctggactacgcgccggagatcggcgagacggtgcccttcaagcccttcacccgccgctaccgcacgccgtaccgcgccgtcggcagcacggagccgctctggtacctcggtcaggtcgcctccgcccacatcatcgtgctctcctcctactcctcctac

SEQ ID NO: 15891 - DNA, 902 bp, Triticum aestivum
  unsure (1)..(902): unsure at all n locations
  Clone ID: PAT_TA_15891
gattcggcacgagaccatctccctgttggaggaagctggtctcgatcctgttgccttagacctcacaggctctcgcacggaccacactgatacaaacagcatagctacagttggaagagtactccaagccactaattgattacctcagtaaactccctgagaacgagaaggtagttttggtcggtcatagttgtggaggtgcaagcgtgtcatatgccgtagaacactgcccaaagaagatctccaaggccgtattccttaccgccacaatggtaaaggatagccagaggcccttcgacgtgttctctgaagagctcgcgtcggcagatgttttcttgcaagaatcacagtatttactttacggaaatgggaaggacaagcctccaactgggctcaggtttgacaaacagcagatcaaggggttatatttcaaccaaagtccttccaaggatatcgcactggccactgtgtccatgcggcccatccccttggccccgatcatggagaagctctccctcacggcggagaactacggcaccgtccgccgctacttcattcagacgctggacgacaggatgctgtcgcccgacgtccaggagaagctggtccgggagagcccgcctgacggcatcttcaagataaagggcggcgaccactgccccttcttctcgaaaccgcagtccctccaccaggtccctcgcgccgtcccccggttcctggccccccgggccctgcccccgggcaaacctgggtcccgggaagaagccccccccgagccccgcgatctctccatgactgtcggaattcatggggtgttacatgaaaaccgantancacaataggttgcggttttgcaaaaagggagaannacaaggggnggggaanaagattaattttgggan

SEQ ID NO: 15892 - DNA, 788 bp, Triticum aestivum
  Clone ID: PAT_TA_15892
gaaacacttgtcctcgtttagcagcacataaactaccctctctcctttgcctcttcttccccttccaaccaaataaatttccaatggtctgcgtcgctgtgaacctacaaatttgtctgctgaggatatacgagcagcttgtatacacttcttgttaggttgcatcatttggagcaccatggaggctgccatggatgggggttcggcgcgagccacaatgagcatcttcggcgagagcatcggtggaagaagggcagacaagaacagagctcaagagaacctgtcctctgaaatgaagcaacgagcgaaatccgacatggacaagctgaacgagcggaaggcgtccgtggataacgagcgagccggcgccgagtcggagctatccagagcacgagccatggccaaggagctggagcgccaaatcgaccagaccaaggccaaggcgacgtcccagaggtcagggctgcaagcaacgtggacacggaagaatgggcgccgaggatcggcccagtacccggaggtgtcgcaagagctggagcgcgtcagggggctcccccccaaccggagtctgcaggtgaagtccgcggcggaggccaaggccaaggccgagagcgacgtcgtggcgacggtgtgcaagatccagtccaacctgcaggccgccgacgagatgaagcggcgcgtggatgaggcgaacgaggagcacgtcctggtggagctcgcgcgcatcgaggccgagcgggagcgccgcgagctggaggcccagcacgtcgccgaggcagagcggttcg

SEQ ID NO: 15893 - DNA, 1376 bp, Triticum aestivum
  Clone ID: PAT_TA_15893
gcaaagcataccacaactagccgtcgccccagccgttgcccgaccaacaaacactctgcctccttccttctgcttctcccccgcccgtcctctgatcccgcctccgatggactccgccgcggcgtcgtccctcgtcgtcagccccgcctccgacgaccgcttctgggacggcctgcgcacccgcgtcgacaccatcatcgaggaccgccgcctcgtcgcctccgccgcgtccacgtgcgcggcggcgtccgggcggcccaagcggctccgggaggactcgctgatgctggtccgtggcctcgactccgtcgccgcgtccctcgcgcagctctccgacaccctcaccgccgcccagaagggcgtgaacgctctggccatgtgctcgtcccaggcgagggaacgcgagagcggggaggaggagcccgacgccaagcgccactgcaccgcctcgacggagttcgcgaccctcgaagcccaaaaagacgtcaatgaaggttcagacaacggcgccggggacgcgaaaccgcgcgaggggcccgacggcgacgccgtcctggcctccgccgaggtcgcgcagagcaccaacctgaagcgggcgcgcagtctggcggtgtcgatggcgggcagggcggcgaacctggcccgggagctgacgaccatcaagtcggagctgcggttcatgcaggagcggtgcggcctgctggaggaggagaacaagcggctccgggacggctacgacagcggcggcggcgccgcccccgaggaagacgacctggttcggctgcagctggaggcgctgctggcggagaagtcgcggctggcgcaggagaacgcgaacctggcgcgggagaaccagagcctggtgcagctggtggagtaccaccagctcaccgcccaggaggaagaagaagaggaggaccacctcctcaccgcctcctacgaggaagccatcatgcaggggatgcggctcgacttctcgtcgccgctcggcaagttcgacggcgagggcgagctcgacggggttccggccacccccggcagcaagctcggcgcgctggtgtcacctgatgagtgaaaaatgttgaagactccagcgctgaaatcgctgcagcactggagtggtttccgctgttgttttgtgttgcgtgcttcagtttgagcactactctctccggtggccggatttggtgcttcttgacgacgatggcggcttgttatctcagttgaatgttaaccatgttccttgtttattcagacagcgcctcagataatagaaactgtgtcgtaactgcacagattattagcatgttccatgttctccataagctctgaatcttttaaatcacactgcaaacctgggatacttcagacgaaaa

SEQ ID NO: 15894 - DNA, 754 bp, Triticum aestivum
  Clone ID: PAT_TA_15894
cgcagccgccccccccacccccgccacgattaaaaacgagggcgagagagaaaggggcctcgggctcgtccggcggagaaaaagcaaggccccctgtcccgcggcgaattgcatgatcgaatcgcgccgcggcggatgatggcggaggaaccggcgatggatttcgacgacgggggcttcggcggcggcgccgaggacaacctctccatgcccctcggcgacttcatggccttcctcgagagcgagcccggcgacgacggggaggacccgccgcagcccgaggccaatcaaggttccttagaggcgccagtggacacgacaggttttgcaaatggatttgaaagccatgaagaatttttggaggatgaaatgcaggccaatcaaggttccttagaggggccagtggacacgacaggttatgcaaatggattcgaaaaccatgaagaaattttggaggaagaaggtttttggtcaaacttctcccacatagacccttcgcaataccagatggaagcaatggtggaacaaggagatggaacctttgatgactccgatgctaagccttatggtttgcttggcagtgatttatctggaaattgtagaactaccaatcataacaaccaacctttaccaagggacacattaaaccatataaatgctgctgaagaagcaaatgcatctccatacaaagttctgtcaaattgttcatatgttggtgagcaaatgtactttggcaaagcacaggtcaaagcag

SEQ ID NO: 15895 - DNA, 613 bp, Triticum aestivum
  Clone ID: PAT_TA_15895
ggccagagagagaagcagagcagtgcggcgcggggcggcatggacgcgagcttggacttcctggagctggaggcccatctggtgttcgatctcggcgacgccgatagcaaacgttggatgagcctggctgactgctgcagctcgtacctgccggccgaggactcgctctccggcctcgactcctcctgctacaacgaccccaccagctcgccggacggggcgtcgaccagggcgagcaagaacatcgtcgaggagagggaccggcgcaggcggctcaacgagaagctctacgccatccgcggcgtcgtcccaaacatcaccaagatggacaaggcgtccatcatccaggacgccgtcgcatacatcgaggagctgcaggagcaggagcgccggatcctcgccgaggtgtccgacctcgaggccggtggctgcaccgccgtggtggtcaagtcggaggcctccaccgggagcgagggggtggaggacgccggcgttggcttctcgacgcggaagaagatgaggaggactgcttcctcctcctccatcaacgacaccgtcacttcccctgccacgcatccgatcctccttgagctggaggtgaggcctatagcgg

SEQ ID NO: 15896 - DNA, 760 bp, Triticum aestivum
  unsure (1)..(760): unsure at all n locations
  Clone ID: PAT_TA_15896
tcggcacgaggggcagattgaagtttcgagcaccattatcatcgagccaatcggacaacacagcctccagtgtacgggcgaccgcggttcccagccggcgcccgatgtctccgtacgccgtcctcgtcgccgtgctcctcgccttctgctacgccgtccggaaggctcgaggcggcggcggcagcagcaggctcccgccctcgccgccgtcgcgtccgctgctcggccacctgcacctcctgggccgcctgccgcaccgctccttgcgcgacctgcacgctcggtacggcaccgatggcggcctcctgctcctgcagctcgggcgcaggcggacgctggtggtgtccacggcggccgccgcggcggacctgtacaagaaccacgacctcgccttcgcctcccgcgtgcccaagcgcgccggtggacaagctgacgtacggctccatcaacgtctccttctcgccctacggcgacgcctggcgccgcagcaagaagatggccgtcgtccacctcctctccccgcgccgcgtcgactcgttcgcccccgtgcgcgccgttgaggtggccgccctcgtcgccggggcacgccgcgccgcggaggcgggggagatcgtggagctgagggagctcctgtgcgcctacagcaacgccgtggtcacccgcgcggcgaacggcgccgcaagggccacggcggagaactaaagnagnttttgggtaactccgcaacgttcatgttcggggctccaaggccgaaagacnt

SEQ ID NO: 15897 - DNA, 681 bp, Triticum aestivum
  unsure (1)..(681): unsure at all n locations
  Clone ID: PAT_TA_15897
ggagcctctaaggcacacatgcctactgctccatgctcggagtcggccccggctggaatcagcccgtcaccggaagctagagagcaagctgctggttgttcaaacaaaagttttgcaacagaatttccaaataagcctagctccactatggaacacaacaggattatccacactgacagagcggcagcatcaagaagttattgggttgtcaagactacaggatccacaacagttgtgatagtattgatccacaaggaggagagtctcttgctgttcnaacagcatccgagtcctagccctgggaattgggcaatccggttatcccggattctccaanggggtgaccatagaagcgctgctcgtgtggagggagagagtgatgttgctttacagccattagtaagagttacaggccagcaggtaggcgatgctgaaaaggaagttaatgccaccggtggagaaaatagtcctgcagatctacctcatttagagcctcaaaatgtggcagctgtgcccagccaggctgccttgcccatgcctaaagaaaacgctgctacccagcctagccgaccttttnccaacaaactcaaagggaggnaacaacagtcgtcgngtgatcccnancttnacagaaattccaggaggaaanantttacngntcccccttnactaaccnctant

SEQ ID NO: 15898 - DNA, 375 bp, Triticum aestivum
  Clone ID: PAT_TA_15898
cgtccgcccacgcgtccgcccacgcgtccgcttcacctatcccattcctggcccctttctgccaatttccaaggagaatgcaggagcatgttctttccttcggcgatctcagagttgcatttcccagcaggcatcctgacatagtttgaaactccatcacctctcggcaagcaacaacggatacgatccagcacgggagctggtgctgttcaccgcccccagctacctacctgctgccgacctttatctctgcagaagatcgatggaaacccaggaaggcgatgcgcataggtccgaatccgatgctcacaaagtgaaagggagaggtggattcgtagccctgccgttcatcatagcaaatgaaatgttggagaa

SEQ ID NO: 15899 - DNA, 673 bp, Triticum aestivum
  unsure (1)..(673): unsure at all n locations
  Clone ID: PAT_TA_15899
gacccacgcgtccggtcccgcccctccccctttccgccgatccgaccggcccttccccgccgcccgctccagctcgaggttctattgttagtgcttaaaagaatttgagttggccacttctattggcatgatagtgttcgacactaggagatctcttgtgttatatatagcagggctcttgatttttaaaatttgaagtagatgtcattccgtagcattgtgcgcgatgtaagggatagctttgggagcttatctcgaagaggatttgacatcaggattctgggcaatggcagagggagatctcatggtgctgtccatgagttacatgaccccgttcctgtaatccagagcagctgttgggctaacttgccttccgaattgcttcgagatgtgattgagaggttggaggctagtgaggctacatggccctgtaggaagaatgttgttgcttgcgcagctgtctgcagaacatggagagagatgtgtaaagagattgtaaaaaatccggagttttgtggaaagatcacttttcctgtgtccctcaagcagcctggccctcgggatggaactatgcagtgcttcattaagcgggatagatctacccaaacctactatctttacctctgtcttacctcnnctgtgcttgtcgaaaatggcaaattccttctgtcan

SEQ ID NO: 15900 - DNA, 581 bp, Triticum aestivum
  Clone ID: PAT_TA_15900
ggaacaaaagctggagctcgcgcgcctgcaggtcgacactagtttatccaaaggcttcggcgcctgcatcgagggatgttgagagacgcatccttgtacgcgcatttggagcagatatcgggttaactgatcctacaacagggctaaaaggagctgttgacaaagctgaggaaatagtttcgaagacaccgaatgcgtacatgtttcagcaattcaacaatccagctaacagtgagatccactttcaaaccacaggcccagaaatatgggaggacacactgggtactgttgacatacttgttgcgagcattgggactggtggcactatcaccggcactgggcgctacttaaaaatgatgaatagagatattaaggtcatcggggtagaacctgctgaaactagtgtgatttctggcgacaagccaggttatattccaagcatactagatgttcagctccttgatgaggttgtgaaggttaccactgcggaggcagttgatgttgcgaggctacttgcactaaaagagggcttgctggttggcatttcctcacgtgctgcagcaattgctgctataaacgtg

SEQ ID NO: 15901 - DNA, 1177 bp, Triticum aestivum
  unsure (1)..(1177): unsure at all n locations
  Clone ID: PAT_TA_15901
gcgcttctcagctcggctctgcctctctcgactcctctccaaaccctaaccctaaccaccagcctccactccctgccgcgccgctgcctccgctccctgccgcatcgccgcctctgctcgcccttgagtcgtcgcttccgctcgccctcgcgccgtcgcatcgcctcctcctcctcgccatctcggtgctcatcgggaggagcacggctcgccgccgcagctactccgcgtcgctgctcccccgttgagctcgcgcgtccccatcgcctggagaagcggaggctgcagctcctgcatctgctcggccctctttccctcgtcgccgcctggtgggtactggctcgaaggtgacgaggtacaccagcagttggatcaagactatatgaggtgatgacaaactgtgtaatcttcagatccacttgaccatagcaagtatctgcaagggaaaccatggttgatgattccttgcctttccggtgcttgggcgcacctagcagctgcttcacgcctcctgagaatgccggtatctcttacttaggttggtgttgtacggcttggttgagctcaaaattcaacggagacggcaattgtcagttttgggcgtttgttcaattttaccgaactcctgaacaccgtatatttgtacggcaacagctggtgaagcagcttggatctcattggctcatcatgaggtatatactggatatgtccctatggattacagagaatatcttaagaagatgccaaaattggtgaactcaagaggctgttggagggaggtcaagtatgttgggttatagaggcgagccccacaccatcaggcattcttacattgtgcacctgatctctaccatgtagatggaatggtctatgtgggcttgcccgagattgcccctctctgcaggtgaattgggcactttacaaactcgacttctgtgcttccataatcaatagtcccgattgaatgagttgtattggttatgtaaactcgcttcatgcgcactttctacgtgacttactgtgcacatataagctatgctatattgttcatacattcctattcctgtgactcatcatctggatggtagagtatattagttgtgacgttggttggtatatgtattgaacctcctttggtatatcatgtgcatttctatnaaaacggcatcactgtttg

SEQ ID NO: 15902 - DNA, 1086 bp, Triticum aestivum
  Clone ID: PAT_TA_15902
cgtccgcggacgcgtgggcggacgcgtgggggaaatggtaaagcaagataatagacgccaattaagtgcaaaggctgagcaattggaacacgaattatctgaactaaagcaggccctatcagacaagcaggaacaggagcaagcaatgtttcagctggtgatgcgtgtggaacaagaactgaaatttgcagaagaagcacgcatctctgcagagcaggatgctgctgctcagagatacgctgctaatgtgctgcaggagaagtatgaggaagctatggcatcacttgcccaaatggagaacagagctgtaatggcagaaacaatgttggaggccacactgcaataccaatctagccagcagaaagcactttcccctttgccttctccaagagcatctgcacaagatgattcattccccgtgcctcactccggttcactgatcttccttcggccctcgtcccacgcgtccggggataagaacaagggaaagcagaacaatgctagtgactgcacagatgccaagcttacagacgctcatgagcaaagggaagaagcacccagcatagatgatgagaaacatggagaaacacaaaaaccggatggtgaatggacagtagaatcacccagaggaaatgacaaggcggagtcgccaaagaaagacagaatccatataatcacaaatgatatgaatgggcggcatggacagttgcaagaaatacaattggattgatagttacaagctcatcctttacagtacatgttcaccactgcggtgtaagttcttgctgaggcaacactggatggcttcaagttttgaacaacaatgtattctttatctgccatttagtgtttttcttcttcttttgggttcattaccgctgtgtagttgtataggttcctaattctctctattattacttgagaagagaaattggctagttatatggctgtccattagttgtcaccttctgatgtaaatgcattagagggaacgtagcaaatggacaatctgcgcattgacatgctttattgcgaattatcatctctagagaagaggtcctgctcgttgtcaaactaaaaaaaaaa

SEQ ID NO: 15903 - DNA, 455 bp, Triticum aestivum
  Clone ID: PAT_TA_15903
cgtccgcggacgcgtgggggcaggaacaatggtacacattcaactatgtatctgccaaagttgattatgcttaactctaggcattgcattactatatcatggtgaactattctttgaagaatttgtaggaggtactagaaaagtatgacttgatgagggatgccttgattttaaagaacagcctgaaagaatttagtttagtaaaatattgtatagccttctcgtaaaagtttgatacactttttcaagaaaacgaactttggttaatcattaagctataacttttctcatatttgaacaacaaggttatttgagctctgctaaaaaagtggcaatgttaaaaaaaaggttattttgtgtaatttttgcaaactttgttgaaagaagctacaaataattgatttcgctgtcaagtctacagtccaatgttaatctacagggtggaatcttcaaac

SEQ ID NO: 15904 - DNA, 741 bp, Triticum aestivum
  Clone ID: PAT_TA_15904
cgcacaaccgcaccggcaaagaaaccgaggcgacacgtgctctgctccgggacttcgaaccatcccattcgatccgtgcacagccgtagaggagaggagaggaaaggaagaccgaccaccggcgatgtatttccggccgccgcccaagggccccgagtggggcggcgacgcggaggccgggcaggcggcgcggccgctgtacccgatgatgctggagagcccgcagctgcgctgggccttcgtccgcaaggtgtacaccatcctctccatccagatgctgctcaccatcgccgtcgcctccgtcgtcgtcttcgtgcgccccgtcgcgctcttcttcgtctcctcccccgccggcttcgggctctacatcttcctcatcatcctccccttcatcgtgctgtgtcctctgtactactactaccagcggcacccggtgaacctgctgctgctggcgcccctccccggtggccatcagcttcgcggtggggctcacctgcgccttcaccaagggggaggtgatcctggagtcggcgatcctgacggcggtggttggtggttgagcctgaccggcgtacaccgttctgggcggcgagtcgcgggcacgacttcagcttcctgggcccgttcctgttcgcggcggtgatgatcctcatggtgttcgcgctcatccaggccttcttcccgctgggccgcatctcgcttatggtctacggcgggctggcggcgctcgtcttctgcggc

SEQ ID NO: 15905 - DNA, 458 bp, Triticum aestivum
  Clone ID: PAT_TA_15905
gctcttctctgctctgttcgctgtctgtggctgttgagctgagcttcttccttcccccaccgcaacagcagccgcagccgcagccgcagccgacggaaggcaaccaccgcaccgcaccgcagcgaggagccccttcccttcctttcctttggtcccggatcgatctggcgcagcgggggcctgccgggaatcgatcgacccaggaccaggagggagcggtgaattaaattgaattcaagaaagaaaagggccggccaagccgggggcgggggcggcgatgagcgcttctcggttcatcaagtgcgtgacggtgggggacggcgccgtcggcaagacttgcctcctcatctcctacacatccaacaccttccccaccgactatgtcccaacagtcttcgacaacttcagcgctaacgtcgtggttgaccggagcaccgtcaacctcggattatgggata

SEQ ID NO: 15906 - DNA, 1222 bp, Triticum aestivum
  Clone ID: PAT_TA_15906
gcgcgccccaggtccccctgtgctccgccccgccctgcagcctatcagccacggccgtgctgagcttctccctccgcccgccgccgctgccctcggatcctacctacccccaccgccccaccagcggcagccgccggttggctcccactgcaccgctccgcggccaggaacccctccccctcctttggtcccggatcaatcggtcgcagcgaggccctggcgggcatcgatcgacccaggaccaggagggggcggaaagttaaatcgaagtcaagaaaagaaggatatcccgggaaagcgcgggccaagccgggggcgggggcgtgcggtgaagcgcttctcggtgcatcaagtccgtgacgccggcggacggcgccgctggcaagccttgcctcctcatctcctacacatccaacaccttccccaccgactatgtcccaacagtcttcgacaaccttcagcgactaacgtcgtggttgacgggagcaccgtcaacctcggattatgggatactgcaggacaagaggactataatagactacgcccactaagctaccgaggtgccgatgtcttcctgctcgccttttctcttatcagcaaagcaagctacgagaatgtcactaagaagtggatccctgagctacggcactacgctccgggtgtgcccataattcttgttgggacaaagcttgatctgcgggatgacgagcagtttttcgtggatcaccctggggctgttcctatttccacagctcagggtgaagagctgaagaaggtaattggcgcgacggcctacatcgagtgcagctcaaaaacacagcagaatatcaaggcggtgtttgatgcggcgatcaaggtggttctccagcctccgaagcagaagcggaagaagaggaagtcgcagaaaggatgcagcatcttgtaaaactagctcaaaatggtagagtgagctgagcagcagccctttgttttgcagtgtctcgcttcgaccaaagggatcataattgcctcgcctcgcctctccttgttgttgttgttgtgtataatttagtttggcttgataaggaagatatgtaggcttgacatattttttactaagttgcagcatcagctcatgatgatatatatgtagtaggtagtattttgtggacgatgaacatggagtgctcaatccaatcctagtacttactgaaatatactactagctgcttatttgtttgtt

SEQ ID NO: 15907 - DNA, 727 bp, Triticum aestivum
  Clone ID: PAT_TA_15907
cgggctgcaggaatcggcacgaggcagaataccccccagcagttcttcgttgcagcatcatcacacagatttaaggttcaatctccagacagaaaatggcgaacgcggtgtcgggcgtggcggtgagcgaggagtgcgtgagggcgttccaggagctgcgcgcggggcgcgcgcaccggttcgtggtgtacaagatggacgacgccgtgcagcaggtggtggtggacaaggtgggcggccgcgacgccggcttcgacgacctggccgcggcgctccccgccgacgactgccgctacgccgtctacgacctcgacttcaccgtcggcgacgccaccgccaaaggcgccgacggggaggcgccgcgcagcaagatcttcttcatctcctggtcgccggcgagtgcggaggtgaagagcaagatgatctacgccagctccaacgaggggttcaagaaggagctggacggcacgcagatcgacgtgcaggccaccgaccccagcgagctcacgctcgacatcctcaaggaccacgccacctaaccaatcaaccaatccctccacggtgtatgattgacggttcacgccgtgcacgttacgtgcgtgtgctagctttgtgctgtgcatgtatctttgccctcttcgattgtgttgtgtgcttccaactggatcgtgtcgtcgaccccaagagaatgatgatgatttccattgtactaaagaaaaaaaaaaaa

SEQ ID NO: 15908 - DNA, 832 bp, Triticum aestivum
  unsure (1)..(832): unsure at all n locations
  Clone ID: PAT_TA_15908
gcaacaaaatatgacattcatagcagcaacatcacacttctaggctggagaagaaaagggggcccacttcaccatcttactcatttacaatgtttcacggtacatactgctctgcaaacgcaaaagaacaggtaaaatgtgttgccgccaaggcagtcaaagaatcgcttcaatctcctctctattttcatatcaactcctcccatgaactctcccgaaaaattaaaccataagccacaccgactatggcttatgacaaacgttgcaagtcctcccaataaaaagacggacaatgaccagcaactagtaggtgaattgacagggtaggcaaaactgcgagtcctcttagatgtataccccgaaaagccaaaggggtaaagccaagattcttcttccaaagaaatcagataacacagcggtatgacaagtttacatgtatttgcccggatacatactggtcgcggaaggaaccatgattggatgaatggcctggaatggctgcacaagcgttgcagggctcggcatcaccatgggcaggttcccggttgccatgaccggcggagccccaaagaacggggcagtgcctcttgaaacttttgcaagctagcttgatgcgagttcaacagcaaagggcgaggccatacttgggacataactggtgttccacgcatagcatcctgagaaactggatgaacataaacaacaggactgaacttcccatcgaccataggctgaggactagggctgatataggttgatcccacttgcaaggggtgatatggtgtaccgagtnttgcaggatctagccttccgacattatgccccacaactg

SEQ ID NO: 15909 - DNA, 497 bp, Triticum aestivum
  unsure (1)..(497): unsure at all n locations
  Clone ID: PAT_TA_15909
ctcaccacgccgcaaccaaaaccctaaaccctagcatcatactacgaccgcgccggacgccgagataggcggacacggtgcagtaccgcctcgagcggatgtccgatgagctcgacgacctcgaagcgccggggcctcttcacccgcgccgagctcgccgaggtcgtgcgccgccgccgcgatttncgagttccgcctccgccgtcactccccgcgcaaggccgacttcctcgactacatcgcctacctgctccgcgtcgacgcgctccgggacctgcgcaagcgcgccatcatacgcgccacgcctaaccctacccactccgacgaggatnacgacacgaacgaggattgcaaaaagaggaagaagaggaagaagaagtgggccaagtccatctccgacttcgccggagtcctccgcgtcctggacgtctacaggatggccaccgtcaggttcaagggcgacctcgacctctggttccgctacctcgagttctgcc

SEQ ID NO: 15910 - DNA, 230 bp, Triticum aestivum
  Clone ID: PAT_TA_15910
ttctgaagataaataaatgtgcaaatgcagtccactattctatattgcgcttgaaaaagataggcggtgcagtccgccggcctacctacccacatgcccgcgagtgcactgctgttgggcgcccgtgaatcagcggcggatagtacgtgcagtacgcatcaacgataggcgtagcaaccattccagaattttggttgtagttgatgtagtgcaatgcacctcttcatgta

SEQ ID NO: 15911 - DNA, 678 bp, Triticum aestivum
  unsure (1)..(678): unsure at all n locations
  Clone ID: PAT_TA_15911
tacttcactcttggagtgaagcagatgatctgctgctgcaacaagatgtgacgccaccactcccaagtactcaaaggcccgttacgaggaaattgtccagggagtgtccccgcgtccctgaagaaggttggctacaaccctgagaaggttccctttgttcccatctctgggtttgagggtgacaacatgattgagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggacgcgttgagactggtgtcatcaagcctggtatggttgttacctttggccccactggtctgacaactgaggtcaagtctgttgagatgcaccacgagtccctcctggaggcgcttcctggtgacaatgtcggcttcaacgtgaagaacgttgctgtcaaggatctgaagcgtgggtttgttgcatccaactccaaggatgaccctgccaaggaggcagccaacttcacctctcaggtcatcatcatgaaccacccntggtcagatcggcaacggctacgccccagtgctggactgccacacctcccacattgctgtcaagtttgctgagctggt

SEQ ID NO: 15912 - DNA, 659 bp, Triticum aestivum
  unsure (1)..(659): unsure at all n locations
  Clone ID: PAT_TA_15912
cggtggcagcccgcgcggcctagtccgggcagctcttggctcctatttgaggcggcttcgctcggttctgatctaccgcaccgcaccaccacaccacaccagggggctgccgcttcttgggcttctccatctcctctccttggttggttctctactagagaggcgcagctgcagggatccttggtggagaggagggaagaagatgtcgggtgctgcactggtcgcgattgcggcttccatcggcaatctgctgcaggggtgggacaatgccaccatcgctggtgctgtcctgtacatcaagaaggaattccagctcgaaaataatccgactgtggaggggctcatcgtggccatgtcgctcatcggtgcaaccatcatcaccacattctccgggccagtatcagactgggttggccggcgccctatgctcattctctcttcgcttctctacttcctcagcggcctaattatgctatggtcacccaatgtctatgtgctgctcctggcacgccttgtcgatggctttggtatcggcttggctgtcacgctggtgcctttgtacatctcagnnacggctccttcggagattangggacggctcaacacgcttccacagttcagtgggtcnnnnnnnatgttcttgtcatactgcatggtgt

SEQ ID NO: 15913 - DNA, 349 bp, Triticum aestivum
  Clone ID: PAT_TA_15913
aggagcccagggccgacgtggaggtgccggccgagccgcgccccggccaggccgactactggggccgccaccacaagggcttcgccgtcgacgtcgtgccgcacgagatgaagcgccacgcgccgtttccgtgagcgagcgaccccgtttcctcggcgcgccggacgtacgtgtcggcacaagtgggttattacagcgctttcgtgttgtgtgtgtgtgtgaaactgtgcactttgtttcgtagttgcggtcgagatagcactgtgtaatagctactggtctgaaaataaaagcatgtacgtaattctcagttctgctgcctgtgcttgtgctatatatgtcgcgcatt

SEQ ID NO: 15914 - DNA, 2249 bp, Triticum aestivum
  Clone ID: PAT_TA_15914
ctgcctcccccccccccccctccctccccctcccatgcccgtcggccggcccgccctagccccccttggccgcctcccagtccggtctccgcttccctgctcgcgccgcccggccggttaatcaccccgcatcacagaaattgcattgggttggacctaatctgacgttctgaagaaagaaggcctcaggatatttagcttggcaggcccagaggtgcttgagagaagctatgtcttttgtcgggcactaagacccttcaacgacatacgcggataatatttatgtacataaatttgggcgcacccaactcaaactttggcacaagaagatttggctctgatacgcagttgttccgttatggccctgaaccattcaattccgaggactatgtgcatatgggttttgcctgaagcaccatctgctgcatttcagaactccttcaataagcagcaagcttcactaacgccctgctccgatgctgaaaaagaattgcggcagttctcaaatggaggaggacagtgggggacttctctatcagataagagagaaaacgctcatcagtcacctccgcgtggcaataggaccgaggctcgctgacttgggttgcattctctctgctgtaatggagagagcatctggtgcagaaattgtaaaaagggtgtgaaatacggaggagtttttggctgatcttatctaattttagcttgcttgctaacttcttcgatagaatcggaatacaacccgtaggaacgctgttatcctgctgcgacaaccgctggtgttgttgtagtcggggatagaatcatgacatgtcgaccctgctccatgtataaatcaatctctggcgggcataacggacctccggcagatggtctcaatccaaggggacccttctcacaggattgcagcttatctggtggagggccttgctgcaagaatagtagcttcagggacgggcatctacaaggcattgacatgcaaggaccctccaaccctgtatcagctgtcagcaatgcaaatcctctttgagatctgcccatgctatcgatttggtttcatggctgctaattatgccatacttgaagcctgcaaaggcgaagaaaggatgcatattatagactttgacatcttccgcgccagccagtatattacactgatgcagtttatgaaagatgatgccaacaagccacgccatttgagaataactggtgtggatgatcacgagacagtacagacgactgttggaggtctgaaggtcattgggcaacgcctggagaagcttgcggaggactgcggaatatcttttgagttcagggcagtgggtgctgacatcggggatgtcacacctgcaatgctagattgccgtcccggggaagcactagttgtgaattttgcattccagctgcaccaccttcctgatgaaagtgtttcgatcatgaacgaacgggatcagctccttcgtatggtgaagggccttcaaccaaagcttgtgaccctggttgagcaggatgctaatactaatactgctccatttcagacaaggttccgtgaggtctatgactactactccgctcttttcgattcactggacgcaacacttccaagggaaagtccagatagaatgaatgtggaaaggcaatgccttgcacgggaaattgtgaacatcttggcttgcgaaggccctgatcgcgtggagaggtacgaagttgccggaaaatggagggcgagaatgacgatggctggattcgcaccgtgcccatttagcagcaacgtcatcggaggaataagatcgctgctgagctcgtactgcgacaggtacaagttcgaggaggaccatgggggacttcacttcggctggggagagaaaacgctcatcgtcgcctccgcgtggcaataggccgagctcgctgacttgggttgcattagcactgctgtattttaggagcttctggtgcagagattgtaaaaagggtgtgaaccacggaggagttcttggctgatcttatctaattttaggagtctgcttgtcagaataattgagtttggctgatcgcccgggtgaaccatgttgtgctgctgcagcaactggttgtgttgttgtattctgggatagaatcatgacatgtcgactctgctccatgtataaatctatttatgttgctagaacatactcctaagtacaatgatgtgtctgtttgggaactagaacatgcagtaatatatacacagtttggccaaaaaaaaaaaa

SEQ ID NO: 15915 - DNA, 888 bp, Triticum aestivum
  Clone ID: PAT_TA_15915
ctgcttcacccagtgctgcgacgcatcggtgctccttaacgcaaccgacggtaagcagaaggtggggcccaacctaacacttcggcgggtggcgctggacctcatcgagcgcatccgcagcgcggtgcacaccgcctgcaaggacaacaaggtgtcctgcgccgacatcaccgtgctcgccacccgcgaagcggtcttcaaggccggcgggccgcgattcgacgtggagctcggccgccgcgacgcgctcgccccggcgcctgcccagatcaacaagctgccggggccctcctttcctgtgcccctgctcatccagtccttcaagggccgtggcctcgacgtggcggacctggtggccctctccggcgcgcacaccttcggcgtcgcgcactgctcgctcttccaggaccgcttcaagccgggcttcgggaacccgcccatcgaccccaagttcgccacgatgctcaaggacaagtgtgccaatgacttcgaccgcaaaaagacgcagagcctcgacgtgcgcacgcccgacgccttcgacaaccagttttacatggacctggtcgccaagcaggggctgttcaggtcggaccagggactcatcgaggacccggccaccaaggccttggccgcccagttctccctcgaccagcgcgccttcttcgagcagttcgccaagtccatgaccaagatgaccaacatggatgtgctcacaggcaagcagggcgagatccggaacgactgcgccgtccccaacaagcgcgtcaccgcccacggcgacaaggagggccatgccgccgacctgtgagagatgaaataatctagtgctcgtgagtgaacgctaggatgcacgcaccatgtgtttgtgtgtgagtgtgctgtgctgtc

SEQ ID NO: 15916 - DNA, 681 bp, Triticum aestivum
  Clone ID: PAT_TA_15916
cgtgcgcccgcgcgcgacgacgatttccaccaggaagagccgcgacgacgacgacgaccagaggaggacgaagcctatagctccaagcttcggcccccgccccgccccttcccccgccctgcccggtacactaaaagtcacctgaaggtggtgtaggggggaaacacatcggttcaaagtgtgtgagaaagatatagagcattctgtcggaaactgctgcataccaaggaaaatgtcaagctaaggtgctgggttgctttccagtctacagccgctcctgttgaatcgcagtgtgaaggtgcagcagattagcatcctttactgatggatcaccctggaaatgtcactcgtcatgatcacacaatcgacataccaaggaatgatctgatgtcgccgtcaacatcccggtccggactgtcccgctcacttgggtccgttgaaccacaacagaggtccttcaaatgaagttcctcctgtcccagaaagttctggcacaaccggtatgcctgactttcgaagcgcatctttcgtgagaagggatcaagtcaatcgtcagcagaatcctctgaattctggcttatggatctcaatcgagcttattgtaaatgttagtcagattatagcagctgttactgtcctatcggtatcaaggaatgagcatccacgggctccactatttga

SEQ ID NO: 15917 - DNA, 1916 bp, Triticum aestivum
  unsure (1)..(1916): unsure at all n locations
  Clone ID: PAT_TA_15917
ttccagcggccgcccgcctacgcgcttcgctgtcgtgcaaaaccttcgccgctctcgttcccccctcctgcctcccgccagctatcaggcgcgtttatcgtcgcatccgagccctgccgccatatcttgcgcgcgcgcctgggcgctgtgacacacccccgtagcgaggctgctggcccggatgctcccccctgtgacgcggcttcctacaaccggcgggcactcataaggttcatatacacgctggccccccctcgtaaaagctcccaagaagtaaccatggaaatcctcaaaggacatggcgggtggaccaaaccaaatccatactggctaaacagacgcattagataaaggcggagggcaaactaaagctgagggtcggtcaatttcatcagattgaaatgtttgggtctacgaggatcggtcttgtgagggagcagtaggtatggaggcagcacaggaagaactttgatgttgggcaggtacagaggaggcagccacacatcagcagacaaatgggcaaacaaaccctgaacatgagaagaacccctttctgcagactgatcttggatcaatccggggagatcaggtttttcattcaggagatataactgtgggagaaattggggaagaccagccggaccagccatggagcgatactagtggaggctagggggcacaggtacaactacaaataccaatgtacactaccggtagccgaactcctgtactgcggcgacgggtactaaaggaggctgcggctcctgtctgtacctgtcgcctgcagcgattagtgttttaccgtcttgggtgacctgtgttcgttattatggatcaaatggcacatcagaatcagacaaataatgcggttacattgcacccttttgttttctgagtttagaatttgtggaaactggtttgtaagaattgctaccgtgttgtttttctgaagccctctatattggggacacatatcgatgggcacatagttgattgtgcatttaccgtcgcatttaatcccatgtttgatccgttgctgcaagcaacgagagatgccacaaatactggaatcaaggaagctggaatagatgcacggctttgtgatgtcggtgctgcaatccaagaagtcatggagtcatatgaggttgaaattaatgggaaagttttccaagtaaaaagtgtgcgaaacctcaatggacacagcattggaccataccaaatccatgctggtaaatcagttccaattgtaaaaggcggagagcaaacaaaaatggaggagggtgaattttatgccattgaaacttttgggtctacaggaaagggatttgtgagggaggacttggaatgcagtcattacatgaagaactttgatgttgggcatgtaccgttgagggtagcaaaagccaagcagctactggggacaatcaacaacaactttggaacacttgcattttgccgccggtacttggaccgcatcggcgagaccaagtatctcatggcactgaaaaatctatgtgatgttggcattgttcagccgtacccgccattgtgcgatgtgaggggaagctatgtgtcccagtttgagcacaccattttgctccggccaacctgtaaagaagtcatatccagaggcgacgactactgattggggctgcggctcctgtctgtacctgtcgcctgcagcgattagtgttttaccatcttgggtgacctgtgttcgttaatggatcaaatggcacatcagaatcggaaaaataatgcggttacattgcacccttttgttttctgagtttaaaatttgtggaaactggtttgtaagaattgctaccgtgttgtattacttgatccctctataaagagtacttcctggagattttttatcattagcgtggacagnataaaanacacatacatcc

SEQ ID NO: 15918 - DNA, 804 bp, Triticum aestivum
  unsure (1)..(804): unsure at all n locations
  Clone ID: PAT_TA_15918
cgtccggttatctctctcagctctccttcccgatcccctctgtctccgccgccggcgccgccgctcgattccggccactgctggcatgcttcgccaccgtacttgccacctacagctccccctcgagctgatctaccttctccacccgctcgatttgcttatccttcctctcgcgcgcgcgagtccccctctccctacgcgactccatgccgccgccgcccacgccggcgggttccggcgatttccaccagggcgcaacaggcttccgcgctcccctctcaccgggccttcatccagtatggccagatccgccgggcgtggcccctaccctcacccacggctagggatttggcggctccaacgtcggcgtggctcaagtaggtcacccatcacgcggacgggtcgaagcgctggatctcgggacagggcggcgcggaggccttcctcccataggattccgagctcgacgagcctagcggctgccgtccttgccccgctcgaggaggaggggcgcacctagcaggccaccaatggcctgttctgctcctcgtcttcctccactgcctggaccanccacgccttcaacagcgggctgctgcagcatcgaccggtgatccttccttcctccagtctttgcttgcagttagccttttagggccaatcaaatccaatgtgctagtttagtttgccacagtttggtgacactcccatcgtgaatatgtccttgtagcttggagtgctttgggtttcagttaactcgtgcgtacttgtatagaacagaaaaaagaagaagagatcaattcg

SEQ ID NO: 15919 - DNA, 673 bp, Triticum aestivum
  Clone ID: PAT_TA_15919
cgtccgacaaggtcatgtcgatgcgagtgccctgccttaataagactgctccgaccaaaggacaatgatgggtacatagcagagcatcatgaacagcacaactattcattgtctccgacatattgtcagacaatacactggccgtcgcacaagcatattgatgcgtacagcggggactcggtggagcagttgcggcagaacaatgtgaacctggcaaaagtgcacagcatcatcgggagtttttttgttcagtggagaaggtacctttcacaaaaagagctctgaagaatttgtgtggcaaaatcagcagagagcaggcagaggacgatgttaggaaaactatggaggtttttgcagatttgggttcacaagatccacatttcacataccgagtccaagcagacaatgaaggtcggataagcactcttatgtgggcaaatggtagcagcagattgcagtacacattcttcagcgacgtggttaccttcgatacgacatacaggacaaatatgtacaacatgccctttggcctgtttataggtgtgaataatcatttccagagcatcatcctagctagggttttggtgtgtgacaaaaaagtggagacctttgagtgggtcttcacagagtttgttcggatgatgggcggaagttcaccgaagacaattctaat

SEQ ID NO: 15920 - DNA, 787 bp, Triticum aestivum
  Clone ID: PAT_TA_15920
cgtccgccgcgccccgcagccgcctcctctctctcttgccgccgccgcctccacctcccctcctgccgccgccgccgcctcagcctcggccgggccgtgctctgccggcgcccgtcggccttgatccggcctcgcaggaggagctcgccctcgaggaggactcgacaggaggaggggagcagtgcctcttctcctccccttcgcttttctcctccccacgttctagattgggcacaagtcaccaccatacaagagcatgggttgcatgatcttcatggtgggcgtggtggagcaaggagggaggaggatagcgatgggggaaggagaagcaaggttggagctccaggatctacgttggcgtgccgctggagtggatgagtggtcgtccgttgcgcgccggccgtcgtccccgtccccaatctgggctgcctatgtatgacctcgtcatttgcctcccccaatcttttttcgatttcttgatctatgtcaatttgtgcagatgtgagaaagaagaggatatttctctctctctcttctctctctctctcacacacacaatcacgtatgttcctgtgttatccttggatgcaaactttttttttgttatacacatcggcctatgtttgcactgctcttgaacacagaacatcaggtggcgctgctgggtaataactttatttgatcattctccacctgttttttatggtatcaaactattgcataacatactgatttgctctcacctaaattaacatagatgcttcaggtgacttatcatgtttgtctt

SEQ ID NO: 15921 - DNA, 307 bp, Triticum aestivum
  unsure (1)..(307): unsure at all n locations
  Clone ID: PAT_TA_15921
cttctctcctcctccgcccgccgccgatcccgaaccagggaggaacccggcgcgaggagggcaaaggaagagaagaggagatcaccgagcccagcgcgcgcacaggacagcaggcgccgcgatctccgcccaggaagcggagatggggctcacgttcacgaagctgttcagccggcttctttcgccaagaaggagatgaggatcctcatggtcggtctcgatgcggctggtaagaccaccatcctctacaagctcaagctcggagagatcgtcaccaccatccncacaatcgggtttaatgtngaat

SEQ ID NO: 15922 - DNA, 1084 bp, Triticum aestivum
  Clone ID: PAT_TA_15922
gaattcggcacgagggcacctcggccacgctaacactctacaaccgtaatgccgtaatggctcatggcgacgaatggggtagccgtggtggtgcatgcccaagtgcactccacagtccgcacgcttcgctttccccaaaatcaaaacccagacaaacccaaattctattcgcttgccgctcgcctctcgtcctcgtctcataaacttcagccttcctgcttttgttcttggtctcttctcgccttgcttcgcgggggaggggatggtggggtcgccgacgaagcggcgggcgataaggaggccgctggagaaggccgggatggtggggctcgccgtcctggccacggcgaccgccgcgctgctgctgctgctcgtatgcagcgcgtcgctacgatactccgccgccgtcgaccacgcgctggcggcgcccaggaagctctggagcggcggggtctccatcgcagcccaggtgtcgccgtcgccgtcgccggagaggggtgcggcggcgatggcggcaggggaggaggagtgcgacctgttcgacgggagttgggtgtgggatgacagctacccgctctacgactccaaggactgccccttcttggacggcgggttccggtgctccgaaaacggccggcccgacgcgtcctatgtcaaatggcggtggcagccgtcgcgctgcgatctcgtccgattcgatgccaaatttatgctcgagaagctacgaaatagaagggtggtatttgttggtgattcaattggaaggaaccaatgggagtctctgctttgtttgctctctagtgctgttcctaacaagaagtccatctatgaaattaatgggagtcccatcacaaagcacatgggtttcttgattttcaagtttagcgactacaattgcactgtggagtattacagatctccttttatagtccttcaaggccatgcaccagctggagcccctaaggttgttaagtacacagttagggtggatgccatggattggatgtcgggcccttgtaagtggagcagtgctgatattttgatctttaatactgggcattggtggaactacgagaaaactatc

SEQ ID NO: 15923 - DNA, 1132 bp, Triticum aestivum
  Clone ID: PAT_TA_15923
cacacggatgaagactagtggattcgagtgggtttcccccgatgaaactgatagagttccatacagagctgaggaggttaaagaattatcagaatcacatgatctttgcattagtggggactgctttgaaatgctacaaaggaccgatgctgttgtccaagtcattcctcatgtgaaggtttttgcgcgcgttgctccagaacagaaagaacttgtactgacaacatttaagactgttgggaggatgacactgatgtgtggagatggaaccaatgatgttggtgcactgcggcaggcacatgttggcatagctctgctaaatgctgaaccggtgcagaaagctggctcgaaatctcagtcatccaaacttgaaagcaaatcagggaagctgaaaaaaccgaaacctgctaacgagtcatcatcgcaattggttccaccagctagcagttccgcttaagcacccagcagccgccccttgactgctgctgagaaacagcgcgaaaagctgcagaagatgttcgatgaaatgaatgatgaaagtgatggccgctcagcaccgattgtaaagcttggggatgcatccatggcctcacctttcacagcaaagcatgcctctgttgcccccacgcttgatatcatccgccaggggcgaagcaccctagtcactacactccaaatgttcaagattcttggactcaactgccttgcaacagcatacgttctcagtgtaatgtacttggatggtgtgaaactgggtgatgttcaagctacaatcagtggtgtcttcacggcggcattcttcctcttcatctcccatgctcgcccacttcaagcactgtcggcagagcgcccccatcctaacatcttctgtgcatacgtcttcctgtccattctcggccagtttgcaatgcacttgttcttcttgatgtcagctgtcaacttagcatccaagtatatgccagaggaatgcatcgagcctgattcagagttccatccaaacctcgtcaacacagtttcatacatggtgaacatgatgatccaggtcgcaacctttgcagtgaactacatgggccacccttttaaccagagtatatcagagaacaagccattcaagtatgctctctattcagct

SEQ ID NO: 15924 - DNA, 1162 bp, Triticum aestivum
  Clone ID: PAT_TA_15924
tagcgtggtcgcggccgaggtgaaaattgaagcctgcaactatgaggcctattcctcactctcgacagcagcaaatacatccttttatgggtttccctgaagctaacgttcacgaaactagtcaggccaagccaaacttgccagttgctccacctgttaagcatcataattcagcacctgcttctacaacagcgcataggaaatctacttcagggccatctcatgctcaatcgatcattcagctgaatccacttcccatgaagaaacatgggtgtgatcggttgcctatccaagtgtgctccgaggaggactttctgaaggatgtcatgcaatttttaattcagaggggccaccatcgactcgttcctcatggaggtctagctgaatttcctgatgcagtccttaatgcaaagcgccttgatctctataacttgtacaaagaggtggtgtccaggggtggcttttatgtgggcaatggtataaactggaagggtcaagtcttttcaaagatgcgaaaccacaccgtaacaaatagaatgactggtgtcgggaacacactgaaaagacactacgagacttacttgctggaatatgagctatcacatgacgacgtggatggggaatgctgtttgctttgtcacagtagcgctcctggagattgggtgaactgtggtttatgcggcgaatgggctcatttcggttgtgatagacggcaagggctgggcactttcaaggattacgcgaagacagacgggttggaatacatctgcccgcattgtagtatagcgaattacaagaagaagcctccgccgccccagaaagtagccaacgggtttgcgaataccgtgctgcctgtatcacggaatgtttaatcctcttcttttcttgcttttcctttttttcgcctctctgccctaggtttcggggtgatgcgtcggtggtagggtataggcctgatagaggggggaggcttttgtagtgttgatctgtattatcccattaatttggttcagtgtaggagctcaagtcttttatagcctgtaacaaccgacaacacagggaggctacttactgcagtagttggccagattcagtgtaagcacctgttgatataagttaatctgtatccccggtttcaaacaccaaaaaaaaaaaaaaaaaa

SEQ ID NO: 15925 - DNA, 720 bp, Triticum aestivum
  Clone ID: PAT_TA_15925
gcacgaggcggcggtgaagctcgtggagggcaagcttgccgcgccgaggatggggccggattttagttcaagaggatgctctccctgacggtgcgtccgctggccctcatctacctgggttccaccatgatacccaacatctggatggccttcaagttcaccggcgcaacaacggggctggcattaggtttcatgttccccgcccttgtcgcattgaggctggacaaggagggggaatgcttggggcgcggagagcggctcctgtcgcttgggatgctggggctggccatcgtcgtcagcgtcgtcggggtcgtggggaacgtgtacagcctgaggagcaagtctgagtgagtgatggatggatcatcaggatgagctatatttgtagggcttattatacccaggctgtattaccacttgccagaatacaatagttagcaggtacaccagttccagctgagctgctgagcaaagctcatcatactatacattttcttcatctacagggttgtttcatgggtgatggctgacatgttgttggtgggcattcttgtacttttggaccagattctttgatgtattttttgatcttctgcttattcttagatatatatacatgtgtatcctgggtctactttctgatcgaggcagtgaatcaaccttggttttttctactgaggttgtgtgcctatggtatgatgaaagctgcattcagaaaat

SEQ ID NO: 15926 - DNA, 709 bp, Triticum aestivum
  unsure (1)..(709): unsure at all n locations
  Clone ID: PAT_TA_15926
tgcaggaatcggcacgaggcaccacctctgcacgccggcggatctcgcgctccaccggcggccgccgtcgctccagcaccgacggccactctcggccctttttttcttctggtttttcagatcagatcggctctgtcactcctcccgctcgaggccgccgtcgcaagctcgagcaccgccttcgctgccccctccccctccaaatcagagacgggtcggtctcgcgcgcgagcacggcgtcgcccacggcccgcagccccggagcaacatgtcgacgctcgcacttcgcaggaaccaggagccccacgactgcttccctttcttcagctcgctgccgagcgtctccggccaagccgcgcgccgagagacggccatggccgcccgatgcccgagcgccaccggccaaggacccgccggcgtccagaccccctccacgccatccccatctcgctggagacctgcaccaaatcccatccaagcaccgcgccacccttcgggtccccgccccgcagttctgcagcctgagcgcttcaagccgcctcgcgctccaagcagaggagaaggagtccctgccacgagcctcttcaagcaacggcaaacaantaggccgacccttccttggctcctgcggcgttgatgcggcggnaagtggcgccaagcccngcggtggagaaagcaaatggacaagcggcgtggtgcccgtgtgaan

SEQ ID NO: 15927 - DNA, 649 bp, Triticum aestivum
  Clone ID: PAT_TA_15927
gctccccgaaccgacgacgacatggtcggacgccagggacacagccgccaccagcaccgacgaccaccaccaccaaacgggccgcgccgcggcggcaccgccagcggcgaaaggcggcaccaccatatccatcaccatcgtcctcctcgcactgctcgtggcctccgtcgcggcgttcctgctgtcgtcgccgacgggcgtggggggcggcagccgccccggcgccgagccggtggagcaggccgtaggccatggtggcgtccccgggttcaacagccggctggacgcgttccgcacgtgggccaaactaacgtggatgaagctgcagcggccgcactccgatgatcatcggtatgatgctggtggaaacgggctccccggctcggcagcggaggcgaccaagaagagcctggagatgggcaaagagacggcggagcaggcggcggcgaccgcgccgcgggggtggccaaggacacggtgaagggggtggccgcgccctcctccgatgccgagctctgaacagaggttttactgcatgccgccgtgttctgttagttttgcccgtgtgaatgtgtactctaccgtagttgtttgtagtatactgggcattctgggtccccgtcttttgaaaaaaaaaaaaaaaaaaaaa

SEQ ID NO: 15928 - DNA, 1004 bp, Triticum aestivum
  Clone ID: PAT_TA_15928
cccgccgccgccgctctttctcttccctcgtccggatcgagccgcccgccgccgccgccccgccgcgccgatctgccgcttccccaacccccgtcgccgcgccgccaaccgccgttcaccatgttcaagaagttctcttccgaggacatatccgggcagaatcaggtcaaggcgtctgtgcagcggaggatccggcaaagcatcgccgaggagtaccctctcctcgaacctttgctggaggacatgcttccaaagaagtcgccgatgattgttgttaaatgccaaaatcatctcaatcttgtggtggtgaaccaatgtcccactcttcttcaacatccgtgatggtccatacatgccaaccctgcgccttcttcatcagtatcctaacatcatgaagaaggttccaaggtggacagaggtgctatcaagtttgttctctctggtgccaacataatgtgccctggactcacatcgcctggtggtgtgttggacaatgaagtcgaggaggaaacgccagtggctataatggctgaaggcaagcaacacgcattggcgattggattcacaaagatgtcagcgaaagacataagcaccatcaacaaaggaattggagttgacaacatgcactatttaaatgatggcctgtggaagatggagcggcttgagtagtaggatcgccgagggaagcagaatcaatccgcagcaaggccatatggagctgtaactaggcgcatcatgtgtcgttttcgcatgggaaaaatcttagttatcttggtttggttatgctgccgctgagaaccttgtatgatatgacatcatcgctgaccatttacacttttaccaataacagttcagaagaacaccatgttgtttatgatgccagcgaaaacagaaatatacacttgtgaactttactgaatttggtgttttatttactgaggttctaaggcaccccagagtttcgtgacgcttcatttgtgctgttttcttgccacagaagcagt

SEQ ID NO: 15929 - DNA, 635 bp, Triticum aestivum
  unsure (1)..(635): unsure at all n locations
  Clone ID: PAT_TA_15929
ctcgtgccgaattcgcctctctccaccgccggcgtccggcgactgccgcttgccggcctaccggtgatgggtcgcgcatccacttgatggatccgtcggcggcagagcctgcgccaccacgggccgccccgggcaggggggcggacccagcggagcggcgcaggcggtggtgcgggatcacagtccgcggggccctcgtgatgctcttccccatcgccgtgtcattcctcttctcctttatcttcggcatcgctggcctcctcctcggcgggctctcctccaacgcgtccgtctccatgccctccacctgccgcatcctctctaccggcctggacattcggtcatctaaggtttgcgagcttggactgttgaactataaagctaagcatgtattttacccctcgagtaatcgaagattccgctgccatgatgactattactgggcttcagtttttgaggttgaatacacagaatatttttccgggcaaacatcttatgcaatggcagaggctccaaagccgcctcttcctcccgcttgccggcctgaggcaacacagcaaataaggcaatgaacatacaatnaataacatgggagtcaaantanattatcaaagtatcaatnncgtagntcttaa

SEQ ID NO: 15930 - DNA, 583 bp, Triticum aestivum
  unsure (1)..(583): unsure at all n locations
  Clone ID: PAT_TA_15930
ccccaccctctcatgtcagttttggtttcatgcacgatatttctgacatggcatgcacataatcaaaggataaatttaggtttgatactatacttcctattcatagtcagtaggcaggtttccttgcacatgtcgccgtccgtggcgctgtctggtacgatccgggtcgagtggtggatttgctgtagtgtattgcctatccccgctgcctgctggtaaggggaggatgctgacagttgtgcagatagccttcacgcatgatgagagtcctccattgctttaccgacgagaagcaatggaaggcgatgccactgcagtttatgcgctcaggtttctccgcttctgtttggcctctgtcagttgtattttgagcattggcatctctagccgagctgcgcaagcagaatgctgagcaggagcagctcggggattaagcaaaggtctaaaatgttgaatctcccaataaagtggtagtgtatatctcagcttcactcaacatcttctccctccacctgaactccgctcccatccgcttccatgataatgtgaactcgggattccncccgcgtgtaacgataatccg

SEQ ID NO: 15931 - DNA, 521 bp, Triticum aestivum
  unsure (1)..(521): unsure at all n locations
  Clone ID: PAT_TA_15931
ttaacccanggcaaggntggatccaaattcnagtaaatttcaggaagccctcaagtcctttgattgagtacaaaagaacatgcgagctgcatgaagtgagctactatgattccttcaagcttcagcgggaagtgcatgacttcaattcaaatgtttaccggaggcttggaacttagccggcctttgggacgagataattgagatgttgcgaaggcgtgagcttccagacgcgttcgaagggcgagaagagtgggtgaacctggggacctcgtaccgccggctggttgagcccctggacattgcaaactactacaggcattccaagaacgaggacaccggctcctacctctccaagggcaggccgagacgttacaagtacacccagaaatggcgcgagcagtcgcaccgcatccccttgggttccagcctcgagtcgtgcttctgggccatgtccgaggagctgcaggctgagatgatcaacggcaaatcattcgaggatctgaaagacagggtaggtgaac

SEQ ID NO: 15932 - DNA, 462 bp, Triticum aestivum
  Clone ID: PAT_TA_15932
cgcgtccggttcaagacattccatgaacttaatggtaagatggttgaagtcaagagggctgttcctaaggagctatcacctggacctagcatgcgctctcctgctggcggaatcaactatgttatgaacagagccaatagctttctcaatggagcggcccaaggttacagtccgagcccggtaggtggttatggaatgaggatggatgcaaggtttgggcttctatcaggcggccgtagtagttatccttcttttgagtggtggttatggaattggtatgaactttgacccagggatgaacccaggtattggcggtagctcgaacttcaacaatagtgtccagtatggacggcagatcaatccatactacagtggtaattcgggtagatacaatagcaacattagctatggtggagtcaacgacaattctgggtcagtgttcaactcactggctcgtaatct

SEQ ID NO: 15933 - DNA, 738 bp, Triticum aestivum
  Clone ID: PAT_TA_15933
agaaacttgtgagcaaaaaccctcctgatattgttctttattttgaccgactggatctgcagagcagggactatggtgatgtacctctgttgcagaccattagcaaagtttttggagcctcggtctggttccattgtataagaagtgttaactcatgctgcatctgcaccaccagatggaccaaatggaattcctctgagtggttatgacatgtttgtcacccagaggtcccactgtagtccagcaagctataaggcaggcggctgctgatgttcgtcttatgaatccaggcgccctggtggaaaaccactcggcttgcagggcaaataggtcaggccagagagtgttgccaaatggaccagtctggaagccacagttgctcttgctctgctttgcgtccaagggttttagcagaggctaattcggttctcaagttgcaggatagccccgctggtaaaacttctagcacgagggttgctccccttcctttcctcctctcttcacttcttcagtctcgagctccgctgaagttgcccgaggagcagtttggtgacgatgatgatcttgaagatgatttggcagatgattatggttcagatgatggttcagactatgatgacctgcctccttttaagcgccttactaaggttcaactttcaaaactcaaccatgcgcagaggaaggataccttgaggaactagactacagagaagaagctgttctacaaaaaacaagctg

SEQ ID NO: 15934 - DNA, 536 bp, Triticum aestivum
  unsure (1)..(536): unsure at all n locations
  Clone ID: PAT_TA_15934
ggcacgccgataggtcgagcgtcgcgagaggttgccggagtcatcgggaatccgcgttgggccgccggccttgtctctgcatcgcgagtgagcgggcggaggaagaaggagacctgccagcaggccccctccccgcggaccccacctgggcagccactcaaggccggccccgctccgccacgtcaagattagtggagacgtactcgccggagntgtacgctttcccttctctgaaaacgccttccgtctcttccccnagttcagaatacgtttccctctcggcccaagggggcctgtttgaagaaatcttttgatagatgggccccgggacttcctcgggctataacttgggcctcgacaccccattccccccccctgtgggagagatctgtttccggcgaatctttccgcggcttcaccggacctcttcccgaagtacccttcatccccggtgttgtattccaaagacttctcctcgatctctgggatggaatacggggcgttccggtttctctgagccggggtgccacagtgcc

SEQ ID NO: 15935 - DNA, 535 bp, Triticum aestivum
  unsure (1)..(535): unsure at all n locations
  Clone ID: PAT_TA_15935
tacatctcgaaaatttatggctaagatatacattccagtcgtaaactggtttctgctggcttcttgtttgggctttattctgctcttccgaagcacatctgatgtcgggaatgcatatgccatagctgaacttggggtgatgataatggccacggtctatgttacactcataatgcttctaatatgggaaaccaatattattaaggtcatctcattccttatcacattcctatccttggagctgattttcttctcatcagctctgagtagtgttggggatggaggttgggcactgttggtctttgcatctggtcttgtcatgattatgttcatctggaactacggaaccaaactgaagtatgacagtgaactcaaacagaagctttcaagagatctaatgagaaaactggggcccaaccttggcacaatgagagcgcctggactaggcttggtgtacagtgagtttgtcaccggtctgcctttttgggcatttctgacgcctcctgcatcaccaaaacgatngnggcgcggattg

SEQ ID NO: 15936 - DNA, 712 bp, Triticum aestivum
  unsure (1)..(712): unsure at all n locations
  Clone ID: PAT_TA_15936
acggagagggcttctcagcagcgtgaagcactgaaggtgcttggtgttgctgaaaagaagatgcaagacaaagattttagggtactgtacaatctgagccttgaaaatgctgagcagaggaaactagatgtagcagctctttatgcaaagaagttactgaaattggagaatggttcagaattaaggagctggctccttgtagctcgtatcacgagtgctcaaaaacggttcgaagatgctgaatctattgtaaatgctgcccttgatcagactgccaagtggtggccaaggagatcctgttgcaaaccaaagccaaaattcaggctgcaaatgggcaatttaagaaggcagtcgagacttatacccaagcttccttgctgtcatcccaactcaggaaagaaaagtttcaactcctgggaattttgtattacagggctcgaacggatgatggtagcatggaaacagaggcatggtacaatctggcccttctgtacctnagcctgtcacagtggagggatacagagctttgcatatcgaaaataaaggctatcagtgcatattctcccttggcttatcatgctacaggaaagctacttgaagcaagagggtttctaaaggaggctcttggagcatactccaaagcattggatctcgaaccttagcacgtaccgagtttgatatctgccgccgttgctcttcgacagcttggagg

SEQ ID NO: 15937 - DNA, 726 bp, Triticum aestivum
  unsure (1)..(726): unsure at all n locations
  Clone ID: PAT_TA_15937
acatctactactattttgaaagaaacccaactcaagcttggatgtctcttgggggctagccttttatgtgcaacaggatccgacgccatgtttgctgatctatgctaattctcctggtttagatctgtccagcttacctttgtgtgtcttgttcttccatgccttctactgggttacctagggcaagctgcatttcttatggaaaacttgactccaaatgagcccggcttctcgtctctctatgcccaggccaggtgttttggccagtggtgttcatagctactctggcagcactaattgctagtcgtacaatgacaactgctattttctcaatcattaagcaggccacagctcttggctgttttccccgcctcaagattattcacacttcaagaaagttcatgggtcaaatatacatcccagtgatgaactgggtttttgctaagtttcctgtctcgcgtttgttacgacatttggggagcattaatgagattgggcaatgcatatggtatagctgaacttgggggcatgatgatgactactatattggtgaccancaataatgctcctgatttggcaagtcaacacattgtcgttcnaagctttctcaacctcctccctggggcctgggagtattttctttcctcccggtatnggcaatgtaccanatgcattgggntctttgggaatngcgntgtacngtaccggnaagtaanatggaacang

SEQ ID NO: 15938 - DNA, 882 bp, Triticum aestivum
  unsure (1)..(882): unsure at all n locations
  Clone ID: PAT_TA_15938
taaactccccaccacgccagccattccccagcacagcaaagcatccaatgctttccccttcccacccatttaccaaccttattgccttccgccaatcactccctccactactaaacccctccctcataatccccccggaggaggagcggagcggcggcggcgggcgagatggacatctcgtcgttcgtgacgtcgcttctgacgtccttcgtcatcttcgtcgtgctggtcctggtcttcacgtggctctcgcgccgcccggggaacgcgccggtntactacccgagcgtgctgttgcgggggctcgacccgtgngaggggcgcggacggggcacgcgcagccccgtcggctggatccgccaagcgttcacggcgtccgaggccgacgtcgttgccgccggcggagtcgacgccgccgtctacctcgtcttcctctcatccgtgttggcaatcctttgtgggtctctnggaattgtgttgcttccacttctgttaccgcttgctgcaactgatcatgccctggagaattctgctggcttcaaaaatggcaaagaggtgcagaacttcacgattattgaaagattagcattgggcaatgttcaaaaaaaaagtatgaggctgtgggcattcatattatcagtctactgggtctcctttgtcacctatctcgtactatggaaatcctacaaacatgtttcgaatctgagagcagctgcaagatcaacatcagatgttaaaccagaggagttagccgtgttgcttagagatgttcctataccgcctcctgatcaaactataaaggactcggtggactcatatttccgagtacttcatcctgacacattctacaaagcaatggttgtgacagacaataaggaggct

SEQ ID NO: 15939 - DNA, 692 bp, Triticum aestivum
  unsure (1)..(692): unsure at all n locations
  Clone ID: PAT_TA_15939
cttgggaattataagggcacaactcggcattttgagaagaagaccaatcctgagtggaaccaggtgtttgccttctcaaaggagcgcattcaggcatcagtagtggagattattgtcaaagataaagactttgttaaagatgactacattggacgggttatgtttgacctgaatgaggtcccaaagcgagttccacctgacagcccgttggctccacaatggtatcgcttggaagaacggaatgggcacaaggtcaaaggagagttgatgttagctgtttggatgggtactcaagcagatgaagcatttcctgaagcttggcactctgatgcggcgtcaatccctggcgatggccttgcaagtattagatcaaaagtttatcttactcccaagctttggtatcccccgcgcccggtcattgaagcacaagatcttataccaaatgacaagaccaggttccctgaggtttacgtccaagcaatgttaggaaaccaggctcttagaacccgagtatcaccaggcaggactctgaatccaatgtggaatgaggacttgatgttggttgcagctgagccattcgaggagcacctgattttgagtgtggaagacaggattgctccaggaaaggatgatgtaattgggagaactgtcatttcactgnnntnnnnngnnnnnnnnnnnnnnnccannnn

SEQ ID NO: 15940 - DNA, 2093 bp, Triticum aestivum
  unsure (1)..(2093): unsure at all n locations
  Clone ID: PAT_TA_15940
ggtcgacccacgcgtccgggaaaattctgggatgccatctacagttgctcaatgcaattcgcactggtggctatttgcctgatagggttatcaatcttatccttcaatatctcaccaacagtctcacaaagaacagcatgtaccagctgatgcaaccacaaattgacataattctttttgagataatatttccactaatgtgcttcaatgacaatgaccaaatgttatgggatgaagatccacatgagtatgttcggaaaggctatgatataattgaagatttgtatagtcctcgaacagctgctatggattttgtcagcgaattggtaagaaaacggggaaaaggcaacctacaaaagttcatccaatttattgtggagatattcatgaggtataatgaggcatcaattgaagtgaagccctatcgccaaaaagatggtgcccttcttgccattgggacattatgtgataggccgtggccgccgccgccgtacaaggctgagctagagcgaatgttagttcagcatgtctttccagagttcagtagtcatgttgggcacttgcgtgcgaaggcagcatgggtggcagggcagtatgcgcacatcaccttctcagaccaggacaattttcgcaaagctatgcattgtgttatctccggtttgcgtgatccagaacttcctgtcagggttgattcagtctttgctctccgttctttcgttgaagcatgcaaagatctggatgagatccgtcctatcctcccacagcttcttgatgaattttttaagcttatgggtgaagttgagaatgaggatcttgttttcactctcgagacaattgttgatagatttggtgaagagatggcaccatatgcccttggattgtgccagagtttggctgctgccttctggagatgcatggctagttcagaagctgatgatgaaatagaggactctggtgctttggctgctgttggttgcttacgtgctttaagcacaatccttgagtccatcagcagtcttccccatctttttatccaaatagagcccactctgttgcctattttgcgcaggatgttgacttcggatggtcaagatgtttatgaagaggttctagaaatagtgtcctatctgaccttttactcaccaacaatttctttggacatgtggagcttgtggccattgatgatggaggctcttaatgattgggccattgatttctttgagaatattcttgtcccactagacaattacatttctcgtggcactgaacattttgttacctgcaaagatcctgattatcaacaatgcttatggaaaggactgtcatctgttatgacagaccaaaatatggaagattcagatattgtgccggcacccaagctcattgaagtgttttttcaaaactgcaaagggcaagttgatcattgggttgagccgtatctcaggcttacgattgataggctccgtcgagcagagaagccttatctgaaatctctccttgtgcaagtgatagctaacgtattctactacaatccttcgttgacacttgcaatgttgcacaaacttggagttgcgacagaaattttcaatctttggtttgtcatgttacaacaagtgaaaaaaagtggcaagagggtgaacttcaaaagagagcatgacaagaaagtctgctgcttaggattgacttcacttattggacttccagctaatcatattccagcagaggctctagaacgcattttcaaggcaacactgtgagctgcttgttgcataccaggagcaagttgcagaatctaagaggcaaaatgctgctgctgctgatgatgtggatgaatttgatgctgatgaagaagagaatgaggaggatgaggatgatggggagaattgggggttgatgatgaagatcangatgaagtaaatagtcttaatatacagaaactagtacaggtttgttttgttatcttgtctcgagtaaaattcgcattcgaagatcttattggcatggtttaatttttattttatatgcccaccatgttaattttatctacaagtgcttgtcatgatggaatagttaatagagctaatgcaatctct

SEQ ID NO: 15941 - DNA, 1246 bp, Triticum aestivum
  Clone ID: PAT_TA_15941
gggctgctcattgttcattctatacccgccgcccctggatgttagtccacttaataaaggcagagaaagtactgtttggggtgtttcgctcatgcttggctatcttggatttgatggtttcacaagcaccttccaagacaaactcttcagcttattccacacgtccattcacaaccaaatattctacacgacaatgtgctcttgtgttattagcttgagtgggcttattctccagaatcatcttcttccagctgtggactttatggttcgtcatccagattgcttctatgatgtcctaatcctatccactgttgcaacagctagccagttcttcatatcctacactattcgaacattcggggctctcacattcgctaccatcatgacaaccagacagttggtgagcatactactgtcctgcgtctggttcgtgcatccccttagctggatgcagtgggttggagctgccattgtattcggtgccctgtatgccaaaaccttctcaagaaacaaactgcagaaggccgcggtcgtgagctcaccgtcgcaaggttctgtgccaaatgctgctaacagttgactggaagaaataacaaataggaacaacgaaggtctgatctacttgtcactttgctgtaccggatagaaaattttcatgtccgaggcgaatgacaggcatcctaacaaattgactgagagagaacagattgtagagtcatgccttggctccgaatcatcaacctggggagctctgaaaggcttagctgaaggcccattagtttgttgatgtgaaagagtgatcgggactgctgaatttgttctctgaggccgtttgctgttagctacagtaacattatgttgtgatgtaaactgtaaacttgatttactccatagatagaaaaagtctttccacccacaagagggaggaaaggctggattttttgtgcgtacagcgcattaccctaccttagggcgtgaccggcgcgccgcatctccacactgattttcatggctgatggtgtggtgtagagttggtcgtgccataggactgtatttgtcatgtttgtgatataattttgcgtttttttgcgactatagacatgcatgaataggcggtagccatatagagtgcttcaaagagaagcatatcttgcgcgcatggttttgatctcacaatggcatgtttaaatcttggtatcactagatgtatgttaaaccgcctcagtaaaaaaaaaaaaaaaaaaaa

SEQ ID NO: 15942 - DNA, 629 bp, Triticum aestivum
  unsure (1)..(629): unsure at all n locations
  Clone ID: PAT_TA_15942
tcgagcggccgcccgggcaggtactctgtcgtatccaggatggagctttgctagcttttgagttggattcttttgactgcacctaaatatgacaagccgacagtaaatgagctcattttaaaaaactacagtttaaaggaaattattacaatatgtatatcaattccaacattgctatctgaaggatgatttaaggactatttgtctctgatggctttccctgtttggctcccttttctgtgagttgactctacagttctaggatcttctctgtaaccataaattcacagcttagcaaaagtatatatatacttgctagaccttctcattacactctttcacttttttggactaatactatcctgtatagacctaataacagaagacatgggaaatgcttttgtaacatgatgtttttttttgttagatgctctgtttatttagtgtcgttgatccaaaaacttgaaagtgtagaaatgttcatgcatgggactatagaaccaagtatttctcgatttggtgatgcttaattcagngntcttatgcatcannnnggagtgttaacacaaacctgttatttatttcacttcatatgagttaatgccnnnnncttnnnnnnnntnccctct

SEQ ID NO: 15943 - DNA, 1805 bp, Triticum aestivum
  unsure (1)..(1805): unsure at all n locations
  Clone ID: PAT_TA_15943
ttcggcaccgggcttcaatcttggtaaggagtgtggaaggcgactacccgcggtaccccccttccgcgcgctccgtttgcatctccgatcgtctcgccggcgtcagcgagaatgcagggcggatccagcggcatcgtctacggcggcctcaagtaccaggcgcggtgcatcaccgacgtgcgcgcggatgccggttccaccaccttcctcgccggaaccctcagcctcaaggaggagaacgaggtgcacctgatccggctgctgccgggggagaacgagctcgtgtgcgacgggctgttctaccatcccaacgagatctgggacctcaagtcctgccccttcgaccacaggctcttctccacggtctacacgtctggcgagggttatggcgcgtccgtttggaagatcccggagctgtatgggcagtccaactcaccgcagcttgagcagctcttcacgctcgatgaccacacggacaaaataagatgtgttctctggtggccactggggaagcatgataagctaattagcatcgatgacagaaacatttttctctggaacatagatccatcaaataaatcagccaaggtgatatcacagggatctgctgacatgcttcccaatttacgtggtggagcttgggatccacacaatcacaacgcagttgctacaataactgattcgtcactccacttctgggatctccgttctatgaagagatcaaatgcaattgaacatgctcatatccgggatgtggattataaccccaagaagcaaaacataattgcaacagcagaggacgaattcggaattcgcttgtgggatctcagaatgcttaagcatcctctgaaggatctccctggacattcacattggacatgggctgttcggcacaatcctgagtatgatgagctgattctgagtgctggaacggattcagctgtcaatttatggttggctaaagttggcactgatgactctggacccgaaagcccttctggttcgcccactaggcaagaagaaccattactgcactcgtatactgactacgaagatagcatctatggaattgcatggagctcccatgatccatcgttgtttgcttctttgtcttatgatggaagggttgttttagaatctgtcaagccccacctgcagagaaaatgaagcttgttggtctattttctccacttcatgtgcaggcttgtttgttgtgcatataattggtgttgtagagcttcgttcttgccattgtgcgttcggctataaggggctgatgcgatgatttggttctagtaaccctggtgcaatagcaagccattcatatctcaataatcacggcgacggaagtccaggatggttgctggagaaaaaagtgatgtagtcacagttgaaaagaatatagcgcagctgagatttcaacagttctcctatatcttcaaattttgtcactagttcttcattttggatttctggggaaactgtggatatcggtagtggtagttaattgctgcttctgggcttattagaattctgatatccgatgaagcctggttggcatgtgttgcatgatgtgatgaagtataactgagctgaagtttgtactagtgttgtgatttacaatgtcaatggatttttctgtttaccggccaattcttaatattcttgtaggatgctgttctacaacagatcgcaatatgccatctgtattttacaaaatggcttagtctaggtcgagtatatttgggtcgtgagagtttttcaccnagttaaattgtactccaaatagtttctcgttcaggacc

SEQ ID NO: 15944 - DNA, 949 bp, Triticum aestivum
  unsure (1)..(949): unsure at all n locations
  Clone ID: PAT_TA_15944
cccccggtatccgtngggttcctccttggggaattgaggcatgtcggcttngtatancagtgcnaagggattctcagcgttagtgtaacccggtttccgtaggcnttaaagacgcnttggnngctaangactcctntggngattggtccggccccccntggantaaagtgctgtattattttgncgntgcttcaggttttgcgatacattggaatgtgtgtataaggcatgtgtgtgcntgtgtnccaagtttttcaaacactgactaagganggaactgtttatgctgaagttccaaagctggagcaagggctgcctttcctcaaagttatggacaatggggagcttgaaggagttggtccgctggtgtcaagtccgaaacccgaaaagaaagaacacctgttggaactcttagatgcaaaagcaggtgatcttatcctgtttgccttgggcgagcagtcaacagctaatcaagttcttggcaggttaagattgtttattgctcataagctggacgtgatagatacatcagcacactcaattctttgggtgacagatttcccaatgtttgaatggaatagtgacgagcagcggtatgaggctctgccccttcctttctcctccccattgttaaccggttcgtatgcctcggcacgtcctcatggcaggtctggcttttcctcaggcctgggcgcgctgcacgttagagaactagcattttgctgtttttttaagagactgcagttatttgttgaatgttgattgctgtttagttgctgattatacactatgaacaaagtttgaaccttggtatagtacgatacattgtactacgttgtatcgcaggaatacccaccaatattggacgaatcttagaactttgttgatgacctccagacgtgatctggtatgacacgtgtttacaaagagatatgtgaaggggaacatc

SEQ ID NO: 15945 - DNA, 710 bp, Triticum aestivum
  Clone ID: PAT_TA_15945
ccagagaagcaagctggtaagggtgcattctcggtcttgtgacctccgagaagtgcctggagtatcagttgactcgcttaatttccactcttcccggacttcattccagtcaaaaagcttcagggcaagcgaaccccttcaatcgaagattatgaagacggtggatgaattgaaaggtgacctttctgaaatcttcaatgaaccttcagattgcaagccaagggcacgccgtccacatccgctgaaacaagatggttacagccaacctcttacagcttatcatcctgctgtcaagcattctggctatgcatctcgcctgagcaggtctggccaagttgctccccatggccatggactgcccttacctcggtatggccggcgcagcgcctactcatacattcgcagtgggcaactggaaatgagaccttgccctcaccaatgccaccacagctgccgcccaccttgttgcagctcctggaaacaagaacctgcaccgcagaagccaccagctatggagacaaagcggcggcctgcctcgagaaatctctgccggccagtcctacggggcgcgccgttcgtcctttgctcgaactgtctgaggctcgtccagctgcccaccgattttgccattccgagcagaggaacacgcaggctgcagtgtggctcctgcgcacaagttctctcctactcttacagagaccccaacagaa

SEQ ID NO: 15946 - DNA, 940 bp, Triticum aestivum
  unsure (1)..(940): unsure at all n locations
  Clone ID: PAT_TA_15946
gtgtagaaaccagaggaacccaagaaaaggtaggtggcctccttcctaaccaaccccgggcggcggaaataaatcggcaatcccctgcgatttactgccgcttcaagttcaactcctcagattcgcagcttcgggggagcggattgctgcgcaaatggggtccggatctttcctcaaggtgctcgtcagcaacctggacgttctcgccgggcccatagtttcactcgcttatcctctgtatgcgtctgttcgagcaatagaaacaaaatctcctattgatgatcagcaatggctcacttactgggtgctgtactcgtttatcactctgtttgagctcacttttgctgcagtaattgaatggctccctttctggtcttatggaaagctgtttttcaattgctggttggtcttgccctactttaacggtgctgcgcatgtttatgagcattttgtgcggccaatgattgtgaaccagcaggttgtaaacatctggtatcttccaaaaaaggaaggttcagacaaacctgacgatgtaatttcagctgcacagaaatacattgaacaaaatggatcaaaagcatttgagactctcgttaacaagtttaagactacaaacgcgaggcgctcaattttggaggaggtagaggcggaaaggagagccagggctgaacgagagctggcagcgagggatgtgaatccattcttccacccgaattactgattctgcaaagctctactgttcaggcatcaggtgnacacaatgtatgttcacctgatgcgctgctagttctttntagcttatatactatatttagccctgcattnntgtgtgatttctccttcagtgcctttaatggtangaaattggtcagaccaagttgaggggataattgnaggaagatcatattttagatttgatattacatagctgaacattatg

SEQ ID NO: 15947 - DNA, 779 bp, Triticum aestivum
  Clone ID: PAT_TA_15947
cccacgcgtccgcggacgcgtggggtaggtgctacggaggggagagcgagtggagtcgaggaagcagcagggatagcaggaggagcgtaggaggaggggaggggtgcgagagagatggggtccggatctttcctcaaggtgctggccaagaacttcgacgtcctcgccgggccactagtttcgcttgcttatcctctatatgcctctgtgagagcaattgaaacaaaatctcaagtagatgatcagcagtggcttacttactgggtgctgtactcgtttatcactttgtttgagctcacttttgctccgatacttgaatggcttccattctggccctatggaaaactgttcttcaactgctggctagtcttcccctgcttcaatggtgctgcttatgtttatgagcattttgcgcggccaatgtttgtgaatcgccaaatagtcaacatctggtacgtcccaaggaaggataagttgagtaaacctgatgatgtactctcagccgcagagaaatatattgaactaaatggaccagaagcatttgagaagctaattagcaagtctacaagtacaaagccttcaaagtttaggagcacgagacggtcaatcttgcaggaggcggaagctgaaaagatgggcaaggctgagagagattcatggggtgaaaatccattctatgataaaaattaccgacactaaatcagtcttcttggattctgcctgatgaagagctttccacgcacgctcttgaggattgcatgatgcgtctaccaaatcgt

SEQ ID NO: 15948 - DNA, 1181 bp, Triticum aestivum
  Clone ID: PAT_TA_15948
cctccgcacccggctacaagtcttgcccatgttgatgcagcgggcctccggcgagcccggcgcggccaatcaatgggcgacgcagtgtaatttgctgtcccttccggtttaacgccgcagaagagtcgcatctttcgggcagcggattgctgcgaagatgtggtcctcatccctcatgaaggttctcctgagcaatgtacacgctctcggcgggcatatagtcacactcttttactctctgtatgcgtctgttcgatcaatgcgatagaaactaacttatctatggatggtaatgaatggcttactgggtgcttgatttgcttgttactctgtttgttggtcacctttgttgcagcaaattgaatagctccctctctggttttatggaaagctgtttgtcaattgtcaattggtcttgccctacttcaacggtgctccgcatgtttatgagcattttgtagcggccaatgattgtgaaccagcaagttgtaaacatctggtatcttccaaaaaaggaaggttcagataaacctgacgatgtaatttcagctgcacagaaatacattgaacaaaatggatcaaaagcatttgagactctcgttaacaagtttaagactacaaacgcgaggcgctcaattttggaggaggtagaggtggaaaggagagccagggctgaacgagaactggaagcgagggatgtgaatccattcttccacccgaattactgattctggaaagctcttctgttcaggcgtcaggtgacacaatgtatgttcacctgatgtgctgctagttctttttagcttatatactatatttagccctgcattttgtgtgatttctccttcagtgcctttaatgtaggaattggtcagaccaggtcaaggggagaattctagagggatcgtatttagatttgatatattacatagctgaacaattatgaaatcttgtaaataggttctggattttgtgggttatgactttctcatgaatgactgcaattttatgtatgcatcttgcgcagcgatccctgcatgctcttggcgtttgcagcatgcggccacccagtcgttttcgccaccacaagaactatgtgacggcggaattcttgtaaataggtgccatcattgacatgttcccagatgatgtaatgttgtcttgcatattagtaacagatt

SEQ ID NO: 15949 - DNA, 707 bp, Triticum aestivum
  Clone ID: PAT_TA_15949
cagagacagggtcgttccccgtcctcctccgcccgccgccggccgcctatgctttcctctcccgggaacccccaccccatccacggtctgaactcctaatgtatgcagcaagtcatgttggctatgcttttggtctctaagaatgatttttttctgcatggggcatactgaagatacttatttgaccaaaagtttgttcgagacttgcctgtgataccgggggtctaccgatcgaccctgactctctgacagcatggaaacatacaccacggatgacgcgctttcagccatggggtttggcagattccaggcgcttgttcttgcttatgcaggcatgggttgggtcctagaagccatgggagctcaacctgctgtcatttgtgggaccgttggttcgggaggagtggaaagtctctgcccaagatgagagcctactctcaagggggccctgcgccggccggccgtccggcccgggcgcgtgcggcctggttgctcacagacgtgggcgttcgcccgtctcgccggttgctccgctgctctctcgccgtttgcgctgcctcggtccccgctcgcccgtcgggttatgcttctgcgctcttcgccgcctcgccggcgtgggagtgggtggcgggcatgtgttctcatcttggtttttggagtttgttcctgcccaaaatcgtggcacttgcgtggttcttttttcgctt

SEQ ID NO: 15950 - DNA, 1397 bp, Triticum aestivum
  Clone ID: PAT_TA_15950
cgcgtgatcatcgcgttccaggagagcagagcgggctgagcgattcggatcgctctccaccttccggggccgtcccccttctcccccccgatccccaatccaatggtgctagtcctagcgctgggggatctgcacatcccgcaccgtgcgcccgacctgcccgccaagttcaagtccatgctcgtcccgggcaagatccagcacatcatctgcaccgggaacctctgcatcaaggaagttcacgactaccttaaaagcctctgtcctgatctccacattaccagaggtgaatatgatgaggatgctcgctacccagagactaagacagttactattggtcagttcaagctagggctatgccatggccatcaggttgttccatggggcgacctggactccctagcgatgctccagaggcagctggatgtggacatcctcgtcaccgggcacacccatcagttcaaggcctacaagcacgaggggggtgtcgtcatcaaccctggctcaggcacaggcgcacacagcagcatcacatatgacgtcaacccgagctttgtgctcatggacatcgatggcctccgggttgttgtctacgtgtacgagctcattgacggcgaggtgaaggttgacaagatcgacttcaagaagaccgccacgatgcatggctgatggtgcttacgcatgacagaaatctgatcagcacaccaccaccagcaccaccaccacaatttccccgacctggaggtccttttcctttgtacccttctgctcgatatgaaaaactagagctgtgtttacatattagtgaatgggatatgcgtgatatgattccaactcgctcacaaccagaaacggtttgtcaaggaggcgtcccccctcatgtatctctcactcagtatggtgaccggctgaatagcagttggcgctggcgtttttttagtgttaatctcagcaggtcgctggatcgatggaaagcccagtatctaccctggacgttgatgtgtgtgaactcacctggtgccacctaattactgctttgtctcaaaaataaaaaaaactacttactgcttactgctttgttgacgtgtttccttatccatgtatgagatttttgtaataatggtgctctgggccggagcaacttagatggattctctgcctttaggtagtcggttcccttcccttttgtcctaggaggactttgaatctttgtaggtgcttgtggttatgtttttcaggcttctttctgaatgaagccggggagctctccttttttatctttttttttggacgtgataagtgctgaacgtgtgggctgaaagacgccacgtcagtcttttatcactttttttatttcatgcatgaatgtaaagagggacaagaaacatgccgacgaa

SEQ ID NO: 15951 - DNA, 2042 bp, Triticum aestivum
  Clone ID: PAT_TA_15951
cccggtccgctgttcccgcgtcggcccccgcctccggccgggcggcagggactctggaccagaagcgtccgcaaatccagggccaacagctgcagaggacacgcccttctgccccgtcttcctcattgggggtttcttccacgggcaaagccgccgcctgatgaagagcaaatccgccaagaaggccgccggcgaggatgaggccaagtccaagaagatccgatcctcgcgcggcaagcgtcggagtgtcagctacagccgaagccgctacccttcccccgacggctccagctccagttcccatccccgcaagctaaccaagaagcccatcaagacgagtgtacaccttacgagtaaaaagagccagacttggagcgaacctgtgatggcttaacatggtacgatcccaagtcattttcccagcagcagtccttcgttgttgtcctgaaatctagatggctgtacttaccataacgttagcaatcccagagcgccaggccatccgtttttacatgcccttcggtccttgtaacccgccaacgtgattcgtgggtacctgggatgcagtgtactcaacgaccaaaaaaaaaggcgggtacggagatcaaggagctactcgagcagtccagccaggagtggcagtagccggagcaggagcaggagcaggagcaggagcaagagcaggaggcggaggccggacggcacgagacatgatgcaagtagggacagggttgtacagggctcgggcaactgccaggatccgcagaatgagaagagatctgttgaggatgtttatagcgatgaggacgcggttgctgacgattatgagaagaatgtggagctgaaggagatggaaagcccaccttccaaggatgctcatgaaacgggtgagatcttacctgttagttgcgaaagcccagaggttgaggaggatttggagctcattctcaggcagaaagctcttgagaacttcaggaagtttaagggagccgtggccatggtaggcaagacagaaaacagcggggccgcggccgaggtactaacagatagcccccggaatactgtcacaaaatttcctgaagcaaggtctgctgttgccccttttcagaggcagggaagcaatcttggagttggccactctactcgatcacctgaatttgaagattttgagaacggtaggagtccttggaagcaggaaacgactcacagggatagatcacctggaatactcgaggctggtgatacttgtggtcctactcaacagctgggaagcggactagaagagatacgttcaacttctcatatcacttcacatgatggtaggaatggtggtagtgtaatgcaaaggttgggaagcacccccgcgagttctggtagtataagccaaaggttaggcatcagctcagtggtgagtcctgtgcaagcaagacccagagttagatcagttgtgagtataccctccagggaaagggcttgatggcagtacatttaccacaatccctaccgcttctgagaatcctgcctctgtcgaaagcagtagtgaagtaagacattttcctgctgaaataaacaagcttgaaggaatcgatggagatgatagaaagattggtgaagcttcagttcctgagagctctgttttgtcgactgacgcgggcaagagccaggcagcagggaccgaggacaaagatgcgtctcagtttgagaagaggactttctctaggatgcatgatggagagacagtgcaggtcagctataaagtctacataccagcgacaagcccgcgacttgcaaggaggaagctccagcgctgaaggcatcgaatggacttccatctagtcgtcattaatcccgttgtctgcagttcagttatatagcgctggataaactgtattttgttcttgtagcacgtgaactcccttttgttccttctagaaactcctgcacgactaatagaaaacctgctcacgtcgtgactacatcttactgctcgatagtagcacacgtggacagaagctgtgatggcttaacatgatacaatcgtt

SEQ ID NO: 15952 - DNA, 560 bp, Triticum aestivum
  Clone ID: PAT_TA_15952
tgcaggaattcggcacgaggctccatttggctcgcagacagcagcaccagcatttcggcaggcttcatttggaaactcaatctggaggaaccagagtacagccttatgtgcagacaccagatcctgacagtgctacaagtggtactcagcctgctagcaaaacttaattccatatcagccatgcctgcatacaaagagaagagtcatgaagagttgaggtgggaggattaccagcgtggagacaaaaggtggaccaagactcttctgtaactccagtggcgaacagctttccaactccgtcgccaagtttgcagaacaaatccgccggcgaatccatttgctaagccctctacaggtggtttgggtgccactccgaacccattttcgacggcccacagttgaccccatttggaccaacgagcagctctgcattttcagcaaatacctcaccatctctatttgcgaattactactccttcattattcagcacgccatcgacaaacccaaatcttttcaataatagcttatccattagtaataatactcaatcagctgggct

SEQ ID NO: 15953 - DNA, 555 bp, Triticum aestivum
  unsure (1)..(555): unsure at all n locations
  Clone ID: PAT_TA_15953
ctcgtgccgctcccttcccctccgccgccgccaccgccgccgcaaagagaagcgcgagagagtggggcggccgtagcaagcgatgccgaacaagcgtcagcgggaggcgcggaagcgcttccgcgaggcgaaccccggcctctgtccgcccgcgccccgcccctccgcccgacggcaccaagaagaagaagagcaagaagagcttgttcaagaagggtgaagaaggcgggagccggcggcggagtacgaggagcggggaggtcgaagcacccgctgcgggttcccgggatgcggcccggggagcagtgcttcatctgcaagggcaccgaccacgcggccaagaactgccccgagaagtcctattgggacaagaacaagatttgcttgctctgcagggagcgagggcattgtatgaagaactgccctgacaaaggtgatggggatctgaagaaattctgctataactgtggtgaatctgggcattccctttccaagtgcccggagcccattgacaatggcggcacaaactttgcgagctgctttgtctgaaanaga

SEQ ID NO: 15954 - DNA, 433 bp, Triticum aestivum
  Clone ID: PAT_TA_15954
cgggtcgaccggaccttcatactaagcaggcattcaaagaagatttctttctcttctttcgtaagagcgtagctggcaggaccttcatactgcttcggaggcatgccgtctttttcgtgcaaacgttgcaggtcctcccgtgcctcaggtgtatcttttgtcttcccatacacgcccaagaagcctagcaggttcacgcaaaggttcttcgtcacgtgcatcacgtcgattgaagagcggacatctaggtctttccagtagggtaggtcccaaaataaagatttcttcttccacatgggtgcgtgtccctcagcgtcattcggaacagctagtgcgcggggaccctttccaaagattacgtgtaaatcattgaccatagcaagtacgtgatcacaggtacccatggcgggattcttccggtgatctgcctcgc

SEQ ID NO: 15955 - DNA, 412 bp, Triticum aestivum
  Clone ID: PAT_TA_15955
cgatgaacgcgcttgaaggtgctggcgcgccggcctccgaggcagaggtccagcaggaggtcaccgcaatgtcacagacgaatatcttccgtccggggatagatgtcactcaagcagtgctgcttccacaggtcacatggcggcggcaggagaggacagaggctgttggacttgtggaaggctaaggtgtatgacatgcaccatgttatggtgagtgttaagtcaaggagggttcctggtgcgatgacggatgaggaattctttgcagcttgcaatgagaatgataccgagagtgaggggttcgatgatgtactgactgacgaggagaagaggcagctggaatctgcgcttaagatggattcttcagaggctgtaggttacggccagtccgacacctttgtaggtcctaggc

SEQ ID NO: 15956 - DNA, 825 bp, Triticum aestivum
  unsure (1)..(825): unsure at all n locations
  Clone ID: PAT_TA_15956
ccacgcgcccgcagggacgccggtgaggtcccgggatgtcttcaggggctgccggtcacgcctggggttgctctgcctcaggccgggctggcccatcggcggactgcgtaccgaggtgctgcactaccgcggcgaggcactgccccacctcctttgccggcccaggaacgtgatggaggttcagaaatgtgtacaagttctgcaggataagcaagagcttgctgaaactcagaacgagctagctaaacttcagattgtatatgaagatcctgcacaaaagagtgaaggtactgccccatcagttttcatggccagggaaaatgatggcagtttcccaggtgcaaagcatgagcttgcccttgtcccgctgcaccaagtaaatcagtctcctgctatgcaattccaaagttgcaacgggcttattctacagcaacttgtgcctgtctctttgagcacccaacaagaccagcaacacttgaaccagtctactgtttaccgcgcgcaaaatcaatgccaacctgagcgcaggcaggcccaaacatttcaacctgcaccgcagtctatgcaaccgcaggcccagaacccccagccacagactgtagttgaggtacctccgataactagtcaggcaccagagttctacatccaagctcagcaccattggcaacatcagactgtccaggatgttcactcgcaggcggggccaccacaacaacaaccacagccacaggtggcacaacagcagcagtaccacaacatgcagcaagttccagctcnnntngttcaactgcaaacatcttctccgcnnnnnnnaagtgcanctcn

SEQ ID NO: 15957 - DNA, 394 bp, Triticum aestivum
  unsure (1)..(394): unsure at all n locations
  Clone ID: PAT_TA_15957
aaaaccctagccctcgcagccgcagcggcgcgcacccctctccctccttcctgaagacatgcgccgccgccggccatgatgcacaggatggcgaccgtccccgctcccgcagccgagaccgcggcctccaccgcgcgcaccgtgaaggatgtcaacccccacgagttcgtcgaggcctactccgcgcacctcaagcgctccggcaagatggagcttccagagtgggttgacattgtcaagactgcaaggttcaaggagtgcnaccttctgaatgctaactgggnactaaatcaaggttgcctccatgggcagggaanttttacctnaggnaggnatcggnatnggggggttcacanaatattaaaggggggcctccaaaagaangttnacccaa

SEQ ID NO: 15958 - DNA, 1018 bp, Triticum aestivum
  Clone ID: PAT_TA_15958
ccacgcgtccgcttacgtacggatccacagggagctgtcaactttgctctcatgatgtcacaaatggagggaggttgcccgctggattataataccataactgatctcttccttcggcgacccacgcgtccggaagcaacagcttttctgttggatgttctcaaaccaaatttggaagagcatgcttttcttcaacctaaggttttggagatcaacttggtaacttacccaaatgttgccgatgccatccttgctaatggtatgttcagtcactacgatcgccctcgtattgctcagctgtgtgaaaaggctggcttgtacttgcgggctctccagcactatgcagagttacctgatatcaaacgtgttatcgtgaatacccatgctattgagccgcaggcactcgttgagttctttggaaccctttctaaagaatgggcactggaatgcatgaaggaccttctactggtcaacctgagaggaaatcttcaaattgttgtgcaggccgccaaggaatactgtgagcagcttggagttgacgcctgtattaaactgttcgaacaatttaaatcatacgaggggctctacttcttcctagggtcctatttgagctcaagtgaggatccagatatccatttcaaatatatagaatcagctgcaaggactggacagattaaagaagttgagcgagtcacaagagagtctaacttttacgacgctgagaagacaaagaactttctgatggaagcgaaactacctgatgcccgtccactcataaatgtctgcgatcgcttcggttttgttccagatcttactcactatctgtacctcggccgcgaccacgctaatattgaaggctatgtacagaaggtgaaccctgggaatgctccgttggtagtgggccagctacttgatgacgagtgcccggaagatttcattaagggtttgattttgtctgttcgatctcttcttcctgtcgagccactggttgatgaatgcgaggtcgacgcggccgcga

SEQ ID NO: 15959 - DNA, 597 bp, Triticum aestivum
  Clone ID: PAT_TA_15959
ctgtggggtgcgagggacacttccctggatggctcctgagctgttaaatggcagcagtaaccttgtttctgaaaaggtcgatgtcttctcattcggaatagtgatgtgggaacttcttactggtgaagagccttatgctgacttgcattacggcgccctcataggtgggatcgtgaacaacaccctgcggcctctggtgcccgagtcatgcgacccccagtggagatcgctgatggagcagtgctggtcggccgagccgacggagcggccgagcttcacggaggtcgtcaagaggctacgggccatggcgacctcccccaccaaggcgccgccgcagaagtaggctgcccttaggctctgtacatgagtaaggtgatgaaatatggagaagaacgcggggacgctgcttacataaggacagtggagctggtggggtttgcctgacgcttcatgtggtgctgttagaaactgatgatgatgatgaaatgtaagagcatgtacaggaaggtgccgtggcaagggttgctgaatgtgttacgtaccggctcctgggtgttccggaacttgtttcctgcgcgtgatcgctgtgcagaagcc

SEQ ID NO: 15960 - DNA, 562 bp, Triticum aestivum
  unsure (1)..(562): unsure at all n locations
  Clone ID: PAT_TA_15960
cccatcactcgtcgtcgtcatcctcagcgctctcctgtcgctccagtgttcttgacctgagagatggacgcggggagcgccgtcgaggcggggcggcaggaggggactcccacggggcccgcggcgccgttcggcaggtcgtcgtcgtcgtcgggtctcggcgcgaagggcggcgcgacaccccagagcttcgacggcgcgctcagagagctcaaggatctgcagtcgcagctgcaccaggcggcggactgctgcgagaaggcgttcctcaacaccgagaagaagcagctaatcctgggacagtacaaagagctacatctgcgacgcggtagtagcggtgatcgttcatctagggaccgtctcatccaagcttgagcaccagctggaggacaaggctgagatcacgcaaacagagcaaaagttcagcttcctcaagcagaggctcttgacatgcgaacagtatgcaatttccctccaactattggccgttcgtgcggacactggcgcccttaatataacgccgttnctcttgcaattactgaaagaaanaccagggaaatgt

SEQ ID NO: 15961 - DNA, 708 bp, Triticum aestivum
  Clone ID: PAT_TA_15961
acaaccacaacaaccaatttcgcagcaacaagcacagcaacaacaacaacaacaacaacaacaacaacaacaactacggcaacatccaacactatgacgcttctcttgctgcatgccttgctgctcgccagtgcagctgcggcagcagcagcagcgtctgaggccggcgacgctgctggcggcggcgctaccgcaggcggcaacgccaccacggctcaaggcctgtgcaacggcgccggatgccagccgccgccgcagccgctgccgatctacggcggccctccgccgtcgccgccgtcgacgacaccgccctccccgggcatgcaggcgccgtgcccgccggtgacacccgtttgctgcggcggccaaaacacgcctcagcagccgtactaccaagcgcctccgatcggctaccttccctactacaacgagtctgcttcttccgtgctcgtgccaccgactcccgtcgccgccgttgcgtattacgtgatcgtaccatgtctcttgctttgggttgtggtgtaacggtgaacactgaagcctcgtccaacatcaacagaagattggggctcggactcgccataaagaaaagactgtactagaaggagggttgcgtcttgccgcgcccttgttcgctttgtcggtgtaaagctggttctgtagccgaagtaccttctcaagctcaaaaaaaaaaaaaaaaaaaaaaaa

SEQ ID NO: 15962 - DNA, 502 bp, Triticum aestivum
  unsure (1)..(502): unsure at all n locations
  Clone ID: PAT_TA_15962
gcacgaggggcagatccatgttgcagataattgtcatcaccagctaaacaagatacttgccgacttggatcaacataacatcatggaaaaatctagttgcttggatttggagaatggctgattttgtgttgcaagatgtggtggtggctgctgtaagccaagtactgatagcctgccaggcgaaaaggcatcagagtctcttgcaacctgccagagagatttatgaagcaactagtgtatggagatggtgttcgactccggcagatcctttctgacttcctatctctttcagtgaagttctctcctgttggaagttctgtcgagatttcagccaaggcgactaagaacagcatcggagagaatcttcaccttattgaccttgaacttaggatcaagcaccagggattaggagtccctgcagagctnatggcgcacatgtttgaggaggacgagccgcagcagtcagaggagggcttgggcctcctggtctccagaaacctgt

SEQ ID NO: 15963 - DNA, 904 bp, Triticum aestivum
  Clone ID: PAT_TA_15963
tctcttttccgcccactgaacttggagcaaagtggcatattacttttgtgataactgagagaaccgcgaggctttcttttctactttggcatataatattagaattaatactattttttaatttgttattaggctattagtgcgaaacttccaagttataactatccttgcatttcttactccaattgtgaaaggactatatatagtctgtgtgcttctgtgaatatatttgagtacatttttatcatgctgctgtaatatgtaatgtagtgtagttttcaaagcatgtctgctattgtaattcagtatttatatgcagcaacagattatccagtactgttgcctacatgcttctggccgctgatacttttcattttgctcagttcttcttgcttcggattgcttcctccctgacaccccgatccagatgacggcagcagcgatggcatccacactcaagcgtgcctacctctccatctataactgggtgcaggtgctctactacgtgctgctggatagtttacctggacgtgcgcgtcgccagttgagaggcgtctccatcttgcgcagaccgccgtctgtgtctatcattgatcagttatctgtaacttgccgacgtgttttctaggtcgctagttttgtactttgcctattactgcatgagccattctcgctgaaatgacatgatttagcttttagttcttctggccaaacatgtgttttagccttttgcctttgcttatcaacagttgttttgcttgtttttgagctactgccactttgagctgatgtaggcctgtagttctttattgcaactgagcttctatattgcattgttggaccaattgattgccacctcttagatgtgcattgctgttcttatctctgtactttctagttgtgc

SEQ ID NO: 15964 - DNA, 1065 bp, Triticum aestivum
  Clone ID: PAT_TA_15964
gcaggtggaggcgttcgtgggcgtgggggcgtgtcatgtgtgtgtgtgtttatgtgtgtgagtgcgagacagtgagactggagatatagctaaagaggggcagcctttctttcttcctcacccctcccccctcactctccctctcttcttcctcctccctgggcttaagcttatattgctgctccttcttcttctccacccaccttgagtgaccgagtccctgagctactaggtagaagcagcggggtgtacgtacgtgtggttgagaaggccatggctttccttgtggagaggtgcggggagatggtggtgtccatggagatgggctcgggggcgccagcgccccgcgccggcggcggcgtcgctgggaagccggtgccggcgccgttcctgaccaagacgtaccagctggtggacgacccctgcaccgaccacatcgtgtcgtggggggaggacgacgccaccttcgtcgtctggaggccgcccgagttcgcccgggacctcctccccaactacttcaagcacaacaacttctccagcttcgtccggcagctcaacacctatggattcaggaagatagtggccgacagatgggagttcgccaacgagttcttcaggaagggagcaaagcacctcctcgctgagatccaccggaggaagtcgtcccagccgcctctgccttcaatggtgccgcaccaggccgcgtaccaccaccactaccacctcggcaacaccttctcgccgcctccgcctccaccgccggctgcgcatcatcaccatcacccggtgtaccagcacttccaggaagagccggcggccgcggccacgtcgcacggtggaggcaacggcggcggcgacttcctggcggcgctgtcggaggacaaccgccagctgcggcggcgcaactcgctgctgctgtcggagctggcgcacatgaagaagctctacaacgacatcatctacttcctgcagaaccacgtggcgcccgtcacgagcccctcgtcggtcgcgtcgcagcggcacatgccgctcccgggcaccgcagcggtggccacgtccaactcg

SEQ ID NO: 15965 - DNA, 454 bp, Triticum aestivum
  Clone ID: PAT_TA_15965
gcgccaggcgggcgcccacgcgtccgcccacgcgtccgcccacgcgtccgcccacgcgtccgctcaatctcatcattcttctcaatctcatcgccgccgccccgtctccctcccgcagacctcgccgcctttcatgtcctccgccctctctcctccccagcccctctccctctctagaagagaagagaagagaagagaggagaagagaagagaagagacgagatgcagtcagatcgaccgagcaccgagcggacaggcggcgcgcccagatccatacggccatggggactggagcaccgagcggctgtgcgtctcggcaagggccttgcctcctccgtctccttctttgtgctcggccatgcctagcaggaaggaagaggacgagccttggactcgacggggacggctcctccttccaagacggactttcttctggtgtgaactgagttcgacg

SEQ ID NO: 15966 - DNA, 1165 bp, Triticum aestivum
  Clone ID: PAT_TA_15966
cggccgcgtcgactcggccctctgttgcagcatgtgccgctcaacatgatctgtagaacactgaatggatgcacaagaaaaggaaaaggcagcaaggagggagagggtatttctgtaaggagtgaaattgtgagtgttttctacgcaaccagagaaagcttgctcgtaattcagtcaagaaggggacggtgaagaggaggccgtgaatgtgttgattcaggatccaactggatgatccgctgggcgggggcgctggtaccttcaacagcagcacatcgggggacaaagaagaagattggggctgcctggacgaagatcgggagctgcaccaccactagcagaagcagcagaggcggaggaagatggcaacagcagaagaggccggagtggcggaagggagcgtgccggcggccgaagcggacggcccaggccctgcgagcggcacaggtaggcggcggtgttcacctctgtggcagctgcgcaggtgggcggcggtgctgggtacgcgagcaggatgacgaggagatgccgcccatcagtcgtggagccgccgcccgttgagttgtcgccggagaggagcaggcgggcggctgcgaagcttgcctccgtgtgcgcagtttggcaactgcaggatattggagcgacatggatttgcgatgccggcactgatcttcccgccgagctcacccctcgccatcgccgggaggagacaccactggtcagatacatagtcagtagagcggcctgtctgcctccatacagccatgatgcgaggcacgcaggaggtgctggattggatcaagcgcagaggtgcgggatcgaggcaaggagatgcgcgatcaagccactcgaagcgaggggagacggggtccgtgcccgaggcgattctgcctgacgccatggttcttctagtgaaactgctccggtgaagctgtgtcaccgccggcacgtccatcacaaccactaccgctcaaggtacaagaattcactttgattgcagatccctacagaagtaaatccatggctactggactgttgtgcgtgcttcaccttggttcgtcgaagatgtgtccgctggcatgctgctccttatgcagataatgagaaacaatctaatgatctattttaccactaattacaatgacatgggggtaaatgctgatgc

SEQ ID NO: 15967 - DNA, 555 bp, Triticum aestivum
  unsure (1)..(555): unsure at all n locations
  Clone ID: PAT_TA_15967
gagagagagagagagagaactagggcacagttttgatgcaccattggcatctaccttcgtcgacatgtatgctaagtgtggcaaccttgacgacgcttgcaggatgtttgacagagctcccatgaagaacgttgctctctggacttcaatgctgtgctcctatgcgtcccatgggaaagngtaggatggccatagaactcttcaacaggatgattgcagaaaagatcaaaccaaatgaggtcaccctcgtcggtgttctatctgcctgtagccatggcagattggtcagtgaaggagagcacttcttcaagctaatgcaagaagagtatggaattgttccgagcattgaacattacaattgcatggttgatctttatggttgagctggactgctcaacagaggcacataacttcatcagcgaagacaagattaagcatgaatctattgtctggaagacattactgtcagcttgtcgtgttccccaggacgtggagcatgcaaaacttgcttctgaaagtttgattcaactggagcaatgtgatgctgggtcatat

SEQ ID NO: 15968 - DNA, 540 bp, Triticum aestivum
  unsure (1)..(540): unsure at all n locations
  Clone ID: PAT_TA_15968
cattcagagaccatcatcatgatcatgaggtgcaatattaatagtagtccggccatgaagggttttgctgctaggcttgttatgatctccatgcaggtgtggtcgctcagttgccggccgccgccgccggaccgagtagcaagatggtaaggctggtgccggcgatgtacgtgttgggcgactcgacgctggatgtcggcaacaacaactacctggcggggccgaacgtgcccagggccaacatgcccctcaacggcgtcgacttgcccggcggcgcccgggcaacggggcggttcagcaacggctacaacgtcgccgacttcatcgcaatgaaactgggactgaaggagagtccgccggcgtatctgtcggctggcgccacgccccaccgccttggtcctcagcgctctcgnccggccggcgtgagctatgcttctgccggagccggcatcctgggactccactaacgccgggaacaacatcccgctgtcgaagcaggtgcgctacttgggctccacagggcggnatggaggcangtng

SEQ ID NO: 15969 - DNA, 740 bp, Triticum aestivum
  Clone ID: PAT_TA_15969
cagagcactcgcgagtcgcaggaccaccctcccccacgatgtgtgccgcgtgccggcgagcgaaccttatcggccgcagatgctgaggcgggccatggcgctggcgctgaccctcgccgcggcttgcatgttggccccgcccgcgcaccagccacgcgtgctcctccgccgccggccgcgtgccgcacgtgacgggcggccactcgaagagacgcctcgtgggggtggtggggcccgcctgccactcctctggttccacttccgcttccaagtccaccacgcgcggtccaatcgcctgccgccgccccgacgccaccggagccccaatggccgccgccgccgccgccggagacctgaggtcggagtatctcgaggtgctgctcagccgccgccgcgaacgccaagtgcctatgaccgtggagcaagggagtccggtgaaggagccgctgtaccaaggcaacgggcctctgggactcagagaggccatggagtcgtgcccgaggaaggaggtggagaacttccaggagaagctggtcgaagaaaatttctacctgatgaccgagtcaggtgaacagggacgcctacctgtacttctactgaaacttaatgacactgctcctgaaagaaagcccgttgttgtaatactgcacagctcttacaaatgcaaggagtggttgcgcccactgcttgaggcatatgcctccaggggttatattgctgtcaccattgattctcgttat

SEQ ID NO: 15970 - DNA, 661 bp, Triticum aestivum
  Clone ID: PAT_TA_15970
gccccctctctccttaaaccctcggcgcgagccaaaccaaaatccgacgaccctcccacattccttgcccctctcgcaagccgcgccatgtcccgcatcgcgagggttcgcgcctcgccctcacgctcaggtcctccgccgcccccttctccaccatttcacccgccgccgccgccgccgcatccctcgcttcgaaggaggcgcctgccgccgccgccgcatcttccgctcccaaggaggcggccgccgctggcgatccctccccggcgccgccttcgggggcccgcagctccttccgtctgctcaaggccggtatcttcaccgccgtcaccgccgcgctcggcgccacaggctatgtcacatacgcttattccgtggatgaagtggatcagatgacgcgggagttccggaagaactcgaagctcccaatcagcgaggacttgtccggctttgagaagttcaaggctacggcttattcagaaactgtgaaagttcctgctgctgctattgacctctacttggatgtcaggagccaaattgaagatcaaattcagggatttgttgaaccatcatcagaaaaactccttccagatctacctcctcaagaacagcatgtctttaccatagttctggatctgaatgagactcttgtatactcaga

SEQ ID NO: 15971 - DNA, 822 bp, Triticum aestivum
  Clone ID: PAT_TA_15971
gaagaagaaaaaggccacaaaggtcatgtagccccaaggccccagttgaagcgcaaaaacaaaaaacattcctccgcggggttcaatgctttaccgtgcatggttaccgtgataagacagcaataatgcgccactggtttgacgcaacagagcacactgacaagtggtttatgttcaccgaggaagaagaaaaagtaatcaaaggtcatgtagccccaaggccccagttgaagcgcaaaaacaaaaaacataccttggctgggcacaatgctctaccgatctcaagctccatgaaaactcagactcctgtttcaactgtttgaaggttgatgagctatgctagccgaggaatggggcgctgcagaggatacaagtggctgagctttgctgtagggaagttacgcaagtgcagaagagccgacatatctgaagatgcagtcgcagcattctattccctgggtcatgccacgttttgtctggattggaactttggaagttattatttctacatcgcaattgttctgtacatgttattactagtttaagggaaggtttctgtgaaacatccattgcattggtctgaacaatcatcgtttgaatgttgtcactatggttgtataatcaatcgtcttgtaggatgcatgtaccaacatattgacttcactgtactgtatctggtgatcatgttattactcatgctcctactcttttatgggtatcttatgctactctggatgagagctgtgtatgttatgccacatatgtcaaatctatgcattttaacactgtggtgggtttatgatgtgcaactcaattgttact

SEQ ID NO: 15972 - DNA, 678 bp, Triticum aestivum
  Clone ID: PAT_TA_15972
aaaacacaggccttatctccttgtggtttaggtgacatcctttgtggcaaagcacataagtgggtttctaacggcacagagctatgtcgccttgctggtttctctgtgcaagtttctgatgccagtcctagtgaagttgtcgaaaccttctgctatggcgggaaagcaagtttggattccatctctgatacatggacgtcttcaaaagatcgtccagtattacatggtatggcctcttgggatcttgaagatttcaagagatgggcaaaagaaatgcttgtcggtgaaagaatttcgtgggcagtcggaggaatggttcttacagcaggccttatttttatccagcaaaagagagggctacagccgtcgtcgtaagcaagcttctgtcgctcaaactgtaagaaaaaaatggaatcgggagctaacccgcagcaactgaagcgatgctaggaagacataggcacctgtagcattactaatagatgatttcttggatttgtatttttgccgctctgtggttatattctgatcaactatcaaagattggttgttagactgtgtcctccctatcctggtgcttaggtacaaccaccttttctcaatgttgtgtgaaagaaaagctgaagaggtctttgaattgttgtcgagattctttcttaatgcagttttttactttgg

SEQ ID NO: 15973 - DNA, 710 bp, Triticum aestivum
  Clone ID: PAT_TA_15973
gattcggcacgaggcttcttcgcgtccctcaagcaggtacccaacccacagctgtaatccctcacggccccgccgcgccgcctcccccttctgacgaatggcgatttcctcctcaggtggaagaccggttggcggcggaggagcagcggccggcgccccgacagcccgtcgcgccgccgcttttctcggacaccatgaccgcatccccgctcttcctcggcgcgtcgacggccacggccaccgaccgcggcggcggcgccggcgagagcagtggcccggcgctggacttcctcaccctctccaaagatgaggtgcgcgtgcaggagccccaacaagactccgactccgacgacgaccgcgatagcggggcggacatagcgcggctgatggcgcttatcggcctgtcgccgccgccatggttcggcgacgacggaggcgacagcggcgggtgcgactgcagcggcggcgacgggttcatggcgaacgtcgtcggagtggtcgggcccaagtgcgaaaaggagaagaggagggtggacggctggatccagcattactacggcgacggcggtggcggtgagtgcagggagcccgcgaggctggcgcatctgttggtcgccaaggcctcgtggtcctggggatggagaaggtcccgaggatagagcagccattgcattcccttccgcggtgaaggagttcttggaccgtgacgc

SEQ ID NO: 15974 - DNA, 651 bp, Triticum aestivum
  Clone ID: PAT_TA_15974
gcgtcgacgctcccgcaccaaacgccagcgagtccacctccacctcagccttctcggcagcgagccggcagcctcgtagctgcacgtccctctccgctcctcacctcgcgccgcgcccacactcccgagggagttcgtgctgagctccatggacgagcggtcctccggatcggtcgacgccgatgggttcccctcctcgcgtcgggaaggattcgggcatagtaaatccacaactgcaacttctagtcgttttagagggcaagatcacgcttttgtaagatcatactccgataggttgcttaagtgtgacctcacgttggatatgctatcagaaaatgagaagatgaagataattgagaaattggtaaagatccagaaagatggcacactggaggtagatgtgacccgtagtgcccttgttgcatcagaactctcagagattgatgcttttggttctgtgccacgtgatgttgaagaagttgggtgtggatttagcaagtctgtcccgaagttgaagattgctatacttgtcgttggaacacgaggggatgttcagccgtttatagcattagctaaaagacttcaggaatttggacaccatgttagattggcatctcatgtcaacttccgtccttttgtgaagtcagctgg

SEQ ID NO: 15975 - DNA, 788 bp, Triticum aestivum
  Clone ID: PAT_TA_15975
cgaccaccacgcgggcgacctcctccacaccaagctcggatctggcagcaccggcctcagatctggtcaccctggtcgcatcgcccctcctcatctcactgagctccgcctcggctccggcgagaggccatcgtctccatcacatccaccctccccccccgcgcgcaagcgccgccagaggctgacagcgagccaccaccagtgtccacttcagttcggcaccaacaaagtccggctgcggcgcgcgcctcccgcacgccccccggcccctggcggccgctgcgttgcaggatgcatcgcaaaacagctgggcagctcgcatggtggagttctgagctgcagtgcactccggtggaggccgtggtgcactctcatcgcgtcccaccactgtagcgtcaaggccagggcggtcatcacgacaacgagcccccccgggtcaactccatcatgcctcctcttgcgcgtgcagtgcacaccttgccgcatagcagtttgccaccccatttctcgatcacggtgctgtccacgccgtcgtcgtagacgacaccagcgccttgcagttcaatggctccgggcgagcagtgcaggttgctcttcacttcaccccggttgggtcatccgtgcaatacacagcgccttgagaggacgatgggcatacagttccctggcatgtgggagttcggtttccgtttgtgcgacgctacagtgtgtatgcttgtgccatgcattttacttgcttcactgccatcgtgcacttgtgtgcagttcgtctggttttcatgatctcg

SEQ ID NO: 15976 - DNA, 744 bp, Triticum aestivum
  Clone ID: PAT_TA_15976
cgtccgcccacgcgtccggcacaacccttcttcgtctcgttcgtgctagggcaggttgttagtcaggagcggcggagatggagggcatgaggaggttcgtcaacccgctgaagctcaacgtgcagaagatggagctggagctcacctgccccgtctgcctgaagttgctcagcgcgcccacgatgctgccgtgttgccacacatgctgcagcaaatgtgccactccgcaggctatgaatggccacagctgcgccatttgcaagctagcctaccatcctcaagatttaagacatgcttctcaaattgaggcattggtgaacattcagaggagcataagctctacggtcagcagcatgtctctgcagctcgggactcaaccagacattcatgttgcaaaggctacttctcaaggaactccagaatcaggaacgacaagttcttacaacctggatgcttcaaagctgccatgtaaccaagcatctggacctgcagatgaaaatgctggcggtgtgcaagcaatggatcctgcaccaggaaacagaactaatgatgtggcagttgagccaacggttattgtacagacaggaccgtgtgggtctcaaactcctgttggctctggggatctggaatgtgatagcaatgaccttgaaggagagttgataacaagcggatcacctcctcagagtactttgaaaagagggccaaatgtaacagatgacagtactagaggactgaagaggcaaa

SEQ ID NO: 15977 - DNA, 864 bp, Triticum aestivum
  Clone ID: PAT_TA_15977
gaagcactgaagaagcagagggtgtcaagcatggcgtccaagggtcttcttgtgtttgctctcctgcttgctgctgctatcctcgtcgcctcaactgaacaaactcaggccaagaaggaggagaagaaagccggtgtagagggctacggcggcggcggcggctaccctggaggcggcgggggaggctacccaggccacggtggaggaggaggcggcggctatccaggacacggtggaggaggaggcggcggctatccaggacacggtggaggaggtggcggaggctacccaggccacggtggaggaggcggcggcggctacccaggccacggtggaggaggcggcggcggctacccaggccacggtggaggaggcggcggcgggtacccgggccacggtggaggaggtggcggcggcggcggctaccccggacacggcggtggcggcggcggtggctaccccggacacggcggacgcggcggcggcagtggatgtcaatggggctgttgcggtaacgggtaccatggctgccgctgctgtgcgcgcgcggacgaggtcccggagcccatgtaccgcgcggaggtccgcaactgagcacactaggtgcagccatacgtaacgtacctacgcgtgtgtgcaactcagtgacgttgctctgcgcacgtttatagtaagttgctggtaaatatggtctcttgataaataaactgtgtacgtaaacgtacgagagcccggtttgctctttgcacattggtgatcttggagaacacacccctctgtgttcttgtatgtaattatgtataaaccccccactttatatgtgttatccatgtactgtatgtatcaatttccatgtttcctgtt

SEQ ID NO: 15978 - DNA, 1083 bp, Triticum aestivum
  Clone ID: PAT_TA_15978
ctggcggccgcctacccgtccgcccacgcgtccgaccacgcgacggccatctcaccgatgctgtactagccactacgaccgcttaagcagaggccgcgaggcacggatcacggtggtcaggcacgggatgccaagaagggtgttcatgtgtctactcgggtgcgtgcggctgctgctatcgtcgttcccccgccccacgaacacacagaggcagggcaggaagaagatggagagggcggggggagggtcctccggcttggcggcggccggcgcgggcaggccgggggcgggggccgctggatcggagggagaggggggggggggctacccaggggccgccgagggggcggacggcggctctccggcacccctgcgcggggtgggtcagggcgtggagggtaaggcggcggtggggggtgccctggacccggtgaatgaggccgtggaggttgggggcgccgggctggctaccgaagcggcgggggcggctgccgcgtacgcggcggacgccggggacgggggtggaggtggcggccgaggccacggcggcggcggctgttgctggctctgctggtccccggggctggcagccatccatggctgccccggacgtgggggcgggagtgctggtccgtggctgacctacggggcgctgtgggagctcgacaactgtgtacacgctcatgtggaaatataggaattaaacccgtccgcaatgtacggggtggatgcccggcgacgaacctcacgtggttcatacatccgcgtgcgccgccgtcgttcagcactacatgacgcatcttctaagaacgtacattgggatccaggataaattgggtctctgatagttcagctgcgtacgtatacctacgcgagcttgggtggttatatgcaccctgatcatagttgttaaatctttgtagaacttatgtctcgtatcttctcagttcccattattttttgtgttgcaataaaatcacaataggaatctacccgaaattctttaaaaaaaaaaaagttccttctgtatgccgtatttcaatgcagcgaagaaaatagatgaaaataacagacaaagaaatg

SEQ ID NO: 15979 - DNA, 1117 bp, Triticum aestivum
  Clone ID: PAT_TA_15979
ctcccccggtcttatccgcccgacgaaatggaagcctgcgcctccaccagccgcgtcctcctcccggccccgccccgcgcgtcgctccgcgccgccgcccggccccgccgcgccgccgccggggccggggcgggcgcggggacggggtactcgcaggcgagctactacacctcgctggggctcttcgtgctctccgtgccggggctctggtcgctcatcaagcgctccgtcaagtccaagattgtgcagaagaccttcgtcagggagggaagggcagccgacggcgccgagcctggtggcaggggagatcctctccttcttcacgcgcaacagtttcgccgtctctgaccgtggcgaggtcatcaccttcgagggctcaatgacaccaagcagcgctcaggcagcactgctgaccttctgcaccgtcattagcctggggagcgtcgggcttgttctgtcgatcgcagtcccagaaggcggcaacaactggttctggcttatgaccttaagccccttggcgggagtgtactactggacaaaagcatcgaggaaagaggagatcaaggtgaagatggtcttgtccgacgacgggaacaacgtgtccgagattctggtgcggggcgacgatgtgcaggtcgagcagatgaggagggagctcaagatgagcgagaaggggatgatatacgtgaaggggatattcgagacatgaccaatagctttgatgtctggagtatagtgaccaagcaagcagttcaaaccaggctttcctgtgacgcgatgcaaagtgaaggtgagagaggagttgagggtgggtttcggtatccacgggcaaatctgtgtcttggcttcgagaaaaagagatggtttttgtcgggatttcggtatggctcctaggtccaaatgatcccagtatctgtaccatgtttgtatatcagctacaactaatgaattacactcacaatgatacatctacaatgtatgcggtctaacagagaaccctagaccatgtgtgtaaaaaaaaaaaaaaaaaaagggcggcgcgggcaatcctcaactcaagaggattggaggggattgggcaaggattgggttcatattttgacttaaaaaaaaaaaa

SEQ ID NO: 15980 - DNA, 636 bp, Triticum aestivum
  Clone ID: PAT_TA_15980
cggcacgagtcggcgatgttctcgcctgatctggagaacgacaagccctatgtcggcatcatcaagggtataattgcgtccgatgggagcttatccgtaagtgctcagtggttttatagaccagaagaagccgagaaagagggtggtgacccaagggagttattttatagttttcatattgatgaagtgccagcagagtcagttatgcacatgtgtgtggtccatttcattcctgagcacaagcaggtgccaagtaaaaaggaacaccctggattcattgtccaacaggtgtatgaccacagagaggagaagatgtataaaataacggataaggactatgaggatgacaagcagcatcagattgatctccttattatgaaaacaatagaccgtattgggaggcttccagatcgtgatcctgaagatatacctggtgacaacactgataaattatcaagacgaggcttgcggaagagacctctgaagcctaaagatgttccaagagatgcttctacaggcatatctgagcaattcagaagagaagatacacccgtgaatgataatctgaagtattttgccatccttgtcagacatgaagtgattactggtaaccagtatcgtgattggtggcttgat

SEQ ID NO: 15981 - DNA, 1183 bp, Triticum aestivum
  unsure (1)..(1183): unsure at all n locations
  Clone ID: PAT_TA_15981
ttnnnncggccgcccgggcaggccgctccctttccccttcgtcttcgtcttcgtcttcgccgggtcaggtggatcagcggccggcactgacgatgtcgtccctcaactcgctcttcaaccgctcctcccccttcggcaccaaatgcaaaacatgcttgaatttgatcatttcgaggatcaagctgctgcgcaataggagggaaatgcaactgataaatatgcgcaaagagatggttcagtatcttcagacaggccaagagtctattgcgaggattcgggtggagcatattattcgggagcaaaatatattggctgcctatgagattgtcgagcttttctgtgaatttgttctggcacgagtccctattgttgaggcccaaaaggaatgccccatagaattgagagaagcaatagctagtataatctttgcatcaggaagatgctcagacttgcctgagctaatgcatctccgtaatttgtttaccaccaagtatgggaaggagtttgttgctgctgctatggaattgcgccctgattgcggtgttaatcgcacaataattgagaagctttcagttaaggctccatcagcggaatcaaagttgaaggttttgaaagctattgctcacgagtacaatcttgactgggattcatctaataccgaagcagaattcaataagaaatacgaagatctgctggatgattctggatcatcagtccgccaaggccaaacacctgcaattgagagctctccagcctcttccatttccaaagataagccatcgattctacctgtcaacgacacaagcaaaaacagaactcccgagtccccaaagtcacctgctgtgagttcaagagcatatgctgccaccaagagtaatgtggccagtcaagagcatcagccccctgctgcggagagatcatcctgcgctggtccaggctccgtcggacgtgctagaaaaaggccccgaagctgccattgccgcgggccacccgcccctcccccccgccccctgccccggcgcacgcgtgtacaagccttactacacccggtgttctaggccgctgtcgtcgccgggttgccgccccccgcctggtccaagggcacctttgttccccgcacatccctatgtctggcccccggattgcttcctgggtgcatgtacactttttcaaaaaaaaaaaa

SEQ ID NO: 15982 - DNA, 400 bp, Triticum aestivum
  Clone ID: PAT_TA_15982
cgtccgcttcacttccccctcgccttctcctgccctcccctcctgatcggagtctcagccgtggcagccatggcgaagacctaccccgttgtcagcgccgagtaccaggaggccgtcgagaaggccaggcaaaagctccgcgccctcatcgccgagaagaactgctccccgctcatgctccgcctcgcgtggcactccgctgggaccttcgacgtgtcgtccaagacaggcggcccgttcgggacgatgaagaagccggcggagcaggcgcacgccgtcaacgcgggcctggacatcgccgggcggatgctcgagcccatcaaggaggagatccccaccatctcctacgctgatctataccagcttgcgggagttgtcgcggtggaagtgttcggtgggc

SEQ ID NO: 15983 - DNA, 515 bp, Triticum aestivum
  unsure (1)..(515): unsure at all n locations
  Clone ID: PAT_TA_15983
ccgggctgcaggaatcggcacgaggcgtacatgcacggatgttccaacaactgctggatacatcatattcaaggacagcattcgagttcaccctttatcaagttattgttttctttatcactctgggattaaaggtgaaaatgcttcacaaatccatcacatgcttctcactggtggtgtattccaagctggcctgcccatcgtatttttcatcatgtttcctngatgttggataaatctaatagtcaagcagtagccctgtatccaatgaagttgtatttttctagaacaaaaaactgtactggtatacagttcagtgaagttgcaatgtttcctgatgtgcaaccacttaagtgtcacctgtttttttttacagcattctcaacattaccttccagctcatatttcattggtttgatcgatccaatataatagtctgcgtgtgcttaaaatcccagcaggacttatgagtcagcaacatcctctgcaccacatcaagattttactggatgcca

SEQ ID NO: 15984 - DNA, 545 bp, Triticum aestivum
  Clone ID: PAT_TA_15984
gcggcctcgtcgttggttcgatcccggcggcggagggaggcaaccccgtccgcctcgttgggtggttcccggctgtggtgggaggcaaccctgtctgccttgtcggttgcttccttgtgaagaacgtgcctgcagctgcttccggtaggaggtgaagggaggcagcaaagttacctggagcaggggaggccaaatcctccaagcgagcacattacttgaggaacctcgccggtgacgactgcgcccattggccatcgcatctgaggggtcggcggcggcagagggaggcaaaccagtccgcatccttggttggttccccgcagtgcaaggaggcaaccccggctgccttgtaggtttcttccttgtggcgtggtgcctgcagcttgttcctgtaggaggtgaagagagacatcagagttacctggtgcagggtgcgaaagggggaggctgaatcctcttaagcaatcacaatcatgtctacgagtacaaaacaggctgatcgggagctgaaaaagttccacgatgcacaatgtgaagcatataga

SEQ ID NO: 15985 - DNA, 431 bp, Triticum aestivum
  Clone ID: PAT_TA_15985
cgtccgcccacgcgtccgcggacgcgtgggttacaattggtcattcccgctttccattaatgggggaatgaagatacagattctggattacaacaataaaggaggcaaagaaggagagcaatgagtcggggcattagcgggaaatccactgtgaatgctcgccattgaaacactcgctatgagacaaaaacttgctaccaccatactaacaacaacaaccaaagagttaaacatggtacacgacaaataactagaatatgaaactagactcgagaatttgcacacacaaaaacaactaatcaaggcagacagtggcttaggcatcaacaaggtagttcaacaccaggatcatcaaacacacaagcttcagtcagccgccttgccagagttgccgcaacattcatcagctcgtacacacctttcagcagttt

SEQ ID NO: 15986 - DNA, 553 bp, Triticum aestivum
  Clone ID: PAT_TA_15986
ggatcatgcacagcgaccagctcaggtaccttgacaaggccgcgacggtcacctgagtgaggactactgcgagccggagaggatgaaggacccgtggcggctctgcaccgtgacgcaggtggaggaggtgaagtgcatcctcaagatgctgcccatctggatgtgcaccattgtctactcggtggtgttcacgcagatggcgtcgctgttcgtggagcaagggaccaccatggacaccaacatcgggtcgttccacgtgccggccgcgagcatgtcggtgttcgacatcctcagcgttctggcgttcatcgccatctaccggcgtgtgctggtgccggtcatggcgaggctgtccgggaacccgcagggtctgacggagctgcagcgtatgggcgtcgggctcgtgatcggcatgggggcgatggtggtggcgggcgtcgtgcaggtggagcggctgaagcgggtggccgcgccggaccagccgagctccctgagcgtgctgtggcaggtgccgcagtacgcgctgatcggggcttcggaggtgttcatgtac

SEQ ID NO: 15987 - DNA, 579 bp, Triticum aestivum
  unsure (1)..(579): unsure at all n locations
  Clone ID: PAT_TA_15987
actcgcacccgtgggcccatcaagttcacatcaaatgtcagcagggtcccaccactgccatcaatgttcacagccaacacgcctgccattgccattgccagtgccttcgaatccaaatccagttcttccactaacattaccacgaggtttgactacgacatctagtgtttcctccagctgcgtccagtgtgttggccaagtaaaggtgttgggccttgcgcaccagactcgccgcagtcagattctgatgcagaatcactggatcaatttctaaccagtattggggtgcccagtgatccccgtggcgtggcggctcctgaagtgatatgcctatctgatgatgaagagaccgatgaccaaaccaagcaagaaacgccgctcgtcgctgaagtgccccaacagaaggttccttgcaagtttttggtcaaaggtgatgnttgtaaacaagaaatattgatgcccagatcgattttataatcanaatttgtgntgnactccttgtttctactagagactttgagtacatgtactcggcgcgacacgctaatcgattccgcggcgcatggcgggggagcatgc

SEQ ID NO: 15988 - DNA, 515 bp, Triticum aestivum
  Clone ID: PAT_TA_15988
gcgtgttcaaaacgaacctacacggcgtcctgggcatggagcaggcgccgtgcgtggtggtacagaccccccgtccgccctacgcgtcggccaacgtcgccgcctacctcaaggcccacctcggcgggcgcaccaccatcgagcccctgccgacggagggccacctcccccacctcagcgcccccagcctcctcgcccaggtgctccgccgcgcgctcgcccggttctagcatcgctagagaaaagcaaagagagagaagaaattactgctgctgcctctgctggtttcaccgacccgcgcgtacacggggtaggaggacacgcgcaaagtctaccccgtatttcttctctgtatttttaccgcatcgatttttacttgcctcaaagactcggaagaaaatgccaggagtgtgtcctgtagcacgtatgagcactcgaaatatttctcgaggcgtacgagtactcatcagttttcatctctatcttttcgctgagaagaaaagttttgtcttttc

SEQ ID NO: 15989 - DNA, 653 bp, Triticum aestivum
  Clone ID: PAT_TA_15989
tccgcgaccagaagaaaccacagggagcagagcaagcgaggggaataaagcagaggaggggagagagaggtagccaagaacgccatggcctccgctgcttgctagctagctagccagccagccagtagtatataaggagcggcaccgcccgtgcgacccagccctgtatcccaggtccgtcgtctcatgctccggtccacgcatcccctcagccccagcagcggcggcagcggaggtagctcggctccggcgtctagctccggcgaggcgatggtggggggcgcgccgagcggggcgaagctgctgcagatcctgaacgtgcgggtggtgggcaccggcgagcgcgtggtggtgctgtcgcacggcttcggcacggaccagtcggcgtggagccgcgtgctgccgtacctcatccgcgagcaccgcgtggtgctctacgacctcgtctgcgccggcagcgtcaacccggaccacttcgacttccgccgctacaacaacctggacgcctacgtggacgacctgctcgccatcctcgacgcgctccgcatcccgcgctgcgccctcgtcggccactccgtctccgccatgatcgggatcctcgccttccatccgccggcccgaccttcttcggcaagcgtcgtccttcatcgggc

SEQ ID NO: 15990 - DNA, 1889 bp, Triticum aestivum
  Clone ID: PAT_TA_15990
gccggccggttcgggatcatccactattctacacctcctaaacggaaacaaaacaaaactctctcgtcgcccacaccacaccaaaccagaccaggaaagaaatccagaggggagcagagcaagcgaggggaataaagcagaggaggggagaggcctccgccgctcgagaggtagccaaccgaacgccatggcctccgctgcttgctagctagccagccagtagtatataaggagcggcaccgcctgctgcgacccacgccttatcccaggtccgtcgtctcatgctccggtccacgcacccgctcagccccagcagcagcagctcggccccggcgtccagctccggcgagacgatggtggggggcgcgccgagcggggcgaagctgctgcagatcctgaacgtgcgcgtggtgggcaccggcgagcgcgtggtggtgctgtcgcacggcttcggcacggaccagtcggcgtggagccgcgtgctgccgtacctcatccgtgagcaccgcgtggtgctctacgacctcgtctgcgccggcagcgtcaacccggaccacttcgacttccgccgctacaacaacctggacgcctacgtggacgacctcctctccatcctcgacgcgctccgcatcccgcgctgcgccttcgtcggccactccgtctccgccatgatcggcatcctcgcctccatccgccgccccgacctcttcgccaagctcgtcctcatcggcgcctcgcctaggttcttgaacgacagcgactaccacggcgggttcgagctggaggagatccagcaggtgttccaggcgatgtcggccaactacgaggcgtgggccaaggggtacgcgccgctggcggtgggcgcggacgtgccggcggcggtgcaggagttcagccggacgctgttcaacatgcggccggacatctggacctccgccgcgtggagcgtgttcaagaggagccccgcggcgtgctgggcatggtgcaggcgccgtgcgtggtggtgcagaccacccgcgacgtctccgtgccggccaacgtggccgcctacctcagggcccacctcggcgggcgcaccacctcgagcccctgccgacggagggccacctcccccacctcagcgcccccagcctcctcgcccaggtgctccgccgcgcgctcgcccggttctagcacgagaaaaaagtgagagagaagatattattgccgctgcctgctggtttgggctacgaggacacgcgcacgggctcccccccatatctcctctgtgtttttaccgccgcgatctcatgtatttgtacagacctcatagaatcggaagaaaatgccaggagtgtgtcctgtagcacgtatgagcactcgaaatagtgtctcggggcgtaccagtactcatcagttttcgtttctatcagaagaaaaataaggtatcttgtaccgaaaataacgaagttgacctagctcccatctaggagccgagccgagcgtacgcgtaccgaactggccccggcggtgactcgtactacgcgatcatcttgtcatctgctcgggcgtgacaagacattcgcaggcagcggcgtgtcgcgctgctccactgcacctaccagactactttactgggtttattatccagccactatcaaaaaaaaatctcattttgtaacatcaagttgcacggggtacgtacgtactactcgtatttgattaggaaaaagataggcttggtctaacacgagccgtttttattaaaaaaaaaaaaaaaaaaaaaaaaaaactctctatcttttcgctgagaagaaaagttttgtcttttcactgcgtttgcactagcaccggcgacgtctcatgaatggactggcgggtggggcccgcactgagagttcgagactgtg

SEQ ID NO: 15991 - DNA, 585 bp, Triticum aestivum
  Clone ID: PAT_TA_15991
tgcatgaacctcaacgggtggggaggcgatgctgttcatcgggctgaacgcggccatcagcgtgcgcgtgtccaacgagctgggctccggccgtccgcgggcggcgaagcacgccgtggcgtcggtcatcgcccagtccctgctcatcggcctgctcgccatggcgctcatcctggcctaccgcaacagcttcgcggcgctcttcacgggcgaccgggccatgcaggccgccgtggggagggtggcgtacctgctggcggtcaccatggtgctcaacagcgtgcagccggtgatctccggggtggccatcggcggcgggtggcaggcgctggtggcgtacatcaacctgggctgctactacgcgttcgggctccccctcgggttctgcctcggctacctcctccggctcggcccccagggcatctgggcggggatgctgtgcgggacggcgctgcagacggcggtcctgctcgccgtcatctggaacacggactgggaggacgaggccgcgcaggcgaacgaacggatcagcgcgtgggccggcgagagcaagcagctggttcatggggacgccggcgccggcga

SEQ ID NO: 15992 - DNA, 535 bp, Triticum aestivum
  Clone ID: PAT_TA_15992
atcccattccccccgcgagccggaaagccctagcccgcaggagccgccgccgccgccgccgccgccgcctcctcctcctcgcaggctctccgtcacgctcgcccctctccggccctgggatgattctctctacccggtcctgtctgtgttcaccctcttcgtccgcttgacgcctgcagcacccttctcgtcggtacctctctgattctttcacctccacatctctctccgccgggtacaaagatggcgcaccagaggaggatatcacagtttggcagcgttataacaaattactgttggatgctgttggcatcttcgggtttcttcttaggcgtattcgcagtgactactattgcccctgtacatcctagattgatgatccctgttcctggcacagctgattgttccactgcttgtcccattgattgtgtgtgctcaccatccacatcaacaacggttgcggataggctgaaatatgatattgctatctggaataggtttcttattgcgttctgtctatcagcagtgtaccttg

SEQ ID NO: 15993 - DNA, 881 bp, Triticum aestivum
  unsure (1)..(881): unsure at all n locations
  Clone ID: PAT_TA_15993
cccacgcgtccgcttgtagctttttctattatggttctgtttccttatatataattccccacgttctatgggtccattgatgtgtagggcaggtaattgtagacacaagtaatgagattggtggggatggggacattcctcatgctgcaattggtggcgcaagaagaatgcaagtacctgaaccatcaatgcaacatagagtgatgattgaagcagttgaaaaccatatgcctgaggtggtcattgtggacgagattggaactgaggcagaggcgcaagcctgtcggtcaattgcagaaaggggtgtaatgcttattggtactgcccatggagaaaggcttgcaaacatcataaagaatccagttttatctgacttggttggaggagtagaaactgtcactcttggtgatgaggaagcacgtgcacgacgtactcaaaaaagtatactggagcggaaggcccctccaacatttccttttcttattgagatgagggagcgtcactattgggtcactcatcggactgagaggagtgtcgatatgctacttcatggcaagaagccactagttgaggtcaggaaaagggataacgagtttgaggttgtcattgaaagatgggcaacatatgatggagatggactctgaatcccaaatttcaagttattatttcttctgccatgcttccttttcttcatacttgcggtctttgtggatatttggtacaaattctatggagcttgttattaaaaggtagaatggagagatcctggttcctaaagtttgttgagcttatttagcagagtataaaataatgatattgtactctgcaaaggaactgatgctgcccattaagctaggacacacccatacntttcaanaaaa

SEQ ID NO: 15994 - DNA, 698 bp, Triticum aestivum
  Clone ID: PAT_TA_15994
gcccgtccccacccccacccgcctctacccatgtagcagcgccccccccagagagcgcgccggaggtcctcgtcgcgcgggccgtgccggcgcaggggcactacttcatcccgcacccgcagcactacatgcacgcgcatttcctgatgccaggcggccacgaggcggacgccgccgtcccgagcagctccagcggcaacagcaacggccacagcaatggccacagcggcggcaccggcgacgagatggccatggcgatggcggcggcggcggaggcgcacgcggcggggtgcatgctgccgctctccgtgttcaactagcgagctttccggccgcatccatggatgcgatcctagcaaaagcaatcgcaaggtagggcttaagtaagttaattcggaggtctatatatctagccgtaatcttgatcgatcattggaacgatggaaggatgagtgtcatcgagatcgatcgatgaacgtactattgttcttcttaccaacactattcacccttttggctacatttcctgctgggagctagtggtgctcctcctccttgctactgtagggtttctactttctagcagcgttcgtgcaggcttggttgatttgtgtatgcagatataattaatccaaggctcgattgaaatgtcaaggggatttccactgctaaaaaaaaaaaagtcgacgcggccgcga

SEQ ID NO: 15995 - DNA, 526 bp, Triticum aestivum
  Clone ID: PAT_TA_15995
catctaacgaactgatgctaggcttgcaaataatggtttgcccctggatatccagaagttgcgttgccgagttaactatagcttcactagaagttcacaccccaaattgaagagttgggtagacgagtagattcgaattctccgcaaaaatggccctttcttggttctacatttacgatatgaaatggatatgctggcgttctctggctgtactgaaggttgcacacgtgaagaggcagatgagctcaccaggatgagataatgcttacccatggtggacaagagaaagtcattgactcttatgtgaaaagaaaagatggcttttgcccattgacgcctgaggagattgctcttgtcctcagagcattggagattgacagaagtatgcaaatatatattgcggctggagaaatatatggcggcgaacgtagaatggcttctcttacttcagcgtatcccagtgtggtgagaaaggagacgctcttggaaccgtctgatctcaggttctttcagaaccattcatcac

SEQ ID NO: 15996 - DNA, 933 bp, Triticum aestivum
  unsure (1)..(933): unsure at all n locations
  Clone ID: PAT_TA_15996
gcctcgtgccgaattcggcacgaggctcaatcggcacgagcgtgacttgagaggattggatgaggcgcgccgcgtgcggtggccgacggcgagaaggcgcaagcaagcaagcagcgacacgccctcgcactcgcggcggcggattcgtggacagcatcgccagacaggggctcgcggcgaggcggccggcggtctgcggcatccgtcgcccggcgctccgcgtcctccgcggtgcggcgctgcagcaggacgggaagctctgacgcagcgaccaacataagggaaattcacaagggtgggaatccttgtggccaaccggctagcngggacggangccgtggcgccctgcccccgccctgctcgtcccatcgccctggccccccggcccgccccgggcgccccccctggcctggcggggcgccgcccgcggccggccaccattgtcgtgtccctccacccccagctcgctgccattcaggcctaactgcttccagttccctcgtccgtgccacacaggcgtggtggcacaccggcgcagagcgtacccaaggatcgaggccacggcgaggcacggcgcgcggaaggagaacgccaaggtcaggaaccgccggctgcagaaaaagtacaatggcactacgaccaagcccaggctgtccgtcttctgctccaacaggcagctctacgccatgctcgtcgaccaccacgcgcagaagatcctcttcttacgcccggcaccctccaggaggaaatccgcggcgaccctccatgcagcaccgtgcaggccgctcggaggcgctcggggaggagctcgtccaggcgtgtatagagctcgacatctcccaggtctcgtgctacgaccgcaacgggttcgcccgaggggagaagatgatcgcgttcgaggacccggtcgcgcagcacgggttcctgcccgga

SEQ ID NO: 15997 - DNA, 459 bp, Triticum aestivum
  Clone ID: PAT_TA_15997
tttttttttttttttttttctataaataacatttagcacgtccgcggacgcgtgggttttgatataaatacatattaaattataatctcataacataacaaaaattagtggtcacaatttggtgtttttagacatagtgccacatcacaatatataataacatgggcaccacataacaaaaaaaattgggtacaaaagatggtgttaactttatccatggtccttataaatttttcttctttagcttcggtatgccactttgctctgacgggaagtgggggatctatgtgctggtaaattgatagaaagagaagcaagaagcccatgttctcccaaatcgagtatatcccagtcctgaaaggtgtatccaatgacattgaccactcatatttttaagatgacctgctttgttgcataatagaagtagcgcatcagcgacatcgctggcacctgatattg

SEQ ID NO: 15998 - DNA, 725 bp, Triticum aestivum
  unsure (1)..(725): unsure at all n locations
  Clone ID: PAT_TA_15998
gggcangccgtccccagggcgtggtgagcaccacgggaggcgcgtctgcgtcgcagtggccgcgtccatgggcgtgctgatcgccacgcgcgcctcttccagcggcgctgtgaccccgtccagcggtgcgacggccgaagcgacgaccggcggccatttgccacggatcagacagaggaagaagttcgcttccggcgtcatctgacgccgtcgcgattgagggctggccgctagcgctgccaccaatatcgagggcccctattcgtgcgtaaacagaagaatttgaagaactccagggtaccttctcttgaatcgaaggaacaaacatgattgagttcgttgcattctccttttcttcttctcgttcttcatgttcttgactgcggccatcgatccatattattcatctctcgttccggtgtgttcttccgttcttgtcatgctcttgtcattctcttggtagagacagtgctgataacgtgtttagaattgagatcgagagaggaacgagagacaaacaccaagatgtaaaagtaaactcttgttctcattgatgatgggattacacatatatatatagcccctgaaggggtgcgaccgaagggatgtgaggcaaccgcctcggttagaaaagcagggattaataggattaattaaatcctaacacccatttcaggcatggtactctgtttctgaaatatactttaataagtttcctttatttc

SEQ ID NO: 15999 - DNA, 748 bp, Triticum aestivum
  Clone ID: PAT_TA_15999
cgtccgcggacgcgtgggtcctgcctcacgtcaccgccgccgccgccgtcggcatcagccccaacctcatgggctacgcctccaagcgcctccacgccagcgtcctggcggtggaggccgggcaggacgcggtgatcaggatgctgctgtaccagcgcgccgacgagacggtggcgccctacaagggccgcacggtggccgagttcacgcgccggatctccgactggcgcaacgacctgtccggctgcggcgccaaggacgagggagtcaaggtgctggaccggcaccagggcgccgagcggcgcaccatcagcaacatcctcggcgccggcgtggactcgcttgggtaccagcgcaccccggcggaggcgctgcgcatcctctacggctctcgcaacgagcaggtccccggcgggttcctgccccagggcgccaacggcaccatcgccagaggatttgtccagctcgcatagatgtcgctgcagctcgaggaatcacccggtggccggtgcttccattccacctctttcatgctacccatgaactgatattctagaccaacttcagtttacagctcgagaaacaaaactataatctattgcgaatagtgtactttgttagcactactcatactctgatttggcattgtctgttccttatatgctgtggatcgagcttcaaatgaaatgctgggccatcttaaaaaaaaaaaaaaaaaaaaaaaaaaaaaaaaaaaaaaaaaaaaaaa

SEQ ID NO: 16000 - DNA, 787 bp, Triticum aestivum
  Clone ID: PAT_TA_16000
ggcacacgatgtggtgtggcgcgcgtggctgtgcagttgcatcacccccgccccctaacaaccatgaacaacaacgaggctagcagtggacacagccgagcatccctctcctctgctcccttccacaacctacatccatgaaggtgcctgtgagtctgtgatgatgagttcattctctggtggcaagttctgcggttgaggctgcgcgtcccggcccgggggtcccggctcgccccccgcggccgcgttgtggtccagcaggtgaggtgcacgaggatagtgacgatggctgaacctccctaagaaaagaacatggttgaggaccgactagctatcgaggaggcagctgatactgaagatgctacctccataacagtgttatcccctcttattctacggacgagctgaacagaactgcggtcatcccaagcccgctgccgaggaggccgatgagtgcgcccacagcatcaccgcctacctcaacctcgtgtcgggcgactgctatggggacaacaccgtcgcctcctccatcgtgcagggagaaaactaatgattttctcaggaaggaatcacaagatttgtggtgggccttagacagcccttgaagaactttagagggaaagaagttcaatcattgtgaagtgaaggcattctggttgatgttgtggcgaagatctctagtgcaaaattctcaaggcgagaagaggatgaggatctccatccctgcccccatgcagttcactcgacgcacccgtgtggtgcgaagtgcatctacatgcaatccact

SEQ ID NO: 16001 - DNA, 679 bp, Triticum aestivum
  Clone ID: PAT_TA_16001
ttgataaacctcaacatcgattgtagcattggtgaccttgctgccctggagagcttagttagttcattggtactgaaaggagagatttcatccaacacgatgtcagctttgtggcgttatttttgcttcaacatcaacggtgtaaggccagtgcaatgccgtggagctttatcaattctttgcatggccgcaaagtcatctcctagcattctgggtactcacttgcaagatattgttgacattgggtttgggcgcttggctaaggaagagcctctacttgctagaactgcatgccttgccctgcaaagattatcagaagaagacaagatcaaattactaagtactagtaccagagtatttgctgcactgcaaagcttggtaactagcttctcgcttccggagaaaatatggtatggagcaacagataaagctataagtgccatatataccttacaccctgcacctgaaatctttgctgctgagattgcaaagaaatccctcagttctgtattcagtgccttaggaatggatggcgtgtctaatggagtggaacttgaaactcagaatagttccacaattacggagttatcagccatgaagttgggtagatttctttttgtcattagtcatatagcactcaaccatttggttacattgagacttctgttagaaaatcaca

SEQ ID NO: 16002 - DNA, 710 bp, Triticum aestivum
  Clone ID: PAT_TA_16002
cccgggccttgacgacacgtccggtcctcgcaggtggaataccttgatgctatctcccctcccacaggctagagtttctcccaaggcgcccaatcacaagggtacgaaatccggataggggcgccgccgcatcccgggacgagatttcactccggcaccgccccccagcctcgcatcggtgatccgctggtggcgcgcgtagggtttccggcggaatttttcgcgaggggattcgccgagggcggcggccgagatgatccggttgcagacgtacgccgtgttcagcctgctggcgacgataacgtcggtgtactatgcgttcagcagcagggagcagttctacccggccatggtctacctctccacctccaagatatgcttcgtgctgctcctcaacacgggcctcgtcgccatgtgcgtcgcctggcagctcgtgaagcgcgtcttcctggggacgctccgggaggccgaggtcgagcggctcaacgagcagtcgtggcgtgaggtcgtggagatcctcttcgcggtcaccatcttccgccaggatttctccgtctctttcctcgccatggtcgccgccctgctcctcgtcaaggctctgcactggcttgcgcagaagagggtcgagtacattgagaccacaccctccgtgccaatgctgtcgcacataaggatcgtgtccttcatgctattccttcttgtcgtcgact

SEQ ID NO: 16003 - DNA, 588 bp, Triticum aestivum
  Clone ID: PAT_TA_16003
cttcactcgcctcccacgtcgcctgccgatcgagtgcacccacccaccacagtgccctgtgcccgaggccattccgtacgcactggagatggcgcgcaggagcggagccttctcgcgcttggccgtcgtcgtcgtcgcggcctactgcctccccgccgcgacgcccggggctgccgactggatcaggggctccgccaccttctacggcgggagcaacgccgccggcaccatgggcggcgcttgcgggtacggcaacctgtactcgacggggtacgggacggacacggcggcgctgagcacgtcgctcttcaacgacggggcggcgtgcggggagtgctaccaggtgcagtgcgaccagggcagctccccgaactgcaagccgggggtgacggtcaccatcaccgccaccaacctctgcccgacggactactccgagcccaacgacgacagcagctggtgcaacccgccgcggaagcacctggacatggcgcagcccgcgtgggagcgcatcggcatctaccgcgccggcatcgtgcccatcctcttccagcgggtgtcctgctccaggagcggcggcgtgcggttcac

SEQ ID NO: 16004 - DNA, 778 bp, Triticum aestivum
  unsure (1)..(778): unsure at all n locations
  Clone ID: PAT_TA_16004
ctacttcttccncgtataggcacccccgctctccgggagcgtcccttccccgggcgccgtgatccgggtgacggtacgggccccgcgccccaccgtcgccgtcgcggtatggcccttcgcccgtggcccgccccctggccggcatgacctcctagagttcagcccctcccgattccttccaggtgggttgcacgagagcgtggacgtcaagggaggcgactatgagctcattcctttcggggcggggcgaaggatatgcgcgggcctcagctggggcctccggatggtcacactcatgactgccacgctcgtgcacgcgttcgactggaccttggttgatggcatgacacctgaaaaactcgacatggaggaggcctatggtctcaccttgcagcgggccgtgccgctaatggttcagcccgtgccgaggctactgccatcggcgtacacaatgtgatgttttatcatggatctttggcgtgttttggttccctttcgatccgatgtaccttgtgttaattatttcatattgtttggatcggttgtaaaagaaaagtgccaacgcgcgccccgggggggtctcaagtgctctcgatgtacccgcttctttcggttttgcttgggacgggaaggcagggaagtctatgtatttacaactaaaaattaaaaaaaaaaactcgtgtgttgcttgaattgtacacactgtatatgtaatatgttggcgtttgttttgttacaagcaagcaaaccaagtggtgatattcgataaaaaaaaaaa

SEQ ID NO: 16005 - DNA, 690 bp, Triticum aestivum
  unsure (1)..(690): unsure at all n locations
  Clone ID: PAT_TA_16005
gagaagggccgggatgtctggttcgggcacggcgtgatgcagctgcagccggagcagccggcggcgggccggaaggcgctgctctacgtgcccaccggcgagaggatgacctcgctggagctgctggagcgccgcctcggcgcgcacggctgggagcgctactacgagaaccgcgacatcgtgcagctccaccgccgcgacggcggcatcgacctcatctccctcccgcgggacttcaccaagttccgctccacccacatgtacgacgtcgtcctcaagaaccgtgacagcttcaaggtcgtcgacgtcccaacttaattgacctactccactccatcatcaacgtcgcctttgatcttctatgcgactatgtgtgtgctatatatactcctcctaagtgcttttgcatttgcttaaggcgtgaaatcagggcggaacgcatcaaggcatgcatgcatgcattacgtgtgtgccgtagtaaattgcaatggtacgtgtgtgtttggcttgtgtgggcctgaagggtgacagcctttgttagctagctgttgcacatttgctggtcatgttcacattgcaattcagacagccatatactacctctataatccggggttactatcccccctcaatgctaatcatattaatttancatgactttaaataataaaggtntaaattatatataaa

SEQ ID NO: 16006 - DNA, 421 bp, Triticum aestivum
  Clone ID: PAT_TA_16006
cgggccgacgaaacacaataccagccgccgcaagttccagaaccaccagatccaatctagacaccatcacggagggcttcatcatcctcattggtgcctctccgatgatgcgtgagtagttcattgtagacctactggtccgtaggcagtagctagatggcttcctctatctcttttgattctcaatgcaatggtctcttggagatctatttgatgtaactctttttgtggtgtgtttgttgggatccaatgaactttgagtttatgatcagatctattttatccatgagagttatttgagctttgatcccttatatgcatggttacttctagcctcgtatttcttcttcgaatatttggtttagttaggccgactagatcaatttttcttgccatgggaagaggtgctttgtgatgggtt

SEQ ID NO: 16007 - DNA, 154 bp, Triticum aestivum
  Clone ID: PAT_TA_16007
tcactgaacctcgatagtagcttttcttgttcttcagttcagaattcggttggttgggtgttggtggagtctagctagcttggagtggaagggaaattcatggagtaaacgtgaagtgcatatctccccttttctcgggataatttttatttta

SEQ ID NO: 16008 - DNA, 470 bp, Triticum aestivum
  unsure (1)..(470): unsure at all n locations
  Clone ID: PAT_TA_16008
cgtccggcgaaagtgtgatggcctccccgtacaatccccaccggcggcagctgggcggggggcagtccgcctggccggatctcccaccggagctcctggagagcgtcctagggcggctcgccccgctcgaccgtgtcgccgtccgcctcgtctgctcctcgtggcgctcgtgcgcgcgagcttcgatcttggctgacctccccttcgaggccccgcgcctcctgctccggcgccccggctcctgcggcagcctcgccttcttcagcctccaccgccgggagatcctgcgcttcgccctccccgaccgcctcaagctcnggccgggtgctgccggccagatncggcggctggcttcgcgatggccctttcgaacganggagcgggcgatncgaagcttccgcaaacctccttctncgggccaaatccngtgtccaatgccaacggtcccccngtggtccccgggtgggnaa

SEQ ID NO: 16009 - DNA, 525 bp, Triticum aestivum
  unsure (1)..(525): unsure at all n locations
  Clone ID: PAT_TA_16009
aggcttagtccgccgccatgtccgacgagtggggccggccgatggtgttcctctccggcgtgcccgggtccttctacgggaggctgttcccgaggaccagcgtgcacttcatctgctcctgctccagcctgcgcggccgcgcccacgtcccgccgggcctcttcgacgaggccaaggcgccgatcaacaagggngaagatgtacatatcgagcacgagcccgcccgccgtgtccgtggcctaccggaggcagttccagagggacttcagcctgttcctcaagtcgcgcgccgccgaggtcttccccggcggccggatggttctggccatgctcggccggcagaccgacgactgcgtcgaccggaggacgaccttcctgtgggagctcctctccgagtccttcgccgcgctcgtgtcgcaggggctcgtggagcaggacaaggtggacgcctacaacgtgcccgttctacgcgccgtcgctgcacgagatcgaggtggaggtgcggctcgaggggtccttcagcct

SEQ ID NO: 16010 - DNA, 891 bp, Triticum aestivum
  Clone ID: PAT_TA_16010
ccaactcccgtccctcccccgaatccgagccgcttgttccctccaaacggtggggcgcggctccgatccgcccgatccgggtcgctctcgaggctccggcgcgcgcggcggcggccggtggcggcgatggattcagaggacgacacgcgcgactccgccgacgaggacttctacagcggcggcgaggcgggcctcgccctcagcgacgacggggacgcggactacgacttcgccgaccgcgactccgatgactcggatgacctaatctcccacaggcagcagcaaaactacagtgtactgagtgaaactgacataaagcaacatcaagcagatgacatgaatcgggtttcaactgttctttcaatttcgaaatcagaagcttgcgcccttcttcgcagttataactggagcgttagtaaggtgcatgacgagtggtttgttgatgaagcacgagttcgtactgccgttggtttaccggagaagcaaaacgaaatgccaaatgaaagagaacttacgtgtgggatttgcttcgaaagttgtccacgtgagtcaatgggtgctgcttcatgtgggcatcctttctgtggtgtatgttggagaggctatattagcacagctataaatgatggtccaggatgtttgatgttgagatgtcctgatccatcctgttctgctgctgttggacaagatatggttaatttattcgctagtgacgaggataaggggaagtatgaacgatatctttgcagatcttacattgaagataatagaaaaacaaaatggtgtcctgctcctggctgcgaatatgctgtggaatttgtggttggcagtggcagctatgatgtttcttgtggctgttcttacgggttctgttggaactgcacggaggaa

SEQ ID NO: 16011 - DNA, 627 bp, Triticum aestivum
  Clone ID: PAT_TA_16011
aaaaaaagagggcatttgttgcctggaaccacaactcgtgcgtgcctcctctggtttttcctccttgctctgcttctcctttactttcaacaaacacttcgtgtgcatgtgtaaccacagagagaagagagatcgagggacctgtgaccaacatttggcctcagagctagattcggcggcggcgccgatggccacgacgccggaggggctgcagaaggccctggaggatgcgctggccgagataaacgcgatgcggctggaggtggaggcgaccaaggcggagttggcggcggagaaagagaagctgggactggtaccggcggcgacggcgctgccggtgaggtcccgggcgcccatcaactacccacagctcacacgcagcaactacacgctctgggcgatgcagatgcgtgtggcgatgcactcggcgggagtttggtcggcgacgagctccgaggacgtcgaccacgagatggaccgtgacgccctcctcgccatctatcacgcggtgccggaagatgtcctggcgtccctcgccggcaaggacacggcgaagcaggcgtgggaggcgatcaaggtcgtgaacgtcggccacgaccgcgttcgtgagacgaacctacagacctt

SEQ ID NO: 16012 - DNA, 526 bp, Triticum aestivum
  Clone ID: PAT_TA_16012
gggcagccttctctctcccgtgaaaatatctcccttctctccctcatccgtccgctcttctccgtgtcgccgccgcctccgctcccctccctatcggccgcctcccttcctccgccttcaccatctcctcctcccgcgtctcctcgtcccatcttgctgccgccggctcccctcctctccccctgattctccccttcagctcggccgtctcatcttctttgctgctgcgccgcctcttcctctgcctccgtgctcaacaggaggagccggggtcgcagctgcaccacacgacagtgggcgagggcgagctccagcgcgagcatgcggagagctatccactggatccggccggcccagatccacacggctccgtcaacgacaggcccggggaccctgccggcgtgggtgtgccggcgtcgttctctcttctccaatccattcttccagatttctctccttctctttcttatgtactcttttcttgacgaacagagggggacgaattaggatggatccacgctgtcga

SEQ ID NO: 16013 - DNA, 538 bp, Triticum aestivum
  Clone ID: PAT_TA_16013
ctggggaaagcaaacagggtgagacatgggaaagggttactcaaattcgtgacaagtttgagtatgacagaaaaaggagaatgagagagcgagcgtttgcacccatgaatatggagaacaattttggccagcagaattggaaaaggccagaaaccagaacgggtcaggtttttactcgacaaacatagaaaccagagtactctagaaaccagctctggtccacatggttgggatttcatgaatcaaactggttggagttttcaacatgaaccaagttcctgaaatcagcatgattcggatcttggatttccgaaatgaatcaagtttcagaaaccggcaatatccaaattttagaaaccaacgtgatggaaagaataaatgatttggtgaccagagtcagattctagtatgttgcaattctgcagagacactaaaaggtggtgcaccattaccgagtctttgtgctcactgatttcacacctttgtaatgctaattgaattgaaaatgagatgagaggtgataacagacatgctttta

SEQ ID NO: 16014 - DNA, 1166 bp, Triticum aestivum
  unsure (1)..(1166): unsure at all n locations
  Clone ID: PAT_TA_16014
cgtccgcccacgcgtccgatttccgtccgcaaaggatgctgcggtgtgtgtacacccagcggcggtgggcgcaccgccggggcggcttcgtcaccggcggcactggctggtcgcagaaggcccgcccagccgccgtgatgggcgcgaagaagtcggagtggtgggcggtggacggcgagctgcacgagatcggggagggcgtgccgcaccgcgagcgcttcgccatcccgcgcgacaacctcccgaaccgccgccgcaagcagatgcgcgagcagttcatgcgccgcacgcgtctcgtcctcaaggactcggaacatgaaacttggtgcaaaaaatatatggaactgtaccaagaacttagagagaactgggaacggttgtactgggatgaaggttattcaaaaaagatcgcagaagatcgcgctaattatgactctgctgaagaagatgacctagacttctcaccatacagcaggagaaggagctccagtgtagagccaaacaaggaccttggttctggggaaagcaaacagggtgacacgggcggaaagggttactcaaactcgtgacaagtttgagtatgacagagaaaggagaatgagagagcgagcgtttgctcccatgaatatggagaacaattttggccaacagaactggaaaaggccagaagccagaacgagccagggtttccctcgacaaacttagaaactaactctggtccaaatgattgggatttcataaatcaaactggtcggcgtttcctacgtgacccaagtccctgagatcagcaccattcggatttccaaaaagaatcaagtttcagaaatcgtcaatatccaaattttcgaaaccagcttgatggaaacaataagtgatttggtgaccagattcaagttttagccagcatgttgcaatcctgcggagacactaaacctgcggagacgattacctgagtctttgtgctcaccgatttcgctccgttgtcttgtttcgcgaatttgtaatgagatgagaattgatgtcatgctttttatgttcgttgatgtagtacgctacagttaaccttggccgtcaaaatgagacgaagtgtacataaatacggcgcccaatttgcctttgcggcctgccaactctaacccngaaatgcaaaangntacnccaaaaaa

SEQ ID NO: 16015 - DNA, 743 bp, Triticum aestivum
  Clone ID: PAT_TA_16015
ctaaattgcccgatatttctgaagcatgggacacatctcaagtatctagctctaagcgggtgtcaccttgtggaagatccactggagatgctcgcccggcacatgccaaagctcacgtatctgagacttaacaacatgcatgggtgcaagcactctggctctttctgcaaattcctttccaaacctgaaagacacttgtcttaaagtgcatgcatgatgtcagtgagctaaacatcagtgagggcgctcttccatgcgttgaaggtctgtatattatctcgctgccgaagcttgacaaggtccctcaaggcattgaatcccttcgcgcccttaagaagctcacactgcagtgcttgcacaaggatttcataagtcaatgggacaccaacggaatgcatcagaagaccctgcatgttccagaggtttatgtctagatgcagcaggtcggttcttcctgcggtgtcggtcttggatggtgcatctctcagtcacagttgtgcagtacttttaatcgttctagtaaatttgtgattattgatgtcctcagcaggcatttgtcggcacttgtgtgcccaccatatttacccctcaaaagtttggtttacattgccttccagaggtccccgtctggttttaagtcatactatgtgctattactcatttcatgtaatgatatgtatcatttctgtcgaacaccttctgtgaataatcatgtcgaacatttcatcttatatgtaaaaaaa

SEQ ID NO: 16016 - DNA, 1077 bp, Triticum aestivum
  Clone ID: PAT_TA_16016
ggaaaattcccctggcatatgatgaggagaaaaaagcatggtttcttgagagagagttacctgaaggacggtatgagtacaaatatgtagtggatggcaattgggtgtgcaatgagcatggtactgctggacttggaagagctcctgctgttgcactggcatatatgtactggattcttggttacaatcttaatgaaggacatcaactactgcagagtaaaaggcctcgctttcccaagttagaagccatcaaattggcaacagctgacattctcacgggcttgtcaaaaaactgcatcactttgaagtggaaaaatggcagttgttcttctgttgaaatttctgggcttgacattgggtggggacagaaaattcccctggcatatgatgaggagaaaaaagcatggtttcttgagagagagttacctgaagtgacggtatgagtacaaatatgtagtggatggcaattgggtgtgcaatgagcatgagatgaagaccaaacccaatgcggacggccatgtgaataactacatccaagttgccagggacggcacgagcgatgaagagaaggcgatgagggagcgattgactgggccagaccccgatctaacaaaagaggaaaggctgatgattaaagagtacctggaacagtacactgagcaataagagaacgcctcacaccggaagcgctgggggtgcgaccggctcgccatggagccgggaacacccactgatgaaatgaaactagactctacgcatctccgaagcgctgctgtgctcggatcgacgtgtcggtagcaagcagctcttaactggaaatagtttggctctagttctcttctaattactattagcagcatccctctttttcctctgctgtgtaaacacgtgcgtgctccatgaaacgagcaatcagtgagtgtccctgacagtaccaattgtagccgtcgtataaaagtaaaataaagggctgtgcacgagaccttgaaacaaaacgtgtaacatatgtatgttactcctgaagaataaaatcatatggtatgcttggatctggcctaaatggttggctccgttccg

SEQ ID NO: 16017 - DNA, 1243 bp, Triticum aestivum
  unsure (1)..(1243): unsure at all n locations
  Clone ID: PAT_TA_16017
gcacgtgggcatgccacggtgacggtgtgtgccgagccgaggggacgccgacaacggaacatctagtctccgtcgggactatggtacgcgcccggtcgatgtgagagttctttcggggttgtgctgcgtgtgtgcgtgtgtatctccatgtatatgtgtttgaggcagttgagatgaatagatgtcaacatacaggccgttcttcggccggggcgttcatcgccggatttgtgatttgttcatcgtcttcctacctccgtccggcgttgatcgtcggagggcttctcggcgctcgtcgccgtgggtttgttccaacataattttctcttaatcacaatagcaaccttttttatcgtcgccttcgcgctggccgcctcgctcctggcgcaccccttctcgctcctcatcctcctcggggtcctcgccgcctggtgcttcctctacatcttccgcgcctccgaccagcccgtcgcgctcttcggccgcaccttctccgaccgcgagacgctgctggggctcgtcgtcgcctccatcgtggccttcttcttcacgcccgtcgcgtcgctcatcatctccgggatgctcgtcggcggcgccatcgtcgccgcccacggcgccttccgcatgcccgaggacctcttcctggacgacgccgacgcggcgagcggcaacagcgcggcccaggggctgctgtccttcctcggggcacccggatctagggtttgaggcggcgggcgacgagatctggtaggcttcctgggcgcgacaagttcgtcttaaactggagttaccctggatctgatattgctttaactgtgccctgtatcttctccagttcatcgttctgtagttacagatctattggtttattgttgatcctgatcgatgcgccgacttttgccaatatatgcaccattttctctcgtgagttccacgctgcgatggaagtttagtgttcaagacttgagtacttttatatatatgtatgatgtttaactatatcagtgatgtagatggtatgttctcgagggtaatgaaagcaaagtactagtacaatcctttggtccttctgttgtttgtgatacttgatagatgaatgtctgagtattttctggcagccgaagtcaccaaaaacgcggggcgcgggcccgtcaatgtttccctgggtatgatggtattgcaatgctggcttgatgtagcgttcanntcaatagatccntgtnacatactcaaatntttgtag

SEQ ID NO: 16018 - DNA, 628 bp, Triticum aestivum
  Clone ID: PAT_TA_16018
cggcacgtgggcgaagtcgaagcagaggagcaccctcttcgtcttcgtgtacttcgcctcttccgcggcgctcgcggtgctgctctccgcgtcctggcaatggcttgccgcggcgtccgccccgcccgcccgcatgcgcctgttcatgcacgacgtgctcaccggcccgggcgccacggcggtcgaggtcgtgaacggcacggggccgtcgctgttcgggggcgagccgccgctgcggttcgggcacgtggtggtgatcgacgacgcgctcacggaggggccggacccggcgtcgagccccgtggggcgcgcgcaggggacctacgtcttcgcgtccatgcacgacccggcgttgctcttctgcatgaatgtggtgctcacggcggggccgtactccgggagcaccttcaccgtcgtcggccgcgacaacatcgtcgagccactgcgggagctgtccgtggtgggcggcaccgggcggctccggatggcgacggggtacgtgctctggaggacggcgagctggcagctacgcaagaacgccgtcctcgacctggacatctttatccacgtccacgcctacgcccgtgcatgatggacgccatcggtcgccttagacgcatcgcatatg

SEQ ID NO: 16019 - DNA, 2130 bp, Triticum aestivum
  Clone ID: PAT_TA_16019
ctcggcatccctcattctccccctcccgccctccatccctccattaactcgtctcccgatcccaacccccacgaaaatcccaaaaatattcagagaagcaatccctagtccccgaatcccacctcgaggagtatcccgattcgcttccgatcagcgccaactccatctgcggcttcatctcaggcggtcccgggcgcgcagtcttggctcgggagatccgggatcccgttcttgggtgttctgggctcaaatcttgcggcttctgggcaatgtgattaggccaaggggcgattttaggcgcagccgttcctgaatctctcgctgggttgcaaagatggagcatgtgatcggggggaagtttaagctgggcaggaagattgggagcggatctttcggggagctgtatcttggcgtgaacatacagagcagcgaggaggtggctatcaagttggaatctgtcaaatcaaggcatccgcagcttcattatgagtcaaaactatatatgcttctgcaaggggggatggggattcctcaactcaactggtctggagctggcggggagtgcgacgtcacggtgcttgatcctcttaatcccaatctgcaggggtcagcagtctgttcacaaaccactaatgaggcttcaccaatcaactggactcggaggccaggtcgtcatcgctgtcgaaaactgcgagaaatgtccatgatgatcccactataaggacatttgagcgccttacaattagtgcagacaggaggaaataaaagtttgaagagtaaaaagatgtcagttgctgtcatgagtgtgggcacttggattctttcagctccagatgatgctcactgatcagcaagataaatgatgttgtgctacacaagatgccgaggaatgcatatagcgaaggcggctcatcgaatcttggcatgaatgatcgagcactgttatttcaatgtctgttattttgaatcgttaaagaaaatgttttacaccattctgatgggcctggataggctgcatggattggccgtgctggcccaattgatgttaatgttgaatcagacacttgcggaaacaccattcaaataaaccagtttccattactgccgatccttgcgttttgaagataaaccagattactcctatctgaagaaactcttccgagatttatttattcgtgaagggtaccagtctgatcatatatttgactggactgtgtcgaggcaattagcagagaataacagattgcgaccaagtggaaggacagctgggttggtgggaccatctgcagaacgggctgaacggattgcagcaagacaggatggtcctgatagattctctagttcagtggaaacatttgccagaagaactggctctggttctggccatcatggagaaaacacgaagcacagaactctgtttgattctctgttggcacctaagatggctgctgattcggataaaagaaggcctacatcatcccggaatgggagcacatcgaggaaggctctcctgtcaagcagcagaccaagttctggagagcccagtgaccccactcgcactagccacctaatcccaactagcagtggcagcagtcgtccatcaaccactcagaggcttcaccaatcaactggtcttgaggccaggtcctcctcgctgtcgaaaactgcgagaaatgtccatgatgatcccacgataaggacatttgagcgccttacaattagtgcagacaggaggaaataaaaggttgaagagtaaaaagatttcagttgctgtcatgagtgtgggcacttggattctttcagctccagatgatgctcactggtcagcaagataaatgatgttgtgctacacaagatgccgaggaatgcatatagcgaaggcggctcatcgaatcttggcatgaatgattgagcactgttatttcaatgtctgttattttgaatggttaaagaaaatgttttacaccattctgatgggcctggatcggctgcatggattggccgtgctggcccaattgatgttaatgttgaatcagacacttgtggaaacactattcaaataaaacagtttatcagacattcaaaattaaaaatgtgtttgttatggtacctgcccgggcggccgctcga

SEQ ID NO: 16020 - DNA, 664 bp, Triticum aestivum
  Clone ID: PAT_TA_16020
cccacgcgtccgagcgtcacgacagaaccaatccctcgctagccccgtccgctctcccgtctccagtcgcagccgccgccggcgccgcaccccaatccaaccccgccgccggcgatctcctcgcccccctgtgccgtcgcccccaaccttctattcctctcccaaggcataggaagggaaggcaaggcaagggaagggagagggagcgctcagatccacggcggcatcagcgcgccgtcctcgacctgatccgcgtccgtccacggatgggagccggcgcaggaaatccccgtccccgcgtccgagccccgctaccctccgcaacggctcgaccgcccatcgacgcgctgcccccgcggcgcccgaccagttcggctttcgcggctggtggacgcgcccttgctgttgccgacgccggctcgctgcgccgcactggccctcacaagcgtcttctgtcaatgatggacttgagaggtcaagggagtttccattgggacatcgggacatgctcctccatctcctccggtggacgacatccaacatcgccagttcatgcacttatggactgaagaaaaaaaggaaatgaagaagaaaagaatagcaatattatcatatgcgagaaaggagtattctgaagtgaattatgctatgttaacagtctaca

SEQ ID NO: 16021 - DNA, 659 bp, Triticum aestivum
  Clone ID: PAT_TA_16021
ctactcccctccgcctcccgtccgccggatccttccttcccacccctccccgccgctccgatccgccgccggccggccagccgccgccatgtcgatccgcatgctgaaccagaacgcggaggtgatgaacaagtcggcggcgctcgccatgaacatcggcgccgccaagggcctccaggacgtcctcaagaccaacctcggccccaagggcaccatcaagatgctcgtgggcggagctggcgacatcaagctgaccaaggacgggaacaccctcttgaaagaaatgcaaatccagaacccaacggcaatcatgattgcgaggacggcggtggcgcaggacgacacgagtggcgatggcaccacgtccactgtgcttttcatcggggagcttatgaagatgtctgagcgatgcatcgaagaaggtactcatccacggtttttggttgatggctttgaggttgccaagaaagcaactcttgaatttctcgagacattcaagacagcagtcgttatcggtgatcaacctgacagggagatcttgaaaatggtagcaagaacaactcttaggacaaagctgtatgaatcattggctgatcagttgaccgatattgttgtgaatgcggtcctatgcatccgccagagtgatcaaccaattgatc

SEQ ID NO: 16022 - DNA, 2167 bp, Triticum aestivum
  Clone ID: PAT_TA_16022
cgtccgccctcctcctcccctccgcctccctccttccggatccttccccccccacccctccctccctttctccgcaccgcgccgccgccggcccgccgccatgtcgatccccatgctgaaccagaaacgcggaggtgatgaacaagtcggcggcgctcgccatgaacatcggcgccgccaagggcctccaggacgtcctcaagaccaaccccggccccaacggcaccatacagatgcgcgggggtggagctggtgacatcaacctgaccaaggacggggacagaaacctgaaagaaatgcaaatccaaaacccaaaggcaatcatgattgcgaggacggcggtggcgcagggacgacacgagcggcgatggcaccacatccacagtgcttttcatcggggagcttatgatgatgtctgagcgatgcatcgaagtaggtactcatccacggtttttggttgatggctttgaggttgccaagaaagcaactcttgaatttctcgagacattcaagacagcagtcgttatcggtgataaacccggctgggagatcttgaaaatagtagcaagtacaactcttaggacaaagctgtatgaatgattggctgatcagttgaccgatattgttgcgaatgcggtcctatgcagccgccaaagtgatcagccaattgatctttttatggtcgaaataatgcatatgtggcgcaaattttgcatacgacacacgactgctagagggtctcgcctttgatcaagggtctcgtcactctgactggatccggagacccggacatgaagcgcagcgcagagaattggtacatcctgacagctaatgtatcactggaatacgagaaaagtgaaatcaatgcaggattcttctactcaaacgcagaacaaagagaaaagatggttactgcagagaggcgtcaagttgatgaacgtgtccagaagatcattgaattgaaaaataaggtttgcgcaggaactgacaagaattttgtggtgatcaaccaaaagggcatcgatcctccgtccctcgatctcctagctagagctgggattattgctctccgaagagcgaagcggaggaacatggagagacttgtgctagcatgtggtggcgaagccatcaattcagttgaaggcatgactgaagactgtcttggctgggctgggcttgtctatgagcatgttcttggagaagaaaaatacacgttcgtggagaatgttaagaaccctcactcctgtactattttgatcaaaggacctaatgatcacaccattgcacaaattaaggatgccgtacgagatggtctaagatctgtgaagaacacagttgaggatgaagctgttgtgctgggcgctggagcgttcgagatggctgcaaggaagcatctcattgacaatgtgaagaaaactgttaaaggacgagcccaacttggggtgggggcatttgccgatgctctactcgttatccccaagacgctagcagagaattcgggcttagacacccaagacgttattgtctctcttgagaatgaacatgaccgtgggctggtggtggggctgaaccataacactggcgagccggtcgaccccgagatggaaggcatctacgacaactactctgtgaagcgccagatcgtcaattccggacccatcatcgcgtcgcagctgttgctagtggatgaggtgatcagggcagggcgaaacatgaggaaaccaacctaaacctagcgctcgccccttccaggccgagaagactttttgtttggctgtttttctctgtggggtgccgagtacgtagcgagtagtgatgtggtggggtggaatgcttgagtgcaagagattgtacttgtaacaaccctcgtgacagtttgtcgatgtgtttctacgctggtgtttgtatgcagaatattttcgtgttggatcaagttgagcagctatgtattttttgtgtgctggtggtgattggattcttgtttgtgttgagcaaagcctgcctttagtaggggcgcaatcttaggtatacctggattggttcaacacccaaactgaaaagatattctgcactgaagcagttgtagcatggtcccgtcgttttgggttcttgcgtcgtaagtggagtgataacctcggccgcgaccacgctaatcactagtgaattc

SEQ ID NO: 16023 - DNA, 912 bp, Triticum aestivum
  unsure (1)..(912): unsure at all n locations
  Clone ID: PAT_TA_16023
ggtgacaaaagagaagaattctatctaacttactggattgggaagaatagtatactggaagatcagcatacggctcttcaaataactaatacaatttggaattcaatgaaaggaagacctattctgggtcgtatttatgaagggaaggagcctccacagtttatttctcttttccagcccatggttattcttaagggtggaatcagctccgcgcgcgggaattctgtacaagagaaggccttgccagatgaaacatatcctggcactggtgtcgctcttgttagaattaatggaacgtcaattcataacaataaaacagttcaagtcgatgcggtgtcaacatccttgagttccacgaattgctttgtcctgcaatctggaaattcaatgtttatatggattggcaacacaagttcttatgaacaacaacagtgggctgcaaaaattgctgagttcttgaagcctggcgttgctgtcaaacattgcaaggagggaaccgagagctcttctttctggtctgctcttggtggaaaacaggattactcaaataaaaatgccacacaggatgttgttagagaaccccatctctacacattctcatttaggagtggcaagctggaggtaactgaagtttacaatttttcacaagatgatctgttgaccgaagatgtgatggtacttgacacacacgccgaagtctttgtctggatgggtcagtgtgtggacacaaaagagaaacaaatggcatttgaaattggcgagaaatacatagaacatgcggtgaccttcgaaggtcttgcttctgacgtgcctctctataaagtcagtgaaggaaatgaaccttgcttctttnnnacatacttctcctnnnatagcacaagatctctgattcacgggaattcatttcagann

SEQ ID NO: 16024 - DNA, 843 bp, Triticum aestivum
  unsure (1)..(843): unsure at all n locations
  Clone ID: PAT_TA_16024
gaattcggcacgagcagacaccatccggcgacgccatgaagcacctcctcctcccatccccgctccctctcctcctccacggccccgcctccaagccgctcctcctccacgtccgccagcgccaccgccacgccctgagcgccgcacccgacggcaactccggcgacacttccacggccgcgtccgagccgcctcccacggacacccagcccagcccgccaccctccgcgcctccgtccaccaactccggcaccaccagcgtcaagacccgcctccgttcaaggaaccaggcccgccgcgtccaggagccgtacctgcccccggtggaggtgaagatgatgcggggcaagggcaaggcgaacgcttccgcggcgccgaggagggagaaggagaagcggaagaagacgtgggacgagatgagcctcggcgagaaggcctacgagctgtacgtcggggagaagggggccctcttctggctcaacaagttcgcctacgcctccatcttcatcatggccggcgcctggatcctgttccgcttcgtcgggcccgccaccgggctctaccagctcgacgcgccgccgctggcgcccacggacgtcctgcgcggctcctagcgagagcgagtgcctaggtttcttgatagatagctcggcgggtaagataagggatgggtgaccggaaaagaagatcgatggataattgctgcttacaatggcttcgatggtatgcttgtatgtgattattatgaaattatcgtagatggatgcatgtatattgtatttcctgggtaatttttggagctaaagttttcaccctgaattactgaacaatttacacaccana

SEQ ID NO: 16025 - DNA, 1021 bp, Triticum aestivum
  unsure (1)..(1021): unsure at all n locations
  Clone ID: PAT_TA_16025
tgaggagtacgaccccgccaggcccaacgactacgaggactaccgcaaggagaagctcaagcgggccaaggacgccgagatgaagaaggagctcgaccggaggcgccgcgaggaccaggagagggagagggagcgcgagctgagggaggccgaggcacgcctgcgcgaggagcagtccagggcctcctccctcaacatatccagcgaggaagcctggaagaggagggccgccatgagcggcgctggcggcggcgctactcctcagagggcctcgtctccgccccacggcgatgccagtgtgcttctccatcccaggctcctcctcctctggcttgggcctgggcgctggcggcctcgtgcccgctgcccagagaatgatggccaagatggggtggaaggaaggccaggggctcggcaagcaggagcagggaatcacagcgcctctggtcgctaggaagaccgaccggagggcaggggttattgtcgatgagagcagttccaggaggcccagatcagccaactttgaaggccagcccaccagagtagtgcttctgcgcaatatgattggtccgggcgaggttgacgacgagctggaagacgagattgcctcggaatgctccaagtttggggctgtgttacgcgtgctgatattcgagatcacccaggcaaacttccccgcggacgaagcagtgaggatctttgtgctgttcgagaggacagaagactcgaccaaggcgttggttcaactggaagggcgctactttggcggacgcatagtgcacgcgaccttcttcgacgagggaaggtttgagaggaacgagcttgctccgatgcccggggaagttccagggttccgactaaacctttaataagcaagactaaagaactgcggcacgggggtccccggatgtaacttaatccaaaacatgaccatgttttcttcccttttgagganatttanaacatgttggggaatgtgggctattccacttatgttgnaaantgtattatnccaaaaaaa

SEQ ID NO: 16026 - DNA, 483 bp, Triticum aestivum
  unsure (1)..(483): unsure at all n locations
  Clone ID: PAT_TA_16026
ggacttaacacagcccaaaacagttgctctcgatcccaaatgagaacttgcactatgcagtcgtcgttgtgtgtcacttggcgctcctcatcctgctattaccatgggggcgccatgaccgcgcttggatgttgcccgcccctttcctgcgctgagcgtacctgtggttgcctttgattctttgtcggacaaccacagcggtgcttcaatctatcgctggtggatggaggggtcaagaagtgacagcaggatgggtgttggtgggagctgaaagactggatggttaagaatataactaacacatggtgttcaaagactttgtgggttgagggtaagatgctaaggctgggagtacgtngaaaataagaaaatttgtgtgctgtgctaggcaactttccattggttttacatttaaattgatctccaaacttgttgcnatanaaantttancnccaaaattggcgtgagtgaaaaaatggacaa

SEQ ID NO: 16027 - DNA, 788 bp, Triticum aestivum
  Clone ID: PAT_TA_16027
cgtccgcggacgcgtgggctgcagcttaagctgtggctgcttcaagaggaagcttgatggccgccagcttgttgtacctaagtgactaaattttgtgggaggtcttgaagtgtgttcatctgttacttgagtgagccatagtggtcactggtcagtttactatccttccttgtttattaatgcaccatattcatctaactgtttttgggggatggtcatctgttatttgtttgcatggagtatggtttttgttgaactttcatttcgtcctctcccatatggccgacactttgttttctatttgaaatacctccttgactgatgtaaatgccacaacattggcattgtttactcacctccatgaaattgaggctatttagattagtgaaggaggtcaaaattaggctgaaatactagtgttgcgtgctctctgttccccagtttggttatggtagcctggttgttttgatgggccacatttggaacaaacgtttggcatgctctttggggatgcataactgcttatggttcttgatgtttttgtagtagtgtttttcttgtcatgggttaacatgagctgcccttgccactacaaatgttcaattgctacttgccacttcattctgtatgacgttggtgattcggagttttgcgttgtcgaatgtgatgatcaatttcttgcccatttgtttgcctcttattttagtttcagttgtcttgcggaagatatatcagcccatcagcacgcttgagtatgtttttgcgatataacatttgcgtagttgcag

SEQ ID NO: 16028 - DNA, 873 bp, Triticum aestivum
  Clone ID: PAT_TA_16028
gcccgacgcgctccctcccctcctctccccggctcgcgtctccgccatcgtcacccgggcgtccttagagcgcccggagccctgccttccctccggtcacgttgccggccatggagaaggtggcggagagcgttgacgctggcgcggcggcgcagctgcagctgaagctgttcgggtcgtgggcgggctcgtacacgcaccgcgtgcagctggccaggcggctcgaggcgctcgcctccgcgtacgcggagggggacctcggcaacaacagcgacccgctacggcgcctcagccccctctacaagaaggtccccgtgctcgtccacgacggccgcgccctcgcccagtccgtcatcatcctccagtacctcgccgacgccttaccgtcgtcccggccgctcctccccgccgacgcctactagcgcgtcgtcgctcccgtgttgtgcggtgccgagcatgtggcgaggcgccatgaattgcgcggctaccactatagttagtggcgcagtctggcttaggcggcgggttttttttcccgtctccccgtcctatttctaatgcgttgtgtgtttgtgacctgggaatgttatgtgtttgcttgcctagcgttgggtgtgttgcaccgacggccacgtgtgtcgcggctcctactggctcgccgtcttcgcggagcccagcagcctgcagcgggtgcacgccgctgcttctcccctcttccaccgctgtgtgccgcgttgtggctcaggacctggtcttgcctaccactccctccttcgcccgctccgcgtgtacccgcgcggctccgccgtgcgcgtcccagcgccgccgcgcggcgcttggtgcacgcgaccgaagcccccaacggcgtcaccg

SEQ ID NO: 16029 - DNA, 1024 bp, Triticum aestivum
  Clone ID: PAT_TA_16029
gcacgagggtggttgcgtaaagcggcaaaactagatcatttcctccgaccccccgctccgctcgtctgccgccgcccacacaccaaaccctaaccctaccgccgccgccgccatggccgacccgcggatgttcccatcgggatcaaacggcccggaagaccacgcccccggccgccggaagtacaacccctaccaggacctcaacatgccctacaactacaagaacctctacgacctccccacctcgccggagttcctcttcgaggaggagtccgcggtgcagcgccgatcctggggcgagaacctcacttactacacgggcatcgggtacctctctggcgccgtgggcggcgccgccctcggcctccgcgacgccgccgcgggcgcggagcccggggagaccgccaagatccgcgccaaccgcttgctcaacgcctgcggcagctccggccgccgttacggcaacaggctcggggtcatcgggctgatgtacgccgggatggagagcggcatggtcgcggcacgcgaccaagacgactggatcaacagcgtcgccgcagggctcggcaccggcgcgctcttccgcgccgctaacgggccgcggtctgccgccgtcgcgggcgctgtcggcggggtccttgctgccgccgccttggccgggaagcagcttgcgaagcgatacgtacaggcaatatgaatctcttcctgttctctcagatcaattgatcaaatcaatcagtcgccaagaatggattatttttgcgtttgtcgttctccagtttagctgctccattagagaatgcataatatctatgctgtgttagtcacatgtatacgatcggaatggatgattttggctttgttacaatgtcggatgccagcatgatgttatacatttttcgggtgttgctgagcaataagagtctatttgatattttgcagcgattacagttgtgaaacatgtactgcagtatttagtaagaatgttcttcagtttgacgaggataagagtgcattgtggatt

SEQ ID NO: 16030 - DNA, 675 bp, Triticum aestivum
  Clone ID: PAT_TA_16030
acaactcaagacggcatgaggttactagttgggattgtgaggcttgttgctctgatgttgatgttggtcgtcggtttgtcagtcccccacgcggtaggagttggtgctatcacgctgcacgacacaaggacgcacggggagcagtgggcggaggagaggatgcagatgaggtcctacatgaccatggactacacccgcgtcaagcggcgcacgcccaagcacaactgattattcagctagctagctagctagaagaaagcctctcatctccgggctctggctccttcagcagcgaccatctgctgaaatgtgacagcaggggaagctctcgattcagctagcggtcgagaagaagctcccagctctactactccaccttcttacttcttcagtagtatgtgtatgtatgcgtccggcgtgcagatccatctgtgcacgcaaattttgccccctgaccaaatgttattactactagcttgattaatttgtgatatatacttacgcagttattatggtagcactagcagtgttcatctttcagttacacttttgtaagaagttagttatgtggattcgtttggtgaagttctggttatttcccctgtaagtgagaagtgatcatgtactagtgtaacatctcaatcgtaatggaaccagacgagtccactgaaaaaa

SEQ ID NO: 16031 - DNA, 524 bp, Triticum aestivum
  Clone ID: PAT_TA_16031
cggcacgaggcgtcatgtgagatcttacatctctgaggccaacattgttgtcaaggaggagacatcccctgccaaggaaatgctcgacgtcacgtcatttaggcagcgggccgaggctctcgaggggctccttgagctctccgcggacctactggaagacaacaggttggaggagcttgctattgttctgaagccatttgggaagatgaaggtctccccaagagaaacggcaatctggctggctagaagctttaaagggatgatgaatgacgaagcaagtcgcacgtcaatgtgagtatctgtatctttgtagcccggaggggcactttttgcttgctccccccttgtgctctgagctttaccgaaactcgcttggttttttaactgcgtgtggtctgtgttgcctgggttttccttttgattcaaccattctttgtggcgtatgttgtacatagccaagacttgtaaacagaataaatatcccttcagtactgcaaatggtttacttctgcaaaaaaaaaaaa

SEQ ID NO: 16032 - DNA, 776 bp, Triticum aestivum
  unsure (1)..(776): unsure at all n locations
  Clone ID: PAT_TA_16032
aacgggtgcccgcgtttatgcccttcttcttcttcttcttcttccatgacaatgggttcctccggaggcatccgcttccgcacccttgtcctgctcctcgtcgcgtacctcggcggcatgcgcgctcgggaggcgccgactgccgctgccgtctgccaggagcgcgggggttaacaacaggcgggcgccggaacggcacgggctgtcgctggacttctacggcaagactgtgccccgcggtcgaccacatcgtcgccaacgtcaccgccgagcggttccgcgaccacccggccaccgggcccgccgtgctccgcctcttccaccacgactgcttcgtggagggctgcgacgcgtccatactgatcgcgccggcaggcaaggcggcaggggagaaggtggagagggacatggaggagaacaggaacctgccgcagtacgggttcgacacggtggagatggccaaggccgccgtggagagcaaagtgccccggcgtcgtcagctgcgccgaccatcctcgccctcgccgcccgggacgccgtgcagctggcaggagggccctactacgaggtgaagaaggggagaaaagacagcaaggtatccctggctggcaaggtgcgcggcagcctgccccacgccaactccaccgtggacagagctcctccgcgtgttcgcaggcanagcgcctggcgcgggcgaactggtggcgctgtccgggcgcacaccaatcggttcgcgcactgcgcccattcctggcgctctacgaatacgggggcac

SEQ ID NO: 16033 - DNA, 694 bp, Triticum aestivum
  unsure (1)..(694): unsure at all n locations
  Clone ID: PAT_TA_16033
ggggacccgacncccaaantttcgggngccngganacgggaacccaatttntccgnggtccaaaagngncccaaaagggagggttgttntancggtcggcccccccagtgcctggcgcgcggcgcccccgcggcgggcgtgtgcccctgccgctggaactcgctcctggaaggcctgagccacgggaagccgattctcggcgtggcccttgcactccgaccagccgtggaacgcggggtacgtgtgcggccaccttcaaggccgggatcgtcatgaggccgtgggagaagagccgggagacgctgccggccaaggagatccaagaggtcatcaagagggcgatagactccgacgaaggcatcgccgcgcagagtgcggcgaaggcgctcgccgaggacgttcgtgccgccgtggcgaacggtggctcgtcgtgggcggacatggaggagttcgtcggtcgcatcacaaagtgaaggcaggattggcgtcaataaacactgaatgctcgatcttgcagcgtcaatcagagcagtgcacgtgtgtgatttgtagtgtctctagtgtcacgttcgtagatttgtttcctgtgtttttcgttcgttccgttcggaacttcggactcacgaacagcactctgaagtccatccgtggtcctagcatgccgtctgaaaggacaaattgtgcctatatggtt

SEQ ID NO: 16034 - DNA, 546 bp, Triticum aestivum
  Clone ID: PAT_TA_16034
ccccgggggccgcgctcccattggtgttcttttcgaccttctctgtgcagatccagaaagccctgggatcctaccggtcctttttggggggttcccgccggttttttttccccctggggagggggaggttggggtaagggggacctccaccattccccggaaggggccgccctcctccttaccgggaaccggcaagatggggtggatttggccccggccggtccacctgccttggggggatccgggggggaaggtgacgcgccccggtatctgcctttctctaccaagcttaccctgggtccgcctgttgtggacgtcgcagtcccgccttcctcgttacggtcgcgccttggctccggcgtgcctctttctcctggctctgtctagccgtcctgggtacctgttcgattatccctgcccagcgttcgcctggaccgtgtgtagtgggttgctgcgttccctctccctcgctggggccgcgtctccgttctgatgagcctgaatctcctggatctgtcaaaccatgtatgctcttctgtcattgaa

SEQ ID NO: 16035 - DNA, 167 bp, Triticum aestivum
  Clone ID: PAT_TA_16035
cagctgcttcactcgcgagctctctcgccccggcgctcccgagccgcgccggagccgagccgccctcgcaccactgcgcgccccctcgactgttcttccccggtttcttgtcgctcgaggtgcccacttagggagggggcctcccgaggaaggaaggtcgggaaggg

SEQ ID NO: 16036 - DNA, 726 bp, Triticum aestivum
  Clone ID: PAT_TA_16036
tattcatggtgttcaacagaatacaccaccaggcttgcctttgcaagttgttcgaccagcagaggctggtcaaaattcaacggaatctgcaagataccaaatggacttttttagaagaaaatgcacttgcaaaaagtcaggctgccttaagaaatactgtgactgctaccagggaggggcaggatgctccatcaactgtaaatgcgatgattgtaaaaacccatatgggaaaaaagttggtgtcattttggatggtaaaagtattcttgccacacccacacccggacccactccgattgaaaggaatggaaccggaagttatctcaagtgatgatgacgacgacgatgaagatgattattacatgaatcgtccacctgtcccctatccccccgtctccagtatcccgagagtcttcattccaacaggagactctagtcggcgttgaagtccacactgtgaatgggcacctgtacccgaaaccgctgacccaggtgcgtccagagtcatggcagctctcgaggaggcctgccgaggaagcacggggagaacaatggcgctacatgaggaggcccagcgaggacggaacatccgatgctatggaaggacacgcggaccccaagtttcatcatcagagagacaacaacaattaacagcgagagagccctgctgacaacaggttcagcatcccgcggtgcatcgaggtaattaacggcatggcagacctc

SEQ ID NO: 16037 - DNA, 480 bp, Triticum aestivum
  Clone ID: PAT_TA_16037
tacgctgcctgcgccacgtgggcaatttgacaaatttgaaatttgatctatagacgaaatcaaatcatagaacgaatctatttcacgtggctgacctttttgtgtgacgcccgccacgaaggcgccacactacgccgtgtagcgcctcacggccagcggttcccacacgtgtgatcagaaaattactaagtggtgtgcagcgcctgagagctaggcgccacactatacagtgtagcgcctagctcctaggcgttgcactagtgcagcgcctagctcccgggcgttgcactagtgcagcgcctgagagctaggcgccacgagtcaaccgcgtgaaataattttactgacagttcattctgtgatttaatttcgtctataggttaaatttgtcaaatttgcccgccatgtgttaccagacccatgttttttactactgtgtgctgcgccacgtgttaaaaaaaaaaaaaaaaaaaaaaaaaa

SEQ ID NO: 16038 - DNA, 1254 bp, Triticum aestivum
  Clone ID: PAT_TA_16038
caccgcgaaacaaccgcccgtcgccccgcggacgcgtgggcggacgcgaaggccgccttcttcctacgccctcaccacactgcgtgtcgcggaccggccatgtcttgcctcgccgcgtcctcggcgacgccgccagcgtcaaggcctacggcccagcgtctgtttgttgcggtggccgctcctccccgttggcggtccgttgagcctcatcgcgctgtatggaggagtgaaggcccccgggctctaacgatgctacggaggtgctctcccgccggcgactccagggcgcccggagacggcagcctatccagtttttgcattattgaaggcccagagacaatacaagacttcattcagatgcaatcacaagagattcaagacaacatcaagagtcggcgcagcaaaatattccttttgatggaagaggtcagacgactgcgggtgcagcagcgaatcagagctgctgaaagcagatgttccagcagtgaagaaaatgagatgccggagatgccatctaccattccgtttttgccttatacgtcaccaaagacaatgaagcaactctacttgacatcattctctttcatatctgggataatcatttttggtggcttaatagccccaatacttgaactgaaattagggcttggtggtacctcttatgaagattttatacggaacatgtatttacctcttcagttaagtcaggtagatcccatagtggcgtccttttcaggtggtgcagttggtgtaatttcagccttaatgttggttgaagtgaaaaatgtgaggcagcaagaaaagaacagatgcacatattgccatgggacaggatacctgccatgtgcccgttgctctgccagcaaaatgttgttgggcaccaaacgcttttcactttctacaactgaacgctgttccaattgttcaggagctgggaaggtgatgtgcccaacatgcttgtgcacgggaatggcaatggcaagtgagcatgacccacgtatagatccctttgactaatgttgggcaatttgacgtgtgcctgcttgatgctatttcctttttctatctagctgttgttttctatggctgtggtagggcttgaatcagtctttgatgtatactacgagttatagcgagatgaagttcgcagtaatgatgatcagatcaaatactgaaaaattgctttgttgttctttgctgtgtactaagagttatagcaagatgaaccttgcagtaatgacgatcagatcaaat

SEQ ID NO: 16039 - DNA, 572 bp, Triticum aestivum
  Clone ID: PAT_TA_16039
accggaggagcaggatctgggacgaggcaaccaatccagcgcgtgacagaatcacgaattcacgatgcgtgtgaagaaaggtgggggcgagggagataatggcagacgcctcgccttcttgaaactgctctggaaattgcttctgctctctttaaagctcgcaatcatggcgtattattcattcacggctgcaaccgatgccccgtctgatcgaaacgagagacggacggtcgctctgcttgaaaagagagagacggtctctgagcgacggcatgcctggttgctggtgcaggccgctcgcctgatttagggaaggcgtcgcggctgttcggtgaagcgggcagatgaagttgatgtgctttgttcctaaaaacaatgcatcatcagttcctggaagcgctgatctgtgccactcaccggcgctcggcggtgattaatggaaatctcaagcagctatagttctcggctagttggttttcatcctggttcttcagccaaattttgaagttttgctctctttttttgtttgaggaaattctcacttcaaagctaccagattgtgcattggtcta

SEQ ID NO: 16040 - DNA, 256 bp, Triticum aestivum
  Clone ID: PAT_TA_16040
accgaagcaactgctgctgccccgttagttgagctccgtggaaacgattcaagatgcctataagcataaattattttttatgctgagaaaatatatttggggatgctttcatgtgaacgttggccaggctcggcaagaagttttttaatcttttgtaagccggctttgggtcaattgtttgtctttgactgctcatggtgggaataacttttgcagtaatataaagtctaactcgcagaaaaaaaaaaaaaaaaaa

SEQ ID NO: 16041 - DNA, 647 bp, Triticum aestivum
  Clone ID: PAT_TA_16041
tcgcttctttcgcttctcttctacacgttcttttgacaagacatttaccgcataccctttcacaatacacatttcttgaaactcattacatcataatgtataccgccggcattcgtcactattgcgagcctggcgcttggcgcaaccgccgcgccagtcgcagcatcacctctcgacatcggcaatggtcacatgcagctacagatcaacatcgacctgaccggtaaagacgctgtcgcagccaacgctatcgatgcccagcaactgtttgctttctcctccacgcacttcgttcacgccgttccagaagaagtcgtcaacggcaccgagccaaccggtggtctcgccggcgcatccggcacgttcaacttcggcatcaacagcgcttccaacatgatctgttacaacatcacgctgcacaacttccaaggcgaattcgactcacccgcgactacggcgacccatatccacgaggccgcccgcggtgcttgtggaccacccagaatctcattcccgaacccggagtttgtagagggaagcgagacggttaggaacagcgcaggctgtatcaagggcccgtttacgactggtgttatggttgaaggaaaggattcgggcgagggcttctatgtcagcatgattgaagc

SEQ ID NO: 16042 - DNA, 770 bp, Triticum aestivum
  unsure (1)..(770): unsure at all n locations
  Clone ID: PAT_TA_16042
agcgctgcttccaggcaatttgttttctgcaaggggtgtatgggtttgttctgttggattacaattatagaagtatgtctacttatcgagagcttgctcgctctgcggtggttctggctgcgtcgttggtcagggcataattaccataaatgattcccactcggattaaacctcaagaaatgccagagagagctcagagctaagcagttctggtcatcagtgctatttgagcgtgcagaatcctttcataaatagctcgcctctttcaccgcgacaaagaaaaggcctcattcagagagtgacgatgatngcactccagcacctgaaatgtgtcaacgaatcagaggatggcctcaatgacaccgccggctcgctcccaccatacgaagaagcatcagacaatgaacgggatcacgggcccagcaagaaaacaaagtctcagcctactgcccgcaggacattagtctttaaagactgaatgcacgggtcgcatgatacatagacggggatgacgttggagttttgccctctgtctatgcctcaagtatcgattatgcctctctgtgatgtcactcccatgtcatctttattttgtttattcagcaaatgatggattagacgaggatttattcgcactgaatctgtacaactatggactatttatgcagtcttttatttaagctttgaaatgagtggattgggatgcttaagtttgagcaaaanaaaattgtnnanagatacccaaccaanaacttnaaaaaanggggggg

SEQ ID NO: 16043 - DNA, 546 bp, Triticum aestivum
  unsure (1)..(546): unsure at all n locations
  Clone ID: PAT_TA_16043
gctcttagattagccgtggcggttctgtctacgggtggaggacatatggaatcgtattcggaggagctctagctgtgcttcttgaggtgtatgactctcctccgtacaaggggtatgctgatgcacattcgctgtggcacgcgagcacccattcctctcacctatctttggtggaccttcgttagagacgatgcagaattccgcacctccacacttgttaagaaggccaagtagtagtaaattaaggtcagtatgaatgctgttagcttgtccctctctcgaaggtaacatgggcagaggacacacgtgctgccatgccatgtgtcccctggaccgcccgggtccccccattcatcttgcaccgaccctccgcctctcgtgcgtgccgcatcctcgggtcttgcccccctgctttcggccttggtcgccatctcctgttgttgtgtgctgcaacagtgttgggctccgtctttgtcgtgggacatatcttttcgtgnccggttgaaatggttcactcaangggtttcaatgcttanagaaacttag

SEQ ID NO: 16044 - DNA, 628 bp, Triticum aestivum
  Clone ID: PAT_TA_16044
ggagactactgtaaccaagttgctgagggcgctcgcaatggtatctctcagatcaccgccttcaacgagaagtgcccttgctcgcacattgtggtgaatgggtactctgagggagctcacgtggccggagatgtgcttggaggacccggggggatgcccattcgtctcgaccggcctagacaacaactctgctgcaggcaaaggcggtcgccgcggctctcctctggggagacgtgatgcataccgccaaccagccctacaatgtgcttgacggtgccgacaagcagtctaacgggcgtaagccggaggatctcgctcgcctcaatcgctacgcacccgtccttcgctcctactgtgctgcaggcgacccagtctgcgccggcggaaacgttgtggccgaccacttggactactttgagctctacaccgacgatgcttcttcctgggtcgtctccaagatcgacagcgtcgcacctctaccgtcgtgcggtgccaccagctcatcatcctctgctgccgcctcttccgctaccagtgcggccgtcacccagtcttctgccgtcgttcctacctcgtctgccgtggccactgcgtctgctacacctactaaggctgagtcttctgctgc

SEQ ID NO: 16045 - DNA, 565 bp, Triticum aestivum
  unsure (1)..(565): unsure at all n locations
  Clone ID: PAT_TA_16045
tcctcggagctccaagcgaccaagccgccgtcatgtccggccgcggcaagggcgggaagggtctgggcaagggcggcgccaagcgccaccggaaggtgctgcgggacaacatccagggcatcacgaagccggcgatccggcggctggcgcgccggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgacagggccgcaccctctacggcttcggcggctgatctgctgctgctgcctcgcccagtctcttcaagccgctgttccatctgtcagtgcgtgtgttgttccgttcgtctgtgtagtggacgccatgaatacgaatgcaatgaaatcagagttcttgcggtgttatttatcttggatgcaaagtttctgtaagcttgttaaacccccccggcganaaagattaggaataatgtnctactgaggtaaatatcggnan

SEQ ID NO: 16046 - DNA, 561 bp, Triticum aestivum
  Clone ID: PAT_TA_16046
tgccggccggcgccgtgggcgactacgtgggcgagatcctcgagaggagcttcacgctcaacttcgtgggcaacaggctcttctacgccggggtgcccctcctgctcctggatcttcggcccgctgctcgccttcctctccgccctggtcatgatccccatactctacaacctcgacatggtgcacgtcgccgccgacagaggaacgaaggagcacagctgcggctgcgtcaacggcaaggcgaaggggaatggctgcatgcaagtctgatcgatcggtgaaccaccgaagaagcgtgaagtgcagtccagtcagttagagtaagccgaaggcgtttcgatctttacatgtcgaacgacgctgccgtacaagatcagagactagcttgacgggacacaagatctagcctgaccgaagcttctcgccgggccgaggacacggcgagaatatcttcttttttcacgagaaactttcaatctatttattatcaatccgaacagtataaagaataagatagataataaaaactataaccatgtccataaaaaaaaaaaaaaaaaa

SEQ ID NO: 16047 - DNA, 1201 bp, Triticum aestivum
  unsure (1)..(1201): unsure at all n locations
  Clone ID: PAT_TA_16047
cgagctgtaactctcttttggccagttttgtccgcagaggttcctccatggacgccatgaagatgtatgagttcatgaaggggaaaggattggcaactggccatacatacaccttgatactcaaggctgttgcaaggaccgagggctatatgtctgccttgcaaatgttcagtgagattgaagagtgcgctgaatcgagggaaacccttgatgtgattgtgtacaacactatgatatctgcatgcggaagagcgaaagactggaggcaagtggagaaactgtggggaaggctagcagagaactctttaagtgggactttgatgacttatgatttgttggtgagcacatttgttgcaacgtggacagcctgagttagttattgccgccttatgaggaaatcctccgcgacgggcttgttccaagtggagacctattgaaggccctcattgccccgtgcaccaaagaagggaggtgggagtttgcgctggnccacatttaggagaatgttgagtgctggcatgaagccccaatatcattgtgtttaacccggttatcaactcacttggaaaggcctggtgaagacgagctcgcctttaggatgtaccatcttctaacatcttcagaacttgagcctgatcaatatacatggagcgcattgctgtcagcgttgtataggtctggtcgatgctgggacgccctagagcttttccaaggaattaaatccaagcatccatctgtcttaaacagtcatctctacaacatagctttgatgtcttgtgaaagacttggtcaatgggagcatgctttgcaattgttgtggatgatggaaaaaagcggactgtaaatttcagcggtctcttacaatcacgtgatacgtgcttgtgaggttgcttgtgagccaaaagttgttctgaaagtataccggcgtatgactcatgaaaggtgctcaccagacacattcacacatttatctgttataagagcttgcatttggggatctctttgggacgaagtagaggatatactggaggaggtcgctccagattcttcgatctacaacacggtcatacacgggctttgtctgcgtggcaagatcagattagccaggagggtgtacacaaaaatgcggagcattgggctaacaccagatggcaagacaaggtcgttcatgctgcagcacatcgcgtcagcagagtagccc

SEQ ID NO: 16048 - DNA, 156 bp, Triticum aestivum
  Clone ID: PAT_TA_16048
tggcacgagggtgctccccgtgtccctgaactgcacgttggaaggattgaactcggcgtcgagaagcttcagtgcagatctcaaccttaacgccgaggtcgctggtctcgtccagatcaatgctggtgtccaggtcgccgtggagaaggtcaacat

SEQ ID NO: 16049 - DNA, 625 bp, Triticum aestivum
  Clone ID: PAT_TA_16049
cccacgcgtccgcccacgcgtccgcccacgcgtccgctccggccacgcatccgctaagcacacgcaaacagccgcccccacgatactcacgaggcttcttcccctccgtgcgctctcttctttcccccgtcccatggccaccccagcgacgacgccggcgacgatgcgggccgtgcagtacgacgcctgcggcggaggcgccgtcggcctcaagcatgtagaagtccccgtcccttcagcaaagaagaatgaggtcctgctgaaactgcaagctgcaaccatcaacccagttgactggaagatacagaagggggacatgcggcctctgctgcctcgtagactgccttttatcccagtgactgatgttgcaggagtagttgttgatgttggtcccggagtgaaaggtctcacagcgggtgatcaagtcgtcgccatgctgaactcttttaacggaggtggactggcagagtatgctgtagcatccgcaaacctgaccgtcaaaaggccagctgaggtttctgcagctgagggtgctgggcttcctattgctgcaggcactgcgctccaggcactgaggtccattggtgccaagtttgacggcaccggcaagccattaaacgtgttg

SEQ ID NO: 16050 - DNA, 1485 bp, Triticum aestivum
  Clone ID: PAT_TA_16050
ggacgcgggccgaccgccaaccaaaccaaccccccaccagctcagcacctgcagccgctcagcagatgacaacacgcaaacagccgcccccacgatgactacttcccctccgtgcgctctcttgttttccccatcccatcccatccccagcccacacgccggcgacgatgcgggccgtgccgtacggcgcctgcggcggaggggccgccggcctcaaccatgtagaagtccccgtcccttcccctcagtagagtgaggtcctgttgaaactgcaagctacaaccatcaacccagttcactggaagttacagaaaggggacgtgaggccactgctgcctcgcagcctgccttttatcctagcgactgatgttgcaggagtagttgttgatgttggtcctggagtgaaaggtctcacagcgggtgatcaagtcgtcgccatgctgaactcttttaacggaggtggactggcagagtatgctgtagcatccgcaaacctgaccgtcaaaaggccagctgaggtttctgcagctgagggtgctgggcttccgattgctgcaggcactgcgctccaggcactgaggtccattggtgccaagtttgacggcaccggcaagccattaaacgtgttggtcaccgctgcctctggcggcgtaggcctgtacgcggtgcagcttgcaaagctagcgaaccttcatgttaccgccacctgcggcgcacgcaacatggatcttgtgaagagcttgggcgcagacgaggtgatggactacaggaccccagagggggcgagcctgcagagcccctccggcaggaagtacgacggcgtggttcactgcaccatcggtgtcagctggtcgtctttccagccattgctcagtgatgccgggagagtgatcgacatcacccccaacttctcggccatcctcacatctgcgctgcacagggtgacattttccaagaagcgcctggtgcccctgctcctgtcgcccaacaaggcggacctggagttcttggttgggttgctcaaggaaggcaagctgaagacggtgatcgactcgaagttcccgttgagcgacgcaggcaaggcgtggcagagcagtatcgatggccatgccactggtaagattgccgttgagatagagagctgatcgtcgtcgacgcttgctagtattacaaaaggacttgcatacagacagtggacgtgaatacttattaggatgtaatcatacagactagtcacttgtgcgtttgtttattggggtgatgttcgtttattcagcttattatattatcttgttaaaagggtattgagagatatgagttgcaacaaactgtatatggctatcgtaaacaatagcattgtgctgtcaaaaatacagttcgctctttgctgatgctttgtgaaccaccacaaagtgctgcagtggtcatctgttggccagaattcagtatcaccttcagttttttctcgatccaaacaaagaaccg

SEQ ID NO: 16051 - DNA, 678 bp, Triticum aestivum
  unsure (1)..(678): unsure at all n locations
  Clone ID: PAT_TA_16051
ttgcacgaggatcactcacatcaacaccgtcgtcatgggtagggtcattcgcaaccaacgtaagggtcgcgtgctctatctatacacggccaacacccgcctgaacaagaaccccgcccagttccgcacgctcgacttcgctgcagcgcaatggttacattcggggctgtcgtttaggagatcgtccacgactccggtcgtggcgctcccctcgccagggtcaccttccgcaaaccntttacaagttcaagcagaacaccgagacccttcattcggccaacggaggggcaatgtacacttggcccagtttcaatctaacgcccggaaaggaaaccgcttgcgcttcacccattcgggcaccgtcctccctcttcgcttccgtccccgaaaggttacccgtcctcaaccaacgngttcgaaagaaccaagaacgggtaacccgtggtgcgctcggcgtaccttccggttaactacgttgaaccgtttatcggccacaaacccctgataagggcaagacccgtgttcaagcttcccatcttggcgcccgcgacggtccttcccagctcgtgccgtgcctatggtccggtcatcgtcgctcgcaggtggcccgcacagacnaccctctcatgaacggcctcggtgctacagcacaaggttcgtcttccagcgcaacagctt

SEQ ID NO: 16052 - DNA, 448 bp, Triticum aestivum
  Clone ID: PAT_TA_16052
ggcacgagcccggacgtcgtcaagctgtgaggagctcagctcgccgccggcggccgtgccattaccctgcacgtacgtgtcccccgaaacctggagctctgtgggggtcccgaccaaattaaaccaatctctttctctcctttgctctctttcttccttttcctttttctatttttcgtcgccataaatggaattacatggatactcgtgggatgcgtcacacaaggaggggatcattcatcattcacagggagattagtcggctacccgtatatttatgttgaattggaggacgctaacgtgggcgtgcgtggttgttaaattgttcgtgtcacggatttccactgcggtgaaagggatacttacattggcactaaaaaaaaaaaaaaaaaaaaaaaaaacggttgtgtaaaccttcttcatgcatacatgcatgcacttctttctc

SEQ ID NO: 16053 - DNA, 667 bp, Triticum aestivum
  Clone ID: PAT_TA_16053
cgtccgggttcctctgctctccctcccgattcagcgcgccgccacccaccgcgtccccccgaccatggcctcgccccgtctccttcagacctcgccgccgccgccggccatggcctcggccctctcccctcccctccccctcatcagatcagaagagaagagaagagaagagaagagaagagaagagggagggggatcgagcgagcaggaggtcccagatgagatccgccgccggccggccccatccccacagccgcgcccgtgcacctctcccctctctctcttccgattcgttccgcacccctccggcgacctgtctcccccatcccaccacacccctccgtcgaccctgctctctcccccaccacacccctcaccttctctgccagatcgagcagggcggccatggctctccggcctcccccgtctagttgctgctgttcgagctcctctcagctcccaccgaccacatcaagggcctctgccgttgggtctccgcggatccacggcgccccggtgcaggcgggtcccaaccctagccgactacatcaaggctcaaaggggctcctcttcaccggcgccggcttgatcagcaagaagatggcagcctcctcgtgggggggtatgggccggagctggaccacacctccgtgcatactggaagtat

SEQ ID NO: 16054 - DNA, 604 bp, Triticum aestivum
  Clone ID: PAT_TA_16054
gagggtcgacgcgcgcaacgtctaccacgcgcacaagcacgagttccaggtgaaccgccataccttcaacatcctgctctccgggtggaagtcttcggaggatgccgatgcgttcttcgcagagatgcgagagcacggcattgatcctgacttggtcacctacaactctttgattgattgccactgcaagaaccgaggcgtggagaaggcctataagctgctcgatgaaatgcgggggaatgaaattgcccccgatgtgatcacctatacgagtttgattggcggattgggactggttggccagcctgacaagggctagagacctgctgaaggagatgcgtgagctcggatgtcacccggatgtggcggcgtacaatgccactatacggaactttgttatagcacagaggcttggtgatgcgtttgcattgatcgacgaaatggcctcaagggggctgatgccgaatgccacgacgtataaccttttcttccggttctattactgggcgtatgatattggtagcgcgtggctcttgtatgagagaatgcggtctgaaagatgtttccccaacacacaggtcttgtatgtttatcatcaggttat

SEQ ID NO: 16055 - DNA, 674 bp, Triticum aestivum
  unsure (1)..(674): unsure at all n locations
  Clone ID: PAT_TA_16055
cnttacgagggagaagtgaggatgaggagaagacatctacacagagtactcacctctcggtgtttgcggtgccatctgcccatggaacttccctcttgtcctgagcactggaaagatcgcaccggccctcatgaccggaaactgcatgatcgtcaagccttcacccttcatcaccttacacagctctgaagtttgtagagctggcacaggagatcctccctgcaggtgtcctccantttaggtcggcggaacaaccgagctcggtggttcagattgttgccctccacccgacatttgcccaaggatcagtttcaacccgggctcccatccgctacgggaaaagaaagtgttccattgggaagaccattcttgcaaaaagaaccctccaaggcggccggtacaccacctcggaggcttgggtaggcaaccgattctttcccattcattcctttccccgaattgtttgaacntcaaggaaagaacttgcacccttaagggtcggtccatgggtggctttccagaacagcggtcanagtatgcgttcgcccaccacagcgcatctacatccacgagtcccatctaacaaggagttccttgaggagattgtcaaaccttcaccaagtcgatcaacgatcggtaacccagacattgcgacacctgctcggaccttttca

SEQ ID NO: 16056 - DNA, 592 bp, Triticum aestivum
  Clone ID: PAT_TA_16056
tatcagactgttttccagtacggaacttagaagagtattgttgatgtgattttgcttgtcattttcgatttgacatccggacagggaagtgtcgtatcttgtgagttattacaagagcacgctatatattctcttctatgacgcagcgctgttgagtaaagcaaaatcgcggctgcgctcttgactggcttcgtcacaacagctgcggtgcaggagaagtacatgaaagatgatgagatcgttcagaaaacaagcgggatgcaatgagatcggcgttcgctggcgccagcctgctggttaaacgtgtcactggtgtagactatggcaatgcggatctattacccaagttgtagacgttgcctgaagtttcttgctagtctgtactagtagaattttgtcttcgcctcagaggcgaaggcagtatgctgtgaaactatatggcaagtatacttgttgtttctcttgacttgggtgatttcaagtgtgtaggactagtagaaacttcccagttcagcagcacctgtaccttggcctcgtccggctgtattcctgtgctatgatagagtggacggtatgcaaaaaaaaaaaaaaa

SEQ ID NO: 16057 - DNA, 1968 bp, Triticum aestivum
  unsure (1)..(1968): unsure at all n locations
  Clone ID: PAT_TA_16057
tcgcggccgcgtcgacccgaaatcgccccgcccaccgccgccgccggcgagaatgtcggccagcgccgcgcccgagaaggccgccgggtccggcggggagctgctctactgcggcgccaccaacttcgacgccatcaaccggaagctggccagcgggatgcagggcaacctcgtctccccgacgcggctgcgctcgctcatgggcgtcgacatcgtctccgtcgcctccggctgcaccgcttgccattgtgttgctttgggtgctgatgggcgttgctatacatggggtcgcaatgagaaggggcagttgggacatggggatactcttcaacgtaacctaccgactgttgtttctgaactatctaaatataaaataattaaagcaagtgttggaaaaaatcatacagtggttgtaactgatgaccggaagtccttcgcattggccccccgcccgtttggacagttgcgcgcgggttccctaaagaatgaaattgaggcatcgccagtgccctgtcttgtgacggaagtgactggtgttgcttgtggtgctgattttactgtctggctgtcgtcagtcgagggctctactatactttcagcaggccttcctcagtatggccaacttggtcatggaaccgacactgagtacaataccaaagattcgtcagtaaagctatcatatgattttttccccgtcccaggggcaatagctacattatctgagaaaactatttgtcaaagttgcatgcggaacaaaccatacagttgcagttgattcgagtggctttgtttacacatgggggtatggcggatatggaaggttgggccacagagaacagaaggacgagtggcaacctcgcctcgttgaaatatttcaaaggcacaatgttctgcctcccaatgctattctgtcagctggttctgcaaattgtgcatgcactgctggcggggggcagttgtacatgtggggaaagatgaagactacaggcgatgacacgatgtatccgaagccactaatggatttgagtggttggaacatccgctgcatggcttctggtaccatgcaccacgttgttggtgcagatgattcttgcataagctggggtaatgcccaatatggagagcttggttatggtcctatgggacagaagtcatctgcgaatcctaagaaggttgacagtcttgaaggaatgcatgttacaggtgttggttgtggattcggactgtctctgattattgtggacagagcaaaagctggtgataagcttgatcagcttgatatttatgatggtgatgcctccaccccagtagaagagaccgtggagccaaaggtgaccaagaaggcgcctgctagcgctaattccaagtccaacaagcggaagaaaaccaaggacctctccgaatcagaagaggaggacgaggacgaggatgatagcgaagacgatgagaacggtgatgcgaggggtgcaaagggcaagcgtggccgcaaaccatcgggcaggggcagaggcaggggagccaagaaggctaccccagagccgaagtcgtctgggaggggcagaggccgcccgaagaaaactgagagcccggctgaaagctcgggacgaggtgggaagaggggccgaggcagaccccggaagtcttagacctctccggcgagcctttttggtgaaatcaggtcaagcgatatctaacacctgatatgatgtgatccagcccggccattcgacagtactctctgactgcctgctattcgagagattttttccgtgtagtggtaatcttgtgattgtgagcctgtaatgttagcatgcgcaaccgtattattcattggtgaccgtgagtgaatttttctgctcaaaaaaaaaaaaaaaaaaaaaaaaaagttgttggcttaattttttccgatgctnnnnnnnnnnnnnnnnnnnnnnnnnnnnnnnnnnnnnnnnnnnnnnnnnnnnnnnn

SEQ ID NO: 16058 - DNA, 714 bp, Triticum aestivum
  Clone ID: PAT_TA_16058
gttcctcctcttcccctcttctcagatctactccgccgccgcctcccatggcgcctccagccagaaaccttaaccctaatccgaacactaacaaccccgatcctcccttcgacatgggtattctcttcggttcgcctcctaccgctgcgcccacgttccctgccgccgtcggcccgccgccgccgttcggcccgccccccccccccgcccccttctctcccccccccgccgccccccccctccaccgccccccctacctccacatgcaggatcttcatccccctatgccccgcccagccatctccttcgccatgcaccgcgcagccatctccttcgccatgcaccgcccagccatctccttccccatgccccgctccttccccattccagatctaaatgcaaaccctagctccgccttgcccggcagctaccttcactacccgcaggatctccgatacctcaactcctacaggcgagaccagaacctgagtgttaacctcagagccgccttgggcctgcctgcaggatcgccaatctcccatggccagctcaggcaactccatccacacactgaacccaaacacaaacctgaacctgagcgccaaccccagcgccgcctcgcacggccgctaccttcagaacgcgcaggatattcgacattccatgccccgcccagtactatcctctgccatgccaaaccggagcgacaactcc

SEQ ID NO: 16059 - DNA, 740 bp, Triticum aestivum
  Clone ID: PAT_TA_16059
cgggctgcaggacaaatttgaggcgtctctacaggaagccacacatccgttattacatttgccacatgagcaagacctttgtcactcaaagaatcctatacatatcacctgcaattatatatacaattcttcttagtgttgttacctttgattttgcagtatttgtcctgattgatactgtatgattatgtgttgttttgcaggtactgatcttggtgtcgattcctacctgagccatcagacacaacttcggttggtcataggtttcttggctctttaggctgaggttttctttcttgggcaactgaggcagaagaacctggtaaattggttgagcagtgctatgaggatgaacacgggatgctggtgtacaagttcatgagcattgggagccctaagacacacctcttcaaaagtataaattgctcccttccgtggatgacaaggataaaaatcgacaaggatgaagattgctattggcgcggctaagggactttcttgatgctatctcgccagtgatctacaaggcctacaacgtcttgctcgactcgcgcgggcgggctataacgtcagtctgagcctccacgagctcgatgccctcggggaaagtagagcactctacacgcttgccgatgcagtggtcgtttaggttgactcgacgactaggtagcagcaggagcggatgtgaaaaagcggtggtcaacttgacctgctaagtgtgcatttgcttttgaagcact

SEQ ID NO: 16060 - DNA, 837 bp, Triticum aestivum
  Clone ID: PAT_TA_16060
gcacgaggaggttctagactttggtggttccaagtttgcagtgaagttgcctattttcaagtcgcacccaaaaatgacagtgttcgttctgcgcaggtcaatacaaggtacaatttggacctgtgtaaaaatgtttatggagaaggagtttatcctgatgtgttcatgacaaacttatattatggaggcacaacttctaaaattgtgtttacaaatggctctcaagctccatggcgtcatgcctcccaacagaagtcatcggaagacatgccatcatacataatcaaatgtagcaactgccgacatggcactgatttggccggccgtccccggccccctttcatgtctgtaggtggcgcccccaactgcacgtccccagaagctgtgaactcagtaagggagcagatcgtcaagcacatcgacctgtggctatcacaatgccttgaaccaaccaagggcgtggtgaggtgacgatgactcgctcctgtttaggaggggtaaaggaagcagtgtgtagaggaaggaccgattgcaagtttgcgacatcgttatgctgcagaccgagtgaaccatatgcggattgagcagccagtccccggcctggatgcgattgcgcgcaggtttgtttggattatcacaaacggtagaaagttgtgtttgtactgcggccgactagagccatcatggcaactttgtcgagttcaaataatcatatacatcgttcatgaggcttttaagaataaaggtagggggttcttcaaaccaaaaaaaaaaaaaaaaaaaaaaaaaaattaaaaaaaaaaaaaaaaaaaaaaaaaaaaaaaaaaaaaaaaaaaa

SEQ ID NO: 16061 - DNA, 522 bp, Triticum aestivum
  Clone ID: PAT_TA_16061
cgtagctgactagctagccccctgcccctctcctgtgctgcacgccatggcgatgctgaagaagaacacgaactccctgatgtgctgcggcttcgcggccgccctcatggtggtcatggctgccaccctcctcgtcttctcatgcgatgcccgcgaagagatggatgatcttgctgcttcttttgtgccggcgtcgtgctactccaactacttcccacactgcaccgaccaccggtgcaagaagttctgcggcggcgcccgcgagccgccggtccccgggagccttctgcaacgaccgaagcaactgctgctgccccgttagttgagctccgtgggaaccgatttcaagatgcctataagcataaataattttatgctgagaaatatattggggatgcttcaggaagttggccaggctcggcaagagtttttaatctttgtaagcggcttgggtaatgttgtcttgacgctcaggtgggaaaaatttgcagtaatataagtctaactcgcaaaaaaaaaaaa

SEQ ID NO: 16062 - DNA, 438 bp, Triticum aestivum
  Clone ID: PAT_TA_16062
cctatgtgatttcctggaattgatccctagaaatatccaattgaattgcttggggaaagcaacaagctgcaataccagacgttacataagcgattcgataaacgatcatggctcaggttattcatgattttagatcgtgaaaaacagagcataggtggatcttgatagcacgggaaacattgaggcaactcccataacaatgcataaattagcttcagtactaacacgatgcttttggatatcagtactgaaccacaaattctgtgatacttggcaaactatgaaatcatgtgtaacgatagtatacaacgatctatttatagtgacagaatatagtgccatcaacaagatatctgcagaattggaattcacaccacattggtcatctgcactaccactttacagaagataagggtttgtcatatacgtacatcacca

SEQ ID NO: 16063 - DNA, 686 bp, Triticum aestivum
  unsure (1)..(686): unsure at all n locations
  Clone ID: PAT_TA_16063
ctcgtgccgaattcggcacgagcggactccatctctgtccatcgcctttcttcctcctatctgcaaatcctcctcccgcaccgcgacccacgcccccctccccccctccggcggaggcggccgtcgcggtggtgctcgcccccacgaccctcaagctgaccccgcccagccgctacgcggaggcggccggcgccggcgccggcggggcggagcggggagacatgcacagatcggcgggggtcgcgatggcgtggaacgtcttccgcttctgcacggcgctccggggcctgggctccatcatgatcctgctcgtcctcgccatcgtcggcgtcacctactacgccgtcgtcctctgcaactacggccccgccctcctcctcggcggcgccgccaccctcgccgcgctcgccgtgctgctcctcttccacttcctgcttgctatgctgttatggagctacttctctgttgtgttcaccgaccctggttctgttccgccaaattggaaccttgattttgacgaggaaaggggagaaactgctccgctctctagctcagacttctagcgccatatccacccanttatggtccatnacccggaaaccaagatagnatgttgaatgaacaannaaccctcgngcaatntgncgttggganggactaaangtacacggnnggttaatgtcgnc

SEQ ID NO: 16064 - DNA, 798 bp, Triticum aestivum
  unsure (1)..(798): unsure at all n locations
  Clone ID: PAT_TA_16064
gcacgaggctcttcttcttcctcatcccctctctgctccactccgggaacgcggcgacgggaggatggggcacgcccccgcgtagagcctcgcggcgcaggtcagtgagggctgcaagaatctgagctgcttgccaagactgtaaaaggaagagctctgcaagaacgagaagacaggattatatttgcttctcaattgatttttcttgcgccatggaggaggtggaggcggccaacagcgcggcggtggagagctgccacaagttgctggccttgctctcccagcagcaggacccagcccttctcaggagcatagcttcagagacgggtgaggcctgtgccaagttcaggaaggtggtctccctcctcagcaatggtggcggcggcaggggagggcatgctagaggcaggttctccaggagaaggaagcccgtggggttcttgagccagaaaggcttcttggagagcagcagcaacaccccattggggatgctcatgtccgggagtgcagccactccatccccatctgctggttcggcagggcaactgcggccccagggtcggcgcgccgccgcagccgcgacgcagcctcgattttgttcatgctcaagcagcaagagcgcccaccagttttggccctccaaagatggtccagccaattgtctgtgcagttccagtttggtgccaactgcacataaggtacccnattccagcaagcangcagcagaattttcaggcccaaatgttcaagaggagcaacagtgggatcagcctgaagtttgatagccccagtggcggc

SEQ ID NO: 16065 - DNA, 486 bp, Triticum aestivum
  Clone ID: PAT_TA_16065
cctctcgcccgcgtcaatccaattttaatgctgcggcagcccccctccccatcctcggaatctgttgcattcaatacaactttcgaaaaacaatcatttttctaatgcgccccagctacctagatccagccaaaggctccaagccccttttgccagcactgttcggcctccattagcggcgcacgagcgagcttctccgccccctcgcctccgctgcgtccggctggtgcgattagcggagcgctcacgaagagagagaccagcagtgaaggcgaggccttcgagctcgcgatcccttttcctctgctgctgcccgcaagattacaaaatcccgcgtttgtcctgttgccgctgctgccgctggcgctgctctcgggagggcggccatagaaaggagataaggagaggaagaaacggaaaaaagaaaataaaggctggaggcttttggagctcataatttttggcctttctctgggcttcccgggg

SEQ ID NO: 16066 - DNA, 814 bp, Triticum aestivum
  Clone ID: PAT_TA_16066
gcggggtcggatgacgatcctaatgtatttcttgtcaatgactttgaagatcctcttcagaagagcctgtcatctctagagcttccaggggttgccactgtggcaaatgccatgtcacgacagaattccttcagcttcactggttcagttagtgaagtacgacatggagatgatgccaaatatggggggccttcaaccatgtctgaatatggctcaaagcaaaggcgcaaatcgaatgatccaggtcgtgacatttcgtttcaagttctggagaaattctcactggttacgaagtttgcgcgcgaaacaacatcaagcctctttcgtgaaaatcacagtagtggttctcatgcttatggacggcaaaaacaagaatatgttttggacaacagagcaagtgacaagtacacagatcagctaataacgccgaatgatgcttctttgacctccgactcggtagagtctgacgagtcactgctggtttggggaaaaaagagaggcaaaccattaagtgttgaagagtggagagctttcttagatcctgaaggtagaattatggattcaaaggcactgaggaagaagattttctatgggggagttgatcatgttctgagaaaagaggtctggaaattcctgttgggttatcatgaatatgattcaacacaagctgagagggaataccttgcagccatgaaacaagaagaatatgaagccataaaatcccagtggaagagtatctcaaccacacaagctaaagggtttaccaagtttagggaaagaaagggccttattgacaaagacgtggtgagaacag

SEQ ID NO: 16067 - DNA, 1045 bp, Triticum aestivum
  unsure (1)..(1045): unsure at all n locations
  Clone ID: PAT_TA_16067
gccacatcgcttcgcttatcagcaacagaatcaaggcttcgcttcaccaaagcttggtactgccgaattgtgaaagtattcccatgtcatggatgatgcccgaggaggccgtttggccgcctcccggagccgcaccccccacggccctgcaccgtgaacacggcgaggcagcaagcagtcatagttcagacatgggtaagctccagcttgatgtatgtttgcctcactaaaggtcagttccaacagcgaagctagcaaatcaagtccacctgctcctttcaactagaagcgacgacgaaccgctgaagaaggtgacatccactcattggcctaaccaagaacccacaacagaagcatcaaccagctctggttcttccctaccttcagaagctgaaccttctaaccagttgacggcgccgctgctgacccccggggtctgcgagggcgctgcttccgcagtggctcccgcgcgctcgtctcgtcggccggtagcggtggtacctgctgggcatcggcggccgccattgtcatcatctgcttctcctggggagtatgacctgatgcggaatggcagcaagcgagctgcggtgatcgttttggggaggaaagatgagcggcaaattgggaagaaaagacgcggcatattgtccnagaagattaaggagantctgggaaaggagcaataggctgggagacgagcacccatttagtagaagtatatatttccccaaatttatatccttgcttattgctccngctgggaatggaattttgaatgtccaactgttnagatgttgtacaatcccgggattgtgcncaaggtttttaaggancattgctgtcccancataatttacanganaataaaccaatncgnggaattncccctaaaaagaattgnaatttcaattacanaatgtataatttntngggaatanaattgtgtgtacattaaacngatgaaatcaaacttccccagggggccgtacaaaatcccccaaatgatctttaccccccatgcctctttaaactctacngaaacctg

SEQ ID NO: 16068 - DNA, 973 bp, Triticum aestivum
  Clone ID: PAT_TA_16068
gtgagagtcctcatctgacaaacatcgcctctgtagttcatccagcggagaagtggatgttgaagatgttcccaaaccagcaaggttggcacgaattgttccttccgggtcttgatgaatttaagacgagagcaattgctgaaaggggaaaggatgcctctagtcaaactggccatgtgattcacaccgaaggggacctagtggtcagttgtacaattatgcttcggccgctaaaggggcaaaggttctggattttaacaaggaggccaaaggcgcttccaacattctagacaaagataaggataagtatctccgcaatccttgttccgtggagggaaaatatgtcatcatagagctttctgaagaaaccttggtagataccattgcaattgcaaattttgagcattactcttctaatttaaaagaatttgaaatgctgagcagtcttatttatcccacagaaaactgggaaacacttgggagattcactgtcgcaaatgcgaagcatgctcagagtttcacatttcccgagccaaagtgggcgaggtacttgaagttcaatttgcctaagctagcgtggtcgcggccgaggttgtacactgagcatgcttgaggtgtatggaatggatgctgtggaaaagatgctcgagaacttgattccagttgagagtaaaaatgctgaatctgatgacaaatcgaaggagccgattgagcaaccacctttgaaggagcctagtggtggaaaagactcctcacaggaaccccttgatgaagatgaatttgaggtagaagatgataagccaaatggagattcatcaaggaatggtgttcatgatcagattgtagagacaaggacacttcaggctggcagaattcctggagatacagttcttaagatactgatgcagaaagttcagtctcttgatgtgagcttttctgtattggagcggtacctgcccgggcggccgctcga

SEQ ID NO: 16069 - DNA, 883 bp, Triticum aestivum
  unsure (1)..(883): unsure at all n locations
  Clone ID: PAT_TA_16069
ctcgtgccgaattcggcacgaggttcgccggagttgggaaccttggagtagttctcgcaaaaacaaaaaaagaagaagcagctagaagtagcatggttacattcaccggagatgacgttcgggcactgttttcccactccacccatcagcacgcacttaagccggtagacacggagaagctgttccggtgcgacggctgcaagcagctcggcgacgagctcagactccggtgcgagcaatgcgacttcgacctccatgtatgctgcgcccaagcgccggcgcgcatcgagccctcgatgttggagggccgtgcgctcaccttcttcaacagccgtcccgcgacggcgactcatgcaggcggtattattccgttgtgcgacgtctgcggggacccggtgcgcggcttcctgtaccacaacggcgtgcacgatatcgacctccaccctttctgcgcaatcctgccgaagcgcacgacatgggggaaggacgacggcgtccatgctggaactccacaacgccgcccggcataactgcattgggccgggagatggaatccggcagcgcggccggcgctcgtcgtgccgaggccccgcgcgaccacggcccgctgtcgcagccatctcccgccttataggcaggcagtcgcccccaccgccggggccatgctcgggggcccngaatttcaacgtgtctgcaaacccattcatcntaccaaggttantaccatcacaactatatcccgtgggttgtcanacttccgtnanggnccaatttgancnatttgtccaatcccnaccaacaattgtactacacaaggaacggggtctaaaggattgcctgctgtcanatcattctctcccntgtaaataatatnccaaatgtn

SEQ ID NO: 16070 - DNA, 917 bp, Triticum aestivum
  unsure (1)..(917): unsure at all n locations
  Clone ID: PAT_TA_16070
cagagctgaattgttttcggagactgcgcagaggcatacaggcactttcaccaatgactatctcaacgcaaatgtgttcttgccacaaccaggacggccttttctctctttacaagctcagaatttccccaatgatacagtaaattccaccagtataattaatgcttcaacatatcatgcaagcgcaagtcaggcacggtctacacatgattacagccaccctttccctgcagctaatgtactgtctgcacgtcggttgccatatgaaaacaggtttgttgatttttcaaactcgcagaccaatcggccttttctattgggctgcccacctccttcccaatcatgggcagtgcagcattccaacagaattccccgtcgcgccgttattactctgatcctatcactagaacagaaccacccacagcaccacctttgcctacaaccagacagcatggcacaccatcttcaggtttccatgccaatttgcctcagcaacatgttgtgcattcagcaagctcatcagtgggttttcctcaccaccggttttacattcaaccatccaggccaggtagttcaagcaccttccaacagcataagagatgtggccctttcggccagaaatacagacaacagaatggggagcgctgttcttggcaattccaatgcttcgcctagtggtcgctgtgtgcaagaagagatcaggcccagtgaagctcactcctggggcgaagcatgtactggtgccaagcgatagcacaggtgatggcgattctgcgcctgtgtactcccgtgtttcgttcgaaagtacggagcacaaatgctgcatgtcctcaagaacagagggggcaatgataccctttggtggaacttttgccttggttgcagttccctgagcacacataaaacaaccgggngtg

SEQ ID NO: 16071 - DNA, 534 bp, Triticum aestivum
  Clone ID: PAT_TA_16071
ccaagggcactaaaccccccgaccataccggccatcgagggcctcaaggccacggcgtcgccggcgggcacggtcagctaccacgtggagcagatgggcccggaggcgtgcgacaggctgcggttcccggcggtggtgagggtgcagaaccacgggcccatggacggcaggcacccggtgctgctgttcctgcggtggccgaacgcgacggacgggcggcccgcgagccagctcatcgggttccggagcgtgcacctgcgggcggacgaggccgcgcacgtcgagttcgaggtcagcccctgcaagcacttcagcagggcggcggaggacggccgcaaggtgatcgaccaggggtcgcacttcgtcaaggtcggcgacgacgagttcgagctgagcttcatggcctgagccggcagccggccgctgctgcttcaggagaggaggatttcgagcatatatgcataagtgtaatcacctaacttatctgaacgagagaatggtaaattaaaagcgagatcatcttccctttgtttc

SEQ ID NO: 16072 - DNA, 1887 bp, Triticum aestivum
  unsure (1)..(1887): unsure at all n locations
  Clone ID: PAT_TA_16072
ccgggctgcaagattcngcacnaaccggcgaagaccgacnatgacgggcaaatacgcngccgtgtccggccgcccccggcttggcggcggagtggccggcgccccctgcgccgccgtcctgcgcccccccgcccgtcccccgcgcctccccccctccgaaggccagaactggaagggcgtcacccgcttccccttcgacgcgaaggtgaccgagcaagacctggcggacacgtacaacccgccgttcaacagctgcgtggaggacggcggcgccagcggcatcatgtgctcctacaacccgcatcaatggcgtgccccccggcgccgcaccacaacctcctctccacgaccgccagaggtcgattgggagcttcaacgggatacattacttctggactgcgagcgccgtggccaatcatccacgacgtccaggggtatgccaaggcgccagaggatgcggtggcagatgtcctcaaggccggtatggacgtgaactgcggcggctacatccagacgcacggcgtgtcggcgtaccagcagggcaagatcacgggggaggacatcgaccgggcgctccgcaacctcttcgccatccggatgaggctgggcctcttcgacggcaaccccaagaacaaccggtacggcaacatcggcgccgaccaggtgtgcaacaaggagcaccaggacctggccctgcaggcggcgcaggacggcatcgtcctcctcaagaacgacgccggcgcgctgcccctctccaagtccagggtctcctcctccgctcgccgtcatcgggcccaacggcaacaacgcgtcgctgctgctcggcaactacttcggcccgccctgcatctccgtcacgccgttccaggcgctgcagcagtacgtcaaggacgcgacgttcgtccaggggtgcaacgccgctgtctgcaacgtgtcgaacatcggcgaggcggtgcacgcggccagcggggcggactacgtcgtgctgttcatggggctggatcagaaccaggagagggaggaggtggataggctggagctggggctccccgggatgcaggagagccttgtcaacaaggttgccgacgcggcgaagaagccggtgatcttggtgctgctttgcggtggcccagtggacgtgacgttcgccaagaacaatcctaagatcggcgccattgtctgggctggttaccctggccaggctggtggcattgccattgcccaggtcctcttcggcgagcacaaccccggcgggaggctgccggtgacatggtacccgaaggagttcacggcggtgccgatgacagacatgcggatgcgcgccgacccgtcgacgggctacccggggcgcacctacaggttctacaagggcaagaccgtgtacaacttcggctacggcctgagctactccaagtactcccaccggttcgcgtccaagggcacgaagccgccgtccatgagcggcatcgagggcctgaaggcgacggcgtcggcggcgggcacggtgagctacgacgtggaggagatgggcgcggaggcgtgcgacaggctccggttcccggcggtggtgagggtgcagaaccacgggcctatggacggcaggtacctggtgctgctgttcctgcggtggccgaacgcgacggacgggcggcccgcgagccagcttatcgggttccagagcgtgcacctgagggcggacgaggttgggcacgtggagttcgaggtgttcccttgcaagcacttcagccgggccgcggaggacggccgcaaggtgatcgaccaggggtcgcacttcgtcaaggtgggcacgccattgacgcggttgtaggagcacatgatgccgctggcgccgccgtcctccacgcagctcttgaacggcgggttgta

SEQ ID NO: 16073 - DNA, 1202 bp, Triticum aestivum
  Clone ID: PAT_TA_16073
caaggctgggtcgaggcactcgcctccacccggatttggggtggacggagttgagcgccctcgcgcaccaccggagcctccctgcacacaacctgttcgacgaaacgcctctgagctctgaccccatggcggaggcgtcgggcgacgggagcatggaagacaagatcagcgccctcccggacgagctcctcatccatgttctctcccacctgcgctcacgcgaagctgtgcacacatgcgtgctggcacggcgctggcgagacctctggcagtcggtgccctgcatcgacgtgtctttcaaggaattcgcagacatggccgctgaaaacgactttgagcctgaggtggtgttcaagaagtttgtgaaccatttgctgatgctccgtgaacgcgtagacccggaggagttccatctgcagtacagcttggcggtcggggtcggcccacgcagtgctaagtctgatgaagccaacctatggatccgccatgcgttacagtacaaggctcagactgtcaagataggcaatcacagcgaacctctgcagcttcttccctcggtattcacttcaacgtacttgaaaagactgcacattaccaatgctcaactgatcctaggtttctttgaccgtctccgaaaaggctgcccagcattggaatatctcttcctatcaacctgcgacattgaggaccttgacattttctccgacacactcaaggttttgatcctctctgatgctatcgggttctcattctcatttgagcacgatgcccaagtctctatttctgctccaagcctcatttctctgtccgtcgaagagtgtccttccggggccaggctacctatactaaagaacatgtcatcactagagactgcatcagtattgctttcagaaggagatatcacaacttgtgatgctgatggtatcaggcagtttctcgggggcctctctggtgttagaagtttggatttctattatggggatagacagctggaggtgaaaaataatcacggatggtgcccaacattcaacaatcttacaaacctgacccttgataggtggtgcatgcatgcggacttatatgccatgatagtcttccttccgcactcacctaatctgaagaagctaactcttaaactaaacgagccaccctcccgctccccgatgactgcagacacaacctcgttgtgatatcgtggctcg

SEQ ID NO: 16074 - DNA, 475 bp, Triticum aestivum
  Clone ID: PAT_TA_16074
cgtccgtccggctttcctccccgattcaccggatgcagcgatttcagtgacttgagcgccggcggcggagcacgtggagctgacggcgacgtgggaggcggggaggtccttcacacgtgcacatccgtaagtgtgccaccggctactttctgcccgcgcgttatccagagacagcggcgtcgcggcggcgatgcccacgctcggcgggggttctgcgggatctggacacggcgtcatcaaggggaagaaagggaacgcgattgctgacagtaatgaccctgctaaagcgtttgcaaacaagtttagagtcacatatggaaagtacgagtctgaggcgaattctgaagattgggaatagcattctctccacaaaagatgcttcaagaagtccaagaggctttagctcgaaaggcagtggttctaggggaagtttcccgcattgtagagttattcttatctgtgattcagaaatgga

SEQ ID NO: 16075 - DNA, 729 bp, Triticum aestivum
  Clone ID: PAT_TA_16075
cacagagacgagagagaaagcgagagggagacagagggttccgtgctcatccacgcatcgaatcgggtccccccccctcagcgtctcgtcggcgccctgccctgcccgggctactttttcctttgcaatggcatctggaactgatgagaaagccaagatggagagtttgacatcacctgcagcctttgtagagggtggggtccagatgcatgtgatgatgcatgtagcatttgtcttgaggctttctgtgagagtgatccttccgcattgacaggttgcaaacatgagttccatctccaatgcatccttgaatggtgtcaaagaagttctcagtgccctatgtgctggcagcctgtcagtatgaaggatcctaccagtcaagagcttcttgaggcagtacagtgggagaggaatataagaaccaatcaaactcaaaatacgactatatttcatcatcctgctcttggtgatttcgaagtgcagcatttacctgttgttggtaatgatgctgaacttgaagagcgtatactgcaacacctagctgctgctgcagcaatgggaaggtcacaccaacatggtagaagagaggggcagaggaaccgttctggctctcatggccgcccacagttcttggttttctctgcacatccaaatactcctgctggctctgtttcatcatcttccactcagggggaaggtgctgatgacctgaggattcttgttcccaga

SEQ ID NO: 16076 - DNA, 1904 bp, Triticum aestivum
  Clone ID: PAT_TA_16076
cgtgcgcccgctcacaccgagacgagagagaaagcgagagggagacagagggttccgtgctcatccacgcatcgaatcgggtcgaccctcaggcgtctcgtcggcgccctgccctgcccgctaagatcaggaggaccctcgccgagctagcccgcgctccccaccttttttgttcgtcgcgatcgtgatcggacggcgagccatccccgattcggggttgtgaacagtcgatgccagggctgttttttcctttgcaatggcatctggaactgatgagaaagccaagatggagagtttgacatcgcctgcagcctttgtagagggtggggtccaggatgcatgtgatgatgcatgtagcatttgtcttgaggctttctgtgagagtgatccttccacattgacaggttgcaaacatgagttccatctccaatgcattcttgaatggtgtcaaagaagttctcagtgccctatgtgctggcagcctgtcagtatgaaggatcctaccagtcaagagcttcttgaggcagtagagcgggagaggaatataagaaccaatcaaactcgaaatacgactatatttcatcattctgctcttgatgatttcgaagtgcggcatttccatgttgttgctaatgatgctgaaattgaagagcgtatactgcaacacctagctgctgctgcagcaatgggaaggtcacaccaacatggtagaagagaggggcagaggaaccgatctggctctcatggcagcccacagttcttggttttctctgcacatccaaatactcctgctggctctgtttcatcatcttctgctcagggtgaaggtgctgacgacttgaggattcttgttcccagagttggtgacttaccaccacatgctaatcccattgaagaagcaggcaaccaaagtccgggggtccttacctacgatgctgaacaagatgctgttgtttcatctggaaatagtacccccgtatccagtcctaggtttttcaacaggagacattcctctggacaatcaactccagtaggtaatgacagggctgggccatcagatgttcagtctttctcagattctctaaagttgcgcttaaatgctgtctcctcgaagtacaaagaatctattacaaaaagtactcgagggtggaaggagaggcttttttcacgtaactcatctgtgtctgatcttggttctgaagtgagacgcgaagttaataatggaattgcatctgtatcgaggatgatggagcgtttggaaactagaggaagtggtagaccaagctatagcccaacaacatctacttctgaagtttgtctcactacagaaccaagcaatgagagggttaccgaaagtaactctaatactactacgagtactagcaacacttctaccccttgtgtgaccatgtctggttcaaattagtgcatgctactgtttctgaagaaggcctgcatgtgcccattcttcatcttcaaaggtatgggcaggtggcatagctgaaactccaacgacatgatgatgccatctcaactgttgcataaatcacctccagaaaatctgaatttgatgtattggtttgatgaaagggcagtgggcctgaggtattgccttggaagtcaatttaatttcctgtttcatctctgtaattaaaaaaaaaaatccttccgagacttctgtttactggtataaatattggatgtggtagtttccatagcaggcctaatcctgacaaatacgactcgtacagctaagagtttgatgctgttgcacggctattatattaaaatttttatgcctgttcgatgcactgacattgatgtctcgataaacaaactgatgcaagaaggcacaccgagttttgttatcttaaaaaaaaaaaaaaaaaacaaccacccccggc

SEQ ID NO: 16077 - DNA, 588 bp, Triticum aestivum
  Clone ID: PAT_TA_16077
cgcacgaggggaataatcaaagagcttgttgcgaagatatatgtgtgcatgagtattcattcagaatggttgaacataagtggttcaatattctgattgaagagcatgaatccaaattatccacccatcggaaggaaggcaataaaaagtgagtgcatgcaggtttttcacatagagaaaaagaggtgcttaaatccctcctaaagggtgtggactccattagcttaactatagatttgtggacgagtaatcagaccatatcttacatgtgtgtggttgcacattatatagatgaggattggaagatgcaaactcgtgtgcttgctttcatagagttggatcctcctcactctggaaatgtcattgctgatgctctctatgcttgtgtgaccgaatggaagattgagaacaaaatcgcgtccgtcacactcgacaatgcttctaacaatgatggtgccgttgatgctttgaaggcaaagttcttggttcgtagaggtgcggacttcgatgcccaatatttccatgtccgttgttgtgcacacatcctcgatttggtggtgcaagatgggacaaaggtcttggaccctt

SEQ ID NO: 16078 - DNA, 734 bp, Triticum aestivum
  Clone ID: PAT_TA_16078
gggttacgtcaatagaattttgggtcagccttcactgattcgtgaatcatcaatgcgaaagtttccattgccaggtcttaaggctcttaaacctagctctgcatctctgttcggaaggtgcggcctttgagaatgttattcttcacccttcacttaaacggaggattgaacatcttgcacgagcaactgcaaatacgagatctcatgatgcaccattccgcaatatgttgttctatggacatcctgggactggcaagactttagtagcccgggaaatggctcgcaaatctggccttgattaggcaatgatcaccggaggagatgttgcaccattaggatcagaggctgttacgaagatccatgaaatcttcgactgggctaagaagtcccaaaaaggcatgcttcttttcattgatgaggctgatgcattcttgtgcgagcgtaacagtacacatatgagtgaagctcagaggagtgctctcaatgcactattatttcgaactggtgaccaatcaagggacattgttcttgtccttgcaactaaccgaccgggtgatcttgatgctgctattactgaccgaattgatgaagttatcgagtttcccctacctggggaagaggagcggtttctgctgctcaagttatacttgaacaactacatgctcaaggacgatgacaagagttctccttggagcacactgctgaagaagcagccgaagaaggtcgacgcggcg

SEQ ID NO: 16079 - DNA, 587 bp, Triticum aestivum
  unsure (1)..(587): unsure at all n locations
  Clone ID: PAT_TA_16079
tnncgtggtcgcggccgaggtgggagcnnnggtgggagagcttgctggctgcagtctgaagattgggagagatgtaagcagaaggtggcgagggcagtggagactgtgaatgggacccctgctgttgcagaacccggccaaggaaggctgcgaatggttgctgagatgatacaaaagcaactcccactttgtctaccgcagctccagagacggaccactttcggctggctcaactgcttcatgagataacaaattagcaatttagagccaggttaggtaaattttgttgtaattccctggagatggctgtgttgacatttggcattcgacagcagaatgctggagccccgaagaaaagaaaagaaatgcaagcatgtctattggcggttcgtgccagggacagcggctctgaggcgacagcttgctgatttatatggcaattttgtacagcaaaagcatgttgtgcgcgttcttggtcacaagctgtctctggcgctgtcagtttggtagaccaggatggattcggtttaggaggcgtggtgtacattacatatggtattcttacttggactgacattctgtctgcc

SEQ ID NO: 16080 - DNA, 579 bp, Triticum aestivum
  unsure (1)..(579): unsure at all n locations
  Clone ID: PAT_TA_16080
gacttcaagtgagcgatcttcctcacttcgtgtggatccaactgcaggaaatgatttgtttgatatatttggtgctgaatttcctcatctgtgccgcaatgtggatggcgactcgacctgggaacactgcaaaaccagctaagctcaggaaaagatgcacttgaatcctcagtttatctcgatacctctccagtctttggtgcactggaaagatgagttccccttttctggaatcttctcactaactgataagtgaccaattgttggacgcagttatctccaagtgtcaatcctggtggcaaagcagatctctggtgaccgtgcgtcttgcaaggacttcattgaccgacatgcctagcagctcttattggggctcaaaaagtgatgaagcaacatgaatcatccggggcgccccccccgctgctaagccnaaggatgaaggttgggtgtatcaaaattttggttaaacaaacaaanttccctaaaanaaaaaccggaggantggtggtcctttccaaaacaaatggggatggnncaaaatcccaaattacccccctttgggttcaaaaagnggggcaa

SEQ ID NO: 16081 - DNA, 661 bp, Triticum aestivum
  Clone ID: PAT_TA_16081
ttttttttttttatatttcagagcacataatcaagaataaaatacacaatacatatgaatgggtgattctatacacgatgaggcaattattctcacgcgtatataatttacatgagtaagaaacatgcttgtgggcacaagtcctatagctatcttctgaccctatacaaaaatctttgaaaaaactgtcttttgtctaatctccactgaacatccgtttgttagcttctctgctctcatgcaaaatgagaacacaaaggttggaggaaactctacagcctacaggagatatcaaaagctgcacaacaatagcgtcatacctcatttcatcaaatccaggaatacaaaaccgttccaaaggctatgaagcaccattgatgccaataggttgcgtgatctggcaaagacacctcccatcacaaccccgagaaatatcaacggcaacaccctttgcacgttgaagtgcgccagcgcaaacgccacagcacttagcaggatcgaccatggaagaggcatgtatcgcgttagagatgggaggaggaaaccacggaacacaatctcttcccatataggtgcacatacagtgactaccacagcatacaaggccattgccaccgggtcacgggccacaatggattgctctacactggataccccggtg

SEQ ID NO: 16082 - DNA, 571 bp, Triticum aestivum
  Clone ID: PAT_TA_16082
gagagaagctggcggcgccgaacctcaactcggtgaggggatacgaggtcatcgacgccatcaaggccgacctcgagaaggcctgcccggggctcgtctcctgcgccgacgtcgtcgcgctcgccgccaaatacggcgtactcctcagcggagggcctgactacgatgttcttctgggaagaagggacgggctggtggcgaaccagaccttggccaacaacaacctgccaagcccgttcgaccacgtctccggcaccaggcagaggttcaacggacgtcggccttaacacaacagacgtggtcatcttatcaggagcccacacgatcgggcggtcgcggtgcgtgctcttcagcggccggctggccaacttctcggcggccaactcggtggacccgaccatggacccggcgcttgcgtccagcctgcagcagctgtgccggggcggcgacggcaaccagacggccgcgctggacgcccgctccgccgacgccttcgacaaccactacttcaagaacctgctggccaagaagggcctcctctcctcggaccagggcctcgtctccagccccg

SEQ ID NO: 16083 - DNA, 876 bp, Triticum aestivum
  unsure (1)..(876): unsure at all n locations
  Clone ID: PAT_TA_16083
agggaagggccatgctgaagtttaggcccatcgcgccaaagccggcggcgatgtcgcctgcgccgantccggccgtgccggctgggaaggggaaggggaaacggaaggcggtttgcaggcccagggggcactgggaggaggggaccgaagcccaagaagtcggccactgtggctgcaccgacgacgcagaagttggactatgtgcaggacaagcgtttgtcctcgcccgtcgtcctcctcgtcggggatgacgtccgtcgactcgtcgcctcctccacccctgcctgcaaccctgccgctcatgcctgcgctgccggcagaggaggggttcggtggggcggcgccggtggcgaatctggcgtctgcccacgttgtcagacagccgcaggccctgcggcaagtggtgtcctgggtgacggttgaggacgttacaagcatctggcgcgacggcgaggcgccgtatgctgcggcctgcggcggcgaccaggccccaacgttcgtgtccgaccaagtgcggccgcgtcacgtggacaaacgtggctttcaaccgggcaagtgtccggtagggaggacgccgacgctaccatggccccatcggcgggttgcttcccaagtgcggggtggtgctcgccgccaagggatggcgccccccgtgcccggcgtgggggctcatgttgccggtttcaaccttgtcggggtngngcggtcccgttacgcatgccctccgcccgagggttccctcgctgggcccccgttgcgacgtggtgggcggctaaaacgcctgggcggggttacctctggggggggccccaccctttagggcaaccctnaaacctctccctcgggggggtttaattnanctgcggtaacngcgta

SEQ ID NO: 16084 - DNA, 771 bp, Triticum aestivum
  Clone ID: PAT_TA_16084
tcgcggccgcgtcgacgcaacctgacatgtaccaagcaatgtcagcagcagcttttcagaacacgacgaagcaagtatcgcctacactgctgcagttccagcagcctcagaacattgctggtagatctgctcttctatcgagtcagattctgcagcaagtgcagcctcagtttcaggagatgcaccaccaaaacatcaatgacagtgcaatccaaggccataatcagtctgaggccctccagcaacagcttcagcgctgccaatcctttaatgggcagaaatcgccgccgccgcagcagcaagaatcacaccaccagcaccagcagcaacagtcacagtgcatgcaaacaccacaacatcaacaaatgcaagaacagaagcactcgcctgactttcagtgtgtaccaaatgggttgtctggttttctcccagctttcctccaccaatcagtctccaccttccacattgcagacagtttcagcgttctcacagcagcagaaccttcaagacagaaatatcagctctctttctccatcgaatgtcccgtccatgcatgacacattgagaccatttccttcagaagcaggttcgaacctccaaggcgtgccaagaaccacccctttgcctgtctctgacccatggtcatctaagcgggttgcaatggagtctgtgatcccttctagctcgcatgttaactcgtcgcatatacgacagttggattcagcgccttctaatataccacaaagctcctcattagcaccattgcctgga

SEQ ID NO: 16085 - DNA, 766 bp, Triticum aestivum
  unsure (1)..(766): unsure at all n locations
  Clone ID: PAT_TA_16085
ctttatagtggatccccgggctgccggaaatttttgcacgaggctctttctctcctcagatctgagcggcggcggcagctcccatcctcttccttcgcacctctccctcagatcgagcaccgccccatcgatctctgcgtgtctagccatggagggctcgcccctctcccgcgcctcctcagcacggagcgctggcaatcccacacggcgtagatccaccatcccttcatccgccccacgtgcctaccgccggtggctgccccctctgttccgttcctcccccagcgtgccgcacccgacggcccacgctgccatgccgttttgctgcagccagcctgccgcccctaccctcgcgctccgggcagaggctcgttcttcttcgtggtgaccacgcgtccctcccggtggtggcgctctgcccgctgtgctgcctttctccaagcagctgtgcccttcgacccctacctctaatcaattgatccggcaacagagcgttgaagctgcaacccgaggcgtgatgaggaaaaagccgcctcgcctcggttcgttttgtgccggcggtctgctctctgtccgcgtaagtatttggtcggcccgtggcatatggctgctgggcacccgtcctacgcggcccctcccctggctacatcccattacntatttttttgggtatgataagttgagaaaacnaacttgttttggtggtttttgnatgtgaactacattatnatgggaccntttcactcccaattaggtgctaanattt

SEQ ID NO: 16086 - DNA, 630 bp, Triticum aestivum
  Clone ID: PAT_TA_16086
cggcacgaggactgcatgcgcatttcgttgcctgcttggttcatgtgttgtcaggcctaggcttcatgggcgagctccgtgtaggcggacggcgtagagaaggtgaagacaccgccggggacgactcgttctccgagtcgatggcggccagcttggattccggcgcgtccagcggatcgctgtgctcgtcgatcatgtcgagcctgacagacgacgacgacgacgcagagtcctccccggtggcgggtgatcctacgccgtcgccatcgccgtcggacgcgatgcggctggacgggggcggcggcgggcctctctacgagctggcgccgctgctggcgcaccttcccgtcaggacagggctgtccaagtactacaaagggaagtcccagtccttcacatctctgtccgacgtcgaatgcttgcaagatctcgcaaagaagaccaccgcccacaccggccggaaggcgagccgctcgtcgacttcaccgcttcacgttcaagggcctcgcagcaagacgatagggaagaagaagaaggcaccgcccaggggttcatctggccggctgccgtcaagagcagcatggagcaggggccttttcgcacagaagcggtaaaccacctgcatacgag

SEQ ID NO: 16087 - DNA, 1185 bp, Triticum aestivum
  unsure (1)..(1185): unsure at all n locations
  Clone ID: PAT_TA_16087
tgggagagactgcaagattccattggtactggtccttcacttgataatgatgggaacttaaaagggatgaaagatatactattacttggttactgggatcttccacaccatttgaagacttgtttgttgtacttgtgtatatatccagaggactacaagatcaactgtgaagaactgaaatggaaatggatggccgaaggattccttgatagacgatggggacgtttggatgaggtagcagagaactgtatcaatgaactcgttaacagaaatatgatccagccaattgacatttatggtgatggtattgtgaaatattgtcgagtccatgatatggtgcttgaccttctcatatctttatcagatgaagagaattttgccactgttttaaatggacgggggcgcgtttctcgtcccaggaagattcgtcgtctgtccgtgcaagctagtggccgagggcatcaaggggcggttggtgcagtcacagaaaccacggtgcatgttcgctcgctgactgcgttttgtcctgcatgagcagattccccatctcgtggacttccatgctttgcgggtgttggatcttgttggatgttatcggttggaaaacaagcatgtaaaacacataggtagttcgcgccagctgaggtatttgagaattggccgttctaggattactgagcttcctggtgaaatcggaaagctgcagcacttggagactctcgatttgagacactgtgattcacttccagagactgccatcaaccgtggcggagttgcggaaattgctgcgtctatttgtcagcaggaacacacaattacctgcaggtgggttccggagtctgcaggccttggaggagttaagcttccaggaaactgacgacccagtgagatttgnggaggaagtaaatgagtcgggcaatgcngaccttcgctatcttcgtactggaggagagatagccaagcgtctgtctgtagccccatgctgcacatacccgtgctccaagttcttaaagattgagtcaatttttagagtgggaaagtggttcccagggaatggctccctcaagaatctcgtggaaactatgccatatgggtcaggaatttgataaggaggtctcccagttctcatgggcatgccttctctggccatctggagcatgcatataggagggccaatgaaaagct

SEQ ID NO: 16088 - DNA, 600 bp, Triticum aestivum
  unsure (1)..(600): unsure at all n locations
  Clone ID: PAT_TA_16088
cggcacctggcgctgaaacaggcttcttcgcccgcccgcacccctcattaaaaaacagcgtctctcgcccgctcgccgcccccgcgccccccccgccgccctcgcctcccccccggccgcgccggccccgctggccccgcgcggctcgcgcgtccccctccaccgcctccaccaccgggtgctgcgggtggtgcggctggcgggcccggccggcgcggtcctgggggacccccggggcccccgcgccccccccgccgacgccctcgccccccactgccgcctcttcatgctcgatatgcaggcaactctgcccgacctactgcgcggggcttgtgaatatcgtccatttgagaagtgcgactatagtgcaagaatcgctaacgagatttgttgcaaaaagctggagtatgtaattgagaanatggatgcatgcaactaaacatggagcaaattctaatggagtttantagttaacaggaatctataccggtggtaagtggtgnttnaaagnatattngnttcaaatcaattctaagtcctgcanacaatgactgtaatgttgttactnaggcatangattgagganaatgataacnaaat

SEQ ID NO: 16089 - DNA, 783 bp, Triticum aestivum
  unsure (1)..(783): unsure at all n locations
  Clone ID: PAT_TA_16089
gnacccaatacaatctgccgctgtgctcgcccacttccctcacatcacgacaccactagccctgtctaagacctatggcgcccactgcctcaggatcactactggccctgtcagtaatcgtccttgtgaccattgcgtcgacccttctgctagcgccagtggcggcgaatgacattgacgcgctcacggccctgaggagcggcttgaaggaccccaacggtgcgttgacgacctgggacccgcagttggtcgacccttgtacctggtttcacatcacttgcgacgaccacaaacgcgtcacccgcatagaccttggccgccagaacctgtccggaccgctagcgccggagcttggccaactggaccggctagaatatttggaaatttatggcaaccagttgaccggcccaatcccaaaggaactggttgggttgtccaacctgaaaaatgcggatttctcaaacaacaacttctgcggcccgatcccaacctccggaccgtttcggcacatacctcggagtagctttgccaacaacccgcgcctgggcaggaagtgctagatggttcatggagtagctgagtgaaataaactggtggtagcatgcagctagcgaaacgggcggcgtcggttcatggagtagctggattcgtgagcgaggtttagctgtgtgtgcgcgcgccagagtagacatgctgattagtttctgttctgtacaagcttgagatcgatgtggctgttgctgtcacattacttcccctaataaaatcgccaattgatgctcg

SEQ ID NO: 16090 - DNA, 871 bp, Triticum aestivum
  Clone ID: PAT_TA_16090
gctcatacaacacagacaagcaggtgctctcgggagatccagctagctagctggcaagttttgctgttgctgctcgacctcatcgccgtcctccggccatggcagcccatgtggagccccttgtggttgggagggtgatcggtgacgtggtggacatgttcgtgcccaccatgccggtgaccgtgcgcttcgggacgaacgacctgacgaacggctgcgagatcaagccgtccatcgccgacgcggcgccctcgatccagataaccggccgggccggcgatctcttcaccctggttatgactgatccggacgcaccgagccccagcgagcccaccatgaaggagtggcttcactggctggtggttaacatacctggtggatcagatccttctcaaggggaggaggtggtgccctacatgggtccgaagccgccgttgggcatccaccgctacgtgctggtgctgttccagcagaaggcgcgtgtgctggcgccggctcccggcggagacacagcagcgtcggccatgcgcgcgcggttcagcacccgtgccttcgcagagcgccatgacctggggctccccgtcgccgccatgtacttcaacgcgcagaaggagccggccaaccgccgccgccgctactagctcgtcgccgccggccgatcaaacccgctgctggtccgtctgcgcgtgcgcgcatgcgcgccggcccaataaattagccatccatctcttgtcgttgtcatgaacaatctgggcttgtattgtgtggtactctgttttttcttgcgggtgcgtgtggtactctttggaccatgtatatttaccgttttctctcttcgttgtatttattggttatgtgtgagatccaaaaa

SEQ ID NO: 16091 - DNA, 1015 bp, Triticum aestivum
  Clone ID: PAT_TA_16091
gctcatacaacacagacaagcaggtgctctcgggagatccagctagctagctggctagttttgctgttgctgctcgacctcatcgccatcctccggctatggcagcccatgtggatccccttgtggttgggagggtgatcggtgacgtggtggacatgttcgtgcccaccatgccggtgaccgtgcgcttcgggacgaaggacctgacgaacggctgcgagatcaagccgtccatcgccgacgcggcgccctcgatccagatagccggccgggccggcgatctcttcaccctggttatgactgatccggacgcaccgagccccagcgagccaaccatgaaggagtggcttcactggctggtggttaacatacctggtggatcagatccttctcaaggggaggaggtggtgccctacatgggtccgaagccgccgttgggcatccaccgctacgtgctggttgctgttccaggcagcaaaggcgcgtgtgctggcgccggctcccggcggcgacacagcagcgtcggccatgcgcgcgcggttcagcacccgtgccttcgcagagcgccatgacctggggctccccgtcgccgccatgtacttcaacgcgcagaaggagccggccaaccgccgccgccgctactagctcgtcgccgccggccgatcaaacccgctgctgcctgctggtgctgcctgctggtccgtctgtgtgtgcgtgcatgcgcgcgggcccaataaattaaccatatcgatcttgtcgttctcatgaacaatctgggcttgtattgtgtggtactctttgtttgttttttcttgcgggtgcgtgtggtactctttggaccatatacatatttaccgctttctctcttcgttgtattcattgattatgtgtgagatccatggcagcgagcgcgtagtgtcatccccgcccggttcagcacccgtgccttcgcagagcgccatgacctggggctccccgtcgccgccatgtacttcaacgcgcagaatgagccggc

SEQ ID NO: 16092 - DNA, 592 bp, Triticum aestivum
  unsure (1)..(592): unsure at all n locations
  Clone ID: PAT_TA_16092
accaggctaactcgtcactctttttttagaacgagaactcgtcactctcgcactcacagaccaagctacctcctcaatggctctcgcggcgaagcctagctccggcgaccagggcagaggcgcaccgcatctcgtcttcatcccgagcgccggcatgggccacctgctccccttctcccgcttcatcgccgccctcgcgagccaaggcaacgtccacatctccgtcgtgaccgcgctgccgacggtctcgcaggccgaggccgagcatttcgccgccctcttcgccgccttccccaccatccggcgcatcgacttcaacctcctgccgctggatgacgccaccctcgccggcacggaccccttcgtcctgcggtgggagtccctgcgccgctccgcccacctcctcgggccgctcatcgccggcgccacgccacgcgcctcgggcgtcgtcaccgacgtaatctggcttccaaggtcatccccatagcaagaaggagctgaagctcccgtgcaacactctctctgccgcccacgcggccctcctcgccttctccgcctacnccaaggggcaagaaanaactcccggggangg

SEQ ID NO: 16093 - DNA, 628 bp, Triticum aestivum
  Clone ID: PAT_TA_16093
cgtccgcccacgcgtccgcggacgcgtggcgtccgtggtggtctggtctggtctctttgccctggccctgggtggtgtttggcatcacaccacttcactccccaccgctgagagtgctcgcctgcccgccccgctcgccgtcgttgaagagctcgctctcgtcgcgtgaataaatagcgcctcgctgcccggaccggagctcgggctcaccggagacgctcctcctccttcttcttccgtcccggcgcgctgagctcctacccgggagaggagagcagaggagcgcggcttcttcccgacggacaggagccatggctaaagattacccagcatctcctaaagcccagcatctgcaagaatccaagaagcagcgtctcacctacgtacttgtggtgagcgcgctctgcgtcgccttctacgtgctcggggcatggcagaacagcaccatgccgaaccctgtggctgattcggcaatcagccgagtcgactgtgataccgtggcgcagagagacggctcggtgccgtcttttgcgcctgcatctgagaatgtgctcgattttgatgcgcaccaccagctgaacctcagtgagacagagtctgtggtgcagcagttccctgcgtgcccgct

SEQ ID NO: 16094 - DNA, 471 bp, Triticum aestivum
  Clone ID: PAT_TA_16094
cgtccgcttccctttcatgtatcgcccagggagcccgcacctgattacaacttacaatgagagggaggaggtgacgcccagggagctcagcatccgagtcccggccatccttcgcagcaaggacgaggagggcgtcaagggctgccgcgtcgccggggccgtcaacaactacacctcccagctcctcacctacggatcatcatcacaatcgccatcttgtaaatcttcccgccaatataacctgacggaagcgctcttgttcctctcacacttcatgggcgacatccacaagatgctggccttcattcatgttttgtcgtgaggtccaggatgaacaagttgggagaagcattggagctagttatactgtgatagctgtgttacttgatgtgaacatttttttattgtaaaactaatgtgaaccatgtttggttgtaataatgtgccaagtttggctcttaaaaaaaaaaa

SEQ ID NO: 16095 - DNA, 602 bp, Triticum aestivum
  Clone ID: PAT_TA_16095
gagagagagagagagagagagagagagagagagagagagagacggcgcgaggctgccaagagcaaaaaccttaggctctttaacctcctcgatcgcgcagaagatggcctccgcgacgcagcagcaccggcgccgccgcgccattctccagctggccgccctgctggtccttgtctcgccggcggcggccgcgggcggcgcctgcaagagcgagaagttcccggccggcaagagctacgagacgtgcgcggacctcccggccctcggcgccgcgctgcactggacctacgacgcggcggcctcgtcgctctccgtggcgttcgcggccaagccggccagcggcgccggctgggtgtcgtgggggatcaaccccaccggcgacggcatgaagggcgcgcaggcgctcctcgccttcaagagcggcgccacgtacgtcgtcaacacgtacaacctcaccgggtacaagcccctcagcgcgacgtccacgcccatcgcgttcaaggccaccgggctcgccgccgacgagggcgccggcgggaaggtgcggctctacggcacgctgcagctgcccaagggcatggagtccgtgaaccacatctggc

SEQ ID NO: 16096 - DNA, 1063 bp, Triticum aestivum
  unsure (1)..(1063): unsure at all n locations
  Clone ID: PAT_TA_16096
aganctccccagattcaatcaaggatatcaccgagacaatcaatgcagttggcaacctcaatgggccatcagagtataaggattatcatgtcggcatttcatttggtacctttcttactgtaggaggtttcctgaacttcatgctaactggaagtacatctgcaattcgctttggctttgttcttggctttgcactattggctctgggtatctcaagtttgagatcacaaagagcaggcggtcgtcagcctcgtcttctgctgaaagggcaagctgctattgcaagcgttatcttcttcaaggacttgtcagttttcttcaggtatgggtggtttccaaatgttttcgcggtccttctcagtggaatggtggcgaccttttacattcatcgcattgtgactggtggccacaaaggtcgcgcggagagcagttcagataactaatggttatacaacacacttggatgaatcatatgtccgcggaaacttgggttctgaagattgatggtgacccttcgccttaaggtttccttctttcatcagccttcaactcaggcacactctgtggtgtctctgaactcttaagtggttctatacagtgatacctggactcacaagacttgcctcgcatactcgcccctcacctttgttcctttcctcgtgtaatatagatgctgccccataagcagaataaggaatggccttgaaggtctctagtatgtatcaatctgttcatcatttatgttgtttaatttatgcaacgtagttgtacacattgatatccaagtgaaatccccgaaatcgtctgtctcaaaacaaaaaaaaaaatccaagggggggccngtaccaattcgccctatatgatcntattacnccgctcaacggcgtcntttaaacncctgacnggaaaacctggcttaccaantaatccctgcaacaatcccnttcccaactgggtaanacaanaggccgnacgntgccttccaacattgccaaccgaaggaatggacccccgtacggcatanccggcggttgngttccnagntacctaacttcagcccacc

SEQ ID NO: 16097 - DNA, 625 bp, Triticum aestivum
  Clone ID: PAT_TA_16097
tcgacccacgcgtccgcatcagtcacgcaccctccacccaagtcgccgactcccgccgtcgccgtcgcgatcgcggcggccgccggcaatgtcttggctcgcgcgctccatcgccaactccctcctctcccccgacagccccgaggccgacggcgaagacccccgcgcctccggctccacctccccgggctcaccccctcgcggcgtccgcgaggacctctcggagctcactgacgccctcgcccaccggttccagggcctcgcctccttcctcgcggcgcccactcccgcaggaagcggcggcgcaccccgcgggctgaacccgtccgagattgcggggcgcttccgcctggggctcgcgcggctcccgggccgccaggccgtggcagatctcgccaagaacgcctcctctctactgcacccggacgaatactggggcgggtcggaggccgccggggctaccgaggacgtggtcgccttcgcgcgggacgccgccatgcggcccgagctctggctggacttcccccttctccccgacgacgcggactcggacgattttgacattagtgatgcgcagcaagaccacgcgctggccgtcgagagcatggcgccggagctggcagat

SEQ ID NO: 16098 - DNA, 766 bp, Triticum aestivum
  unsure (1)..(766): unsure at all n locations
  Clone ID: PAT_TA_16098
tggacgaggtaaggaagctgtggtaaatggtcaggcaaaatccagatttcttgctggatggttcaggaaagatgctatttacagcggttctcatgatgctaaaagcgggatgtggaaaaaaagagctgtatgatcttttatggacttcccaaatgtgtcggtcgaggatttcacaagtaacctacggaggggaatgctgttcttagctgagattggcatttgccatgaggatgttaacaagtttgttctttctcatggattaatccttgggttctgccccattgaagatgccaaacagcattgttacaaatctcaatgtgggaaagaggcgcctgcgcaagattatactgggaggaccccgaaactgttgatgagttacacattagggtcaaaagtcagccagctaccaaaaattgacccctttgaagcatcattcaatggagcagaataaaattcttgaaaagcataggattgtctgaaggctctgaagatatgaagaaggcactcaaaaccttccgtggtaaaggtgacgaactacaagatcggtacgtcttctgagtcatccgggctgggccggacccgtatgacgtggtaaccgggctcaagccggccccacaggttcggcacccgaagatcctccgtgctcgcgtcaaggttatccttcctggtgcttccgccgcggcattccctgggtgacctgctgctttccggcttgcgggcatttgccggggatccgaccttagccagcctantntnaaaaantttn

SEQ ID NO: 16099 - DNA, 691 bp, Triticum aestivum
  Clone ID: PAT_TA_16099
cgtccgcccacgcgtccggctcccagtccggccgccgccgccgccgccgctgaccgccgtaggaggcgagcgtcagagaacgcggctctcgctcgcccatgcttcttgcttaagcttgacacatcgcttagcacggcaggtcagctgctggctggttgcagtaacgagaggggaggcgagatgccggggatggaggaagcagaggactacgcgtcgtgcgccttctcgctcacttgccccgaagacggcgccgagctcggggacggcgtcgtggacgacggcgacctcttcttgttctacgccggcggcggcgccgccgacgatgaggacggcgacaatgagtacgtggagcagctggtctccaaggaggccagcttctgctcctcctctgactcgggcgacgccgactgctcgtcggccgcctccgaggactggttcctgcaggcgcgcctcgccgccgtcaaatggatccttgaaacgcggggctgcttcgggttcggccaccgcacggcgtacctggccatcgcctacttcgaccgcttcttcctccggcgacgcgtcgatagggcggccatgccgtgggcggcgcggctcctgtccgtggcctgcgtctccgtggcggccaagatggaggagtactgcgcgccggcgctgtcggagctcgacgccggcggcggctacgagttctgct

SEQ ID NO: 16100 - DNA, 515 bp, Triticum aestivum
  Clone ID: PAT_TA_16100
ccgtcatggtgatcgcgtccacgttcgccaacgccacctacgagcgcctgccgctggaggacgaggcgtccgcggacgcgtgggcgatggcgcacgacccgctcatggccggcggcatccacgggcacgggcacgggcacgggatgcccgacccgtcggcggcgatgccgatgttcaacatgccaccaaacaacgggcatctcggcggcggcggcgacgggttcccatgggcgccgcactcccgcgctccctactgatggcgcggcaatggcgaaatggcgcgtggtgcatgctgcatggttactgttccattggagtcacttggcgccattagctaggttagtacatatgacgatccaagctatctagtggtgattaattagagcgaattcgtactgctacttagtttcttatgttgttatggtcaaataattttctaatttgctggtgtgtttattgttgtctactgctgtatcaactgagctagagatatacctagcccgggccaaaaaaaa

SEQ ID NO: 16101 - DNA, 1290 bp, Triticum aestivum
  unsure (1)..(1290): unsure at all n locations
  Clone ID: PAT_TA_16101
cgtccgcccacgcgtccgcccacgcgtccgtcctcagcagactccagcgaccgagatcggatcagagagagcgatggcggcggtgatggagtcgtcgtcggtgcccggcgtggacggcggcgagggtgcggaggggagggtgcggaacgccctacaccatcaccaagtcgcgggagagctggaccgacccggagcacgacaagttcatctgaggcgctcctcctgtttgatcgagattggagaaagatcgaagcgtttgttggctccaagacagtgatacagatcaggagccatgcacagaagtactttctcaaggttcaaaaaaatgggaacaggtgaacatctgccaccacctaggcccaagaggaaggcggcacacccgtacccacataacaaagcctcgaaaaaggcccctgaagctgacttaccacaacacccccctccttgcatcaagggcgtgttatacctatggatgcacttactgtccctacaaactcaactccagtccaagcgacacttccttccctgggaccatgttcttacccaaccttatagcccaaggcacacacaagatttaggccgcgccaaatacagcccctagagccaagagggcccatcctgggatcggccgcaatctgatgcgattgagcaagaaatttggccaacttcccatgcgattgagcaagagattgtacttccagcactgcatgccatgccagactttgctcaagtatacaactttcttgggggcgtatttgatccagatacaacaggacatttgcagaagttgagagagatggatcctatagatgctgaaacggtactacaactgatgaaaaatctatcggtaaacctgtctagcccggactttgagacacacctgagcatacagcacccctgactgttgcagaggaggatgctctcgtcgcacggtggcggcatgggccaagccaggcacgagagcgtaggagatccggggtctctactcagacccttcgcgttccattcatgtaatctctagtcaccctcttcgtgagcacggatccacgctcgcgacatcactcccgtagctaagcgcatggaccgctctgcagggtaaggagcaaatgaggggagaggacagtacattgttgtcaanaggngcgacatgttgcagtatcgcttgttgtcaaagggtgcaacatgtttctgcatcaccacgtgcctatgtttggacaaangttcttgggagatcntttcgggctttttagatggttggaactttttatctntccggntgatgngggcttt

SEQ ID NO: 16102 - DNA, 592 bp, Triticum aestivum
  Clone ID: PAT_TA_16102
gtcgtcgacggggacggatatcaaaaccatggcactatgtataacaaacaacgtacgggtaagataattatacgagtaactatatatccaaatcacacaaacatcaatttggtaatgtaaaacattcatgaacaagaggctcaccacaaggtggtgccggcgacgggacggtgcgggcgatcgacggtggttacgacggagatttagaaggcactaagtaaaccacacctacatatgcaaactaagtgttattttgacctcaaattgcatataaatcaaatactaccacatataattcctcccaaattactaaaacccacaaattaatcactatataaaccaatgcaagagctaatctagcaatgagagatgaaaggacaaagttgctaacctttgtgatcatttgaatggatggtggcctgcaaatcttgacaaattttgggcaaaatttgtgatgaactcgagaggaagaagggaagaacagaggagagggagaggggaaagggagaagaacagagtgcgggtggatgaagggtttatataggacgacctttagtaccggttcgtgccacgaaccggtacaaaaagtgct

SEQ ID NO: 16103 - DNA, 602 bp, Triticum aestivum
  Clone ID: PAT_TA_16103
cgtccggccagaacccccgcggcttccccgctccctactccagcgcccctgcccggaaatacctctcctcgccgtcgccgtcgccggcgccggagaagaggagtacagggcaggcctccccgcatccgccgaagccgcgccacctgcaaggcgaagatcaacggcttcgtccttctggtggagacctgatactgttgccaaggctgagggtctactgaagaaattaggtttgagcaacctgatcacagaagagaatcaatgtctgagttcctggaactcgaggcccgggatggggtgaggatgacctggaatgtgatacccggcaccaagcaggatgctgctagctgtgtcgtccctgtttcggccatgtacactcctctgaaccccaaccctgccattcctgttcttccttacgccccactccgctgccgcatctgccgctccatcctcaaccccttctcggtcgccgacttcggttcaaagatgtggctctgcccattctgcttccagcgcaaccactttccccagcaatactccgctgtttcgcaaagcaacctacctaccgaactgtatcctgaatgctgtaccgtggagtacatggc

SEQ ID NO: 16104 - DNA, 1525 bp, Triticum aestivum
  Clone ID: PAT_TA_16104
ggacgatgtttttgaaataatagctcaagctcaagttatcggggagaaagtggactgaccactttcgatggcttgatcgagcttaccgaagagaattgctccgtgtctatacgaccaatatagaacaaatttaccgacgctttattggggaacaaagaaataaacttaccaagctcattgaggacaaaattagatggagcaatttttgtgcattctggttagcaattgacccaagaaccaggcaccggatgtccagagagaaaaccgataccatacttaaagcactggtgaaacattattttgtagagaaagaggttacttaaacattagtgatggattttttgtatacggatatgaaggcacttgaataccaaagcaagggcaagaaagggagaacataaatagcataattggatgaactacctgcacccatggtcagtgttgatatggacatatttgttttggctggtgatgttataactgtacttgagagagcagccttggaacccttgccttgtcaaccagtatctacaaaggatgacacgtgtgcccagagccgcatgaaggatggtagttctggcgaggttaacaaaatctctatggaacgcgaagaaagacgcctaactgagcttggggcggaagatacttgaaacatttgtgctatctcacatatttagtggaattgaagttgcataccaagaagctgttgctttgaagaggcaagaagagctaatccgtgaggaggaagcagcgggacttgaaaatgatatgaagggaaagcgtggtggtggtgccaatgaaaaggacaaacgtgcaaagaaaaagcaggccaaacaaaaggtgcgcaaccgtaaggttaaagacaaggaaagagaagataaatctgaagcaagaattctggaaagacttaatgacgaaatcgcagttgatgacagtgatggcttaccatctaagcaggcagaagaagtggcactgaaggttggccttaccttggaagaaggtgcttcagatgggccagatcatttggacagttctagacctatgaatggaaagagagtctcctctatggaggccaactcatcagcattttcagctgattctactgctatgaatggcattcacagcaaaataaacaatttaccagacagcagaaatcacttgtcaccaaatagagggaaaaatcagcgtaacaagggcataagcattatcagttatgccgaagaagacgattgccttccctcctccagtgtaactggtagttcagatcgcaatagttctggctgtggcactgctccaaaattggaccgggatactgttctactcaccttgaaagatagacttcgtgagctggggcagcgtctccatgagaaaaacattgaggggagaaaacttttcaaagcccactttgaagcaatggaatctcaaacaaagacaaatggatcatcctcatccagttctacggagaagccacctgatgttctgaagagcccggaacattcccctgaacttacgaacgatgtaaaag

SEQ ID NO: 16105 - DNA, 851 bp, Triticum aestivum
  Clone ID: PAT_TA_16105
gccataaatttaatggctagcccgacgaagctcgacatggccggccatggcgacgaggtgacgaggaacaagaaggtggtgctgaggaggtacgtgacaggctacccgacggcggaggacatggaggtggtcgtcacctccgacgtccggctgcgggtgccggaggggtcggcggccgccgtggtggtcaagaacctgtacctgtcctgcgacccgtggatgcgcggccgcatgaccaagcatgacgacggcgacgccgtgccggccgaggacttcgtgcttggagaggccttggtcaatttcaccgtcggcgaggtggtcgactcgacgcacccggagttcgacgccggtgacctcgtatggggcatgagtgcatgggaggagtacaccctcatcacccaaacggagggcctgttcaagatcaaccaccccgagctgccactctcacactacacaggtgttcttggcttggcagggctcactgcatatgctggacttttcgaggttggcaagccaaagcaaggtgaaactgtttttgtgtcggcagcatctggcgccgtcggtcaggttgtcggacagctcgccaagatcgcaggatgctatgtggttgggaagtgccggctccgatgagaaggtgagtctcctgaagagcaagatgggcttcgacgacgcgttcaactacaagtcggagggggacaacctcggcgcggcgctcgggcggcgcctcccggacggcatcgacgtctacttcgacaacgtgggtggtgcgacgctggacgcggcattgctgcggatgcggccgggcggcagggtggtggcgtgcgggatgatctcacagtacaatctgtcgg

SEQ ID NO: 16106 - DNA, 418 bp, Triticum aestivum
  Clone ID: PAT_TA_16106
cgtccgcggcggcacccgcccgctcaggtcctgggcgatgctcgtcaccttcagccacgacgagagcctcgtcggcgtgggcggcgccgtgctcaccggcggggccgagctgccctacaacaccaccgaggacgccggcaacgccacctccttctccgggtacccgcagacggacctcctcacgccgattgccaccgccggggacatcacgcagatccaggcctcggtcggattggtcggcacgctcttcgccggcccgcgcggcctcgtgccggagccggtccccaccgccttgacgctccacgacccggactacaactgcccggcggggaccaatggcactcgcaccatgctcaccacctgctggcttctcacccccgaggcccgagccaacgccaccgtccccgagggcaacgcc

SEQ ID NO: 16107 - DNA, 680 bp, Triticum aestivum
  unsure (1)..(680): unsure at all n locations
  Clone ID: PAT_TA_16107
cttcttcttcgggcctcgtgagatcgccgggctgcggcagcgcgcgccgccgcacatgagcaggagctcccggttcgagctggtggcggccttgcttctggctcggccgcacggcggcgctcgggtacggcgccgacgaggaggtgcggctgtccttcatcgtgaacgcgccgcggccgccgcgacgtgccgctcccggagggcttctacgggaacgcgttcgcctactccgtggcggcgaccacggccggggagctgtgcgccggcgggctggggtacgcgctggagctggtgaagaaggccaagtcggccgtgacgtacgactacctgctgtcggtggcggacctgatggtgctccgggggcggccactgttcgcgttgtcccggacgtacatcgtgtcggacgtgagccacgccgggttcaagagcgtggacttcgggtggggcgaggcggtgtacggcgggccggccaagggcggcgaggggccgatccccggcgtgaccaactacttctccaaggtccaagaacggcgaagggggaggagggcaccgtggtgcccatcaanctgccccaaggaacgccaatggaaaanttccaagctccaaggtctnttgtctcaccncccgangattctaactnggncgccatncaanaatcttgcncancgttncgtactgng

SEQ ID NO: 16108 - DNA, 597 bp, Triticum aestivum
  Clone ID: PAT_TA_16108
cgtccgcggacgcgtgggcgtcgtaacactaccacggcggcgccggatatatatagcttgacgcactgctgccggtgcagtgacagctgacaagatgctgatgaggctgctgctggtggtggctctcgccgtggcggcggcggcggcggagcagcgcgccacgtacatagttcacatggccaagtctgccatgccggccgagtacgccgaccacggcgagtggtacggcgcctccctccgctcggtgtccaccggtcgcgccgccgctgccaagatgctttactcctacgacaccgtcctgcacggcttctcagcgcggctcacggagcaggaggccagcgacatggcgggcatggacggcgtcctggccgtgaaccccgagacgcggtacgagctgcacaccacgcggacgcctgagttcttggggctcgccgggagcgagggcctgttcccgcagtctggcacgggcggcgacgtcgtcgtcggggtgctcgacaccggcgtctggcctgagagcaagagctacaacgacgcgggccttggcgaggtgccgtcgtcgtggaagggctcgtgcatggccggcgcggtcttcaactc

SEQ ID NO: 16109 - DNA, 662 bp, Triticum aestivum
  Clone ID: PAT_TA_16109
gccacctggagcgatactgctagctacgaccatggacgccaacgccgatgcccgctcctcgtcctcgcccatgcacatcgtcatcttcccgtggctcgcgttcgggcacatgatccccttgctggagcttgcagagcgcctggtggcgcgcggccaccgcgtctccttccgtctccacgccgcgcaacctcagccggctccggccggtcgtcggcgtccacttcgtcgccctgccgctgccccgcgtggacggcctcccggagggagccgaggccacctccgacctcccgcccagtcccgggaacctggccgagcttctactccaaggccgccgaccgcctcgtcggcccattctccgccttcctcgacgagggcaagaagcaaattggtcctcctcgacaacctcaataactggcaacggccgccgccgccgaccgaggcgtcccctccgtgacgttcctccccttcgccgccgccccgcgcctcccctgctccccgccgcgtccctccgcggccgaggacccaaagttccggccctccgtgcctcaacgcttcccgctcccctgccggtgctgcccgatcgtcgcccagcggtgctgcgtggagttcgaccccgaggccatgcctctgctgccgggcgtcctgggcaagccgttcgcccc

SEQ ID NO: 16110 - DNA, 612 bp, Triticum aestivum
  Clone ID: PAT_TA_16110
cttcctagtactccagcacagcaagtgcaagttcctagtaccaaatagcagcaatggcgccagcgcagcaagtgcaagttccagtgcaagcctcgccacccgcgattctcagcgtcctcgagaccactctcgtagcgccctcgccgagcgccggtgccgccccgctggagtcctccctcccgctcaccttcttcgacgtcctctggctcaactccccgcccgtcgagcgtgttttcttctaccgcctcgccgccgacgccgacgtccccgccatcctctccaacctcaggacctcgctgccccaggctctccacgcctactacccgctcgccggccgcctccgcctcacgcctgggacggctgaccgctacgagatctactaccagccgggcgacggcgtcaccttcaccgtcgccgagtaccgcgacgatgttgacatcgacgagctcgtggttgacaagccgagggaggtctgcaagatcgggccgctcgcaccgcctcttcccaaggggggcccggtgctcgcgctgcaggccaccgtgctccagcgtggcctcgccattggcgtggccgtgcaccacgctgcctgcgacggcgccctctccacgcgct

SEQ ID NO: 16111 - DNA, 685 bp, Triticum aestivum
  Clone ID: PAT_TA_16111
atctgctggggctgcggttcctccccgtctccgatcgccggccgcctcccccgacccgtgcccgcgcttcgctccgaggacaggattcaagatggggcatcattcagatgatgagtactcagtagccggtgataagccggaagtagagttcatggattttcagaatgacaacactcttcaggactatcaatctgatgatggtcccgtggttgttacggctcctttcccttttttgaacggaaagcctaaatctgtccttcgtccggaaacatctgcagacgccatttgcatagagaatacctcttgtgagcctgtagatttatggagtgtgagaatattctcttcaaatccagaagatagttatgtcttgtcaatgatgagaccaccgttgaatgattccgatgaagcggcaaagaaggcttttcttggtttgacttctgtggaagatcgtacacttcagcctggacaaaccctaaccatttggctgtcctgtatgccaaaagacattggtttgcatacatcaatcgtgcatgttgatattggggatgagaagattgagcgtgtggcttttctgttggccgatgataatgtttcgatggccttatcttctgataaaccttattccaggagacaaggctctcaaaggaagcaatttgagtgtaatacatttgtgccaggtagccgg

SEQ ID NO: 16112 - DNA, 620 bp, Triticum aestivum
  unsure (1)..(620): unsure at all n locations
  Clone ID: PAT_TA_16112
gcacgaggcaaaccccgcgccccctcaccaaaccagacccggccccggcgcttcagccgaggaagggatgctgctgatggccgcgcccggcgccgacgaccaccagaggcgccgccggggacggccgccgtccgccgatctgctcctcaactgcgacctgccccctccggccaagctcttcggcccgctcccggctttgcacctgccgagggaaaggttggggagcacgggcggagccgacgagaagggtaacggcgacggtaaggacagcctgctgcgggcgctgcgcctgtcgcagtcgcgggcgcgggaggccgaggagaagctggccgccgcggccgccagcagcggaggcctcgcggcgctgctcgtgcgggactcggtggcgctctcggcgcaccgccggtgggtgatgatgctcgaggccgagaactccgcgctcagagcaggaggagtaggagccgcccgtgcggagaccgaggagcccgaggaggaggatggcgcgggggccgcccggcacccggtggccgccgcgtggtgggtcgcgctggcggtgtgcgtcggcctcgcgctcggcaacctcctgctctgatctggaactaatcatccttgatttgann

SEQ ID NO: 16113 - DNA, 661 bp, Triticum aestivum
  unsure (1)..(661): unsure at all n locations
  Clone ID: PAT_TA_16113
tcacttgtgatggcagttaggagacccaaggtggcgcgtgagctgatacaaaaatggcagaatgaacaaacagaagtttccatgccacttaacattgaggtaatggagcttgacctgatctcccttgactcggttgcaagatttgctgatacttggaatgctcgtatggcacccctacacgtattgatcaacaatgctggncattttcaccataggagagcctcagcgttttacgaaggatggatatgaagaacacatgcaagtgaaccatcttgcgccagctttactgagcaatgttgcttctaccttcccttattagaggctctccaagcagaattataaacgtcaattcagttatgcacactataggtttcgtcgatgctgaggatatgaaccttacatctggaaagcacaagtacagaagttggttgggatactcaaatagcaagttagcacaggtcaaatttangcagcatatttcataagagaattcctgcagacgctggtgtccatacggtctgtgcctctcctgggattgggccacacaaatgttgccaccggggacctccctaaanattcntgtanctggggtatcnttctcattccatacntcacatttngatcctccannaaaggttcaacgcnngtcnatttgttttgg

SEQ ID NO: 16114 - DNA, 707 bp, Triticum aestivum
  Clone ID: PAT_TA_16114
cgtccgcccacgcgtccgcccacgcgcgagcccacgcctccgcgcgacctcacctagggtttgctctcctttcctcccccgtcctgctcttccccaatccgccttccaccccctcgatctcctcccccagccgccgtaggcggaggcgggggcgggggcgagcagcgacgacaagctcgtccaacgcctgcccgcctcggcgaaaagcctgtcgccatgtctgacatggagtccgtggctacccttatggagtcgacaagcttgaagatacagcagcttcagcgagcatttgctgagcttgagagccagagcgctgttaccatgaactttaagtggaagcagctcgaggaccatttccgtggccttgagcagtccctcaagaaaaagtttgatgagctgaaaaaacaggagaaggagttccaggagacagtcgcaaaatcggagaagatgctggagcagcaggaggctgttgtggtggctaaggagctgacttctctggaaaggctgcaggagaaaagagatgctgcgttagctatgatctttggcaagtccaagctgtcgctaaacactaattatatcaccccaatgaataagccacagagtaattataccgtgggtactcttgatgtgaagtggccgaagcattctccccaaggaatgcgcgaatgcaagatggccatgctgctgtgaagcctccgtctgaactt

SEQ ID NO: 16115 - DNA, 2132 bp, Triticum aestivum
  Clone ID: PAT_TA_16115
gcccccccgtctccgtcccccacgcgtccgccccacgcctccgcgcgacctcccctagggtttgctctccatgtcctgccccgctctcctcctcctcacttcggctttcccctcctcgccttcccccccctgctcctccccaatccgccttcccccctcgatctcctcccccagccgccgtaggcggaggcgggggcgggggcgagcagcgacgacaagctcgtccaacgcctgcccgcctcggcgaaaagtctgtcaccatgtctgacatggagtccgtggctaccctcatggagtcgacaagcttgaagatacagcagcttcagcgagcatttgctgagcttgagagccagagcgctgttaccatgaactttaagtggaagcaactcgaggaccatttccgtggccttgagcagtcgctcaagaaaaagtttgatgagttgaaaaagcaggagaaggagttccaggagaccgtcgcaaaatcggagaagatgctggagcagcaggaggctgttgtggtggctaaggagctgacttctctggaaaggctgcaggagaaaagagatgctgcattagctatgatctttggcaagtccaagttgtcgctaaacactaattatatcaccccaatgaataagccacagagtaattatactgtgggtactcttgatgtgaagtggccgaagcattctcccgaaggaaatgcacgcacgcaagatggcaatgctgctgtgaagcctcgttctgaacttgccattctctgcgaggagatgaatgttaaagggcttcataagttcatatctgacaacagaaagaacttgacgtctatccgtgaggaaatcccgagtgcacttaagggagcatcgcaaccatatgtcctggtgttggattccttggaggacttttattctggagataatctggtgttggatgggaaaaaggatggagaccttctgggtgtaagaaggacgtgccttatgttgatggagtctcttgtacagctgcaagctgatgatataactggcttgttgtctgaggggcaaatgtttgcaacaaatgtgaaagatcgggcgaaaaagattgcgtttgagtggaagtccaagttggacagtcttgacattgatgctagcaatggaaactgcctggaagcacatgcatttcttcaactgcttgctacctttggtattttttctgaatttaatgaagatgaactttgcaaacttcttccttctgtcagtcgacgtcgtcaaacacctgagctttgccgactgcttgggttgtcacagaagatgccaggtgtcattggagttctggtggatagtgcaagaccaattgatgcaattaacttggcctgacgcgtttgggctcactgaacagtttgagccagtgcaattgctgaaagcatatctgagggaggccaagaaggtgtcacatgccaagaatggaaaaatgtctcctggagcacagaatgagatgaatgagcgtgagctgtctgcactgaaagctgtgatcaagtgcatcgaggagcacaaactggaggagcaatatccggtggatccacttcagaaaagggtgattcagctggagaaggccaaggcagacaagaggagggctgtcgaagccgccaagccacagtccaagaggccgcgtgccaacggatcgctctatgcaccccgtgtcaccagcttccctgagaagagcttctaccaggcaacaccagagaggcacccatacccttatgaaaggcagtttgtgtacggcgccgaggcccaccaccaccctacgatgatgaatgcggctccctacaccatctcacccgcccacacgccgtactacggtaatggctacccggtgcagtaccaggtaccttatatccactaatgggggagagctataatggttctttcctaactatccctagcttttaaccttccgccgttgttgtagttgtaccaagtcatctagctagtttgcctagctgaaaatagttggaccactcgcttgtgtgtgtgctatgagtggctattgtgagaatctgttaattttatgtcacgacttatgacataatttacttctagtgtctagttgttttaatccacgtatcttctacgtacgcggttccaattaacctt

SEQ ID NO: 16116 - DNA, 1278 bp, Triticum aestivum
  Clone ID: PAT_TA_16116
tttttgcatgaaatcccatttagttacctgatcaagcatatcaccaatatttggcctggctacaacaatcagagacgatcccaactccacaaccaacactgcagaattgttaaaagaccaaacatgacttcccctacgtgcaccccaaaaagtgcacacaggataaccccgcacgtccgatcagatccattaagttgcatccaacagtccacgatacatccattatactacagtcagatctacggctgaaaacaaatgcggctgcactaagggcgcgggccgcactagcgcaccaccgacccccaactcacgtagtactccgtactaccatagcccatccctcatctcctctgactcctaacttctacacctccctcctccaatccctcactggcgacggcggcagcatctcggcccagcggccctgtccttctgagccccttccccaactaccaatccgcctcgctctcccgcgtcaagctctccgccggtggctcgccggtcacgtccatcagcgccctgtctcccccctcctccccctcggccgccgccaagatccgtcggtcctgcatgagctccccgacgaaccccccgcgcgcgttccggcgcacccccccacaaggcccgcaagcaggacgcgggcccggccgtcagcagcaagcaagcctccccgccttcgccgccgcccatcggcagcggccgctctaggcgcatggtaaacgggctggcgcagcgcgtcgccatgggggagcgcgcactgggcacgcagacgcgctggcgccgtctccctcggtacagcagcttcagcagggggagcgcgcggaccggtttcgcgccggacccagccggctctccggcgtctccatggccggacgccgcgccggcggcagccagtaaaaaacaacctcgtcaacatgtcatactagtacatactgcacaaactgtacataggaaacaaattcccccgaataattccgttcgctgtattcgaagcgccgtggggattagggctggccggaaggatagctaccgagtagatacaattcgattcgtggctgtttgcttcccttgcctgtggacaccgccccttcggtgtgccccctcggctccgcttcgctgctcgttgagtgacttcgtcgtctctgctccacctccacttgtacatagagtgagctctcgtcctctctgcccgctagctgtgtataggccttcattttgcttctggatatacatcaatacatgagtaacaaattgtagacaaaaaaaaaaacctcgtgc

SEQ ID NO: 16117 - DNA, 517 bp, Triticum aestivum
  unsure (1)..(517): unsure at all n locations
  Clone ID: PAT_TA_16117
ctggagctccgcagttcgggaacatgggcagacacaatcccatgcctgtgcctgtgcctgtgcccgagccaacactgatgctaggctatgagccaacgttgatgctgggttatgcaccgcagttcgggagctgccctccggtccagttaggttgggacctgtccaagatggttggcgtgctccaatccgtatgtgtgtggtgcaacacaaggttccagcattttggcaccgccgagcagcagaacgattctgttggcttcatttgccccgcgtgcaaggacgagacatctggtcatcttggcacactcaacaatggttcattgctttagcattcgatctctgctgctgttttcatcatatgtagtccgatcttttttctttctcgtggggatcatgtanggtagactggaatctgagctancactgantttgtgtgtgcggtggttacgcctgacggtttggctatgtttaaatgacactgttttttggtccttgacngaattggcntttgtannaa

SEQ ID NO: 16118 - DNA, 1323 bp, Triticum aestivum
  Clone ID: PAT_TA_16118
ccccgcgtccggcggccgccacccacggcgacgtgcgcctccttcctcccctccctccccattcccgtgacgtcacccgccaccctccgccccattcccagccacctacccaaagccgcaccacacgtcccgaggcaggcggcgaggcgggagagggagcggccatggcggcggtggtcggcgtcctcgcgctgcagggctcctacaacgagcacatggccgcgctgaggaggatcggggccaagggggtggaggtgcggaaggcggagcagctgcttggcatcgactcgctcatcatccccggcggcgagagcaccaccatggccaagctcgccaacttccacaacctctttcctgcacttcgagagtttgtcggcacaggaaaacccgtatggggaacctgtgctgggctcatcttccttgctaacaaggcagtagggcagaaaacaggaggccaggagcttgttggtggactagattgtactgtccaccgtaacttttttggtagccagcttcaaagcttcgaaacagaactttcagtgccaatgcttgcagagaaggaaggagggagtcatacatgccgtggcgtatttatacgagcacctgctatcctagaagtaggccaggatgttgaagtattagccgattgccctgttcctgctggcagacccagcattacaataacatctggcgagggtttggaggaccaagtgtactccaaagatcgggtgattgttgcagttcggcaagggaacatccttgccaccgcattccacccagagctaacatcagactctagatggcatcgcctcttcttggacatggacaaagaatctcaagcaaaggccttggctgcgctatcgctatctgcatcctcaaacgatgcagatgttgggtcgaagaataaggctcctgatctacccattttcgagtagagctaggaaacccgaaatttgattatccggttggtgacaggaaaggattctgggcatttgttatgcccagtccaaagaatatttttggcgtcaaagctgtgccaatcaaaataatggccattgtgctccaaacactatgatattgctatgacaaggaggctgaccagttggattggatctgtgtgtcagtagtacttttttcgaaaaggggtgctttattacttaaaagatttaagcattacacccggcctctgcataactgagatgcacacaaccaacgtcactgtagtactacgcgtctcgtgaatgcctgaatggtgatgtatgtttgtcatggttttcatgtcagcttgatgaaattgcatctagtgaatgaagataatgccgt

SEQ ID NO: 16119 - DNA, 464 bp, Triticum aestivum
  unsure (1)..(464): unsure at all n locations
  Clone ID: PAT_TA_16119
cgtccgcgctgaggcaagccgcanaaacccatcccaaccgtcccaaactgaagatatgcagattccttgaagagtatatgtgtgatgattcagacgacgagaatgacagcggatccgagggagtatcctctgcagatgaaaagtctgacgaggatgaagatggcgaatccaagcaggaactttcgggtaccgaccaagagttgaatgatgatgtggtggaccagatatctcatgccaccatagaggaggatccgatggcgatggcgagtcaaccctgaacctttttcccttccttcaatcatgcttgccaccaagtttaactgttggttgtacctttgttgctttctacagtctcgttgccagttgaaaggaagaattggtgggcttacttgtccatcaaggcaaaaaaaagtttgtttgctttcatcattggggaagaatttttttaaactttttttattgta

SEQ ID NO: 16120 - DNA, 573 bp, Triticum aestivum
  Clone ID: PAT_TA_16120
cactacacccccacgcgccatactcaagtcagaaacttctcttgtgtagtgtacgtagctagctctaggcatcatcaatgtcgatgacatcatccaagcatgtcttcggttcctacggcatcatggcgttgctcttcttctccgcggctcttgttacagcggatctttccgctgaattctacgacgaaagctgcccggacgctctggacatcatcgaggacgccgtgagggccgccgtctccaaagaatcccgcatgggcgcgtcgctgctccgcctccatttccacgactgcttcgtcaatggctgtgacgggtcggtgctgctcgatggcgccaccggcgagaagaatgcggtgccaaacaagaactcccttcgcggcttcgagctggtcgacgacatcaaggcgcagctcgaggaagcctgcgccccaaggtggtgtcctgcgccgacatcctcgccgtcgccgcccgtgactccgtcgtcgcgctgggcgggcctaccgtgggacgtggagctaggcagaagggacgggacgacgacgagccaggacgccgcgaacagcgacctcccgg

SEQ ID NO: 16121 - DNA, 633 bp, Triticum aestivum
  unsure (1)..(633): unsure at all n locations
  Clone ID: PAT_TA_16121
aatccttctcctactctctgtcctctgcgtgggcggccacgtgggttcgtcgcggcggagacgagacgaccagccggcaggcgacgacgaggggcagcgtcagctcagatccgacgagatggcggccaaggcgatctccagccctgtgccggtggaatggtacccgacgctggccgtcgtcatggtctccgtcggcctcatgctcaccgcatccttcttcatttatgaagccacgacttcaaggcggaaccgtagtttagcaaaggagattgtcacagcgtccattgcttccgtcttcctgggctttggatctctcttcgtgctccttgcaagcggtgtttatgtctgacaattggcctctacatgcgtagttctagctaggatgtgtcacatgcccctgaaattgtgttgtttcctggagaatatgcagtcccacatggacatgatttttataataggcgagtgacatcaaaattcaaccaatgttgttgaacctgttctggaatctctatcatgttatccgtccacaacttcatttccattattagttatgggacatanaaaaaaaaaaaaaaaaaaaaaaaaaaannnnnnnnnnnnnnnnnnnnnnnnnnnnnnnnnnnnnnnnnnnnn

SEQ ID NO: 16122 - DNA, 557 bp, Triticum aestivum
  Clone ID: PAT_TA_16122
gccggccgggctgagaccacacagttctccgccgcgacgactagccggcaggcgacgacgacgacgagcagcgtcagccagatccgacgagatggcggccaaggcgatctccagccccgtgccggtggaatggtacccgacgctggccgtcgtcatggtctccgtcggcctcatgctcaccgcatccttcttcatttatgaagccacgacttcaaggcggaaccgtagtttaaccaaggagattgtcacagcgtccattgcttctgtcttcctgggctttggttctctgttcgtgctccttgcaagcggtgtttatgtctgatgatcggctgtgcaagctttttgtttgtgtagctaggatatgccaagttctaaaagcattaatattgtgctgttcctggagaatatgcagtagtactatggagatgttttagttaaaagggcgagtgtggtgaaaactctctgattattaccatgccatcagatcacaatgtcacttgctgcttcttctacataacatttttccctacataagcctaaaaaattttatattgttg

SEQ ID NO: 16123 - DNA, 808 bp, Triticum aestivum
  unsure (1)..(808): unsure at all n locations
  Clone ID: PAT_TA_16123
cgccgcgctctccctccccagcagttctccgccgcgacgactagccggcaggcgacgacgacgacgagcagcgcagtgccaggcggcggagacgagacgactagccggcaggcgacgacgacaagcagcgtcagctcagatccggcgagatggcggccaaggcgatctccagccctgtgccggtggaatggtacccgacgctggccgtcgtcatggtctccgtcggcctcatgctcaccgcatccttcttcatttatgaagccacgacttcaaggcggaaccgtagtttagcaaaggagattgtcacagcgtccattgcttccgtcttcctgggctttggatctctcttcgtgctccttgcaagcggtgtttatgtctgacaattggcctctacatgcgtagtttttagctaggatgcgtcacatgcccctgaaattgtgttgcttcctggaagaatatgcagtcccaacatggacatgatttttataataggcgaggtgcacaatcaaaattcaaccaatgtttgttgaatcctgcttcctggaaattctactatcatgttatccgtccacaacttcatttccattattagttatgggacataagccacatcaatccttcaattttttgtttcataatacgaagtaagtacacattgatattcaatagtacagatttaggacccacgcgtgcaggctcacaccgttcagtaaccggatcaacaaacacagcttcacaacacccctgactaattgaacgaaaatatggaccctgtgatttggaatatatatcaggttcaaatnccacc

SEQ ID NO: 16124 - DNA, 470 bp, Triticum aestivum
  Clone ID: PAT_TA_16124
gaacggagaaggaagcatggactgctgcatctgcggccccatggccgccatctacaggcctccgaggaacaccatatgtctccccgtgctacgaagtgctccgaggccatcatcgccttcctcaacgacggcgaccacgccgccggtgacgtccaaggcgaccgtggcttggtgaccccccgcggattgatcaagcacaccgaagactccaccaaggggatgagagaagcatgggagcagactaaggagacgagagaccggcaggaggcggcgaaccagcgggccgggttcctcgagcagggcttcggggcggcctggactgagggagcccacaccgacgtcgtcctcgaacctggaaatgggccgcctatcccggcccacaaggccatcctggtcagccgccctcctttgtcggcctttgaagttttggcactggtgccagacgtttacaccggccgtgcattccgtgc

SEQ ID NO: 16125 - DNA, 655 bp, Triticum aestivum
  unsure (1)..(655): unsure at all n locations
  Clone ID: PAT_TA_16125
angcggccccccccccccgtcccgcttctcttcccttccccgtcccattccctttccctcttcgccgccgtcccagacaggcaggtagctccgctgatcaggggctcttcctctccccaagaccatccgcgcccccatcctccgtctggttcttgcttcgctgcgccgccgcccgcagctgaggggcaagaagtgagcaaaaggagaaagtcgatcggctggtcattatgcggcggtggttttgctgcgcacatggttgacacaccgtatcaggaaaacggggatgagtttcccaacagtcctgaacgggcaaatggtaatggttttactcaagttggngatcanggaaaaaccctccctccattgaagncctgaattgtatttgatnactgaaaaaaaacngtnattttggnnaaaacnttggtnggggggtttntaagaggggttttttttttttaaaaaaacccancctttggggnnaaaaaaaanttttttttttnnccnncccccnccccnnaaaaattttttnncccccccccnnccttttttttttttaaaaaaaaaaaaaaanaaanannttnnnnnnacnccccccnnncccccnnnnnnaaaaaaaaaacaccccccccccccnccccccnnaaaannnnnnnnn

SEQ ID NO: 16126 - DNA, 880 bp, Triticum aestivum
  Clone ID: PAT_TA_16126
cgagaaatccaccgttcaggtccgtcgccggcggcaagacaggagctgtatagcgccgtccgtctctgatgcgcttcgccgcccggagctgtcacggctagcgccacccgtctccggcgcgattcgccgccaggagccacggggttcgaaggcagtaagacaggaatcgccgtcgctcacctccggcatgctgcgcggcctggagccgttgtcttggctggaggcaagatgggatccgtcgcggctagctctgctcgcctaaggcgcgctgcgccacgcccggccgtggacttggccggcagcaaaacggggccgtcgcggctagtgtcgctcgcctccggcacacccaaggccagcccaaggttgtggctgacccgctccctgtgaggtggtggcacggtggaactgcagcgcgtgcagccggtggctgagattccgcgggaggtcgcgccgtcacagtggaagatgcgaactcgatgcaaactcaacaagcaaaggcgcaagaacatacctacggacgatgaagtggcaggagctccgtccatgctgaagaacacgtagttgttcatccgcagatattgatccacagagaggacaatttcctatcaatcttgatctattctcctttgatccgggggcaacaacaatggaatagattggtatgagaaaggatggatgaagccacgaagagattttggcggcaatctggtgttaggcgagagataaacctgtcgttttgctgattttctagagcctaactgtaattagaaagatacgctgggttgtttaagtggtggggtcctaccaggacaggtgtcggccacccgttggccctgcaccataatgcatgctgggaaccctgcaggagagcccgacccaa

SEQ ID NO: 16127 - DNA, 527 bp, Triticum aestivum
  unsure (1)..(527): unsure at all n locations
  Clone ID: PAT_TA_16127
cacgcacggtggggctcgacgatggccaccatcgcgtcatagccaccaaggagtacctgccggcgtgggggccggcggggactgcgccgtgtgcctccggcgagttcagcgaccgcgagctcgtccgcctcctcccgcgctgctcgcacccgttccacccgccctgcatcgacacctggctccgcgcccacgtacagctgcccgatttgccgttccgtcgtcgtcgtgccatccagcctcccggctgcggcgactgatgccgaggcagagggccgccaagtggaagagcaccaggtgtttgacgaaatgtccccgtcggaatcactgcccgagggttcccgangattccgatgcctcgtcngacactcaaagtgaggatgcccaagttgtagcagaggagaatggaaatgcggcgcccaagccaatacgngctctgcctccatggatccccgtttccttgtggttgtccctaagncaaggtggtgtctgnaggtaatccaatttccanggtcacanatacactcaga

SEQ ID NO: 16128 - DNA, 741 bp, Triticum aestivum
  unsure (1)..(741): unsure at all n locations
  Clone ID: PAT_TA_16128
tcaagcttattgtatctacatgaggaatgggagcaagtcatcgtccaccgagatataaaggcaagtaatgtgcttttggacaaccagaatgaattggaccggttgggttgattttggtccttgcagggatatatgaccacgaaactgccgttgaaaccacccatatcgcttggcaccatgggaatatcttgcaccagaactctcccgtgcagggaggccaacacccttctccgatgtatatgcatttggcgtgtttcttctagaggtgacatgtggacgcaggccaatcttcatcgatgagcaaaacaaccgggtgttgttagtcgagtgggtgcttgagcaccaccacaacggctcaatgctcgacacggtggatgcacgactcagaggggaattcaacacggaggaggtaaccatcgtgctcaaattgggtttgctatgcacgtacccatcgcccaacgcgcggcctctcatgcgaaaagtcctgcagtaccttgaccatgatcaatcacctcctgatttatcgccgggctacataaagctacctcatgatggcccaaaatgcaaaatgaagggtttgntccaaacaacataccaagttcccgaaaccncaatggagtntcccccactgttgtcggggtgaatcttaagcgancaanttttccgaagaggggaagattaacgcaatttngttaattganctctctctcgtctctnctctctcntctctntcnctcnttg

SEQ ID NO: 16129 - DNA, 1526 bp, Triticum aestivum
  Clone ID: PAT_TA_16129
cgtccgcccacgcgtccgcccacgcgtccgcggacgcgtgggtaaaccgaagtttggcccgcgagcagtgcccggcgtgtgcggctcaagtcgcaaagtcgtcgccgtcacacatatctggcccaactggtggggggcggtggcaagtgcaaccgtgcgtccgctcctgtatccatctgttagccgggactcatcgtctcctccttccccaatcgccattgtcggtggtgcaagcaagcgcgccgaggcgtgtgggagggacatggcggggcgctacgatggcggcaaccctttcgaggaggaggaggacgtgaaccctttctcggaacaaacgcgaggcaaagctggcgggcagtccaactatggcggcggcggcgcgttctacatgccaaatcccagaaacgttgctccctcctcgaattcgcggctttcgccccttcccccggaacctgcagatttcagtgccacagtggatatccctcttgagtcatcaaaggacctgaagaaaagagaaaaggagctgcaagcgagggaagcttcgacaagcaggatccagaaggaattgaaaagaagggaggaagctggcagcacgagctggtattgtcatcgaggagaaaaactggcctccttttctgccactcatccaccatgacattgccaatgagataccgactcatcttcaaagaatgcaatacttcgcatttgcgtcatttcttggtttggtttgctgtctcttctggaatgtcgtagcagttacttcagcctggatcaagggggaaggtgtgaaaatctggttgctagcaataatctacttcatctctggggttcctggtgcatatgtgttatggtatcgccctctttataatgctatgaggactgacagcgcgttgaagtttggattgtttttcttgctctacttgtttcacatcgttttcgtcgtatttgctgccgtggctcctcccgctgtctttgagggcaagtctttggcaggaattttgccggcgattgatcttatcagcgtgaatgctctagttgggatcttctacttcattgggtttggattatttgccctggagtcattgttgagcatctgggttatccagcaagtgtacatgtacttccgaggaagtggaaaggccgcagagatgaagcgtgatgcgacaaggggcgctatgagagcggcattttgactgccacatatctcagatgatgataggtctcaagattaattccatggattagatggcaccataaacaaaagtatatgtttgccttgggctctgactataatcttaagttggcataggatactgctgtgatgaagtgacatcgtaggacttgtccacttttcttaccggtatagagaatgtgcactttttacagattatgatccgtcctggattggggcgctgtgtcctgagagagtaggtattaacaaggtaccgttgcgactatatcaatggtacccttgcgatctggcctatttgttgcagctttaccaatatatcattcggtttaaagaaaaa

SEQ ID NO: 16130 - DNA, 413 bp, Triticum aestivum
  Clone ID: PAT_TA_16130
cgtccgcggacgcgtgggatctcttcccccagcgcgacaagcaatcaccaccgcagcgagcgaatcggccgctttgcacgcagcgaggaacccaccagatcttcccccaatttcgcgtcgacaagtagcagcggagacggccatggcgtcggacgtgcagatgggcggcggcgcggcggaggcggagaccttcgcgttccaggcggagatcaaccagctgctctcgctcatcatcaacaccttctactccaacaaggagatcttcctccgcgagctcatctccaactcgtcagacgcgcttgacaagatccggttcgagagcctgacggacaagagcaagctcgacgcgcagccggagctcttcatacgcctcgtcctcgacaagcccagcaagacgctctccatcatagaca

SEQ ID NO: 16131 - DNA, 865 bp, Triticum aestivum
  Clone ID: PAT_TA_16131
cctcaatccgcagctgccaagcaaagtctaccatccacaagccatagtgtgtttgcatcagagcaaccttcaagggaatggtacatgaatggcgcatcaggggtggatatgatgttgaatggtggtttagggcatggactacgtaatatgagtttggagaatgctaattctgccaagcagcagttcatgcatgcaaaccatcaacaaagttttgtttccaatcctgtggagctggctgctaatggttggggtggcacatggggtcctggaggtgcatcatcttcccaggctggggcgtcggcacatgggacgttcagaggaggaggatggagctcatccgagccgtcttcagctttatctcatgctgattggagaagcaatgcgccagcaccatgcgactacacttcaatagattggagcctcgacacaacattgttaaaccctgcagcgaagagcgaatggctgtctgacacatggtcaaccatgttcatgggcggcagatccacaaggcctgctggggggaaccttggccttggtggtgcaggaggcatgaatgggttgcatgagagcagcagtggtcttccaatggagcctgctccatcaccccgcccttatgagtggccttctttctgcaggggaggatcttcctagttccggaaccctgtaggtaagaaagaagtcattgaataagaaaaaagtaaaagatgtcatttgtttctgttcttgtttttgtctcgttggagttggttgaaaagagttttacttcttgtgtattgaaccgtgtttgtgtacctttgactgttggccgagataagtcttcattctatggagtccatgtgcatgcaaataagaaagaaattaagct

SEQ ID NO: 16132 - DNA, 978 bp, Triticum aestivum
  Clone ID: PAT_TA_16132
gccgccgcgactcacgacacgacgccctaccacgcgctctacggcggcccctactcctccgccggccgccagcagcacgctagcgcctaccaccacgccgcgcaggtcagcccgttccacctgcacctcgacaccacccacccgcacccgccgccgtcctactactccagcatggaccacagcaaggacagctacgcctacgggcacagcgtcaaggaggtgcacggcggcggcgagcacgccttcttctcctccgacgtcaccaccgacagggaccatcaccaccaccaccatcagcaccaacaccacgctagcgccggcggcaacggccagtggcagttcaagcagctcggcggcatggagccgaagcagcataacccaacgtcgctcttccccggctgcggcggctacggcaacaacgcggcctacgctatcgacctgtccagcaaagaagaggacgaggagaaggagaggcggcagcagcagcagcactgcttcctgctgggcgccgacctgaggctcgacaagccgtcgtcggggcacggcgactccgccgaccagaagcctctccggcccttcttcgacgagtggccgcacgagaagaccgggagcaaggggtcgtggatggggctcgagggggagacgcagctctccatctccatcgccaacgaactccccatcaccaccacctcccgctaccaccatggtgaatgatcccaagtcccaacgagaagaccgagaacgaagctgcaacgagagaccatctccacgaagaacacgcacgtacggagcgaatccattggccctttcccggcgtgctactccagctgcatgccgccgagacctggaccagctagctatcttgactctcgaggcatgcatgcacagttcgagtgctgaagatcttgaaaggccggaacctactacgaccatcattttcatttcttcttccttctccttcatttgtaatcgttgctt

SEQ ID NO: 16133 - DNA, 792 bp, Triticum aestivum
  Clone ID: PAT_TA_16133
caccaactggcgaccaaccgcggaccaagacgagcagcgagctctcttggtgtgctcagctctgcttcgtccgagatcccctcctcctatctcggcccagcgccgtcttcttccatcccgtcgatatctctcccccgctccgctccccatcacgaacagctggtcgaagcgagcgcctggtctatcaatggcggaggagaccgagaccgagaagcagctcttctctccgtcggatgtctcgctccacgcatccacgaaggactgctgggtcgtcatccatggcaaggtgtacgatgtgaccaaattcctcgaggaccaccccggcggagaggatgtcctcctccatgcatctgcctctggggatgccacggaggcttttgaagatgtgggccacagcacatcagccatcagcatgatgagcagctacctgattggaagcatcgaggactttgtgcctcccagtgcaacgaaggacgccacagttggtggcagtgatgtgcttccagattccagaacaatgaagaggaacaaaggctctcctgctccaaacacatttctggacttcgtgctccctttatgcatgcttgtcatggcctttgcagcttggtactacctaaccttcgtggccgagagctagtaaattcggagaagattcatatcattgcacatttttacgtcaatagtgttgctgcatcgatacatttaaggaacgtaaacttggtcatagaatcatttgctcttgatggaggtttcttgatgtagcttgaaagaactaggcatatttcgccctac

SEQ ID NO: 16134 - DNA, 627 bp, Triticum aestivum
  Clone ID: PAT_TA_16134
ctggcgacacaggcggaagacccaaaccgcgccgccggctaccctcctcgtcgctctccctcccctcgccgtcgccggaggacaccgccgagctaagctcgcgcggcggacggcggcggcggggccctgttctcgcctggcggcggcagatctcggtgggggaggctcggtccacctcggctacactgcgcggtagttccagcgactgctcgcagcggccctcatctccggcgattcaaaggggttggcgcctctttcttctccgcggtgcagcttgctggctcgcggatctgaccttcgaccggcggcgcctcttcggcggccagggtggcgtggcagctccccttcctgccatgtaggtgctcgtctccgcgcggatctgcaccaggccggcttctagaggcttcctcgacagtcctgtggcggtggctcgccgatctgggcggctgtggccggatcgacgggttgcgcgggtttggctcggcagctcgttccggcgagttcgggatggggtggcagccctccctctcagcttgtcctctccgacgtgtctgggcggggtggcagccccccttcttggtcctggtgctcggcgttctggtcttcggtctgttctgcggcagtgtg

SEQ ID NO: 16135 - DNA, 1084 bp, Triticum aestivum
  unsure (1)..(1084): unsure at all n locations
  Clone ID: PAT_TA_16135
cgcnaacgccntccgcccgccgccgccgacgccntgcggtgcgcccggcgggccgccggtgacggcgccgagggtgcggatgcgcgacgggcggttcttggcgtacgccgagtccggcgtgggccgggacggcgcgcggttcaaggtcgtctactcgcaccgcttcctccggcagccgcatggactcgccccgcgcctcgcaggcgctgctggaggagctgggcgtgtacatggtgggcgttcgaccgcgccggctacggcgagagcgacccggacccgcgccggtcgctggagagcgcggcgctggacatccaggacctcggccgacgcgctcgacctccggcgacgagttccacctcatctgctcctccctcggctgccacgccggctgggcctccgtcaagtacatcccacacaggctggccggagtggcgatgatggcgcccgtgataaactaccggtggtcggggctgccgagggggctggcgcggcagctgtaccggcgccagccgctgggcgaccagtggtcgctccgcgtggcctactacgcgccgtggctgctgcactggtggatgagccagccatggctgcccacctccaccgtcgtcagcggctccggctccttccccaacgccctcgacgagaagaaccgcctcatggccctctccaccggaatgttccaaaagagggcacaggcggccacgcagcagggggtgcaggagtccttctaccgcgacatggcggtgatgttcgggcggtggccggagttcgagccgacggacctcggggaggcgccgccgttcccggtgcacctcttccagggcgacgaggacggtgtcgtgccggtgcagctgcagcggcacatatgccgccggctcggctgggtcggctaccacgagctcgccggggtggggcacttcctgtcggcggtgccggggctcggagacaggatcatcggcaccctattgccagggccggcgggtaacagctcgaccgccgtcggcagcgtctgtgcgtactgataccaaagacgactgatgactgatcttcagtaggtagaggactgtaggaagcaatgctgaag

SEQ ID NO: 16136 - DNA, 606 bp, Triticum aestivum
  unsure (1)..(606): unsure at all n locations
  Clone ID: PAT_TA_16136
cgccatctctttccgtagcactgacggcatttgcgaaaccattcaagcagtatacatctccttcgtttaaactttaaccacaatggcgcctccgacccggcaacctacacggaaacaaccacgccctcggcaggttatgataaaccagattcacaacctgaagngcactggccaccaacgaaccccatctaacccagcatggcgctgaagcaaagatgcagttctttccctcgccaccgaagttcaccgacnaactagaggagcgcaaatatctgaaggagcgtcttgcattggccttccggatttttggtaaatatggctatcaggaaggtgtcgcttgccacattacgcttcgggacccagtcaaccctcataccttctgggtgaacccatttggccttgcattctccatgattaaagcctcggatcttattctcgtcgaccatgaaggaaaggttattgacggtggtcctaaccgcctgctcaacaccgctgcctatataattcacgctgcggtacacaaggcacgcccagacgtcatgtgtgcagcacattctcacagcctctacggccgctcattctgcgccttgggccgaccaatcgatt

SEQ ID NO: 16137 - DNA, 477 bp, Triticum aestivum
  Clone ID: PAT_TA_16137
ctagctatgcagctcagtcactgcaagcggcaaggtggctgattctaagtgtggtggttgtggatcaggctgtggtggtggatgcggtgtctctttagtcaccatttacctacaaaacaggtctcgcgagctgttgacttcgttgcaggtggcgagaatggccatattgagtctgctgggtgtggatcaggatgcggtggcaacatggttattaaaagttcccatgaggggaacaccaagtcaggtggctgcggttcgggttgtggtggcagttgcagcggtctggtggtcgaaggctccaaaattggccatgccaagtcaggctggtgtggctcgggctgtggtggtggttgcggcggcatgctgattgaacactccaagacaagttgcaccaagtctagcggttgtggctcaggctgcggcggtggttgcggcagcatgttcatggaaggctccaagactggcttcaccaagtca

SEQ ID NO: 16138 - DNA, 938 bp, Triticum aestivum
  Clone ID: PAT_TA_16138
cagtcttgctcgctgtgcgtgcgctcggcccgcgtccgcggacgcgtggcttgcgctctccgccctctcccggtctccccaatctccccgccgccgcgggctccttgctgcctgcgtccgcttccgaccttccgtgctccgtcttctccccgtcttccccgctcccacctccgcgctgccctcgaggatggaagagccgccgctgtacaagttcgggccgtataagatcgacgcgagggaggtcttccacgccacgcccctctcctacgccatggtcaacctccgccccctcctccctggtcatgtcctcgtgtgccccaaacgcgtggtgaaacgatttgctgatctaagttctgatgagactagtgatttgtgggtaactgcaaaagaagttggtgcaaagctcgagcagtaccacaaagcttcttccatcacattcgcgattcaggatggtcctcaggctggccaaacagttgcccatgtccacatccacgtcatccccaggaagaaaggagatttcgagaaaaacgatgaaatatatgatgcgactgacgtgaaagtgaaagagaaggaaatgaaggagaagcttgacctagatgtcgaaagaaaagatagaagcatggaagaaatggctcatgaggccaccgagtacctcgctcttttctgatgaactctaattttcatccactgccactcttgcctaaataagccttgtgactgcttgtccttgattgcgcgttgtggttcttattctccacggacctggtagcgtccagtccaaatctgatgtggtggtattgcttcatcgtaagaatatatcgcacatctgatgtagtggtatcgggagatcacttgttcgtcgtaactcgtaagaatatactattgggctggttattctcccttacgtgccaatcaaatttatttccccaaaaaaaaaa

SEQ ID NO: 16139 - DNA, 769 bp, Triticum aestivum
  unsure (1)..(769): unsure at all n locations
  Clone ID: PAT_TA_16139
ctgccgctcgtgccgcccatcctcgtcgccatggtcgcgcaccccaagccgctcctctgggcaacctgcgcaaggtgctctccggcggcgccgccgttcagcaaggagctcatcgaaggcttcagggagaagtacccgcaggtggagatcctgcaggggggtacgggctgacggagagcacggccatcggcgcgtccacggactcggccgaggagagccgccggtacgggaccgccggcctcctgtcgcccaacaccgaggccaagatcgtcgaccctgagaccggcgaggcgctgcccgtgaaccgcaccggcgagctctggatccggggaccctacgtcatgaaaggatacttcaacaacacggaggcaacacaggccacggtgacgcccgatggatggctcaaagaccggagacctctgttacatagacgaggatggctatctcttcgtggtggaccgtctgaaagagttgatcaaatacaaaggtatcaagtcctccggcggagttgggancttctgctgatcaaccaaaagttccngactcgctgttatccatttccggacaggattcngcaatccccgatggctanntaagaagaaaggngaacaactgtcngccaaganggatggagttgtggcaaacagtacactnanagaagcaggaagtgcgttctacggatccaaaacctcngaagtactaggaggtntaaantccagtcaaccctaantatgtcanccccctataccccaancantatcacttacta

SEQ ID NO: 16140 - DNA, 1231 bp, Triticum aestivum
  unsure (1)..(1231): unsure at all n locations
  Clone ID: PAT_TA_16140
ttcggcacgagcatctccgcacttgcaaattcaagtgttgagctagcaaagcctagttgcttaatacgaaggattccatatacgcatggagtttctaggcttgctagctcttgccatcgccgcgatggtcggagttgtcgccggcgatgactcaacctggagcaatggccgcgccacgttctatggcggcaacgacgcgtcaggaacaatgggaggagcgtgtgggtacggcaacatgttcagtgcggggtacgggaccaacacggcggcgctgagcactgcgctgttcaacaacgggcagagctgcggcgcgtgctttgagatccggtgcgccggcagcgggagctgcctgccgggctccgccgtcgtgacggccaccaacctctgcccggccaactacgcactccccaacaacgagggcgggtggtgcaacccgccgcagtcgcatttcgacctcgctgagcctatgttcactaagatcgcccaggcccgtgccggcgtcgtgcccgtccagtacagaagggtggtgtgtgtcaagacgggtggcatccggttcaccatcaccggccactcctacttcaatctggtgctcatcaccaacgttgccggcgccggcgacctgacggcggtgtacgtgaaatctcctagcacaggatggctgaccatgagccacaactggggcgccaactggcagaacggcgccatgctcaacggccagccgctgtccttccgggtcaccaccagcgacggccgtaccatcacgtccaacaacgtggcgccctccggttggagcttcggccagacctacgccggtagccagttctagccagccggcgaccactgcacaagtctccctgttcacttttactatcttcgtgtagagtgtcagcggaggatggctctgttttgaagcggtctcctccgagtaacaaaatctgcgtcgccgtggtgaggttacgcacttttggggttaccgtttttgctcccctcaaggcgtgctcacattagccggttgggcggttttaccttaagtagggcgtattatgcggagatccttaggtttgagctcagaagattaaagcaatggctggctgtggtgacgagcataatgcctggtcacccgcccatgggatcaaaccaaccctctatgtatctttgcatgctataaaactaatggatgtgttttgggagcttgaaaaaaagggggggccggtaccaantcgcctatagg

SEQ ID NO: 16141 - DNA, 815 bp, Triticum aestivum
  Clone ID: PAT_TA_16141
cgtccgcttcgtgccgtcaccgccgctgcagctgcggcgcagcctgaggaacggagagtggtcgacggctcctctcgccgcggcagctccgtcacggcgaacgacttcctgccggcggacaagcccgtcgcgtacgacagagtggcgtcgctgacgaagagggcgccgtccatgcggaagcaggcgagctcggtgtccaaagacagcgccgtgagcgggaggacgagcttcgcctccgagttctccggcttcggcgactccgactcatactccagcgccagcgacgacgggtactcggtgaaggagcttgtcgtcgactccgacagcgactggttccactcggagaaagacttctcggcgggggtgcacgacgccgccagcctgcggagctacaaggccaaggtgctcaaggccatggaatccctggaggaggtggacatgctgcagctgtctttccgggactcgtcggcaaccacggtgtcgccgggctcagtcgcccaggcctcgccggacagcgtcaagtaccccgaggacatgtggtcacggacccattcgccggaagccgagtacaaagaggatgacgagacgggaacaccccgagaagccgaagaggccgaggcgaagatcgtcgaaggggaggggagcagcatcgacatgagcgacgacgatgacgatgaccgctcctcgagcagcaagaagaagatgatcgcggcaccggtgtatgacgccgaattcgccgttgagaacagcttggagcattcggagaaggaaattatcaccataaacgatcattcatacgaagccatttctgatgc

SEQ ID NO: 16142 - DNA, 605 bp, Triticum aestivum
  Clone ID: PAT_TA_16142
ctgcttcaaaacattagctagctagcacacaacatctgaaacactaggcggcagaagggctttgatctgcagcccggttattcgccattgattttcctttttccatactagctatttgcttgaccgtgttttaattaggctgcatgcaaaaattgtgtttcttctcctcgtctccctttttactgtggcttcgggagtggttcggcccggtgcctgtgattttgaccggccttctccctctctctctctctcctccgcttgcgtccccgcggccggagaaggctgtgcccgtagtagttgttcggttttgttattattgtttggtttcttgtttgaataaatcagatatggcgtcactccttgttcgttttgggagctggtctgcagtatggtttgccggagctccggtcgccgaataaggtgggtgtgctcggtctgaaattggctgtttccctgagctggtggcaaggccttgcctcgttcatctggctttttggccaccgtggtgctagaggcatcgtcttggacgagcggagatctcagaagtgccattcgggaacaacttatcatcgtcgattttcttcgaggagctacgccgcccgctg

SEQ ID NO: 16143 - DNA, 546 bp, Triticum aestivum
  Clone ID: PAT_TA_16143
gcggcacggacatgccgggccgtttcttcaacagcccatggcgccaccgccctccgcacctcctcaccgttcgcacgaggagttcaacttcgactgcctcagcgaagtgtgcaacccttaccggagctgcgtcggcggcgtccctcggcatggggtcgcccacgcggccggccaggcgctggctcagtttcccctccacgacgccatggcggaggacggccccagcggcggcaacctgcatcgcggtggtggggcgtcgtcgtccccggtgccgttcgtgttcggagcaggaggcgcccgggagagcccggagatgatcaggggcgtcctccccggcgcccacgctagaggcaagctcaacggcggcactacgtccaagaacctcatggcggaaaggcggcgccggaagcgtctcaacgaccgcctctccatgctccgctccatcgtgcccaagattaccaagatggataggacctcgatccttggggacaccatagactacgtgaatgaactaaccgagcggatcaaaaccctcgaggaggagat

SEQ ID NO: 16144 - DNA, 1274 bp, Triticum aestivum
  Clone ID: PAT_TA_16144
gaggaattcggcacgaggctcgagacccccaaccccccgcgtcgcctcctccactccacctcccctcccccctttcctctcccctcgtctgctttcgcatccctccttccatccatccccatcgcatcgcaaccgccgcatcggcgagtgagccgcgccagcacggtgctccgagcctgcctgcctgggcgagcctcggcgcgggcggtggccgggttagagagggggaggggacgaggagatcgagggagagagggaggcgacgcgatggcgcgggagcggagggagataaagcggatagagagcgcggcggcgcggcaggtcaccttctccaagcgccgccggggcctcttcaagaaggccgaggagctctccgtcctctgcgacgccgacgtcgcgctcatcgtcttctcctccaccggcaagctctcccagttcgccagctccagtatgaatgagatcatcgacaagtacagcacgcattctaagaacctggggaaaacagaccagcctgctcttgacttgaacttagagcatagcaagtatgcaaatttgaacgatcagcttgcagaagctagtcttcgactaagacagatgagaggtgaggagcttgaggggttgagtgttgatgaactccagcagttggagaaaaacctagaaactggtctgcacagggtgcttcagacaaaagatcaacaattcttggaacagataaatgaactgcatcgaaagagttcacaactggcagaggagaacatgaaactaaggaaccaagtaggccagattccaacagctggcaagctagtggttgctgataccgaaaatgttgttgctgaagatgggcagtcctcggaatccgtcatgactgcattacactccggaagttcacaggataatgatgatggttccgatgtttccctgaaattaggattgccctgccttccgtggaagtaacaacagttgtcgtccgttcggttcctcatggagctgcagcatcagtggagaagctcttggggttatggataaacctgggctgcaataatcctgcggcggaagcgagatcagttaacctgatttatcatccttgtggctgcatgatgcgatgcccccgttttaactgttggtgtttgctaggaccttgactaaacttttagagctacctgatgttcatcgttgttgacactatccatgttatgtatgtaccatggccggtatcttagattatgctctataaatacatgttcttggtccagcgttctactcctttccgtctc

SEQ ID NO: 16145 - DNA, 401 bp, Triticum aestivum
  Clone ID: PAT_TA_16145
cgtccgcccacgcgtccgcccacgcgtccgcggacgcgtgggttgagctgccatgctgctccccctacagcagtaagttcttcattactcaggattcctgatgtggatgacctatttccatccacatcgtcagatcttgctggcgttttcttaagcgacttccctttcttcctctttgtagatgccacagggcacgatggaggttcaagtccatacatcccagaaaaataagaggctttagattgcaaaatattagtcaattcttcaaacatttcatcagaccggccactcaaatgtaccaacttatgcgctgccagcaatgcttcttgacattcttcctgcttggaagtcacagcaacattcacaattatgttcatgcattcgatgtgtaacacacatag

SEQ ID NO: 16146 - DNA, 837 bp, Triticum aestivum
  Clone ID: PAT_TA_16146
cgggtcgacgggctgattcaaagtttgaactgggggcataaaggtccatttgcccattttcacctggtcggaacatattccccagcgactcacatttcagaacggaaggagtagaaagtatcacaaggaacagaggaagcaacccgtaaaggacaatcgtgccaaagcaacattaattctgcaaaaaaaaaaatagacaccataccaaaaccgcatcggcccctcgtccactgctgccgccggagatcaagaggaaggggaggaagggagaccagtgcgcggcggagctgggcgttcactcaaaatgggtacagaccggtaattctgatccgtgatgataactcaaagttgggcagcggcggctgtggtagcaaatggtggtgcgggtagacggggagatgagaagaaggcggctccagggtgcgacgtggaggcattgcgcaagtgcctggaagagaacaagggtgatggcgccaagtgccaggctcacattgacgccttccgatcctcatgttctgtcagccccaccaacacctccgactaccgtcccaccgtacaaaaggagacctgaaacactggtgtctttgctggggtggttttacaagaaaccttgtggaataattaggatgaggtgcgactgtgcaaatgctcatgtgaaagataggataattaaggcttagactagcagtttttttttttgagaaaattatacttttcatccctcaattcttcgcgaagtttagatttggtccctcaattccaaaaccggacaacttgcatccttaactactgaaatcggacaaaattcatccctggtcacggttttgaccggttttg

SEQ ID NO: 16147 - DNA, 1114 bp, Triticum aestivum
  Clone ID: PAT_TA_16147
ccatacacaaggcgcacggttgcaaaacaagggagttactttagaagcaggaaggaacacctgaagccatgtgtatcgctgcatggatttggcaggctcacccacagcatcagctcctgcttctgctcaacagagatgagttccatagcaggcctacaaaggcagtaggatggtggggggagggctcaatgaagattcttggtggcagggatgtacttggtggaggaacatggatggggagcaccaaagatggcagacttgccttcctgaccaatgtgctcgagcctgatgcgatgcctggcgcacgcactaggggagacctgcccctcaggttcctgcagggcaacaagagcccactggaggttgcaactgaagtcgcaaaagaagctgatgagtacaatggcttcaaccttatactagctgatctaaccaggaatgtcatggtttatgtgtcaaaccggccaaaggggcagcctgcgacgattcagctcgtctcaccaggactccatgtgttgtccaatgcaaggctagacagcccttggcaagaaggcaattcgccttggtaaaaacttcagggagtttataaggaagcatggtgatgatgaagttgaagcgaaggatatagctgatagactaatgactgacaccacgagggctgataaagataggctgccaaacaccggttgtgatcccaactgggagcacggtctgagctccatcttcatcgaggtgcaaactgacgaagggctctatgggacaaggagcacagcagttctttcagtgaactatgatggagaagctagcttatatgagaagtacctcgagagtggtatatggaagaaccacacagtgcattaccagatagaattgccaatgcgcacctaaaggcaggagcctcaaataggaagaaagaatgaatagctaccattgtgcatgctgttatttccacagttgcgctttaagatcacataatgatctctaattatggcaattaaattatttactgtatgcggatctataaattcagagacagatcaagtcaaattgttgaatatatatacataataataatatgatatagttgtgtctttaaaaaaaaaaaaaaaaaaaaaaa

SEQ ID NO: 16148 - DNA, 1597 bp, Triticum aestivum
  Clone ID: PAT_TA_16148
cgtccgcccaaacgctcgaccctaattgccattacgacccgcgcttcccgcgccacctccctgctccccctcccaaccctagaatcttccagaatcagcgggaagcagggagggcgaggcgcgcgccccgcttccggaagcttctagaagctctaggggggaaggagccgagatggggacgtcggatctggaccggcagatcgagcagctcaagcggtgcgagccgctggcggaggcggaggtcaaggcgctctgcctcaaggccatggagatcctcgtcgaggagagcaacgtccagcgcgtcgacgcccccgtcacgatatgtggagacattcatggacagatcaacgacatgaaagaacttttcaaagttggaggtgactgcccaaagacaaactacctgttccttggggattttgtagaccgaggattttattctgttgaaacattttggggttgttatggccttgaaagttaggtacccagatcgaataactttaataagtggaaatcatgagagcaggcagatcacacaagtttatgacttctttgatgaatgtcttcctaagtatggcttcgtgaatgttgcgacatattgcacagaaccattttactatttaagtttttctgcacttattgagaacaaaatcttcagtgtccatggaggcctttcccctgctattacgacactggatcagatcagagtaatagatcgcaagcaagaagtgcctcatgatggtgccatgtgtgaccttctttggtctgatccagaggatgctgtagacggctggggattaagtcctcgaggtgcagggttcctctttggtggaaacgttgtctcttcatttaaccactcaaacaacatagattatatttgccgtgctcatcaactagtcatggaaggattcaagtggatgttcaataacaagattgttactgtatggtctgctcctaactattgctacaggtgtggcaatgttgctgcaatcctagagcttgatgagaacctgaataagcagttccgtgtatttgaagctgctccacatgaatcaagaggtgttcctgccaagaggcctgccccagattactttctttgagactgcacacatggcatgtgacacgctgtcttttcatgcccttgagcaccagcgggccgatagggggtattgaaggcgtgccatgttggcagatgggcgcgtgctttgcaagagattagccaggaggtgctttcgggatgtataaatcgattgttctgtgtccgtccaggtctattgtttgtaacaaagttgatgtcggtatccacttctccccaaaatagctccaatttgagctttgagaaaatgcctccgagaagggagtggtgtagatgaagccactctgggcccatgatgtaaaattttgatgccagtcccttcctcccctgggaatccgtacattttctagaatgtagaatggtatgcaaatgtgtgccttgagtttaccttttagttgcattgcaggcagctgtaggaaatcttgtagttttgatgttttgcatggaagtattctgaggaagcacacatcagtattgctgccaaaaaaaaaaaaaaaaaaaaaa

SEQ ID NO: 16149 - DNA, 655 bp, Triticum aestivum
  Clone ID: PAT_TA_16149
ttcgacgacgagtacgtcatcgtggggtcggccaacatcaaccagcgctccatggacggcggccgggactcggagatcgccatgggccccttaccacccgggctacctcgcgtccaccaaccggcgggcgagggggcaggtgcacggcctacgacttgccctgtggcaggagcatctgggccaggccgcggcaaccgtcgacctcctccagccgtcgagcctggcgtgcgtgcgcagggtgaacgaggtggcgcggcagcactgggacatgttcgcgagcgacgcgccgcctcagggagacctgccgggccacctcctggcttaccccatcggcgtgggcgaaggcggagagctggtggagacaacggccttcttccccgacacaaaggccagggtgctcggcaacaagtccacctacctccccccgatcctcacaacatgaagaagtaggagatcatctacgtacgactacgatgcatgatgacactgctcgttgtgacatggatacacagcgatcaggtgatatgtgcatggccaggttatctctcgtaaattcgttgcgtgtaggctggatgcacgtacgtggtgggaacgtgtataaacgatttactactatatatacagcttgtgaattgggattgctaaaaaaaaaaaa

SEQ ID NO: 16150 - DNA, 617 bp, Triticum aestivum
  unsure (1)..(617): unsure at all n locations
  Clone ID: PAT_TA_16150
atcccttccccatgcctcctcctccgccgtccatggcgccctccgccctgccttccagaaccttccaccgccactcccttcgctcccaggaccctcctcctccgagggaggccaccgtcccctgctgcgtctcccggcggcgggccgccgcccagctcctcctctcggccggcctcctgaccgccgtctccgtcctcgccgccggcacccgctctcgccgccaaggaggggccgccggaccatcgcgccggaggactacgcgtccacacctgcggccccggagctcctcccccccgcgcccggggggccccctccggcccccgcccgatcatcggccctggcccactgcgtccgcatgctccgcagctcctccggggtgccgtgccgcgtgcccttgcgccggccggggatccggtgtttcccacagccccatttgttctccgtccgatcgctgcctggatcaccgcgggggcgcccggtcccagtcccccccaacgggctcgtctccccgcggcctgcccccgtgcctccgccggcccgggaaacctgggntaccacttanccctgganaaatcccttcgcaagtggggtatacaaangcnaacgntgccttcaaa

SEQ ID NO: 16151 - DNA, 527 bp, Triticum aestivum
  Clone ID: PAT_TA_16151
ccgccggagctgcacgagcggttcgtggactgcgtgagcaagctcggcggcgcggacagggcgaccccgaaggggatcctgaagctgatgaactcggacggcctcaccatctaccacatcaagagccacctccagaaataccggatggccaagtacatgccggcaccatcttcgtcgtcgtcgtcgtccgaagggaagcagcacgagaggagggccgccggaagcgacacccagcatgaactggacccgaaaactgggatgcacatcacggaagcactccgcgtccagctcgacgtgcagcgccgcctccacgagcagctcgagatacagcggaagctgcaggtgaggatcgaggagcagggcaagaggctgcagaagatgttcgaggaccagctcaaggtcagcggcaacaccgcgccggccgcgggcccggacgtcgtcctcttcccggccgcggcggagacgccgagcgagcaagaggaggataccatgttcgtcgatgtcatcgacgatgacgacgaggtgca

SEQ ID NO: 16152 - DNA, 591 bp, Triticum aestivum
  Clone ID: PAT_TA_16152
tcggcacgaggcaccagccagtatcccaccctctccccctctcccctcgcctttggtctcggcggctcggcgctttgcatctctctcagccccagtcgccggcgcggccgcagaatccgaggttagggtccgccgtcgagaaggaggtggcggcgatgatggcttgccggctgcggctccaccagcttaggctggttggagtccggccgacctgctgctctccgtccagggacttcgcggctgtcaaatcccagaaaatccagccccccgagaagaaaaagcgattggacgaggcgtgccttgagaggtatcagcaatacagtagaacgtacatccagtcatggattcttcagggtaaggtccatgtaaacggaagggtcgtgaacaaagctggaacacaagtatctgacaagtcagtcatagaaatcaaggctgaaatcccgaaatatgtatgtagggctgggcataagcttgaggcagctatcaaagaatttggagttgactgtgatggacagatagcccttgattcagggctgtctacaggtggttttaccgactgtttacttcagcatggggcatcacatgtgtacc

SEQ ID NO: 16153 - DNA, 684 bp, Triticum aestivum
  Clone ID: PAT_TA_16153
ctctctacctgatccagaatcgataagccgcctctcgcaccgtgtcggaaggtccctccgccgccaccccctctcctagacccggccatcctcccttccgccacctgctcctattctagtcgcccccttcgtcctcccacaacagatcgagcagggtccccaaacctcaccggcgatagatgcaccgccgcctagcagcgacggcgtcgcggcctgctggctcgccagcttgcttgtgcttcaatgctcgccctccttcgagctggccggaccgcggcggcgtgttatctagggtttgcggtgactttgccccacgccatccacgcgcgaacctctccatccgctaggtttgggctaccgtgtcgctggtgtgcctctgtcattgttccggtgacccagatctgtcgtcgctcgagctccgggacgccatggactggatggccacttcctcccctgctccgacgccatagaggacgcctcctcactgccacgtctacttgctgccgcgtctctctgtggtggtctattggttgtgatctcaatccgccccaatggattcgccgacgttggtgtgcactgggcagctcaaggacacgctttaattccagcaatagcgggagtgccatattggacaaaggaagaggatgagaagaaatgaggcttgggcgtgagtgggtgctgggt

SEQ ID NO: 16154 - DNA, 484 bp, Triticum aestivum
  Clone ID: PAT_TA_16154
gggacctcatgttcttcctcgtcggcgccctcgccctcctctccgaaaacaccaggtacctgcccctgacggagggtgcgctgtgcctgctgggcggcgacggcctacacggcagagctgctgctcttctacttccactcgaccacgcaccaggggctggaggggtactaccactacctcctggtggtgctcgtcgggctctgcgtcgcctccgccgtcctcggcgcgctcctcccggcgagcttccccgccgacctcgccagcggcctgctcatcaccctgcagggcctgtggttctaccagacggcgttcacgctctacgggccgatgctccccgaggggtgccaccgcgacgccggcggggacctcgattgccacgggcacgccgccggggagcgcgcggagcagctcgccgacttccagctcttcgcctacgtcttcctcgtgttcgcctacgccctcggctgctacgccgtcgccgccg

SEQ ID NO: 16155 - DNA, 849 bp, Triticum aestivum
  unsure (1)..(849): unsure at all n locations
  Clone ID: PAT_TA_16155
gcacgagggagacgagtgaaacatccgccacctcgtgtgccacttggctgttatagctacacggcttacctgtcgtatttctgggcaaacgacgtgctcacccgagacgcccctgnggatcaaggacggcactgtggacgagtgggtgaggtgccacagcggcgacctgccgtacgccgtagacatcgggagcagcatcaagtaccaccggaatgtcaccgccnacggttaccgcgcgctggtgtacagcggcgaccacgatgcgattgtgccgcacctggggacgcaggcgtgggtaaggtcgctcggcttccccgtcgtcgacgactggagggcctcgcggctcgacggccagtctgccggattcaccatagcttactctaacaacatgaccttcgccaccgtaaagggagccgggcacacggcgcctcagtatgagcccgagaggtgctacgccatgttcagcccttgggtactccaccagccactctagtcctcctgtaccgtgcttatcttttttcaatactgcgagccaaaggcacactcctatttagtcatagtcagccagtagcttggaccagcgagtatagttttctggcgtcaggacctcaataaaattcattgtggccatatcccatggtttctattttttaatgctgaccccaatatttgattgaccgtgcttattatgatattttattcaattcataccactcaccaggccattggcttcaccgctttctgcaactcgtagtcatacaaccttattaatctaagtgatttcttgtcaacgggtcgatatcgcttacaagaatggatgcagaatgggacatcagaatgtgannnnnn

SEQ ID NO: 16156 - DNA, 864 bp, Triticum aestivum
  Clone ID: PAT_TA_16156
tcacacctcctatatttatcacgtcactacagcttcctccaagccatcgtgttcggttcacgaatccacctaaagcgagacacagaccgagcagcgaccgggcggcgacagacagtggcggccaagaagagcgggagccagatgggcgtggtggtggggcgggacgttgcgcgggacatggggcggtggtatgagagcgcgtccttccccaacttcttccagccgcgcgacgggcgcgacacgcgggcgacctacgagctcatggaggacggcgccacggtgcacgtgctcaacgagacgtggagcaaagggaagcgcgacttcatcgagggcaccgcctacaaggccgacccggccagcgaggaggccaagctcaaggtcaagttctacgtcccgcccttcctccccatcatccccgtcgtcggcgactactgggtcctctatgtcgacgacgactaccagtatgccctcgtaggcgagccccgccggaaaagcctatggatcctgtgcaggaagacgcacatcgaggaggaggtgtacaaccagctgctggagaaggccaaggaggaaggctacgacgtggccaagctgcacaagacgccgcagagcgacccgccgccggagagcgatgccgcgcccaccgacagcaaagggacctggtggttcaagtcgctctttggtaaatgatagattcatccgtctgtatatgcagttggccggcactgtaacagccatgatgtgtgttcatctgtatcttagtgtattagctattctctatggtgtcgaataaatgggactcagtgatatggtatactaccgttttccaggaaaagactccatgacgagctttaaaaaacccccccc

SEQ ID NO: 16157 - DNA, 484 bp, Triticum aestivum
  Clone ID: PAT_TA_16157
cgtccggtgacgggaaaggagagatggaccgggatatttttcctcggcatgtcgcatggtggccgagatgcggcagccccatgctctgttctgatgggcctcctctgctcgatggttgccgctggttgagtttggtacagtttcctgttgtcgcttgcgtcgagccctaggtccgtctctccttctcattgagcctacttctcctgtcgctggcgcttcttcttctcgtccgtcccgctgcttaaccaacgttgtacgatctcttctgtcgctgcgtgcaacgactcatcaagcgggatttaatatcacttgcttctcagtcttctccaccctcgacatgcgtaggccaaaaaggcggagacgagtcatgatcctccaggctatggctggggcagagcagcaggaacaaggccgatcgattgtctacattgtgctagcggagctcaaggatttcctgagcaaaaacttttatcagaccacattt

SEQ ID NO: 16158 - DNA, 996 bp, Triticum aestivum
  unsure (1)..(996): unsure at all n locations
  Clone ID: PAT_TA_16158
acaatnacacatctgttggtcgtgttggtgctccactnccttgttcatatattaagttgattgactgggctnaangcggatacttaacaacggattcaccaatgcctcggggggagatagtcatcggnggtcccaatgtaactaaaggttatttcaagaatgaagctaaaacaagtgaagtctataaggatgatgaaagaggtctacgatggttctattctggagacatngggcgtttccatccngatggctgccttgaaatcattgaccgcaagaaagatatcgtgaagcttcaacatggtgaatacgtatctctcgggaaggtggaagctgcgttggctatgagcccatatgttgagaacatcatgatccatgccgatccttttcacagttactgtgttgcacttgtggtagcagcacagaatgagcttgaaaggtgggcattgcagcaaggacttgcatacaccgattttgctgatttgtgccagaagcaagaggctgttgtagaagtgcttgaatctttaacaaaggctgcgaagcaagcacgactggagaagttcgagacaccagccaaagtcaagctgataccagatccatggacccccgagtcgggcctcgtcacggctgcgctcaaactcaagagggaggtgatcaggaagacgtttgaagacgatctggcgcagttgtacgcctgatggttctcttctgactgataccctgagatgacataggactgggctcttatgtcaaaacatactatattgatatattttgatgtcagggtagattggatcattgagggagtcctggaattttggagtgtcttgtcttacacttagaagcaattttgtgtttgtgtagttgtacacttactaccaatgcatctatcataattgcaccgaattttgattgcagtgtaatctctgatcgaaagatagctgttatcatcttctagaaccggaatcttttctatctcttctacttataaagattcga

SEQ ID NO: 16159 - DNA, 2075 bp, Triticum aestivum
  Clone ID: PAT_TA_16159
ggccgctctgggcacgccgccaaagctctaaacagcagtgcttctgctgatgaagcatcagcatccaatgttgtaatgctctctgggttcagtataccgaagcttgtcttgcagattgttactgttgaaactttactgagactcaataaaccaaatgagcttgctgctttcaaggacatagctttcactgtgtacaataaggctcgacggatcccgcggtttgtttccacgagtgacatgttccagtcacctacttatatgagtaggcctcagtcgacgatgatgcatactgcatctcctggtcctaccctttggaaagaatgtctagctcctcggatgtctggacaaactctctctagagaaacagagtttgatgcatccatgaggtcagtatcatgggacaactcatggcaacctggccgtgctgtaggattgcctgatccaagcaaaatccctgaattatgcgctcaggatgacaggaagtatgcctttgagccgcttttcattctggcagagcctggggctgttgattacaatgatacaatggaatcttcaagatttggagttgatgcaagtagcagcagggcttacagctcaatttcaggtggcactgatagtggagcaagcccgctacttgaagggtctgagaatgacagtgctacaagtcttcattgctgttatggctggaccgaggactggcgatggttagtatgcatctggacagattctagaggagagttattagacagcttaatatttccttttggtggtattagtagccgccaagacactaaagttctccagagcctattcattcaaattctgcagcagggttgtcaaataatgtcgtcttcaccagaagctagcaatacgagatcaagagatgtaatgataacccgtattggaggtttccttgaacttgaaatccaggaatggcaaaaggcaatatactcttttggtggtaacgaggtaaagaagtggcctgtgcagctacgacgatctatacctgatggtattccgccaaattctaatggaccaacactccagcaacaagatatgggcttaatccaggacagaaacatgccttcctcacctagtacgttatacagccctcattcaaaatctagcttcacaaaaggtcagtcaggcaacaaaaagcagatcctagtggaacaaagtggaatggacagttcaaggggttcattgcacttggttcgtagcatcagtttagttgcagtttcgcaagatagctcattgcatctggcatgccaagcggatctgatggcgaccagacctacttctggtgaagggaatcaaagcagcactgggtcggcatctagttacttagacgggtttgccccagtcaaatccatcgggtcaatgtctgcatcgtatcttctggttccatcaccaagtatgcggtatctttcccctgcgacattacagcttccaacgtgccttacatcggaatccccaccacttgcccacctattgcacagcaaagggacagcaactcccttggcaatgggttatgtcgtctccaaagctgtcccaccagtaagaaagcaactcaccaaggaggacagcaggcactcggttctctctgttagcatcgtcgattactacggaggcactgtccaagacaagatgagcagagggagcaagcaggctgtaaggcatgaaacatcagcccgtgattacgaaacggacatgcacaatgtgttggaagcggtggctgccgagctccactccctttcgtggatgacagtgagcccggtgtacatggaaaggcgcagcgctctccccttccactgtgatatggttctgaggttgaggagacttctccactacgccgatcggcatctctctcagccaacagacaagggagatgttagctagcttagagaggtgatcgctaattcgcatgatcgaaactatagctgtttgttttacacgggctagatgctgcgggtacctgccgctctgtccctagtgcctgtctctgtgtatctagattagggtaggtaggtgaatggtgcgttgatgagcccggttttgctctatagcaagagtgt

SEQ ID NO: 16160 - DNA, 516 bp, Triticum aestivum
  Clone ID: PAT_TA_16160
ctcctcatgccggggctgttctcggctgagccgacgcagtcagagctggacacgccggacaccgcatggctgaccgcgggagaatgttcgaccggttcttccggctcgggatgcccgccggagcgagcagggaccaacccgctggtgaacccgtttgggccgggcagcccgagcttggagccaacgtgcgtgggccgcatgctcgtcgtcgccgcggagcgcgacctcttcagggacaggaacgtgcagtacgcggagcggatgaaggccatggggaaggacgtggagctcgccgtgttcgccggccaggagcacgggtttttcggcgcggatcctgcttcggaggccgacagggagctcgtgcgagtcatcagccgtttcgttcagcgggatggagaccgtccggcttgagtgctcgtctgtaccgggacacatgagcccgcagtttgttcccgcatttctctcaaacctttgcatgtggtgagaggttcagtgacttgagcatagctcacgttg

SEQ ID NO: 16161 - DNA, 512 bp, Triticum aestivum
  Clone ID: PAT_TA_16161
cgtccggcttcatgctgcctctgcccctgaacgcgttacgttttgctccgtccgccagaatgaccagaggcacctggtgctcgcccaccttttcgacaagccgtgcttcctgggattgctcgcagttcaggctgacagtctttcggacttccacgccaacacgcatattccgatcgtcgtcggcgggcaaatgagatacgaggttaccggtgatcctctctacaaggaaatcgcaacattcttcatggacgtggtaaactcttctcacacctacgcaaccggcggcacgtccgtcagtgaattctggttcgacccgaagcgtttagccgagaccctgaccactgagaacgaggagttctgcactacatacaacatgctcaagggatctcgccacctcttcagatggaccaaagagatcgcgtacgcgactactacgagcgcgcgctgataaacgggtcctgagcatccagagagggaggacccaagtgtcatgatctacatgctgcccaggg

SEQ ID NO: 16162 - DNA, 715 bp, Triticum aestivum
  Clone ID: PAT_TA_16162
gggccgacgggggtccatctctctttcgatccatcgcaactccccagccgtttccgctcccccacccaactcctcacgcatcgtcgtcgtcctttgcgtcggacaccttgccttctccgcctcgccctctcccagacaactctcgacagatacatagcggtgctgctgtggccgcaatggctgtccaggcgcggttcctctcccacgccttcccccacgacctcaacgcctacaggtccatggacgccgcggcgccgggtaactcccagttcctggacgagcacgccgggtgcgcgccagcggtggcgtgtattgggaacaacactgtgctcagcgatctcccgcgaagcgagctcacatgcaacgacaactgcggattcgcgcccaggaagcgggcgcgcatggccggggacgagccggcgggcctcgccgacctggcccggcagcgcttgcttctgcagcaggcggcggcgatgcacggactcatgctgccttgcgatgcgcagagcagggcggtcggctccggcgcggcctccaccagcgggagggtggccaatgccgcgggcctcaacacgctgctctacaaccagggcgtggagatggacgcgctcatccggctcgagaccgagagaattcgcgcggggcttgaggaggcgcgccggcgacacgcgagggccgcgttggctactgtggagcgcgctgcggcggggcggct

SEQ ID NO: 16163 - DNA, 525 bp, Triticum aestivum
  unsure (1)..(525): unsure at all n locations
  Clone ID: PAT_TA_16163
cgtccgcggacgcgtgggcggacgcgtgggcgctcgaacagagacacacacgaacagagacacacacgagcccctctccctcgcgttctccctctggaaaccctcagcgccgccgccacgcccggccccctcggttgccggccggattctctccaactactccagatccggccggattctctccaactactccagatccggccgtcccagctagttccccgccgattcccgtcctcacagccgcgagtaccgccgtcagcgaggagcagcgccggtgggggaaggaggagcgagctcagtgaggagcagcgccggcgagcaaggaggagcatcccgacgaccaatccccatcgcccaaagcgcaatgtgtgatgaacatgtcggagatactgctcagccaccgtcagcacaagcttgacaacacatagttgattcattctcagcgctgccgctgtatagacatgaactagctaccgcaatgttcatgtctttagatgcgagaccatnntgatttgcanacttatg

SEQ ID NO: 16164 - DNA, 1731 bp, Triticum aestivum
  Clone ID: PAT_TA_16164
cgtccgcccacgcgtccgcggacgcgtgggtttctctctctctctctctcggtcggccagtgtgacgaactcgtcgcggtggaggggggagaggggggttgagctcgccgtcgattcgaggggagaggaggcgggaagagaggggcggccaccccggggagaccgagccctaccgcgggcgacccccctccatcgaccgccagtcgccgccggccatggcaggggcggcgccggatcgggcggcgctgacggtcggcccgggcatggacatgccgatcatgcacgacagcgaccgctacgagctggtgcgcgacatcggctcgggcaacttcggcgtcgcccgcctcatgcgcgaccgccgcaccatggagctcgtccccgtcaagtacatcgagcgcggggagaagatagacgagaatgtccagcgtgagataatcaaccatagatcactgaaacatcccaacatcattaggtttaaggaggttattttaacaccgacccatcttgctattgtcatggaatatgcatctgcgtggtgagctttttgagagaatatgtaaaaatatacgattcagtgaagacgaggctcgctacttcttccagcagcttatatctggtagtcagctactgccattcgatgcaagtatgtcaccgtgacttgaagctggagaacacattgctggacggtagtcctgctcctcgcttgaagatatgtgatttcggctattctaagtcttcagttctccattcacaaccaaaatcaactgttggaacacctgcttatattgcacctgaagttctgttgaagaaagaatatgatggcaagattgctgatgtatggtcctgtggtgtgactctttatgtcatggtagtcggtgcatatccttttgaggatccagaagagcctaagaactttcggaagacaattcagcgtatcttgagtgttcagtattcaattccagataacgtggacatatctccagagtgcaggcacctaatttcgaggatttttgttggggatcctgcgttgaggataaccatccctgaaatacggagccataactggttcttaaagaacctccccgctgatctgatggacgatgatagtatgagcagccaatacgaggagcctgagcagcgaatgcagacgatggacgagatcatgcaaattctaacggaggccaccataccacctgcttgttcccgtataaaccacatcctaactgatggattcgacatggacgatgacatggatgaccttgaatcagactcagatcttgatatcgacagcagtggagagatcgtgtatgcgatgtgagccatctctggcggttatcgtaccgaagcaaaccgtagaaagcagctgaagggcacagggtgacctgatatgctgtaccctgtcaaaagagctagcagcactttgagaaagaatcgttctgtgttttgcaagcgaagtcccggtcctgttctggttgtaatataatgggggttagtccctggagaagcatcctttctgttcctgttgtgctacatatgtgcaaatagttcgtactcctgttgttaatgtgtgaaccatgtgttaaacttagatttattttatgtttattactgtatatctactgtactgttgataaaaaaaaaaaaaaaaaatctattgacctgttgtttgggctactttgccagaaaaatgcagggtaaattcggtctaaaataaataaatacaggtttagt

SEQ ID NO: 16165 - DNA, 993 bp, Triticum aestivum
  Clone ID: PAT_TA_16165
gcacgaggaggttgttgttggcgacaagcatgtctttcaagtattcagaaagcattgtaagatggttgtgaccaatgctttgcttggacaaaagctggtgaatgctagacgactaggatttgtgtttcggcgaaagcagatattgaaaggagctgcccaggaggagcacgattgtattccggatgaacactatgtgcagacattattttctatcaaaggactggaagatgaacttgaaaggagaactttgacctatacatcatggaaccagtcaactttagatcctaaagatcaaatgacttggcatccaacgacatttgaatatgacgcagcaagtcctgagcagatcaatgctataaagagtatcgatcatgtgaactatgaggtggaacacaggactgagtggtgccaatccaacggcacatccgtcccatgtttcttatttgccagaaagttctcatatggcgccgcgatgcatctgttggaggatggcgcttttggtctgctaaaatctgctcaactactggttaacttttaacaaattctcttgtatacgagcaatcatttttcgtgtgggtggatcagttcatagccaggtccagcttcgttgtttgcagtagcatttgcagctgaagctacttcagcgatggagtaccatagtttactgctaggatttagattgtgtatagatcatcggatcggagcagagtaggttattattgtacagagcatcattgaagtacgggaatagcatcaggatgcaatctccaacttacagactgaggctgggacgcggtgtcaacggctccatccgtgacaaacaatgaagcatacaaatataaaggagaatctgtcgcaatggtttactatcagtgtaggaaaggtgcagcaataattttgtgtcaatgatcttatacatacaaaaaatagaagaacaaaacagaaaggaagtacatttcttatatttttactcttttacattgaaaaaaaaaa

SEQ ID NO: 16166 - DNA, 714 bp, Triticum aestivum
  Clone ID: PAT_TA_16166
gggcgatggctgagaagtaaagaaagctaagatcatcgagcgggaagaacagaagaaggaggctggtggccgactcactctaagcttctgggtgccctgccggcgactcagattgcgcgtgctcgtattcccgagcctaagatggacctctgcctacctcccacgttcgcgtatcttgatcgaagggctggtatgcccgcggagaagatgccaggtccagttgtggcagcagagtggacctgcacgaaccgagggggacataagaacaacgactctgtgcttaacaatcctacaaacaactttcttctcatgctgcctcctctcttctgcgaggagtgtcaccgtgtgaaccctgcagggtattgttcggatatcccgcacatcagcataaggcatgtgttacttgattttctcgtccggaatcaaggagattacaatacgagcgtggcgcatgcattcttgactgctgtggatgccatgcgcacgatccatgaagcatttacatttagagcagagcctggcacggaactcgatgatgggcatctcttcaccacgtacatgcgtatcttcaagacagcatttggctacgagaccggtccatgtgcgcacctgcgatttaagaggccggaatgtatcgcttacatcttacagaatcacggtgtgcgtattgattgctcgagcatgcaggacggttatcgacagagggcccacacc

SEQ ID NO: 16167 - DNA, 549 bp, Triticum aestivum
  unsure (1)..(549): unsure at all n locations
  Clone ID: PAT_TA_16167
ggatccgcccgcctcgcctcctcctcccgtccgcccacgcgtccgtccgaaccccgcaaccgcctcgcgccccgccgctccccgcccgccgagccctaaccccgactcttcggagcttcgcttctcgccgccctgcgccgctctgcctgctgatggatccggccacgcccttctccgatgctagggccgacgcctacgccgagttcaacggggagactggcgtggacgacccggagttcgcggacgccgaggcggaagcggggggagaggacgcgggcttcgacgggcccagggaactgcccgaggagctctccagaggagtggtgtgcctcgagtgcgtcacttcggccgaagggcgtgcggctggggaaggcganacctgccgcgtctaacgttcgtcgggaaccgcccatgtctcgcaaagaatnatgtgattaaagtcaanagcggtcatnaaatttcctgaaaacctcangcntgttttctttggaaatggtggttccaanaanggggtttctatttcntgaaaaccancaaaaaacnttcang

SEQ ID NO: 16168 - DNA, 662 bp, Triticum aestivum
  unsure (1)..(662): unsure at all n locations
  Clone ID: PAT_TA_16168
gaattcactagtgattagcgtggtcgcggccgaggtagaggctggaatatttggatttaaagtgctacaagtacaaccattatgaagtgcgccaaattgaggtggagcaacaagagataatagaggctgtatttgatgagttgtgcccttcacctgctagattggagacactattgatacgaagatatttcggccgtcgactaccaaattggttgcagtccccaagtagcaacaacctttaaaagcttgaaggatattacactagggcacataacacacagcacccaactacccgatggtttgtgcaggatacacggtttggaaaacactacgtatcttgtatgctccagccatccgagcatgtcggggcctgacttccagaacccatgatggangatggaggtggctgcattncccaaatcctgacaagattggcgcctgnggagccctctccccccggatggggtgggactgggaggaggaggaggagcagagcaaagtcatagccatgcccgctctggagcatctcgtactcaggaactgcaagctgacacaccttcctccaggacttgcttgtgaccgcaggtacgatctgagaaccatgcgcctacaggatctcacgctcctagaatatgtggagaacttcccttcagttgtggagc

SEQ ID NO: 16169 - DNA, 820 bp, Triticum aestivum
  unsure (1)..(820): unsure at all n locations
  Clone ID: PAT_TA_16169
cgaatcaaagtggcctccccagctgtgccgggaaggcccatggcgatccaccgccgccgcgagcccctcctgcccgcgctcgccgccgccgccctgctgctgctcctcctcgccggacccgcggcggcggacgacgcctccagcgacgaccgcggccacgacgcctcccccggctgcaacaacaagttccagctggtcaaggtgaagaactgggtgaatggaacccaaggcacaactgttgtcggactgagcgcgaggttcggatcccccttgccaagaactatcaacgaggctcacagaacatttgccgccctcaccagtcctccagacttgtgctccaattcgaccgcaaagttaacgaattctatcgccttggcggcacctggagggtgtcctttcaccgnccaaggccgagtttgcgcaggctgctggcgcagctggcttggtcattataaatgacgatgaagaactctacaagatggtttgcggtgacaatgatacttcacttaatgtgacaattcccgtcgtgatggtaccgcattcagcaggcaagaatctgaaggacttattggatcatggagcaagggttgaggtgcagttatattcgccaaatcgaccagttgtggacctttccgcatgcttcttgtggttaatggctgtaggaactatagtatgcgcttcactctggagtgaattcgttgcatgcgaacagatcgacgagcattataatcagctgacacggcagccgggacctaattctggaacaaacaacacacaagataaagaaatccttgaaatcacagcaaagggagctggtgtt

SEQ ID NO: 16170 - DNA, 831 bp, Triticum aestivum
  Clone ID: PAT_TA_16170
tttttttcagttctcttaagattaataaataatgtaaaaaacacatgtttctgtttgttttagggtaaccaacatatatacagggtagtttctagagatgccactctaagagttaccttcggatccaccatatgatacactgtatgtccaactgagtaatttataaacattctacatttgaatagaacgatcaatgttatgtctgtacagtttttggaagccgagttactccccatcacaacaaggtgaacaacaaatacaggtagcagaatagtctaccgcttcttatgtacaaaattgatctgaatgtttgtcggaagcaaataactgataaagattaatcctgtttgttatccacttcttctacccgcagacaaagctgttgtcttgcagatggggcataggttctttaccgtcagccattgttttaagcactccgcgtggtatctgtggccacaatccaggattccaacgcagtcctcagcctcgtactcctcctggcatattatgcaagcctcattctctgtggaaggttcagatgactgattagacacgcaggttgctcctggcacatataagctagtcttcaatttatctacgatgtgactttttgccagacctgtattgacgtctccaatgtgctcttctaatgctaaaagctcctcataggtcatgctgtctatatctagacgcatatctctatgctcatctactacatttgacccctcatacaacctcgaaaaatccatgattgcaccatgcagaggtggcaaaattcttatgttcctatgattaactgggttcggacgcgtgggcatgctgtgggggccc

SEQ ID NO: 16171 - DNA, 885 bp, Triticum aestivum
  unsure (1)..(885): unsure at all n locations
  Clone ID: PAT_TA_16171
ggaacacctcaagaaagctggagtgaagttaaaatcatatgaagcaattttatctgatgtagaaaggctggcagaaaagggtgcaaaactgtggttggattcttcaagtgtgaatgctgccatagtcagtgtatttagatctggttgtgacagatacatgagaaaaagaggaaagacagggcggcaaattggcaaagaggcatcttcagatgcgcccgcccccccgggccggggcggtccgtttttggaccttatcggtcgctacaaagcctcaccagtcacccttgccaaatcagttaaaaatgaggcagaaattagaggaatgaagaactcgcatctcagagatgctgctgctttagcagaattctggtgctggatagaggaggaagttcgtaacagtgtggctcttacggaagtgcaagttgcagaaaatcttcttggatttcgccgaaggcaagatggttttatagagacgagcttcgacactattagtggttatggtgcaaatggtgctataatacactacagaccaactccggatagctgcagttctgttggaagtgacaatctctttttgttagatagtggtgctcaatatgttgatggaacgactgacattacaaggacagttcattttggcgagccttccccgaggcagaaggaatgcttcacaagggttttgcagggccatatagctctagatcaggcagtatttccagaacgaactccaggttttgtgctagatgttctggcacgatcatctctctggaagattgggcttgattacagacatggcacaggtcatggagttggagctgcactcaacgtccatgnnngcccgcagagcataagctatcgatatggaaacttgacagctttacagnn

SEQ ID NO: 16172 - DNA, 811 bp, Triticum aestivum
  Clone ID: PAT_TA_16172
cgcgccccgtgttcggctcgggcccccccgcggccgagaggaggagcaagataaggtagacaaaaattcacccagagtcgtggtcagggagctgcgtgccgtgcagagatgccgaccatcatcatcaaggtagacctcgactgcggccgctgccacgccaagatcaggaaggtgctcgagaggatcagagagaagggcgagttcatcatcgacgacatcaagtacgacgagaagaagaaccacgtgatcgtgtcgggccccttcgacgccgacaagctgggcgacaagctctgctgcaaggcctgcaacatcatcaaggagatcgagaccgtcgagccgcccaagaaacaggatcccgagcctccgccggcgacggacaaggtgaagcccccgggcccgggtaaggatgagacggtcaaggtgaagcaacagccgccgccgccgccgccgccgccgcccaagattgtggaggtgccggtgccgtacccgtgcccctacccctacccgttcccggcggggccgtccggctgctgctgccaccagggacacggcggttgccagtgctggcagaaccctccgccgccgtcgtatccgtgcggcggctacatgatggtctgcgaggaggacccgtccggcgcctgcaccgtcatgtgactcctcggcagcgttatcaccggtattagtgcggtaattcctcatgtataagcaccgtaccgatgcgcatgtacgaccgatcccagcgagaattatgcaataaaatatccgcattcgtgtaagtgaaactaacgaggaggaagacgtcaaaaaaaaa

SEQ ID NO: 16173 - DNA, 574 bp, Triticum aestivum
  unsure (1)..(574): unsure at all n locations
  Clone ID: PAT_TA_16173
cgtccgcggacgcgtgggtgcttgttgacttgggtgcctggtccgcactccgctagcggatcgagccgaccacgaatggattcccctccctgagtcgcctatccgctcgacggatcacgccggctggccgcccggccgcgcgccgccgcgagaccctgccggtgggcaggttgactccgatgagccctcctccgccgtcgcgtcggactcccacttacatcctcctcctcctcctgctcttcttctcgctaaccgcgtcggctgcacaaccaaaaggggtatgtgtttcacctggtggacggttccctgctttctcatccttaaaggcaagcttcctggaaaagcaacaaanggggcgcagagacctagcactatgttagatattccgcccgaacacaattttttacgttacaaaaaattttctggccgtgcttaatggaaatnctccncaactggnggaaggcgtttagaaagctcaattntgganttttcccatgncacatggtgatctaaaagggggtgtaaagcgcnnactctctnaaatgtgcacaattcgtntnaaagttctaaantn

SEQ ID NO: 16174 - DNA, 332 bp, Triticum aestivum
  Clone ID: PAT_TA_16174
gttcctggtgccgtcctacctaggcgacggcagcgtggacgccttcgtccccatcttccagcacaacctcgacgccttcaagcagtgctgctactccatggactaaatatgaaccaattaagctatatgatcatcgagtaattaaaaacggcgatcatatcgcttgcatttgcgtgcatgcatgcatgcatgcaagtagtagagtattcttcatctccgtgtatcgattgtatccctacatatgtgtatatggtgtacatgcatgtaatacgtaatggtgtacattttgcttcaaaaaaaaaaaaaaaaaaaaaaaaaaaaaccccgggggg

SEQ ID NO: 16175 - DNA, 1566 bp, Triticum aestivum
  unsure (1)..(1566): unsure at all n locations
  Clone ID: PAT_TA_16175
caatctcgcctcccctcccctcccctcgcctccccctcccctggcggcgccgtcgttctccaccaggaaggaaagaggatctttgaggtgttggattgatcggagatgagcgcccggcggtttttgaacatcctggtgtcggattgccagaaattcacgtacatgctgcggcgcttcgacctatcccacaaccagttcttctacccaacaccagaagaagcagcggaacatgccaaagtggtgcctccattgacaggcatgcccgacaagtcaaccctatcagctaactcctcggcgggggcggggcacaacaagaagaagaagccgatgtatattcggccgccggcaccgatggtgaacatgaaaccatcgatatgcgccaagactcggtacgatcgatggggcgagatggattgcttccctctcactgaaaccaagctcttcttcaccgacagctccgcgcgcatcttccgcttcgatgccgacacccactgcatcgacaccatgcccagcctccacacgcccaagtccgaccccttgtccttctccatccctccaaatccgaccacctccaaggaaggcgaaggcgaaggcggaggcctctacatcatggacaggatcctcaggcccaacaaggagggtcaggtccagtttgagtctatctcgtaccgcaggcgctgcaaccactccagcaaggcctggcactgcgacgccctcccgccgccgcctttcgtccacgacccggcctacaaacaagcctccatctgctcctatgccctggttggcggccacaccatctgtatctccatcaggggcgtcggcacctactgctttgacacgctggcttgcgagtggagcaaggctggcaactggctcatgccgtttcatggcagggcggagtatgacccggagctcggcctctggcttggcgtctctgagcgcaacatccacctcccctgcgtcgccgacatctccggtgtcctcagaggggaggagccgctgccggagcacactcgaatctgggaggatactgacatgccagaggggtggtacccgcacagtcagtgccccaccgaagttgtcagcctgggttcaggcaggttttgcgtcaccaacttcgttgaaactaaggagttcgatgagcgctgcggcgattcggtggttgacgacatatttgctgtcttcaccggcatggagctagtgttacccggcaatgacaatgatgagggcaaagccaacagcaacagcaagggcgactccaaaggcaatgccaatgggaacggcaacgggattgctggtgtgcgtatgattaagcataaatccagatcttgcaggagtcgcggcaccaacttgatcaagtctgtgctctgatgagagccataatagtctgctctcaggccatgtcctacttggtctgcctgctttaccctctctatctctactctgatatatgtattgtaataagataccgtatgtatgttgaggcttcatttgcgatatattcatgctgctcttttgtatctcgctttcccagttagcaatcaaacttnaataatctggggcaaa

SEQ ID NO: 16176 - DNA, 999 bp, Triticum aestivum
  unsure (1)..(999): unsure at all n locations
  Clone ID: PAT_TA_16176
aacgcacgaggtggcggctcgccgcgacctccttctccggcggcggaccagagcagctctgtacatccaggcgcaatggcgcgcgcgcagggcgctgtggagctatctggagatgaagagggcctcggtgatctgccagtgcgcttggaggcagagcattgcaaggaggcagctcggcaagctcaggctggccaacgtcgagagggagaggctggatgagctctgcaggctgcatgagatggtggatgtgctgcagcaggccgtcgaggacgcggaggtgagggtcatcgccgagcgggaggcggcggtcaaggcgatagcggaggcgcctccggtgatcaaggagactgtggtgtgggtggaggatgctgacaaggttaactcgtggaacgccgaagtcgaccgactcaaggggttgctgggagcagaaatgcaggccaccattgacgccgagaacgccctggcaaaggctgaactgagaaatgaaaaactggctaggttgcttggagttcaggagattaagaacaaaacgctgcaagattccgtcaaaaggatggaggagaaagcttccgacctcgaagcggaaaacagaatgcttagacaggctgttgcatccatcccttctgtcaagtcaccatctagcgaaaaccacagagcacatgatcttcaggcaactccattgaacgagaaaacaacaaatggtgccgttaagcctgtgatagtggacaggaacggcgatattcatgacgatgacaatgctgaactgcctgggctcaaatgatgctgaagctgagaaacagcagcangactgctgatcaagtgcatatctgaagatctgggatctcaaaccggaaggctatcgctgcgtactcatctaccgctgtttgggccactggagatattntaagagncagaacacgttttggacgcatatcaaaanataaatgctgcaatngaggcccaaacacaatgaaaattacatatggtatcaatncggcn

SEQ ID NO: 16177 - DNA, 719 bp, Triticum aestivum
  unsure (1)..(719): unsure at all n locations
  Clone ID: PAT_TA_16177
agccatgtttcaggcatcagtgcatcagtgcagtcacccacaggttcgagcggccgcccggggaggtatgaaattgagccaaaaaaggatgttgaaccggagaattgtccattctggtgggcgcgttcgcccgaaaatatactgcagcaggatacatatctagcactggcagcttcttttgtaatcctgcggttgctgtatcttctattcccaaggatagtttctgcagcaaaatgggcatggaggaggcatactctgtttgcgaacttgatgggcgtgcatgaatatttcttcacctacctcgagcaagcaagacagaaattgagtaggttatacccttcgaagcgagggaatttacaggagggggcaaggaatgccactgcctgggcctccaaatcattagcatctgtgtcaatcggagaaccaagcactatcggaaggacgaactccacgaatgaactgaggtgaagtgtaaacttttttgcccgcagggatattatgtacagtagagtgatcaggatatgagcaccaagaatctgttgtaaccagctttgttagctattgtaacatcatcattagaataagcacctcccccggtattgttgccattataaccttgtcctgaatagctgttgcccaaacatattcttggaggaaaaaggtttgacgtgttccatgatatgttaaaaaaaaaaaaaactcgagaaacaanaaaaaaa

SEQ ID NO: 16178 - DNA, 758 bp, Triticum aestivum
  unsure (1)..(758): unsure at all n locations
  Clone ID: PAT_TA_16178
ggtctgagcatggaggattgagagcgaatttcttcttgtacttgggagtaacatatctgtgctccctccactctctagcccatctcctttcgatcctctgaatgcgcactctgctcgcggtcttcgtttctttgccatgttttgcctcatcaggcgtgcagtaccctgcatagatttcctcagggatctcaaaggcagtctttacctcgggcttctttcctcccttctgcggacgtcttaccgtctgccattttcttcacctgaggaatttgcacaattgacttctctgaagaagtatgcagcttttcttcgaggaacgctgcaaatgagttaagttgatgagaacctagtgattcagcagctgacatgagtacctgtgaacagagtacaggtgcgaggaatttggagaggtcatatgcgttctgagaaggttttttgaaaagaacaagttttgatgaatttgaccaagatgagccttgaagaattcactaagcgatctttgtcctaagttccagagttgtatagattgaggatcacacaattgaggaatcctgaggaatacatgcttagagaaacgatcaagacatagttggttgagngtcanatagtgaagattgaagaataacacttgaagattcaagaaantgagaacaaagtgagtaataaattactttataccnaatgaanaacacgacgagaaacantggaantcgcagtantntcctgccnaancgngggganaactnggggacgntgaa

SEQ ID NO: 16179 - DNA, 632 bp, Triticum aestivum
  Clone ID: PAT_TA_16179
ccgtgcacaccttaatataatcaaagtaaacttgtgataaagcagtggaacttaggggcttccggttcgaatacgaccagagacccggcccaaaggggtttaagctaagattcggatacgatcatgtagcccccagtgggtgtggcgatgccaatcaagagggtaccgacagctatgttctctttggttcgaatacgacccatgtttgaacaggaagcccccaagtgatttcaagaattgtttaacgacgctgattcaaatacgatccacgtcggttctcagaggggttaaactatgattcaaatatgaccaaagataacctcccaatgagctcggcactttgccaatcaaatgggtatcgacagctatgttctctttggttcgaatacgacccatgtttgaacaggaagcccccaagtgattttactgcgtacggctaaattcgaatacgatcataagccggatcctccttgaagccatcatgtaatcttgcaataagagcaacacgtgtatatttggaggagaaaaaaggacagaggtcctgttttattgcgctatcataatatatacatggctgagagaagtatgtacaccacgagagccggtggctcaagtgtagtaaggcctcgtgc

SEQ ID NO: 16180 - DNA, 540 bp, Triticum aestivum
  unsure (1)..(540): unsure at all n locations
  Clone ID: PAT_TA_16180
gctagctgtagcatggactgccaagaactttttacatgcatgtngtagccggctattgcgacctttgaacgcggagcagccgcgtgcacccagaagcggcgcgggcgacgctctctcggccggcgcgccgcttcaatgccggcgctagtgagaggtcgcgtccgctctggccgggcatgaatgcggcactgaccgttctgggcgggaagcacgcgcgggtgatgaagagggttcgggttggtcaggaccggccgtggcagcggtccggacgtccgcaaacaagagatgttgtacgttaatattgctgcgtatatcattaacaacgtaaataatgtgccagttggacaaatatgatcggagatggagatggaaatggaattttacataaacacggatatgcatgtctangtctatgtgtgtgtgcgcgacgactctcgcgacctggaagcgggggcgtgtttttgatcgagttttctttcttggtatgttagaaaatcagtttctctaattcacatctagatgttatttaaggatatcaca

SEQ ID NO: 16181 - DNA, 944 bp, Triticum aestivum
  Clone ID: PAT_TA_16181
ccacgcgtccggcttcttgctctccaatctggagcccggccggcagatcaccggccaccccctccccaaatccatccacccgccgcgtctccaccgcgcgctcgtcggaggaggaatgggcggcccgctgggcgccatcatcggccgctacccctcggccgccgctggcaccgggggagacgacgccgaccacccgggcgggggcgggggcacggtcagcctgggcattatccggcacgaccgcaggtgccgcgacctggccttcctcgtcctcttcgccggcttctgggtcgccatgatcggcaactccagcttcgccttcaaccagggcaacccgctcaggctgacatacgagctggactacaaagggaacgtctgtggcgacaggcacggcgacccggacgtgcacgagctcgaggtcaggtactggttggacccgaaccaggtgtaccaaagtggagtcaagggcagcaaggctaacctggccgacgccaaggccatctgcctcatggagtgccccactccggcaccggatggcctaaactttgtctgtgattacccggaaggggatgtcaggctctcagttgatgactggatcaatagggactataactacttcgatgttctaacacctgatatgaggaacagctcccttcagcttcagggcccttgctaccctgtcatattccctagtgtaaacgtctattggagctgccaatatatcgcccgggcatccaatgtttctttgacgcactggcaacagatgggtggtgtaaacattgaacaaaatatgcttatagataagacaatccacaaggccatcgattccagatctgcagtcctcaagagatatgttgcggacattgggaagtcttggcctgtcctaatcgtgtgtggtgcactccttcctcttttcttgtcagtgatctggttgctcatgattc

SEQ ID NO: 16182 - DNA, 570 bp, Triticum aestivum
  unsure (1)..(570): unsure at all n locations
  Clone ID: PAT_TA_16182
gggcccgaacctaggtaaacnatccttgtgcttgtntacttagccttgttcttttngcaaccccgcaccccgacaaccgtagtagggattctttgtgatcccataggtgtcgttccacaccgacatctttggcgcgccaggtaggggagcgcaattgtgagaatctggtctagtagttagcctagcagttcctcatcgcccttggctcccgagaaggaggtggccgggaggaaaagggcgccgcctgcgaacgcaaaggacgccagtgcggcagcagaaaagctaagtcattcggagctttgagttacttcctcctatacataaggttatcgtcctcggagatctcgcctatgtatgagaaacctgcacgcaaaggggccctcccgcaattggcaacgcccttgttctgtttcgagtccgctcgtcccctcttcggcgccgcgtcgagagtggcggggtagccttccgcacttggcaacactcccgactctgactcgagtcaaactcgacagttcgggcagccgcgctnagggcggtaaggtggttcgcctggcagcaagcacaccccgt

SEQ ID NO: 16183 - DNA, 563 bp, Triticum aestivum
  Clone ID: PAT_TA_16183
ggatcccccgggctgcagggagagaaatcgctcagttcattgctaactgtgacgtttgtcgtcgcgtgaaggcagagcatcagaggcctgctggcacccttcagcctttagctattcctgggtggaaatgggataaagttggtatggacttcatcaccggctttcccaggaccaagagagggaataacgctatcttcgtagtcgttgatcgtctttccaaagtggctcacttcctccctgttcgagagagtatcactgctagtcagctcgctgacttatatatttctcgaatagtgtcacttcatggtgttccactagagatcaattcagaccgtggcagtcttttcacttctcacttctgggagagtttccaaactgccatgggcacccatctttccttcagtaccgctttccaccctcagtcgactgggtccggtggaacgggtcaaccaagattctcgaagacatgcttagagcttgtgttatctcaatccgtatggattgggagaaatgtctccctttgccgagttgcttataacaatacttcaaccagcctcaagaag

SEQ ID NO: 16184 - DNA, 432 bp, Triticum aestivum
  Clone ID: PAT_TA_16184
cgtccgcggacgcgtggggttttccctgtgggcgatgaaaatatcaggcggcattccagcaataaatctgccacggcatcggtgatttcttaccgtttccttgtcctccttttcacagtgcaaccgtcgaaagcgtcgaagcgacgagtcgagagtgaacagaaggtcgtgtatagtgtaccgaagagggcagaagcagctgacgaggatgttcctcagggaggcggaacgtcttctggagctgtctgcggaggagcagatatagagaatttgcttacctggtacatgtgttgggagctgacacatctctagcaagacttgtgttgatccgctttggagaaatatatttgctccatgcaaactttggacaaatattgttatccttggattgggtttttcaaacttaaaataagatcgcactcacacaaggga

SEQ ID NO: 16185 - DNA, 451 bp, Triticum aestivum
  unsure (1)..(451): unsure at all n locations
  Clone ID: PAT_TA_16185
ggagaatgcacccaagctgtcccgcgtacccactgactaattctttgggcgccgttgtgatgcccgccggaggtcacttcagtaaattcctccctgacggtgccgagcatgttcgggcgccggtccttccgttgcctcttcggttggctgccatctgtgcgtgcgccgccatcatcagtggtggcatccgcggcgccaccatcagtggtgtcatccccgacgccactaggggttgtgtagtcgggatcggtgtcttccgcggcgtcctcatagcggtgaggttcttcctccatctcctgggacagctcccagaatgcctcgcccccccagccggcctcatcgttgtgggccatgttcgctctaaataggaaaaaagtttggtcaaaattttggttattgtcaangaacaagatctctaaagttgaccaaataactaattcccaaggggggg

SEQ ID NO: 16186 - DNA, 556 bp, Triticum aestivum
  Clone ID: PAT_TA_16186
gatggagcactcatcttaccaaacccgctgcttccagtttccggatctcccctatgatgaacttttgttgttccaaagcttgctttctgacattctgctggacgggccgggcatcaggacagacagctaggtggtgctcaatcaccttcctgggaacgcaggggatgtcggatgcttgccaggcaaacacatcgacattcgcctgcaggaaggtgacgagcgcgtcttcctattcgtcgtcaagggtggagcttatggtaaaacctcctcccgtgccgtcctccttgacagaaaccttcttggttcccggcggtgtggccctggacttcttgtttctgtcggcggagctctctggcacggcctcgacgggagcgctacactccgaagagggtgcgcttgccggagtgggtgcctgaggtctcaccggccttcttcttttgccctcccggggctccggcggcaggagcaagcgccttagcagcggcggctgctgcaactgcttgttggtagagttggtcagtgcaaattagcgcatccttcttgtgtgatgggacgg

SEQ ID NO: 16187 - DNA, 828 bp, Triticum aestivum
  unsure (1)..(828): unsure at all n locations
  Clone ID: PAT_TA_16187
gcttttcgaaggttgaggtacacgatttccaaaggtttcttggttatgtgttgacggatggatacagcttggatgtaggtattgttcgtttgggtgagatatatattgcttcccctgtatccccaacaccacgattgcataaccagaaagtttcgggagttttataggtgggaattcaagttagcgcttgtgctgtctcgccgacgctcacttggtcgggcgcgcggccttgcacatgttggtgccggccgattcagccagcctaggcccctcctttgtttcttcggacgaaatctctgtcatatgtttgttccagcttattatgcaatcccatccattagtttttgttttcagttgtgctattcgagttgcttccatgtctaatgttcattccctaccttttcaatcctgtcttctcaggtttctttgtgtctactgattcatcattatcatcatgtgtgtcatgtcattcattttcaaacggggtgtgttccttcgtgcaaattccatcctttcccccttccacactttcaatccaccgtttttcaccggtgtgttttatccgtccatccccgtttgtctcagtccaccccctccttcccaagcttcccattcctaggcgcccgcctcttccccaagagtcctcatctctcctcaattccctccacggtgcccgccatgttcttatccggtgattctcangaanatacaacaanncttcaagttaacattctcatcncttcctcccggnggntcaatcaancttcangtgataaatctttccccgntnaaagctcnagcngggaacctancatcantccncanctt

SEQ ID NO: 16188 - DNA, 699 bp, Triticum aestivum
  unsure (1)..(699): unsure at all n locations
  Clone ID: PAT_TA_16188
ggcaaatcatgtagaaaaacatttgggcaattatgatacgggatattctagaacaaagaagaagtgcttgtgttttgaggtttgtgcattatgcttaagtccaaccctggagtcttctagattgttcttgtggcagaatctggtggaatgtagatgatatccaacgggccagtagtgctcggatttgccatctctgcaccgtcggattggcttcatccaacgaccatctttcatagttattcgcactcgctctctgtgtatagttgtattgatacgggtagctgtgccccttgctagacagagttggtgtggagcgcgtgcctgccgtccccctcccctcctgcccccgttgttggcttacgggtcggcaggggtcttgtgccatggtccggaaccgggcccgctgttccggttggtaatgtacttaagggtgggccatcgaattgtccatttggggatttaaacacacatacaccatcgtacccatacatatttccggncgcatgcatgtatacgggccttctgatngacactctcccttgtgcgggttttgtgacgacacgatactgtgacncccgatgtatattatatcccttgaccgataatgagggtattgttggcatgaatgatctccaattangtagggcggcacgtcaatgtggcacaaaactcagggggccgtaccantcccnaanggcc

SEQ ID NO: 16189 - DNA, 266 bp, Triticum aestivum
  unsure (1)..(266): unsure at all n locations
  Clone ID: PAT_TA_16189
ccgaggtaaagatccagcaggtatctactggcctctagcccgccagcgttagttatattttggcctaanannatccgcaggcagtttttttactgaatctcccccgcgccccaggtcttttgtccgctccaaacgcatgtcctacatctgttttctaatctctacctatagttttactagttcatatacacgtatcgttatattgaaacacacataaaattcccttttcatatttacatccttatttttgttgtttattctcaccc

SEQ ID NO: 16190 - DNA, 869 bp, Triticum aestivum
  Clone ID: PAT_TA_16190
cttgtcctccgtgcacggcgttctccggcttcgcgctcccattgctccggcagtgtatcccatccaggattggtacggaccacctgtgcactgtatctgtgccgcgtgggtttactgttggtcactgcgttcccttgaactttcaccatgagagcccccaaattttatgccaagacaacttaggtttctcttaaccggtgtcgtctcaacggaattacgtgctaccctatttaaagtgaatgcggttgtctctaatgcctaacccataaacgatagtggtaattcgataagagacatcatggtatgcaccatatccaatagggtgcagttatgatgttcggacacaccatcacactatggtgttccaggcggtattaattgtgaaacaatttccacaatgtcttaattgtgtgccaaaactcgtaactcagatattcatctctatgatcatatcatagacattttatcctcttgtcacgacgatcttcaacttcactctgaaattacttgaacctttcaataattcagacttgtgtttcatcaagtaaatatactcagcatctactcaaatcatctgtgaagtaagaacataacgatatccactgcatgcctcagcactcattggactgcacacatcaaaatgtattacttccaacaagttgctttcttgttccatcttactgaaaacgaggcctttcagtcatcttgcccatgtggtatgatttgcatgtctcaagtgattcaaaatcaagtgagtccaaacggtccatttgcatggagtttcttcatgcatatacaccaatagacatggttcgcatgtctcaaacctttcaaaacaggtgagcccaaagatccatcatcatggagct

SEQ ID NO: 16191 - DNA, 818 bp, Triticum aestivum
  unsure (1)..(818): unsure at all n locations
  Clone ID: PAT_TA_16191
ggtttgcatgttcatgtgaaagtttgtgcgtggcatgtgagtgtcgatcaatacctcgttgctcgtaaggcgaacgacccggttgttccgaagttgcgatgacctctgatgagaggtggcctaatcatgtggtgacatgaagggcagcaaggtggtactattgtagcatgccagccttgcgtcatccgtcgctcttcggcgtcagcgtgttccccgccgcgtgttcggcctcttcccgcttgttccaaagtcgcgatgacctctgatgagaggtggcctaatcatgtggtgacatgaagggcagcaaggtggtactgttgtagcataccagccttgcgtcatccgacgagttccgacgttaacgtggacggagccacgttatcgttctttcccctttccgtgctaccacatgtctcattgccaggatgcggtttagtaagttggtaacctctttccgtgtacacaccaaacagagaggccgggatgatggtaccttggcccaggattaaagccagtcatccggtcagggggcatgggtgtttccggttgggaccgagaggggggcacccccttagagcgcgcgtatagaaatttgatcccatgctacccgaggttgtagcctccccgtctcaaggtttttcttgaacgttgccgagggtgatccctggcttcggatggttgaattgggtgtgtactggttagacgtgtttcttccaaaacaccgtagacggaactagtcccgtgactactgaaaaccgttggctgtggtaagtaaaactcgcanagtcattctttcaaatcancgancatgntaagtc

SEQ ID NO: 16192 - DNA, 775 bp, Triticum aestivum
  unsure (1)..(775): unsure at all n locations
  Clone ID: PAT_TA_16192
gcaaaagttctttttttctctgaacgaaaatataccaacatcacggatccacttaccttcccttcgttcggagagacgaacagtggcagatgcgagtgttgcctttcttgaagacggtgagggagaaggatagtccgagggagaaggggattcagtgaagagtgaaatgatggttgcttcgtccgtcaaacttagactgcggggaggtgggattttgtgatacgacggctcgttactgcagcgctacgaccggggtgactctccgcctgcatactgccttctaatttggtggatggcatttgggcccgtgcgctgcatggcccgcatgtcggtgaacaaaagtataacggcgttcactagaggcagacgtttcaatgacctaggaggagccagaagcggtagagtgtctccactgtactagtagtaattgtttttctgggtagctgtagagtgtctccactgtactagtagtaattgtttctctggggcccaagacaaaacagcccatccacactggtaaatagtaaaatcaattcaaaaggtgctacccacacccagcacaccgcccccccaaacctgggtactcttcttcctcttcgctcccacccacctcacgtcagcttgctccactcgtacccccaaattcctcacctcactcctacagaaaaccctagctccccttcttcctcantcctacggaaaacccccagctccccttcttcttcgntcgnactacaactaggntcggcattcgttactctgtcaaatccgtggg

SEQ ID NO: 16193 - DNA, 541 bp, Triticum aestivum
  unsure (1)..(541): unsure at all n locations
  Clone ID: PAT_TA_16193
acgctagtatccggtaatcccgactaaaacggcacggccaggtcttttcccgcgcgatatgctgggaggttggcttagttgggttttttaggacgagtaatgttgcacctacgtaatcctagttacgtaattaacaataatgtgaaacgtgtgagctattgattgtagatagggggggagggaggggcccaccaccatgaaaatcaggggaggagagagagaggcaatttacgttaaccctttcgtaggttcccgtagatntagaaagatgtgaaatgcgtgaatgtgtagtggacgtactattggagtgcctaagataatttgtgtatgtatagaacctatgtgtttattctacttcgcatgttagatttgtctcggttcaataaaagcagagttggtgatgatggtgtgcctgtcatcctgcaatataggccgtccgatctatatctnacggataggaaggaaactgtgacaatttacccgcactcctctccacatttgcagataaggctttccctcattcatcctcttctcccacaag

SEQ ID NO: 16194 - DNA, 634 bp, Triticum aestivum
  Clone ID: PAT_TA_16194
ggaaacataacaccggaaatttcccagaaaaaattccagaggctcgctcaagatttggggtttttagacagaacagatcagagagaggagaggggagatggcggactggggcccggtgatcgtcgcgacggtgctgttcgtgctgctgacgccggggctgctgtgcacgctgccggggcgcgggcgggtggcggagttcggcagcatgcacaccagcggcctctccatcctcatccacgccgtcctctacttcgcgctcgtcaccatcttcctcatcgccgtcggcgtccacgtctacaccggctagccgggcgcgcccgcccgccgccagcatcgatcggttcgagctcctccgctggatttagtttaagatctgtctgtctgcagagctatcagcgatggttgtggggtcttgtaatccgatttggtggtacggttttaaactttagtttcattgtaaccagatgttaaagatcgatactgcctacggcgtgttgcgttattatactcgtataaataggctcgatcgtcgactcgtgttcgcctccgtggcgcgtttgttttgccttcggagttgttccaggcgttggttgaggttccggattacacttcaaaggaagaatatataaaaaaa

SEQ ID NO: 16195 - DNA, 409 bp, Triticum aestivum
  Clone ID: PAT_TA_16195
gaactgcaccaaagcaactggagttttgcaactatgtgatagcgggcaccccgaggggcccttgagtttgccagaatgtcgattaacttccgttccggcaaattcgggtactccatatgtcctattttcagcaaaggtcatgctgaaattttccatgaattttagcatgactttgctaaaaataggacatatggggtacttgcgactaatgcatgggccggggtatcttagtacttaattaagtaggatcaactgcctcttgtgttatacatatagaagtgtgatatctactcatagttattactaatgtcagttgctcgccttcctgtgccccttttctggtaggatgacctactaaaaaagcccataccacatattctatttggattgccctgctaacccttgacca

SEQ ID NO: 16196 - DNA, 777 bp, Triticum aestivum
  unsure (1)..(777): unsure at all n locations
  Clone ID: PAT_TA_16196
cggcaacttcctttaaccaaaactcgcatttgctgaatttggcatataactgatgttccctcagtttccccaaaaccaaacgcaaatgttccttatgctcctcttcattctttgaataaaccaggatgtcatcaatgaacactacgacgaacttatcccaaaactccataaacactttgttcatcaggttcataaaataggcaggtgcgttagtcaatccaaatgacataacggtatactcatacagtccatatcttgtggtgaatgctgtcttaggtatgtcctgctctcgaatcttcaactgatggtaccctgatcgcagatcgatcttggaaaacaccttagctccttgcaaccgatcaaacagatcgttgatcatcggcagtgggtacttgttcttgatggttacttcattcaatccccgataagctacaaccatccttaacgatccatccttcttctccactagaagtacgggtgatccccaaggcgaagaacttgggcgaatgtaacctttatcccgtaactccttaatctgcttcttaatctcctccagatcctttgcgggcatccggtacggtcgcttagatattggccctgtgcctggcaaaagctcaatanaatctcaatatctctatccggtggcatgcctgggaactcctctggaaatacatcaagggaaaatccntcactactggtacntcctcctgcacaantccngttacaaaattatccnaagggggggccngnaccaattcccctaaaagtgngtctatt

SEQ ID NO: 16197 - DNA, 392 bp, Triticum aestivum
  unsure (1)..(392): unsure at all n locations
  Clone ID: PAT_TA_16197
tgcgcagtcatgttatctgccgttataaattaaaatgctgtacacaataataatagttcaaaaaaaagacaaacaagaaagagaaatgatattggtatttctccgccctctattaatgtaaacggaatggcaccatatacttgaatctggtttcagatgctaacgacatcatgctttccaccattagctctcagctaacttgtaaacaaagcattgtctctttctttttgcgacgatcaagctttcctaatcagaacggacacgaggggactcgtgtcggttcaaggtagcacaaggctgccggcagagacnggacagcggaatcnagaaaaatctattcctgccaacaggtgcaaggatgtcgggtaggagccatgagaaggatgaagaaa

SEQ ID NO: 16198 - DNA, 405 bp, Triticum aestivum
  unsure (1)..(405): unsure at all n locations
  Clone ID: PAT_TA_16198
atcaaagatgccactgcttctggcatgattgtgggctctccggtatgattttggtattgcccttgcaaacctagcaacggttctacagttcttagtgcatgcaatcgatcaaatcgagcatactgagaaaccatcttcttcaagntgccaaaagtttggttatgtccacgacatttggctctctcaagtgctttttgtcaaacacgtggaccactgaagtgacaaatttcaacattgttgcgatgtcttcggcacaaataccacgacgtagatggtggatgatgcgcgtgatggatgtgagaccagaggaggaaaaacaatgggttgtgtttgctgcgatcgagccgccaccagcgtcagatcggacggctggctagacacctccagatcagacggctggctagg

SEQ ID NO: 16199 - DNA, 406 bp, Triticum aestivum
  Clone ID: PAT_TA_16199
ccccccccccttgggagtttctaattccttgtgttccagattagaagtaaaatagttactcttgcttgagatattccttgtgttaagatttgttcttgaatattgtctatgtaatgcccaggccttgtgtttgattgcaaagttgagcttggaatgttgtggcatgcggcatcatgagctgttcaccgtgcctcctgagaataatgcttcgtattgttttgcatgtcgatctaatgccagtgatttgcttgttaagaagatcatcctcttctgttgtttccgtgcttaagaagttcatcgtctgatgtttcattcatagcctatacgacaagtcgggtaggttagacgtgaaaccctatgatcttccgaccaactcatgatattaggccgtgattggatcgttgtt

SEQ ID NO: 16200 - DNA, 570 bp, Triticum aestivum
  Clone ID: PAT_TA_16200
gcgcagccatacgttgtggcggcgctctacctctgtggcaccctggcactcgtggttgtggagtccgcccccgcgtgtgcgtcttcacaagttcccactcgcaattgtaccaaatataaacaacccaatctccatttgcgccagcccaggccttaccctgaagcgatggcatcttgacatcacaccgtatcgttatcaagcggcatcaacttgcacaaggcgaggcctccgtcgtccgcgcccatgcgaacaggcttatagcaaagaagataagggggatcaaaccgctcctcgacccttgggttccttgtaatgatgttattagttgagtcgagaatggtcttgaacgaacctgccatgctagccgaggtgatgatgtcgcaccgatcaatgagttcccccaccacgtcatctttcagatcggggcaagaataatggggtcgtttccggcttgttccctccatggagaagacgatcgaacaatggcagaaggaagggtgaaggccaatggaggagggaggaagagcgtgcgacagcagttccaaatcgagagggaaaggcgaagagtcg

SEQ ID NO: 16201 - DNA, 516 bp, Triticum aestivum
  unsure (1)..(516): unsure at all n locations
  Clone ID: PAT_TA_16201
cgtccgcggacgcgtgggcgccgccgctcctcccgatcgccccgagccgaccccgcctctggtcgccgcccacgcacctggaagccgccgccgccgtcctctgccgggctccgccggaccgtcccacgcgactgccggcctcctcccgaccagaccgacgatggcgacgaccggatctgaccggccccgatcgttcccgcctcgcctagccgcaccactcatccgccccacctctcccagccagccccgccgccccctccctgccgagccccctagtggtggacggtgacatctcacctggactggactggagagttgcatccaatcaggcctccctcctctccactaagtgcatctgattctgaacacagagttcttcacggtaattgttcaattctctgatgcaagccatttgtgtgagtggcgctaattaacttatatgggnaanaactctatngggaagggntccgacaataanaactaattttaaaangacacnggaatattttactatat

SEQ ID NO: 16202 - DNA, 424 bp, Triticum aestivum
  Clone ID: PAT_TA_16202
cgcccctagcgagtccggtgtttccggtgggccccggcattgtccccggcatgtgcccgtatgggccttcggcggggcgcttggtgactgccccccgtccctaaagagcgtggtatccactgctgaacggggccacttggaatgtaattccttcggacttgtagttctccggcgtgccgaataccacatctagtgtgattttcccagcgcatcgtgcctcccgactggggatgattcctctgaaggttgtgctactttgctcaatgcggttccagtctatttccattttttgaagagtttcctcatagatgaggtttaatccgctgccgctgtccatgagtactttggtgagtcaaaagtcgtccatgattggactgaggaccagtgcggctggtggtcgggctgttcggaatttaggttcgtc

SEQ ID NO: 16203 - DNA, 550 bp, Triticum aestivum
  Clone ID: PAT_TA_16203
agcctagccacgtgaacgggttttccttcccagcatctcgtggctcgcatgcccgcccgagccgctcctcgcctgccgcttcctcatcagctagtcgcatatggacacttgcgccttccatctttgcccgtcccccccctttggccgggcgggcccttcggtacggtgcactttcgcccccttcgtcgggtgctctactactactctgtagcttgtggcgttgcacgcatggactttcactccattatcggcttctactataaaagaaattcctcttgacgtgttttttttgaaacggaggcaaaagctttgcttcatctcattcataaagaaggaacttacttaacaaagttcgacgagatccattacacctccacaaatggaagcgaaaagcctagtctcagctgtatcaaataactcacatgttctgcccccgcagtaaccgtcgcttgattaacaggctgcttggtgtgtgcgtgagaggagcggctgagtaggccagctacgtgagaggagcggttgaatagagcaccgagagtacccactaggc

SEQ ID NO: 16204 - DNA, 860 bp, Triticum aestivum
  unsure (1)..(860): unsure at all n locations
  Clone ID: PAT_TA_16204
ggctcgagcttagaaccatcaatcctataggactacggattagtaacacgtgatcatgatagaaagaagataaagcctagttcctactatcttccgtatgttcatagttgatcccagaacctcgatttttttgatgtttgagtggttatgccaccattttgcaggacgtctcanatcttttgagcatttacagccgttatgatgtctgagtcatcctaggtttctaaacaatttgatgcaattgcacaatcctttccctctattttcgatgtcctttgggccagattaaccacactaaccagtgtgttgaggtactccgttgcctcgacatttatgttggagctagtattatgacccttggtgtcttagaggatcacctagtaatcgagccatgctttgtgttcccagtgtgatgattctggccatcattctcgaaagcatcccgtgatgccatttagttagtaggccttctatttctaggttcttaagcccaagattcactctacatacctcgtgttgatagtgttgctcgtacctttaggatattagtaacctttgtgatagtctttgaggtccgtggtatatcattcttccaataccatgaactgcttatggcagaagttcttttgaaccaaaatatcacaaccagagtgctcttgatgagttctccattctacattgtgaatctgccagttctacctttctgcatgggttatctagaagaaatgttgagctttgctcgacatactaatcaagcatccacaactcagaaagatatagtccttcaagttgtcctctcttagttgaatccgatctcgtcatcattgataacaagacattctgatcagccatcaacccan

SEQ ID NO: 16205 - DNA, 1070 bp, Triticum aestivum
  Clone ID: PAT_TA_16205
cgtccgcaacgctggtaagcagatcgcgcacccgacgcgatccagaccgcccagcccagccccgaccccgaccgacgacgccggcccgcccagccgccgacccacgccgctcgcgctcccgtctctcggcgatcctcccttctccgacgaccggctgccaccccttccgccctcgccgccagatccgcgcggccacgcctaccccacctcgctcttcttcttaggccccggcagatctacgcgggcggcgaccgtccctagccatgattaatttcgtgctcctaatcagccgccagggcaaggtgaggctcaccaagtggtactcgccttacacccagaaggagaggactaaggtcatccgtgagcttagtgggctcattcttactcggagggccaaaactctgcaactttgttgagtggagaggttacaaggttgtgtacaggtaaggtatgccagcctctatttctgcatgtgtatcgatgctgatgacaatgaagctcgaatttccttgaaattatccatcatttttgttgagatactgggaccgctatttcggcagtgtatgcgagctggatttgatattcaatttcaacaaggccttactatgtactggatgagattctcatttctggtgagcttcatgaatctaacaagatgaatgttgcaagacttattgctgcagagggattagttggtagaggctgctaaagaggaacctggctgcataagtaacatcattgcccaggctacgaagtaaatgtctgcgtcttattatccctgcccctcctgtcttcggtttatgtttatgttggtaaatttgatgtaatagctcctttgctgtatccattttcccaaagaaatatgacttcccggcttacaggcctgttcagaatgagtgatatgtaactacaatgcatgtgttcctttgcaactgaatttggaatcttccaaagataaaactgtcatggagattgttcgccagtagtctgtttagtgggtatctaagaaatatttgtaaattcttggtcgtaaaaaaaaaaaatgtcccctggagtttaatcaaataaat

SEQ ID NO: 16206 - DNA, 512 bp, Triticum aestivum
  unsure (1)..(512): unsure at all n locations
  Clone ID: PAT_TA_16206
ggttaaccnggggatgattagtagacaatnatcttggatgatgntaaatacccaacacattaggatgaattatttcgtttaantccaaggcaaaaggttgttagcattatngatttnacacgcattgttnatttgtcggcattccggttacattaacacaggtccgaggatcccggtgctggctatgtggcttgggttctttgggttcttggcacggtgtgcttttcgggtttctatccgaggttttggtgtgggtgctactcccaagctaggccagtgatttgaaaacagggcgagaaggtgctacttcggccacttacccgcagcccacctagcgcccccacctggcccagcaatgcggctgaggcccagcccagctccccaccgtcttcaacctctgccagtaggcagaggcgtgtcgacgcgcccgcgcccgagcaccacctcctgcttccacctcctgctgccccctcaacgccctggactccctccgcgacgccacgcactccctc

SEQ ID NO: 16207 - DNA, 626 bp, Triticum aestivum
  unsure (1)..(626): unsure at all n locations
  Clone ID: PAT_TA_16207
cgtccgttctaaagaagggaagcaggagtgtcaggaggagggtggtgatggcaatggcaatgctgagggcggcgccaagcaggcaggcaactctgtgcaagaggggcggagggaatctggtcctggggcagcagctgcatccaatgttgtttgtgaataccaagaaagtggcatggagcacacccaccacctgcctggtagcccctttgcttcccccaccaaggaggcctccattgctgctgctgagcagctgacagctcacactggtgccatgggcaacagtagcagcccccacctggtggcctcttctcttttcccgcctacaaaacctctctacagctcctgcttctctcaagtgcctagattgtcgtctgggcagggagcaattgggctgtgaatagagcaaagaagaggggcgtcatctcctctctgaagtgctgggagggctcgtgtgatgactgaccccatcaacaagtggtggtcggaaaaagaaaaggaaagcgttaacagattctaggaggtgtatcttgttgagttgggagagggacagcagcagcaactcaacagcaacaacagcaacagattaagaaaggaaacaagtcctagnttgtctttnnncctnnnnn

SEQ ID NO: 16208 - DNA, 1194 bp, Triticum aestivum
  Clone ID: PAT_TA_16208
gaactgcctgatgacattggtgcgcgcgcggccggagttcgtccgcggacgcgtgggcgcgtgcaaggcggacggggaggggaacagggtgatcggcggcgtggagatgatgagcccgcccggggaggcgtacgtggactcgctgttcgacctggagccgccgggcagagggaagcggctcggcgaggaggagctggtcacgctctgctccgaggtgatgagcgccggcaccgacaccagcgccaccgcgctggagtgggtcatgatgcacctcatccttgacccggcggcgcaggagagggtctacgacgaggtcgtcgccaaggccggcaagaccgcccggatcaccgaggccgacgtcgaggccttgccctacctgcaggcggtggtgaaggagacgttccggcggcacccgccgagccacttcgtcctctcgcacgcggcgacccgggacgccgagctgggcgggtaccgggtgccggcggacgccagcgtggagttctacacggcgtgcgtgacggagaacccggagacgtggccggacccggacgcgtggcggccggagcggttcctcgagggcggcgagggccacgacaccgacatcaccggcacgcgcgcgctccgcatgatgcccttcggcgccggccgccgcatctgccccgccgccacgctcggcgtgctccacatccagctcacgctcgccaacatgatccgcgagctccggtggactccccccgccggcgagggcccccctgaccccaccgagaccttcgccttcaccgtcgtcatgaagaactcgctccgcgccggcatcgtcgagcgcaaccagccgccgccggtggccgcgaattgatttcctccgtcgacccggaatgcacggcgcggcgcgtaccacgtcacggatatgtgattatggcagggtgtcagtgtcatgcctcatcaagaagatatagataaatactgcggcgtgacatcggttctgcttgtagctgctgctcgttggacatcatgatgcaatgccacctcttcaattttagcgtcatgtattttattttctttttttctcttgattagtgctcgagtcccttctcttctttcttcttctcttgaattcttgatttgatccacaaatgtacctataacctgctgctgttcgttggagaatatttttgttgccaaaaaaaaaaaaaaaaa

SEQ ID NO: 16209 - DNA, 604 bp, Triticum aestivum
  unsure (1)..(604): unsure at all n locations
  Clone ID: PAT_TA_16209
attgcccggtacattgctagttgccacgtctgtcaccgtgtaaaagcagagcatcagcggcctgctggcacccttcaacccttagctattcctgaatggaaatgggataaaattggtatggatttcatcaccggttttcccaggaccaagtgagggaataatgctatcttcgtcgttgtcgatcgcctttccaaagtagcccatttcctgcctgttcgcgagagtataaccgctagtcagttggcagacttgtacatctcccgtatagtgtctctccatggtgtccctttgggaaattaactcggatcgaggaagtcttttcacctccccgattttggggaaagcttccaaaatgctatgggaacccgcctctcctttagcaccgccttccaccctcagtcgagtggtcaagtggaacgcgtcaaccagatactagaagacatgcttcgagcctctgttatctcattcggactgggattgggagaagtgccttccatttgccgaattgacttacaacaacagctatcaatccagcctgggtaaagccccttctgaagttctctagggacaaggggtcnaacacccttaacnggcagagaacggg

SEQ ID NO: 16210 - DNA, 376 bp, Triticum aestivum
  unsure (1)..(376): unsure at all n locations
  Clone ID: PAT_TA_16210
gtggatcccccgggctgcgggccgagtcatcccaggtttctaaatagtctgatgcatttgcaaaatcctttccctctgtttttgcgtcccattgggccagattaagcacactatcggtgcgttgaggcactctattgcctcggtatatatgttggagctattactatgaccctaggtgttttagggagtcacttagtaatctagcaatgctttgtatccccagtgtgatgattctggccattattcccgaaagcatcccgtgatgctacttagtagtaggtattctactcctgggtttttgaacccgagattcaccctacttcatgttgttnatatttgctagttcccttaagatattagtaacctttgcgatagt

SEQ ID NO: 16211 - DNA, 750 bp, Triticum aestivum
  unsure (1)..(750): unsure at all n locations
  Clone ID: PAT_TA_16211
tgggctcccngtctcgtttttctctgtttttctccctttncttccntgtcttctccgttttcctttttcctccggtaaatgctcctgtcatttttaaatcttaaaaatccaattatatcccaaaaaaaatcggtaaaataaaactaattcattnttaaaatccctttgaaggtttgacaaaaggtttgatacatcattccagttcatcggccaaatacaaagtttggtacaataaattattacacatcaattcttcccttgtgtccctgcttgcttacgattgtgccgtatccatggagcatcctcatcatttaacttaatgcttgggtcagtgttcactttgaagggcggaatttcaccaaacatattataatcttctgacatgtctgtcttgtcctccactcccacgatgtttcttttccctgaaagaacaatgtggcgctttggatcatcgcatgatgtactgatcgttttcttatctttccgtttcctcggtttgctactcatgtccttcaaataaaaaacctgagcgacatctttggcaaggacgaatggttcgtccagggtacccagattgttgaaatccaccattgtcattccgtattgctcgtccacctttaccccacctcctgttagcttgaaccatttgcaccggaacaaagggacctttaaggaaggtccatagtccagttcccatatctcctctatgtaaccgttatatgtgaccttttgccccttctcggttgctgc

SEQ ID NO: 16212 - DNA, 668 bp, Triticum aestivum
  Clone ID: PAT_TA_16212
gctaaacaccacatgaaagatgcaaccaatatgactctgccaagttaaaagcttcccatcataaatggaatttcaacaaattagaagcagcgcatgctataaatcatatgaaagatgcaactaatattgcactggatatactaaaggtgtctcgtcatgttgatcgatgcgggatacagaaaaaacaatagttttatgtaaggacatgcttaatagacagatgtactatgtactaaatacaggaaggcatgtcacattaacaggtataatgtatcggctaagcagactagcacatgcagtttaaccagattgggaagaattacaatctagacacaccatatgcaacatgcaaccacatatcacgcggccaagttagagcaagcacctgcgatgctagtgtaggggaaatgctgtaatcaactacagagctacgttcactatcctcatctagcattcctgtttcttgagaatcatgtcgggaggctgacgctgcattctttaaatgaggagtagtccccttgcctgtctgcctcgtcataagtgattgatgagggatacacaagaacattagtttgatgtaagaacatggttaatacatagatgtactattatgtaccaaaaacagaaaggcatgtcatattccaaggtataatgtgtaagctaagcag

SEQ ID NO: 16213 - DNA, 1270 bp, Triticum aestivum
  Clone ID: PAT_TA_16213
gccggccgggtcgggcctctagtcttgtcccctcccgcggctagggtttcctccgcttcgctctcgcagaatgcctcgctacgatgagcgtgatcgttatggcggcaacacaaggctgtacgtgggtcgtcttccctcgcgcacccgcacaagggaccttgaagacctcttcggcagatatgggagagtgcgacatgtggatatgaagcacgagtttgcatttgttgagtttagtgatcccagggatgctgatgaagcaaggtacaatcttgatggtcgtgactttgatggaagccgcatgattgttgagtttgctaaaggggttccgcgtggccaaggaggaggaggtgaccgtgaccgtggccgtggcggtgaccgtgaatatatgggtcggggacctcctcctggttctggccgttgctttaactgtgggattgatgggcattgggctcgtgactgcaaagctggcgactggaaaaataggtgctatcgttgtggagatagtggccacatagaaagagattgccagaacagccctaagaacctcaagcgtggaaagagttactccagatctccatctcctcgccgcggaagggtgcgtgataggagctacagcaggagccgcagtaggagctacagccgctctgtttccccaaggagggatgaaaggcgatcaaggagtccccgtgacagtcgcagcccaaggaggagcccccgagacagtcgcagccctatgaagagcccccgtggcagtcgcagccctatgaggagcccccgtgacagccgcagccctaggaggagcgcttcacctgtcaaggggagggcccggagccccacccctcctggcagcaggagccctgcaccaagggaaaacagcaggagcccaatgaaggctgacagccctaataacatgagcccagctgcaaatggtcgtagcccgagccccagggatggtgaagacaatggcaaccaccgcgcacccagtggaagtgcctcacctggtggaggttgagttatggatcaaaatccttccagtgttcacccagtggaagagcatcacctggtgagggtcgagagatggatcatattcttcctacagttatgaaactctccaaacatgttgaacaaaagacttgcctgtacgagtttgattttatcgtgtactctatttcggtattgacactccagtcagaccataatatctgttgtactatgtgcacatggaatcattttgcagtttctacattccatcaaatatcttttgtgctta

SEQ ID NO: 16214 - DNA, 1865 bp, Triticum aestivum
  Clone ID: PAT_TA_16214
cgtccgctcccgcggctagggtttcctccgcttcgctctcgcagaatgcctcgctacgatgagcgtgatcgttatggcggcaacacaaggctgtacgtgggtcgtcttccctcgcgcacccgcacaagggaccttgaagacctcttcggcagatatgggagagtgcgacatgtggatatgaagcatgagtttgcatttgttgagtttagtgatcccagggatgctgatgaagcaaggtacaaccttgatggtcgtgactttgatggaagccgcatgattgttgccctcctcccgcgcctggggtttcctccgcttcgctctcgcagaaatgcctcgctacgatgagcgtgatcgttacggtggcaacacaaggctgtacgtgggtcgtcttccctcgcgcacccgcacaagggacctcgaagacctcttcggcagatatgggagagtgcgacatgtggatatgaagcacgagtttgcatttgttgagtttagtgatcccagggatgctgatgaagcaaggtacaatcttgatggtcgtgactttgatggaagccgcatgattgttgagtttgctaaaggggttccgcgtggccaaggaggaggaggtgaccgtgaccgtggtggccgtggtggtgaccgtgaatatatgggtcggggacctcctcctggttctgggcgttgctttaactgtgggattgatgggcattgggctcgggactgcaaagctggcgactggaaaaacaggtgctatcgttgtggagatagtggccacatagaaagggattgtcagaacagccctaagaacctcaagcgtggaaagagttactccagatctccatctcctcgccgcggaagggtgcgtgataggagctacagcaggagccgcagtaggagctacagccgctctgtttccccaaggagggatgaaaggcgatcaaggagccctcgcgacagtcgcagcccaaggaggagcccccgtgacagtctcagccccaggaggagcccccgcaacagtcgcagccctatgaagagcccctgtggcagtcgcagccctatgaggagcccccgtgacagtcgcagccctaggaggagtgcttcacctgccaaggggagggcccggagccccacccctcctggcagcaggagccctgcaccaagggataacagcaggagcccaatgaaggctgacagccctaaaaacatgagcccagctgccaatggtcgtagcctgagccccagggacggcgaagacaatggcaaccaccgtgcacccagtggaagtgcatcacccggtggtggttagagatggatcgaaatccttcaagctttcacccagtggaactgcatcacctggtgagggtcgagagatcgatcaaattcttcctacggttatgaaactctccaaacatgttgaacaaagacttgcctgtacgagtttgattttatcgtgtactctatttcggtattgatactccagtcagaccataatatctgttgtactatgtgcacatggaatcattttgcagtttcaaataatctttttgtgcttaacaaccacgcaaccagtggaagtccctctcctggtggaggttgagttatggatcaaaatccttccagtgttcacccagttgaagagcatcacctggtgagggtcgagagatggatcatattcttcctacagttatgaaactctccaaacatgttgaacaaaagacttgcctgtacgagtttgattttatcgtttactttttttcggtattgacactccagtcagaccataatatctgttgtactatgtgcatggaatcattttgcagtttctacacatcaaatctataaatcttttgtgcttagttcaaatcaca

SEQ ID NO: 16215 - DNA, 442 bp, Triticum aestivum
  Clone ID: PAT_TA_16215
ggcgcttcttgccgcggccctggacccagctgtcagcctctccacatacagtactcttccgatggaagtcgttccttgaccacattgaccacgccgcaccgagagaaccaaggcggtggacgacggcgaggcctaggaaggggaagacgcggcagtggatgcacacgcggagaggagtacgagggtcactggtttggctgcggtgtgaggctaccgtcgctgcagggctagcccgtggtgggagtagtgggggcagtgaggcctccgtggcagcatagctagccatgggaggcaagagcaggcggcacgaccggcactggtttgggcggctggagccagaagacccgatgttgaagatgcactatggtcgttggatggacatcgtacggtcactagagctagaatcattcatatttactaagttgaccaagccctccgtccc

SEQ ID NO: 16216 - DNA, 362 bp, Triticum aestivum
  unsure (1)..(362): unsure at all n locations
  Clone ID: PAT_TA_16216
ctgcaggaagctgataggttccatcccaaataacttgagaaatttaacaaaactcactgccttgtattttggacagaaccaactttctggccaaattccacaagatttaggttatctagtgaatttaaaggtcttggatctttgtcaaaacacgttctcaggttccattccaataanatttgtttaatttgacgaagctcactatcttatctctatagggcaacaggctctctggtcaaattccacaagaattaggtcagctagttaacttggaggaattagaacttaatacaaacacactctcaggttctatcccaatcactatagggaattcgaaccaactcactagattataccttttt

SEQ ID NO: 16217 - DNA, 498 bp, Triticum aestivum
  Clone ID: PAT_TA_16217
tttcggacgcgtgggttgtagtaccacaaggaagggataggagctctgtggctctctctgctttccgtccgcggacgcgtgggaaggtccctctccctgtgaggagcaagagcttcaagaagagcaggggagcctcatgcagcctccccctgctgctgctcattggggccgtccagttcttggtgatcggcaagccttttccgtcgctcttgatggatagcagcacgaggagggccttcttcaatctcgcagaggaggaattcatcccggagccacaagtgagctgcgacttcaacgacacgagatccgactactgcgagatggccggcgccatccgcatccgcgggagtacgtcggaggtgttcgttatgacccctcgccgcggcaccaccgccggggacgtcgtcggcgacaacgcgacgtggatcgtcgccaacgccacgagctggaagatgcagccgtacacgcgcaagggggaggcgcgcatcatgaacggca

SEQ ID NO: 16218 - DNA, 370 bp, Triticum aestivum
  unsure (1)..(370): unsure at all n locations
  Clone ID: PAT_TA_16218
cgccctgacagggctgcatccgatagctctaacttctgcgtacgaactcagattgggataatttttatatcaaaatcgatcgtttcaacgagacgaagacattcgtgtagatcatttttctatatgagcccgtcttaggggcgaaatatggcgtgccccaccacacacnncatatctgatgggtagcacgagcaaacggattttttccatgatcgttttggcccagaagatggcttcaaatcgaagaatgttcattataaaagttgtttgtctcgtcgaaacgagtaaatatgcttttgagcgcgctttcatccaaggtggttcactgccacaaaaaatacccgcaaggtgcagccagtttaaaccgaac

SEQ ID NO: 16219 - DNA, 1537 bp, Triticum aestivum
  unsure (1)..(1537): unsure at all n locations
  Clone ID: PAT_TA_16219
gcttataagggatttgcagactccatacgcctccttttgtttttgggcgcttatagggggcggcaagataaagaaggttgtactcctttacattgggctgccattcgggggaatatggagtcatgcactgtgttagttcaggttggtaagaaggaggaccttatggtgcaagacaatactgggttaactccggcccaacttgctgctgataagagtcaccggcaagttgcattttaccttgggaatgctagaaaagtgcatgaaagaggatgtggtgggaacaattattttgggaaactatcaaaattaggactcgcccctgtgctttggtgtattattattggcttaattgttgcatatatacattcagttatcgcaggacaatacaactcgaatatgacattactatttggtttcttttcatggttgggagttttccttgcaattgctggactagttatgttttatagatgtagcaggaaagatcctggttacatcaacaagaatacaagagactcgcaaactcaaagagatgatgaacctttgttgaagaggggtctagataacccagaacttctggctggcaattggtctcaactatgtattacttgcaaaattgtgaggcccatacgctcaaaacactgctctacatgtgatcgctgtgttgagcaatttgatcatcactgcccttgggtttcaaattgcatcggaaagaagaacaaatgggagttctttatgtttcttatcctagaagtttctgcgatgatcattactgctgcaacggctgtcataagagtcgcaggtgatccaggctctccagcatcgtttgatggatggcttaactattcagctatgaaccatccttgggtggtgtcttttgttataatggatctcttccttttcttcggcgttataactctaacagtagttcaagcatcacagatatccgggaatataacaacaaatgagatggcaaatgccatgaggtacagttatctcagaggcccaggtggtcggttcagaaatccatttgatcacggggtgaggaagaattgttctgacttcttcctgaaggggtacaatgaggatattgagaaggtagaacagacgtcacatcctgacgaggaaatggcaattattcacatgacaagaggtgcagtctcgcagaatggtgatgagcgtgccacttcatgctaatggtgctgaccatgtttgtgctgactcacaaaccaactcaaaatcgcatcgccaagttagttcgtctaaatgttgcgatcacactaagaagactgacaaaaccccctttgagcctagggttgggccttggacgaaacaatccctctagccgttatgcactggaatcttcgtcccctgtgcctctctgcgacgatccccccctgggccggtgcctttcgtttggagggggctcgtcctctccttcgccggttgtacgcgttcggtactccacccctctcggctggctgggtcttcatatnncgatcacttctttctggctgcactaatatcgtcanggtcg

SEQ ID NO: 16220 - DNA, 962 bp, Triticum aestivum
  unsure (1)..(962): unsure at all n locations
  Clone ID: PAT_TA_16220
gtgggtgccgttgccttcttctacctcctgctgtccctctgggctcaggatgcaaccacggctgaccttggcctcacaagaagcgatttcccacgggagttcgtctttggatctgggacctcggcatatcaatatgaaggtgctgttgctgaggatggcaggagcccaagcaactgggacactttcactcacgcaggcagaatggcagacaaaagcacaggagatgttgctgcagatgggtaccacaaatacatggaggatgtcaagctcatgtctgagacaggcctagaggcctataggttctccatatcctggtcaaggctcattccaagtggacgcggagctgtcaaccccaaggggctagagtactacaataacctcattgatgagctagtgaatcatggaattcaagtacacatcacacttcaccatgtagatctccctcaagttctcgaaagacgagtatggtggatgggttaaagccccaaaattgttgaagatttcacagcatatgcagatgtttgcttcaagggagtccggaaacagggttgcatcctgggacaactatgggacgaggcaaacatccgtgtacttggctcttatggcaatgctctatttcctccctgggccgttgctcagatccattttnggagcaacaaagtgcaccgctgggggaccctagcatccgaaccatacatagccgctaataatacccttatggcgcatgcatcagttttcagacggtacaagagatnaatacaaagactttttgggtgcaacacaagcaanaaagatgtntgggataaatnctaccctacggggtttcacggacaatcacgcggntcagaacaaccanagattaagattctgntgcnggtacaaaccattgngttggnacaccaagtatgaaaaaattcgnccgcttcacttaaagttatcgattanaggtcctatttntgaaa

SEQ ID NO: 16221 - DNA, 628 bp, Triticum aestivum
  unsure (1)..(628): unsure at all n locations
  Clone ID: PAT_TA_16221
tgcactctccgcccgggcaggcttccaactcaacagacaccattagagggagggtgcggctccaggtcgtgcgcctccgacaccattagcattagagggagggtgcatcagcaggattggagggttctcttcttccaagggcgccgaagttcttcagcttggcaagtaagtgataatcaatggcttacaggcttccactggcaggagttagggcttccaattatgaggctagagagcttccatcaaacagctacctggaatctgggtgggccttatggaaaatttgtgcctttcataatcgcgggagaagggggctttggggagcataagcagctcaagctggcacaaacttgtttttactgaacaagcttggacagtgacatagacagggatcatcaaagaggtgatcgattaagactaaaggcagagaaagttgttgggcatgataaaagagtcgataaagcgccgcctcctgaaattgccgagcattgggaaggcatgtcaccatgaacaggcccaagcctggcaatttggtcacgacatggattaaaggacgtctacccaccagagagatccggaaccaaggatgactgganagtgatcangnatcgngaaatcccaacattgc

SEQ ID NO: 16222 - DNA, 651 bp, Triticum aestivum
  unsure (1)..(651): unsure at all n locations
  Clone ID: PAT_TA_16222
accanatccaggcggcgccagtgaccaagcaacacacatccgtcccccacgtcgcctcccaggcgacacaggcggatccagatcgggcgccaccggcagccccctcctcctccccacctcccctcgccgtcgccggaggaggccgccgggctaagcccgggcggcggacggcggcggcggggcctctcttttgcgtcgggatctcgtggcgggggaggcacgcctccttgcggtgctgcgcgacggctacggcgcgaagatcctccgaggctgcgtctccggtgggtggcggccacggtggtgtcgtcgtcaggctccagggattcggtccggcggctcctgcccggcgagtagggcggggtggtgccccccctttcctgctttcagtcattcgtttccgcgcaggtcggctgctctggccggcccttggtggttgctgctgtgctgcggcaagggggcgccagatccggcggttcttcgtcggatccggctcgtctgcgtctttcggagggtcggtcattccggtggccttgcctgcggcagtgaggcgggtgtgcgtgctcaatggtgggccctgtgaggtgacaacgcggttgctatgcaggggtgtgcgtgtcagcggcggtgtgggccggcttgtgccggctgcgt

SEQ ID NO: 16223 - DNA, 521 bp, Triticum aestivum
  Clone ID: PAT_TA_16223
cgtccggcccccaccggccccgaccccgcgcacctcgccgaggccgccggccgccgcggaagccccgctacgatgggggtggcgcagtcgtccccggacgagcccgtccccgacctggcctccatgctcgacgcctgccccggcccgacggagagggcgctgctcgcggcggtcctggatggcgacgttccccgcctcaaggatttggttcgtgcaatggatgttgaggatagagcaaaccttgctgacatggatatactagagggcgttggactgctaggattggcctcatacacgcgtaaaatgaaggtctgcgaatacttggtagaggagcttggtcttgacgtcaatgctggtggcttccgtggtggtccaccacctttgggttgtgcagcgttgtgtggagaattttttgctgccagatatcttctcaaccatggagccgatccaaataagatagatgggacaggctttgctcctcttcattgtgctgccaaaaatgggcatgaatgtgtactgcg

SEQ ID NO: 16224 - DNA, 553 bp, Triticum aestivum
  unsure (1)..(553): unsure at all n locations
  Clone ID: PAT_TA_16224
cccccgccgccccggccgcctgctcgtccgcgccgccgcccgcccccaccgccgccgggcccccgccctggcccccgtccgcctcggcggccgcctctgccgcgttgcccgcgcccgccgcgcccgcgggggcccgcccgccctggccagcgcgctcgcggtgttccgggtgctccagtgccccgcgccgcggcgcgcggtgcgccgcggccgcgcgctgcagcggcccccccgggtccgtgaggcccccgtgccgcgcgccgcggcgccggcggcgccgcccccccgcccgcgcgcgccgcccccgggcccgtgcccgccccggccccccaggctggtggtcggcggcgctgctgcgccgacggtcaccgggcccgcccccgccccgcaagccggccgcctcgttgcgtcgtgccgccttcgccccggcgccctcgctcctcattaaggaggctggtgcaccaaggtataacagggcggccggcgcccgtnaaactatactctgtttggtatctgtctagcagacttctccgttgtttcttctcttcttgtc

SEQ ID NO: 16225 - DNA, 1840 bp, Triticum aestivum
  unsure (1)..(1840): unsure at all n locations
  Clone ID: PAT_TA_16225
ctcccccctccaccccccccgcccccccccgccccgcgctggccctgctgtggcttccggtcgatccccggcccgccgtgccaagccatctccacctccaccaccggcgggcgggcgccatgaagcagccgaggtcgcggcaggagccgcgccggatgggcaactccgccatggtcgtcaccatgctgctctccctctgcgtcctcaccttcatcaaggcccgctactgctccaccccgtaccccaacaagccggcgccgctgctggcacctggaggtggagatcgacgaggactacgacagcagccggtacaagatctccggccccatcggggaggaggagttcgaccccagccgccccacctgctacaacaccagcaagcgctcggagcggtgcgccgccgtgggcgacgtccgggtcgacggcaaccactccaaaatctacatcagcccgctgggcaatggagtggcgctaccaaagccgtacgcagcgccgccaccgacgccgtctgccatggacgacgtccgcgagcttcgcgctgctgccccttcctgaggaccaccaacatagccaaccaggcgcggctgtctcgacagggaccagctcccgcccgcgctttcctcctcccccgcggggtccggccccccgcaccctgacacagagctctacttgcacctgcaagttcatgtttctccatgcctagattaggggtcctcttcttcctcctctctctctctctctctctctcatgtttggttcacttcttgatttgttgttgttcttgttggcgccaaagtaggcgtttccttcgaccaggatttgcactgcttctcgcgcatcggcggcggctccaccttccaccggcccatgggcatcgacggcacccggtccccgggcggcgagaccgtggccgacttcaagcgcctgctccggcgcgccttccggctggaccgcgtggtggcgtcccacgacggggccgccagcctcggcaagccgcggcttctcatcatctcccgcaagtcgtcgcggcggttcctgaacgagcgcgccatggcgcacgcggcggcggcggcgcagttcgacgtgcgcatcgcggagccggacaaccacacggacatgcccaacttcgcgcggctggtgaactcggcggacgtgatgnaatgggggtgcacggcgccgggctgaccaacatggtggtcctcccgagccgcgccgtgctgctgcaggtggtgccgttcggcgggctggagtggctgtcccgggtgaccttcaaggacccggccaaggacttcgacgtgacctacatggagtacaacgtgtcgctggaggagagctcgctcaaggacctctaccccaaggaccatttctacctgaagcacccctacgacgtgcacaagaagggctggaacgccatcaagaccacctacctcgacaagcagagcgtcaggctcgacctcgacaagctcacgcgcacgctccagcacgcgcgcagcctcctgccctccccctccccctcctcgcactgacaccgagctctgcttgcacctgcaagttcagtttctccatgctagattaggtcctcttcttcttcctctctctctctctctctctctctctctctctctctctctctcatgtttggttcacttcttgatttgttgttgttcttgtggtgccaaatattcatttccttcttttctccttttctttttcattttggtaaaggaggagacgaacaagttcgtgtcaagcataggcaacaaagtgcccaaagtgttaatttacactctgtaagttcgatnattgtcccagcagccagcacacactgcagagaaaaatg

SEQ ID NO: 16226 - DNA, 1008 bp, Triticum aestivum
  unsure (1)..(1008): unsure at all n locations
  Clone ID: PAT_TA_16226
cggcatactacanagcttggatgaaaagtctcaaaagttgccggccgtcgtcacttacttggccaccagggcctccttgccgccgccggctgcggccttggccttgccgcaaggcaggtgttttccactcagatgggtttgagtgaccaggacattgttgctctttctggtggtcacaccctgggaagatgccacaaggagagatccggctttgagggagcatggaccgccaatcctttgatcttcgacaactcttacttcactgagctcctgagtggagagaaggaaggccttcttcagttgccgaccgacaagaccctcctgaccgacccggccttccgcccacttgtggacaaatatgctgcggatgaggatgcgttctttgctgactacgctgaggcacacctcaagctctccgaattgggatttggcgaggcgggctgctgctgattcaagctcggcgcctgaaggtcggtggtaatgaagaagaagaagatcatgaagaagaagaagagcaataaggatgtgttggcctgctgcggccatgtcatgtgttaatttgtctcgacttggattagatgggtcggtcgatggggtgttgcattgttttgctttggacgcctcgtgtcttgtgatgggcgtgcttgtagtatgaactgctaagtgttatgtagttcctttccggttgaattggtattccctgtcgaggacgaaatgaaaatttggttgccctcatttggccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaaaataaaaataagggggggcccttttaaaagaaccaaattttactccccggggttggaaagtatattttttttttttggggcccccaaattaaatttcggggccggggttttaaaaacgggggaaggggaaaaccccgggg

SEQ ID NO: 16227 - DNA, 3573 bp, Triticum aestivum
  Clone ID: PAT_TA_16227
agttgattctttatgcctcgacagtccaggatgggaaaatagatccaagcacccatttgatatgatcattcagtttatctctgaagaaatacagcatggtcctatggtcctatttctgaaggacacagaaaaaatatgtgggaataatgattcctattatggtctgaagagcaagcttgaacatttcccggcaggtgtctttatagttggttctcatatccagcctgacagtcgcaaagagaaggcaaatgcggtgtctcttttcctttcaaaagtgccttatagccaagcgtccccgacggcacgcaggggccccgtccgcacccccgctcctcctccccccccctccccacacacgcacgcgtttgacattttccgcccaccaccacccggagggagcgagctccagccatggccgccaagtgctacccgacggtcagcgacgagtacctggcggccggtcgccaaggccaggcgcaaggctccgcggcttcatcgccgagaagaactgcgcgcccctcatgctccgcctcgcgtggcactcggccgggaccttcgacgtggccaccaagaccggcggccccttcggcaccatgaagtgccccgcggagctcgcgcacggcgccaacgccggcctcgacatcgccgtcaggctgctcgagcccatccaaggagcagttccccatcctctcctacgccgacttctaccagctcgctggagtcgtcgccgtcgaggtcaccggcgggcctgaggtccccttccacccggggagacaggacaagcccgagcctcctagaggtttgccgtcttcctgatgctacccaaggcccaggaccacctcaggcaggtgttttccactcagatgggtttgagtgaccaggacattgttgctctttctggttggtcacaccctgggaagatgccacaaggagagatccggctttgagggagcatggactgccaacccgtttgatcttcgacaacctcttacttcactgagctccttcgtggggagaaggaaaggcccttcttccagttggccgaccgacaaggacagcatgccttgactgacccgctccctttccggcccacttcttgggctaattatggcttgcggattgaggatgctttctttgctgactacgctggagcaacacctcaagctatcacggaattgggatttggcgaggctgttgagggctaggtcaatagattcaagctcgggcgcctgaaggtgcgttaatgtagaagaagaagaagattcatgaagaagaaggagcaataaggatgtcatgtgtttgtctggacttgggtttaagatgggttggtcgatggggtgttgcattgttttgctttgacgcctcgtgtcttgtgatgggcgtgcttgtagtatgaactgccaagtgttatgtagttcctttccggttgaattgttattccctgtcgaggacgaaacggagatttggttgccctcatttggccattgagctcatgtcattgtttgttttaccaactaaatataaaacccatcctctcctaaagtcaagtcctcccagacctactttgtatatattctcagccctgtccccctctctaaacaaattttgctactttcattaggctcttgcacaatgtgaacaaacaaattcttgaccttgcattgcaggacttggatcgggtacatgataaaagtaaggaaatgtcaaaggggatgaggcatctaacaaagattttcccaaataaagtgacgatccaaccaccacaagatgaagttgagctttcacggtggaaccagatgttagatcaagatattgaaattcttaaagcaaatgataacacttcaaaaatacgctcttttctaacgcggattgacttggaatgctctgatcttgagacaatatatgtcaaggatcgcacccttacaaatgagtgtattgatacaatagttggttttgctttgagccatcaactaaagcacttaacagctacaaaccctgacccttcaattgatttgcaattttccctatctagtgaaagtctgaagcatggagttgatatgttggaaagtatccagtctggccctaagaccagcaacaaaaggaagtcacttaaggacattgctacggaaaacgaatttgaaaagaggcttcttgccgatgttatccctccagatgaaataggagttacatttgaggacatcggagcactggaaagtgtcaaggaaactctgaaggagttagtgatgctgcccttgcaaaggcctgaattgttttccaaaggacaacttatgaagccatgtaaaggaatattactttttggtccgcctggtacggggaagacgatgcttgcgaaagctgtggcaacagaggctggtgctaatttcataaacatatcaatgtcaagtatatcctcaaagtggtttggtgaaggagagaagtacgtgaaagctgtgttttcactggcaagcaaaattgctccaagtgtcattttcgtagatgaggttgatggcatgttgggtagacgtgagaaccctggagagcatgaagccatgcgcaagatgaaaaacgagtttatggtgaactgggatgggttaagaacaaaagataaagaacgcgtattagtccttgctgcgactaataggccatttgaccttgatgaagctgttattaggaggcttccaaggaggttgatggtgaatttgcctgatgcatcaaatagaagaaaaattattagcctcatactagccaaagaagatttggcagatgaccttgatcttgaagccattgctaatttgacggaaggatactcgggcagtgatcttaagaatctttgtgtgactgctgctcatcttcctattagagagctccttgaaaaggagaaaaaggagagagctttggcagaagcagaaaacagaccattgccccaatcgtgttctagcagtgatgtccgtgccttgagaataagtgatttcaaacatgcacatgaacaggtttgtgcaagtgtatcttctgattcaacgaatatgaatgagcttgttcagtggaatgatctctacggagaaggtgggtcgaggaaaacgacaacgctaagctactttatgtagcgatgttgagagcttgtacatacatgataaaccttagcacagagcaatggctgcgattggaggggggctacagtaaaaagaagtgtaggcatctgctgctagtcatcagatcaagaagggaccgtcatagtgagagcaacggagggatgcaaatctggttgatgccttgtggcaggtcaacaacagcacagctgacatggcctgctccagcgcatcaccatccaaaggagatagatttgtatttgtagcaccatcatgctcgggtcagggccggttcatgccggccatcgtttttcgtcggttattattgagaaaatctttgtttagattgcaagttgtagagcctgtgcaagtgtacagtatgaatgagcatcaggtcaggtcaattaacttgttattgtggtcagttccagggaaatattcattttattaaccagattaatttattacaaaaaaaaaaaaaaaaaaa

SEQ ID NO: 16228 - DNA, 445 bp, Triticum aestivum
  Clone ID: PAT_TA_16228
tgcgtggtggcgcagaggtcgcgatggctcgggcgacaatcgtggaaggtgcgtgacacgtaggcgcgttgggtgcgcgcgggacgtgcggggcgcagagggacgccaggcgtgtgtcgccggcggagaaggagctcggcgtatgttgccggagtcatgatggagcacggtgcaaccggcgtcgttgcggcaggtcgggtccgcggactgggtcacgactatgacgacgacgatgacaggagctgcaacaacttcgacgaccgcgagatcatggcttaggaggagaatgttagaaataagccatgcgttcatgtgcgtgcgtgcgttgtgtgtgcttgtggcatgcgtgtgtgtcgctgggtaggcgtgagagccggagctagctagccaggccgaacttggtggctgctaggtgtggttgttagcgcatgcatgcactggtagt

SEQ ID NO: 16229 - DNA, 436 bp, Triticum aestivum
  Clone ID: PAT_TA_16229
ttatctctgccccccctcacgcacccagccgcgactcggccgcaatggcggagcccgtggccaacgcggcggcgcccgcccccgcgcccggccgcctccgcaacgccttcggaggcgtgctctgcgccttcaccctcatcctcatcggcgtcctcgccttctcgatccgcctcttctccgggatcaagtacgagagcgtgatccacgagttcgacccctacttcaacttccgcgtcacccagtttctgtcgaagaatggaatctacgagttctggaactggtttgatgataggacatggtatccccttggtcgtgtgatcggtggcactgtgtatcctgggttgactttgacagctggaagcatttggtggttggtaaacgctctgaacatcccattgtcggtggagactgtctgtgcgtcactgcttcaatattc

SEQ ID NO: 16230 - DNA, 578 bp, Triticum aestivum
  Clone ID: PAT_TA_16230
tggatcaggcgatggcgttcgtggccgtcgccggcgtcttcttcctcacccttcacctctacctcgtgcccctcctctacctctgctccagctagcgacgggtggccttgtggccgcgcgggtcggcctcagcaggggcgggtagctaggcgggatgtgatcctggctgtggcctgcagtggttgttaggccggcgctttgtggttggccggttcgtgctcgtctccggaagaaattatatttctggtcttagccggatcgggcgacggcgatgcgcgggcgtctgcaatctttcctggaagcatcgtccgggagctgtgctccttccctctcctcgcggccatggcttcggaagttgtgctccttccctctcccatggccatggcttaggaggggaacttaaatccgttggatcaggcgatggcgacatcttcacgtctttctactcttaggggcatcgtctctaactcgaagcagcctacgatcaagagaccggcggatggcggcgtcttgcccgcgtgcttcgctgaggtggctgttctgaggtgttggcttcttttggcgacaatgatggcatc

SEQ ID NO: 16231 - DNA, 769 bp, Triticum aestivum
  Clone ID: PAT_TA_16231
gaaaaggcgttgcggacaactgtgttgtcagatacatcacatggagttaagaaatgcattgaaatagcattaaaatgtgtggaggctgaccgagcgaaaaggcctactatagccgaggttgtggatgaattgagtaagattgatactaccattatcgatgaactaaataagattgatacagccagaagttcaacaatagagcaggtcaccaatctacgatgcaggccggccgtcaacccaggtgtgttctcaggagtgggtgctaaagatgggagtatgattagttcctgcagcagtcgagccactcgagcctcttcggattcggtgcttctaagcgcgaatattaaatgcccgatcttgccatcagccagtgttaaaatcttcagttatgataatctcaggttagccacaaggaggttccgtgctaactctgtgcccggtgaaggaggatttggatgtgtatgtaaaggatggattgatgagaacacattgtcaccttgcgaacctggcactggtatacctgtcgcagtgaaaagattcggcccggagagttcgcaagggcaccaagagtggttggcagaaattaatcacctagctcacctttcccaccccaaccttgtgaagctatttggctactgcttagaggatgagtaccggctactcgtttacgagtttttaccacatgggagcttggaaaatcatcttttcaggagaggctcatgtcaacctctttcatggaacatgagaatgaaagttgcacttggagctg

SEQ ID NO: 16232 - DNA, 477 bp, Triticum aestivum
  unsure (1)..(477): unsure at all n locations
  Clone ID: PAT_TA_16232
aggtgcggtacaagtcggggcggctggtgccggagtaccgcccggcggcgagccccacgttcgtgctcacgcagcactccaactcccaccgcaaggtgatggagctgcgccggcagaacgagctggtgcacctccgcggcggcgtgggcgggggcgtcgtgtcggcgtcctccgggtccggcggcgcggcggagcacatgttccgcgactacggcgtgtgctgaactgccgactcgccgcacggatcgagcagcctagctagctagcaagcaagcaagcatggaccgaccgaccatggatgggatacggatgatccgattagcgccacgacgacgatctgcttaattttgcatgcaaattcctttttttccttgctttcctccgtgtacaattcgccttgcttgtttaangtattatatatgggtctcatcactttttgtccggaaataaataaggaatctgttcaaaaaaaaaaaa

SEQ ID NO: 16233 - DNA, 946 bp, Triticum aestivum
  Clone ID: PAT_TA_16233
gcgggactgtgggatggttgcagcagcacgctggattgcaagaggtataacaccatgcctccttcaagccgtcactcagtgcccagagtaccaaataaagattgttggccattcattgggtggtggcactgctgcattactgacttacatcttaagagaacacacagagttctccacaacaacttgtgttgcatttgccccagcttcatgcatgacatgggaattagcagaatcaggcaagcactttgtaaccacgattgttaatggtgctgatctggttcctacagtatcaactgcgtctattgatgtgcttcgttctgaggtaacggcatcttcatggctgaatgacttgagggatcaaatacagcagacgcgtttcctgaatgccgtttaccggtctgctaccgctttaggaactcgcctgcagtctttctctggtgcgagagccagggtttgctggtgctggggcactactatgccctgtttcaagcaaaaccctggttgtgatgaaacaagcacagaatgtagcacaggctgttgcaagaagtcggtcagcgctgtcttcatgggcatgcatgggtgcacgccgtcgacctgtaggcgtaatagctgtaagtcaggatgaaatgactgcagaaacccatgttaaaaccacagtggattcagagtcctttgttgtagaacaacatgtcacagaggtcgtagaggagctgcagtatgctgcaactagtatttcagttcacgaggaaacagaagaagaggctcttatgagtgagcatgaaacttctagggagcatacagaagaagaaataactgacggtgagttgtggtttgagttcgacaaagaccgggatcggcaagctgaagtggaagcacgaacccgggcggaagaagcagctgctgccaaggaaataatggaggaggaaagtgctgtcctaaagaatgt

SEQ ID NO: 16234 - DNA, 595 bp, Triticum aestivum
  Clone ID: PAT_TA_16234
ccaaaccctcgcacccgccgccgaccaccgatggcgccgctggtcgacgacgtcaccgccgagatcctcctccgcgtccggccggacgagcccgagcacctcttccgcgccgccctcgtctgcaagccctggctccgcgttctctgcgaccccggattccgccgccggtaccgcacgttccacggcgcccctccactcctcggcctcctccacaggacccaagtcttccacggagaccctgccgcgcgcttcgcctccaccacgtcgatgcccgacttcccccacccaggctccgacggccggcgcacgcgccctctcgactgccggcacggccgcgtcctcatccacatgctgcaggacccggaaggggatttgctcgtctggtaccccgtcaccggcgaccgccacgtggtgcccgagccggacatcgactggatgatctacaccgccgcgggcttctgcgccggccgcgggctgcgaccacctcgactgccacggcggccccttccgcgtcgtcttcctggccactgatgaccacgacgaagtcgtcaaggcgagtgtgtactcatctgtgacaggtgcatggagtgcgccg

SEQ ID NO: 16235 - DNA, 768 bp, Triticum aestivum
  Clone ID: PAT_TA_16235
gcccttcaagccccacctcgtcggttccccaccccgagctccttctcccccatcccgggcgagcactggataggcagagggagtgccttggtcgagggacaacgaggctcgccggctgggcgacttcgagcgctggaggctagacaggcacaggcaggagcggatccatgtgggggcatgggtgccgtcgcgccatcgaagcctccacggcgccctctatcaggtcacctctctctccacgaactcctttttacccacgtttttaccactctccaagctcgcactattgctctggaaaattccctttggaattggggatgaagcaatcgatttcgattgattggcgccgtgcagacgacgggcgtgggacgccgcgggaggcgtgccgcgttcgagagccactgtggattatcttcgaggtgtcaggcgacattcgcctcgagacctacctccgggtctcttcccatatgcattgacgggcgcgggtagcgggtcaggctcaccggcaaggcgccgcttgcctctgaacttgtgatgtccggccattgcatctgggaggagctcctcttcaggaagaatgccgagacgtacgccactgctgcgactgccgttctcgtccacgttttgactacacttgcaggcaactgcgaaggcaaaatctacatgtgagaagtgcagatgagccccgctgtgctaattacctgtattctgaattggctgctgaagtacataagtgaagtctactggtgaaggagatgtgaagaatga

SEQ ID NO: 16236 - DNA, 911 bp, Triticum aestivum
  Clone ID: PAT_TA_16236
cgtccgcccacgcgtccgcccacgcgtctcggcggctctagcgagctgctaaagccgcgccccccgacgccataatccctgaacgatccccagagcagagccatcctctctctcctcgggagccctcacaagcgagaggcgagagaccagagatgggcggcggcaactgcaaccccaaggacttcggcgccgccgcctactgggaggcccgctactcctctccctccactggcggcaagggcggcggcggtggcgggttcttcgactggtaccagtcgtactcggcgctccgccccctcctccgcgcctgcgtgcccacttcctcccgggtcctcatgctcggctgcggcaactcccttctgtcggaggacatggtaaaggatggttaccagaacatagtaaacatagacatctcatccgttgtaatcgagcagatgaaagagaagcacatggatatcccacagcttacatatatgcagttggatgtcagagatatgagcttctttggagatggatcatttgattgtatcatcgacaaaggaactttggatgctatgatgtgtggcgatgatgcccctcatggtgcttacaaaatgctagcagaagtggcaaggcttatgaggcctggtgggatttacatgttgataacatatggtgcccctaaggaacgcctgacacttctgaatcaagtccgatgccgttgggaagttgagctttacattatgccagccacacctgaataccagctgaaatggagcaacggtgctgcacacgccatgatggagaaaagttgcactgacagtggatggccaactgccacctgactacgttctcaaagggtccagagtcccatttcacttaggtttgttacaagtcacatttagtgaccgaagataagtccatggttgctg

SEQ ID NO: 16237 - DNA, 708 bp, Triticum aestivum
  unsure (1)..(708): unsure at all n locations
  Clone ID: PAT_TA_16237
aggccagaccaagagcgccgcgtccaccaccgccggcaccaccgcacgcgcttggggatcgatccctccccccgaactcgcgcctcgcgcccggtagttgtccccgcagcatctgcgctgaccggggccccgtcgatccggccgccgcgtggggtttggttgggtttgggctaggctgggttggtccctccccgagggatccatttttagtcggattcccgggtccctnccgcgggggctactagattcccgggggaggggatggatttggcgtcggtcaacgaggagctcgccgagatcgacgggcagatcgccgacatcttccgcgcattgcaaaatgggttccagaagctcgacaagatcaaggatgccaaccgccggagcaggcagctcgaagagctcactgacaagatgcgagattgcaaaaggcttatcaaagacttcgaacgagttgtcaaagatgaggcaggcagtgttgatcccaacactgctaaatttctgaacgagagaaagcagtcgctgatcaaggaattgaactcttgtgttgctctgaagaaacaacatgcaagtgaaaataagcgagttgatctttttgatgccccaagtggtgaagatgcctttggtgaagaaaatgtcctgttagcatcaaatatgtcaaaccagcagctaatgcagcatagttgggacnaatcctantgggtnagaact

SEQ ID NO: 16238 - DNA, 409 bp, Triticum aestivum
  Clone ID: PAT_TA_16238
cgtccgtcttccttccatccgccctctccctctcctcttcaattgggcgcaccagcggttcttgcgaagctgttcgaccgaggcgagatggaggacaagcggaaggccgtcgccaacaatgaagagcgaaggcagcgccagcggcgtgagcgtgaggcggaagccgtggaagacactgcgacttcagggcggacgccgactgcaggcggcaacgggacttcgcaggagcttccacgggtgacggcggcgactactcccgctctaggccccccacccggcgcctcttcccagttcgacaacgggcgtccgcagcacgcgcagatcggcaacgccggtgcgcctcaaggtcacggcagtactgtcattgatcagcagcgccttcgggaccagccttttttttcacgggcaa

SEQ ID NO: 16239 - DNA, 516 bp, Triticum aestivum
  unsure (1)..(516): unsure at all n locations
  Clone ID: PAT_TA_16239
cctatccgcgccgacaactactactaccattcagccagctagctgctgcctaccaccagcaatttcttccattcaaccaactggcagcattgaactctcctgcttatgtacaacaacaactactaccattcagccagctagctgctgtgagccctgctgccttcttgacacagcaacagttgttgccgttctacctgcacgctgcgcctaacgttggcaccctcttacaactgcaacaattgctgccattcaacccccttccttcggccagccccgcctaccgccggcaccctccctaccattggctggcagcccccgctcattcatccaatcttggctttgacaaacccaacaaagtttcttaccagcaacccatcattggtaggtgccctcttttagattgcttatgagttatagttcaataatgaagttttttggatgatgtttgtggcttcccaagaaataagaaagtacatttctaaaaaaaaaaaaaaannaagagttttcataaaaaaa

SEQ ID NO: 16240 - DNA, 670 bp, Triticum aestivum
  unsure (1)..(670): unsure at all n locations
  Clone ID: PAT_TA_16240
accggtccggaattcccgggtcgaccccgcgtccgcggacgcgtgggtttctgtttcggaggaaaggtccagaagcgccgctgccgccgccgccgcagcgacaccgctccctccggcatggcgccggcgtacctggcgaccatacccgcgctccggcgcgcggcgcggcgggccccggcggcgctgttctcgtcggggatcgtcgccggcgacaagcccgttctggtgcgcgatttcgtgaggtcggcgctctacgaccccaaccacggctacttctccaagcggtcggggcccgtcggcgtgctcgactccgccatccgcttccacaagctcgacgggaggaatgcgtacatgaagcatcttgataagctgtataagatgcatgatatctcttggtttactccagtggagctttttaagccatggtatgcctatgcaatagctgcgtcaatccttcgcacggctaatctttcagtcccattgaagatatatgaaatcggaggtggatccgggacatgtgcaaagtgcgtacttgattacatgatgttaaatgccccgccaaaagtctacaataatatgaaatacatctcagtagagattagctcctcccttgctgaaaagcagttggaaactgtccgtgaagtgcaanagccattttgtcaaagttcaa

SEQ ID NO: 16241 - DNA, 789 bp, Triticum aestivum
  Clone ID: PAT_TA_16241
attcggacgagggcgggctggtcaccagcgtcgcgcagctcgtcgacggcgacaaccccaacctccacctccgggaggacgacgtcgtcctctgcgtgctccccatgttccacgtctactcgctgcactccatcctgctctgcgggctgcgcgccggcgccgccctcgtcgtcatgaagcgcttcgacacggtcaagatgatggagctggtggagcgccacggcatcaccatcgcgccgctcctgccgcccatcgtcgtcgagatggccaagggcgacgccatggaccgccacgacctctcctccgtgcgcatggtcatctccggcgccgcgcccattggcaaggagctgcaggacatcatccacgccaagctccccaatgccgtgctcggacagggctatgggatgacagaggcaggtccggtgctgtcgatgtgcattgcgttcgccaaggagccgtcgccggtaaagtccggcgcctgcggcacggtcgtaaggaacgcggagctcaagatcgtcgacccggagaccgggctgtgcctcgggcgcaaccagcccggggagatctgcatcaggggaaggcagatcatgaaagggtacctcgacaacccggaggcgacggcggagaccgtggagaaggacgggtggcttcacaccggcgacgtccggttcgtggacgccgacgaccagatcttcatcgtggaccggctcaaggagctcatcaagtacaaggggttccaggtcgcgcccgcggagctcgaggccatgctcatcgcccaccccggcatcg

SEQ ID NO: 16242 - DNA, 413 bp, Triticum aestivum
  unsure (1)..(413): unsure at all n locations
  Clone ID: PAT_TA_16242
ctcgggcccggggcggcacgcggccggctccggctagccgtcatcagccctcgtccgccttggggctgtacccgcagcaacttggtggtgcaacccttcgtcgagcagcagtagcacaggccacccgagcagctcatcggcacggccttcgctcccgagcagcagcgctccggcgaccggcgagctgccccgtgcgtcgacggcgacaccaagcgtggcgaccaagctcacctcacgcatgcacatcaacagcgagtgcgctcacccaacgcacggcagcatcgaggccggcttgcgtcaatggtcatggcctcctcttccgtgagctgctctgcccgagcgtcnagcggccacaacattttcttctccagcgttcagcggtgacgacagcaactaagcagtaccgaggagtc

SEQ ID NO: 16243 - DNA, 2368 bp, Triticum aestivum
  Clone ID: PAT_TA_16243
tgacggatcccatggatccagggagcaggatatattggagaatggagttggattgggagagttgcagccaaaggaaaaatattggatcaaaagggattctgatttggctggcgtccgaaagagggagatttcatctagtgcaaagcatgacagacatacagcttctgaggagcagaagatgcatgtacctccatcttctgtatcaactgcaaatgcagctcctgcacttcaagcacctgtcgtgatagaggaacattgggtacaatgtgacatatgtcagaaatggcgtctcctaccatatgagtcggatcctgatactcttccaaaggaatggaaatgtagcatgcaactgtggctacctgggatgaataggtgcgatgttggtgaggaggagactacaaatgctctgaatgcactatatgtcattccaccccctgccaatggtattccttcagttggtcatcctcatgctgcttcttctggaccggcaacagccaacacgttcagtataaatggacatgctgaacagagtaggaaaaggaagagttttccaggtgatggaagtgctttggttgacagttctcacccaacacaagcttcagcttattcaacgatcacccaaccccctcctagagttagaagtactgctgatactaatcactatccttcccggccccgcgcccggagcaaatcccctgacgtttccactgaaaagaagaagtccaagagcaagaatcgtggcagctattctgatggaggagatcttgtggaaagatccaagaagcattcaaaaggaaaaggcaagagggagatggattatggtgaatacaaagcttctaagaaaattaaaaaggaggagcggcatcgttctagcagagaccggaaccctgaatgtgatttagctagtggagacgttcctgatgaggccaaggcttttcttgcaaaggcaaagagtttgggtgagaagggtgatatttcttcattgaagcaaaaaagtgttgcgaggtctgatcgtttggagaagtccaagagagacaaggatgaggatatagctcttcctgaagatagggacaaggaacaataccaaacctcagatgtacagagatcagacgtttctagcaagaagaggatagtgaaggaatgggaggagagtcagcatagttcaatagctcaggtgagcagaggaaccacagtgaatcacagctctgctgccaaggaaacccataaggatcaaaacttaaaggaaacaaagtccaagccgataaagtctgaagaactgtattccacgacggattctaaattaggaaaaggtctgcactctaatcagatttcttcttattatggtggtcatgtaaacaatgaacttgtggaggatagcacacactttgctggtaaaagaggtccatccgaagtattagataagcgatcttctgaacatgctttggacttagctggagccgcttctagtgatgttccgaccacagcaatagcttcaagttcttcaaaagcttcaggctctcagaaaaagaaaaataactcccaagttgcaaagacttcaccgattgaatcagtttcctcatcaccaccgaggaactctaacattgataagttctcccagaacagaatagtggagaaagatgggcctatgaatgctaacccaggcaccatgccgagctcagtaaagtatctaaatactccacgcgtccgagtagacaatgttcggcaggctaagaagtccaaggagagcttgcttgcaagtgaacctgtcttacatggctcttcacaaggaaattctgacaaagatgatgaattagttcagtcaactcaaggccatgcatccgaaaggttttcattgagaaagggtttggatgatgatcagcagcatgcatctgggagaaaggactccactgtgaatggctccagcacagcgaggggttataaccacctgcattctggtgataaaaataacttgcgcactgatggctctttagtgcaacctaggactgcagcttcgggctcgaaaggagatttgattgcgagtgaaagtaagaaaactgcagctcctatccaagatagaaatggattaactcattgtgctctggatggaaatcctaaaccagaggtgccatctggaaaagataaatcttatcccaagagtaacaagcaagatatggagaagcccaaagcccaaatcgccccttcacctctgaaagaaacccactccactccagtaaaatctaatgcgtcaaaattgacaccacagtcaaggcgaagcagtgatgaaaatggagggcaacagcgtgttgccaaacagggaacgtcgaatcctacggatgggaaagatgggaattcaactgcatatgctctc

SEQ ID NO: 16244 - DNA, 696 bp, Triticum aestivum
  unsure (1)..(696): unsure at all n locations
  Clone ID: PAT_TA_16244
gcacgaggattcattccgttccgttcgcccaaccgatagaaaagtctcgtcatcttcacaggacccaagccaagcaatcccctctcctcttctcttcctcctccgactctcacctcgccgatcgcgtccaccgagcacgcgtagcgggcgcagaggctgcgggcctcgacgctcttcctcgcgccgctcgacccctgccccctgctccctcgctcccccgaggacccgaggccctcctgcgctcccgcctcgcaggcccccgcccggctgcccgccctcacggcggccgggcagccgccgccggcgcccagggacgccccgggcccggctgagtccgacctgccgcacgcgcacggtccggcagcaggacgcggggggcgggcaaccgaccaggggcggcgggccggtgttggtcatgctgccgcttgtcgcgatggggccgcgcggccaagtgtcgcccccgcggccgctggcggtgagtctgatggcgccgcggagcgccggctgggaggggggcgtggtggacgtgtggtggggcttggtggaaagggatggacccggacggtgcctcgagggtacccaacgctccactggggaccgccggcgcgcccaaatggagtctcagaaggggggactcgggtcccgatagacctnctggaattgtatccaaagttccaanttagnaattggtaaagn

SEQ ID NO: 16245 - DNA, 1010 bp, Triticum aestivum
  unsure (1)..(1010): unsure at all n locations
  Clone ID: PAT_TA_16245
cccatccccatccccatctccgtctccgtccctccacagcagcagcgtcgccacaggggatacacgaggcaccgcccccgcgcacgatatctgcttcgccgtcagggggatccgcgcgcctttgccggtctcttcctttctcccgcgccaccgtaaactaatcccgtttcgcggctgctgctgggtaggcggcggaatccaatccgaagagcatcgtgttcngggaacgggagtattggattccttcccgctgcccccccccccttcgtgatcttggtatcttccttggttgggcgtgttggtttggaggagaggggggctcttggggcagaggtggatgcgtggtacggacatcgccaaaatgcaagtttcaggatcgaaggtattgccacttgcggtgcagttcttccaaagcagatgatgtgcagttcagtcacagactcacagagacttcagatctgttaaaaaccttcagaatccacaagagttctcattcatctcagttcctggatagccgctgatctgcactcgccaaagaatagatggatagccagttcggtgcactggaaagaggaggtagcaggcagaggaggagccctgtgttagccagaccaaatactacaaagaggcacatacagcagcagagggcaaatgctgctgacaagaaggttgtcatgccgaactacttcagcatcgaagcgttctttgtgctcgcctgccttaccgtatcattgctcatactgccattggtgctgcctccattgcccccaccaccgtcactgctgctgttcgtgccggtctgcttgctcatcctgttgatggtgttggccttcatgccgacggatatgcggagcatggccacctcttacttgtaaataggcttgttgcgtgttttttgtttctgattgtgtgttggcataagatgagtgcaatattatgaagcatctttatatcggaatattatgttttgaatggtttagttcagtagctttaaaaaaaaaaaaaaaaaa

SEQ ID NO: 16246 - DNA, 759 bp, Triticum aestivum
  Clone ID: PAT_TA_16246
ggcacgaggtccacctcgccgccggagacaaccaccaaacccacgcatcccctcccctcctccttccacagcgagcgcggcgccgatggccacggcacactgttacccgccgccgccgcccatcgcccacgcgcttccaaggccgcacgccgccgacagcgccgtcgccctcctccccgacgacggcggcagcgacagcgagggccggccggggtccgcgggcccgcgcccgcgccggccgccgccgcgccggcgcgggggcgggcgggtgctgggccggcgccgccccgccgccgcggcggccgccgggtgccggcggcgcggccagcagcgccggcgtccccaggcggccggcggcgcggcggggggcggcccgccgggcctcggcgggctgccgcgccgcccggcgcccgcggctgccagggcccgccgcgcgttcccctcggcggtgggccgtgagcgccgcgagccgaagccgcagccccccccgcgcgcggccccgccgctggtggtgggccgcaagttctgggcggactgcctcgccacagggtacccatgaacggaccccgggggaagccatagctcggcatgcaaagcccatggcaaaaagccatgagcgccgctaaccgaaactgcagcccgacccaagcgtatgtctacctttttttttgtttcttttctttgtacagaatattcaactcctcaacaagtcattgggtggcgtattttgacccccgcaagctttacaaaaaaaaaaaa

SEQ ID NO: 16247 - DNA, 1025 bp, Triticum aestivum
  unsure (1)..(1025): unsure at all n locations
  Clone ID: PAT_TA_16247
gacaggtggggtactctctcatgatcgcgcccgtgtacacggccgaggtgtcccccgcgtctgcccgtggctttctcacctccttcccggaggtgttcatcaacttcggcatcctcctcggatatgtctccaacttcgccttcgcccgcctctccctccgcctcggctggcgcatcatgctcggcataggcgcggtgccgtccgtcctgctcgccttcatggtgctcggcatgcccgagtctccccggtggctcgtcatgaagggccgtctcgcggacgccaaggttgttcttgccaagacttccgacacgccggaggaggccgccgagcgcctcgccgacatcaagactgccgccggcatccctctggacctcgacggcgacgtggtcgccgtgcccaaaaacaaaggaagcagcgaggagaagcgcgtgtggaaggacctcatcctgtccccgaccaaagccatgcgccacatcctcatcgcgggaatcggcatccacttcttccagcagtcttcgggcatcgacgccgtcgtgctctacagcccgcgagttttcaagagcgccggcatcacgggcgacaaccgtctcctcggcaccaccgtggcggtcggggccaccaagacggtcttcatcctggtggccaccttcctcctcgaccgaatcggccggcggccgctgctgctgagcagcacgggaggcatgatcgtctccctagtgggcctcgcgacggggctcaccgtcatcagccgccacccggacgagaagatcacctgggccatcgtcctgtgcatcttctgcatcatggcctacgtggccttcttctccatcggcctcggccccatcacgggggtgtccggctcggccccgttcccgctgcacgtgcgcgcgctgggctgctccctgggcgtgggccgtcaaaccgcctnaacaaggggngtgatctccatgaccttcatttcgctntcaaaggncatgnacaatcggggggtgccttcttcctcntcggccgggaatcgctncttt

SEQ ID NO: 16248 - DNA, 676 bp, Triticum aestivum
  unsure (1)..(676): unsure at all n locations
  Clone ID: PAT_TA_16248
gggacaccgagacagcccgggagatggcgaaagaggtccgccttccaccacccaccggcggcatcgtcgaagagcgcatccctgctcccgccgtcgtcgggcgccgtctccgtgctcaccgacagcaaccccccccccggtggccccagacacgcgccgcggccatggccgcgaagatgtgcctgctccccctggacgcaggacttcgtcacgttgcccatccgtcgtccccgtcgtcgtggtggggcttagactcgccgccgtgcagccaccgccccgccgccgcgccgtcacttgcttctatcgcctggacccctccgccgaaagagtcgacctgtgtgctcggcactaccggtccttagccttttgcagctgtcaggtttctctttgttttcgttggtataaagtttgcagttgcacgatagcgtgagctacatcataattttaatcgttctggccgtgcttgtcagtgttgtagtgtcgtaatttctttttagaagaaactaagtcaagtcctgtgtaaccaccgtaccatggattgtcaccggttgtgttaaccacagatttggagttgttggtggttttgacgatgtctgtcgtactgctatcctgttttgagatttgaaatgtgtatcaggcgacgttcctcactttcccccaagnaatgacnccgtng

SEQ ID NO: 16249 - DNA, 1051 bp, Triticum aestivum
  Clone ID: PAT_TA_16249
cgtccgcggacgcgtggtcgcgacgccgccgccgccgtcaaccccccgctagcacgccgtcgcctccttccctccccgagctcctccagcctcctccctgcccccctgcaacgctaccgccacctgccccgtcctccgtcgccgcctcccctcccctcccctccccttccctcagccgccggccaccactccgcgcctctccctacccccagccgccacggcgcgccgccccggccgggcggttcctgccccgattggaggccgtgagcagggggagacatgatttacacggcgatcgacacgttctacctcacggacgagcagctgcgcgactcgccgtcccggaaggatgggatcgacgaggccgccgagacgaccctccgcgtctacggctgcgacctcatccaggagagcggcatcctcctcaggctacctcaagcagtgatggccacagcacaagtactgttccatcggttttactgcaagaaatcatttgcacgatttagcgctaagagagttgctgctagttgtgtttggttggctgggaagttggaggagagtccaagaagatcaaagcatatcatatttgtcttccatagaatggaatgcaggagagaaaacctaccaatagaattcttggatgtgttttcaacgaaatatacagagctgaggcatgatctgataaggactgaacgacatctgctgaaggagatggggtttatttgccacgttgaacacccgcacaagttcatctcgaactaccttgcaacactcgaagcccctgagctgacacaagaagcgtggaaccttgccaatgatagcttgcggacaactctttgtgtacggtttaagagtgaagtagtagcatgcggagttgtgtatgctgcagctaggaggcaccgggttcccctcccagaagagcctccttggtggacagtctttgatgccgatgaggcagcaattcaggaagtttgcagggttcttgctcacctctacagcctcccaaaggcacaatatataccagtgtataaagataatgattccttcagtg

SEQ ID NO: 16250 - DNA, 1048 bp, Triticum aestivum
  unsure (1)..(1048): unsure at all n locations
  Clone ID: PAT_TA_16250
tcgcggccgcgtcgaccgaggagctcggtgtcgcccggcgcgcggccgacgccgtggccctgcggatctgcaacgaggtgcttttcccgacgcggtcgccgccggagtggtgggcgtcggagctcgcagctctctcgccagtgtcgttccacagggtctttacggcgctgcgctgccgacgcgccggtcctgaggtgctcgtcgccgcggccaccgcctacgcggaactcctactggccgacggcaaagcttccgaccaccgcgccctcctcgagtctgttgtcgccgtgctcccttcagcggacgacgcgccccttcccgcagcgttcctctgccgcctcctgcacgacgccgtcaccaccgaggcctcggccaagacgtgccgcgacctggagctccgcctcgcggccgtgctcgaccaggccaccgcgggcgacctgctcgccttcgcgttcgatggcgctggtgagcgcgtcattcacaccgaatcgctccggcgtgtcatcgccgcgtttgtggagcgcgagtccggcgccgggcggaacaggagggcgtcgctgtccggagcggcggcgctgggcgcaggggcgctgcagaaggtggccaagatggtggacgaagtggcggcggagatcgcgacggacgagtccctaccgatctccaagttcgtgggcgtcgccggcgctgtgcccaaggacgcccgcgccacccacgactgcctctaccgcgccgtggacatctacctcaaggcgcatccggagctggacgagatcgagcgggagaaggtgtgcagcgtcatggacaccctgaagctctcctacacggcgcgcctccacgcctccagaacaagcgcctgccgctcaagccgtgctcaacgcactctactacaacaactcaagctccgcancgccggcgtcggcacgacattaggataacattcgcgtcggangccggtcgccccatgcagcaaagnngacgcgcgcttgcncgganaacaagnatgcgtcggactgccgatcggcgaattctcggntgaanaacaaggaag

SEQ ID NO: 16251 - DNA, 522 bp, Triticum aestivum
  Clone ID: PAT_TA_16251
cgcctccatctcctccgatcctatgctgcgcacggcgagtttgcgtcggcgccccacctgctcgacgaaacaccccgcccggccccgccgctcctctacaacactggcatgcgcgctcactcccgccgcctagacgtccccgccgcgctctcgttcttcgcgggcatgcgacgctccgccaccctgcccgacgcccacaccttcgcttgcgtcctccgcgcatgcgccggctgttctcggccgggcgccgccaagatcctccatggtattgcgtcatcttccggctgttcctcccatccaatcgtcaggagtgcgctcgttagcgcatattcaaagttcttgcttgtggacagtgctcgccatgtgtttgatggtttgcgtgagcccgatttggttctctggaactcaatgatgtccgggtatgggtacaggcaaatgtcgcttgaggggcttcaactgttttctgcaatgctcaggactggggaggagccagatgactactccatggtcagcttggtctcg

SEQ ID NO: 16252 - DNA, 460 bp, Triticum aestivum
  unsure (1)..(460): unsure at all n locations
  Clone ID: PAT_TA_16252
cgcgaaaccccccggttccaggttccggtgccgattccgattcccccggcagccatggcgtcccacatcatcctgccgccggacggcgacgacgacgagcagcagcggagggaggacgaggagaacgacggcggcggcagcgggagcgggggcgacggggagcagcagcagcagggcgggggcaacgccaaggcggcggtgcccttctccgccatggtgcgtgcggatctcccgcgactcctaccccaacctccgcgccctccgcaacgcctcccacgccagcctcaccggacgccgcatacgtcgagatctccgagggcgacttcggatacgtcctcgacgacgtgccccacctcgccgactacatcccccgacgtccccacttacccngaacccattacaagacacccanncaataattcaactggtcaangcaaatatttttgtccgatnaaagatt

SEQ ID NO: 16253 - DNA, 553 bp, Triticum aestivum
  Clone ID: PAT_TA_16253
ctcccaattcactggccatcgccaggacgacgggatctggccgatgggattcggctgaccggtacgaccggcatgggcgtcgatcttcctccgccagctcccagtcacaggcgccgccaccatcgaccagatcttcaccacggcccctcgcacgacctcgtcggcgacgcgtcctccagggcaaagctatggaggagtccctgtgccatgccacggagctggcgcaggccgtcgccaatgccctcttctcgctgccggcgacggccccgtcgtccgcctcccgccgcccaccaatcgcctaccccacgagaagcatatatcaacgagaagacgttgttggtactctgtccggaggagcgcgccattgcaccatcgacaggaagaggctaggtggagcgcagagtcaccaccggctgtgccctgggcgatctgctgagttaaacctgttgtagtctgatgtccatgcttttttgcacgcgcggcaccgccgtccggacgccgatccccggttgccttcttcacactcctcctcctgctccagttcgcgcccagc

SEQ ID NO: 16254 - DNA, 645 bp, Triticum aestivum
  unsure (1)..(645): unsure at all n locations
  Clone ID: PAT_TA_16254
catgcactaatcaatcgagcaatggaaatcacgagcagcatgatggtgaagccggtgccgcacccgctcgtcggcgagaaggtggcactgaccatcttcgaccgcgctgcggcggacgtcttcgtcccccccgcgtttccccttcctttgcgccggccccgtcgaacgagggcgctcaaggaaggccttctcaaggccgtcgcgccgtacccccacctggcggggcgcctcacggtcgaccagctcggccggcgcttcctccacgtcaacaatgagggcgtgatcctgattgagaccacggtacaagctaacctggcggacgtgctcgtcgaaggccggatgctcaccagagtcgaccacctctaccctacaataccacaacgagaggagaagattggagcggcgctnctgcagatccagctgaacaggtacaagtgcggtggtctcgtggtccggatatgctcccaccaccataccgccnacggtcactccatgagcatgttcttcaccgcgtgggcgacagcggtccgagagggtgaggacttcaccatgccaaccccattcctcgaccgcgcgaaaaccgtcgtgccgaggagcacgccgacgcctgtgttcgaccaccggtcactggagttcacgcatggg

SEQ ID NO: 16255 - DNA, 613 bp, Triticum aestivum
  Clone ID: PAT_TA_16255
ctttagccagccaccagccccgatctccctcgatctcctctcctctttttaccctgtcactcattccctcccagccggcagggccggccttgatcctgccacatatggggacgggctagcaaagcggaactgcggacaccgagaggctttccatatcttcatccatccatcatcattaagtacgtggtggtggggcgcgggagtgccgtgtcggccggccatgacatggtgcaatagcttcaacgacgtgcgcgccgtggagaacaacctggcctccgccgcggccgtcgcggcggcggccgccaagaagcagcagcaccaccagcagcaggcctcctcccacgtcagcctcgttaggacgtgccccgcctgcggccaccacgcgcagtatgaacagttgcaggcggcgtcgacgatacaggatctgcctgggctgccggccggcgtcaagttcgaccccacggaccaggagctgctggagcacctggaggggaaggccaggccggacacgcgcaagctccacccgctcatcgacgagttcataccggcgattgagggagagaacggcatttgctacacccatccggagaggcttccaggagttggcaaggac

SEQ ID NO: 16256 - DNA, 1205 bp, Triticum aestivum
  Clone ID: PAT_TA_16256
aatggggaggttgtaaccccagtttcttcgcaatggagactttaccttgatgacagcgtcggcaaggaggtaaatttgcagattgaaagaggtggagtgcctttgacagtaaagttagaggttgaggatttgcactctataactccaaatcatttcttggaagtcagtggtgctgtcatccatccactttcataccagcaggctagaaacttccgcttcaaatgtggtcttgtatatgttgccgaggcagggtacatgctctctcgggcatcggttccacgccattcaattatcaaaaagtttgcgggagaggatattgaaaatttagatgaccttattgcagttatttcaaagctgtctaggggagcacgagtgcctctcgaatatgtaaagtacactgaccgttatcggaacaagtctgtactggtgacaattgatcaacacggttggtatgcgcctcctcagttgtacactcgaaatgacgcaactggtctgtggaatgcaaagttggctataccgcttgaatctccctttgtagtttctcatcgtgccggccatatggatgcaaacttaaattccatttcacctttgactgaatcaagtcctatggatctcaaatgccagcacgagtctgaaaatacggcagatggatgcataaaaatgcaaacagatgaggagattgccgtagatggatcccactctggcgaagattccatcattgagaaaaaaaggcgccgggtggatgaggagatagctgctgagggaactatatcatcttttggagatttagatgacataaaagatggcgcgtccgggcatccttccagtgtggaaggctctgaccttgctcggacaatatcaagtaatgcttcattggcagaacaagtaattgagccagctcttgtaatgtttgaggtgcatgtgccaccaatatgcatgcttgatggagtgcattctcaacatttctttggaaccggtgtgataatatatcattctgactgcctaggtctggttgccgttgataggaatacagttgctgtatctatctctgatataatgctctcttttgctgcatatcccattgaaatacctgcagaggttgtttttctgcatcctgttcataattttgcattggttgcctatgatccttctgcactgggagctggtgcatctgttattcgagctgctaagcttcttcctgaacc

SEQ ID NO: 16257 - DNA, 914 bp, Triticum aestivum
  unsure (1)..(914): unsure at all n locations
  Clone ID: PAT_TA_16257
gttctccctcctccctatccgaccgncaccgccatggcctccgcccctgccctgtatcacaccctgcttcactttctcaacccgatccattctcaccacctatcctctccccccacacgccaccgccaccgcggccccgccctctcctccgccgccgcgcgcctccccaaccccaacgccgccgccccctctcgtttcggcccggtgaggacagccagcgcgagccaactagcgttcgagacagaggatggggaggagacgcctctagcgttcgatacagaggaggaagaggaggcgcctcgttggcccgctacgcaaggcgcagtctgacgacgagggatgacgagcaggagtgggccgggggcaatggcacggcggcgcacggggaggaggagcattacggcggagatccggcggccgaggatgggagcgggtggacgcggcggccgcccgcggccgcgcgagctgttcgtgtgcaacctgccccgcaggtgcggcgtcgacgaactgctcgagctcttcgggccatacggcaccgtcctctccgtcgaggtttctcgtgatgccgagaccgggattagtcgaggatgtggctttgttacgatgcgttctctcgcagaagctagaacagctatcagtgctctcgatggatttgacctggatgggcgtgagatgtttgtaaaactagcggctcacgtcgttgctagtaggagaaatcccagcctgtcccatacgccacccatgaaggaccatatctttgaaagtcgatacaagatctatgttggcaaccttgcatggtctgttcaacctcaacacttgagggagcactttactcagtgtggaactgttgttagtacaaggctgctgacagatcgcaaagggagggagaagtcgtgtctatggattcctttcgt

SEQ ID NO: 16258 - DNA, 603 bp, Triticum aestivum
  unsure (1)..(603): unsure at all n locations
  Clone ID: PAT_TA_16258
tgcaagcagccaggaaggagtaggaccagcagctagcaggcacagggccgttgattctatggtgcagaggataaggcgcgcagacatgtggttgtttatcccgaccttatcaggacgctngtgatgcgccggggctaatcgccgctgtggaacggcagccaccccttccacatcttgttgttgctcagcaagggcccaagggttatataagccgctgctgacccaacgcagcagtcctcaagccagagtgcctcctcctagcaagctatatacctacatagcacagccatggcccccaccgtgatggcctcgtcggccacctccgtcgctcctttccaggggctcaagtccaccgccggcctccccgtcagccgccgctccaaagggcgctagctccggaacgtcaanaacngttgaaggttcaaggtcatcaagtgttggccaatcgaagggcatcaagaanttcgagacctgtcctaactgcaacgnttaacaacggaggctcctcaagcaagtcgactaactnattcgctcccaaanggggncttgcncccagttnaaaaagggttggttnaacttccggtngnnaaagcaaccccnggt

SEQ ID NO: 16259 - DNA, 1669 bp, Triticum aestivum
  unsure (1)..(1669): unsure at all n locations
  Clone ID: PAT_TA_16259
cacaatcttattttgtgtatttgctttgcatcaagagttgcccngtatattccgtcggctcggctttatanccacccgcgtgaagtctcttcgtacattcagtttaccaaaaaagatacatcatggtggcgtgtcctgatcgctctgtgatcggtgccctcccgtttagtgccctgttgtgcctcatcttgctctgtgtggaccgggtctctctttttcttttttgttctcattcttcatacaacccgtttgcaccacatgcattcataacaatcaatgatttggctacaaactgccatcagctgactcactaccaccaccactacaaatgtacaaccaaataccatctcaagccacagtttccacacatgataaggcacaaatgcattcttattgccaacaacaactgtaacctagcactctagctgcagcacgtcagggcttggccaggagctcgcgcaccgtctgtgcaagcccgggctcactcctgatgccctcggcccatctcgcgctgatccgcacggtttcaaggctctgcttcagcgtcctctcgaatccaggctttgtgcgcgttgcaaagaacttggagatctctgcggccttctcgttggaggtgaacaatggaacaatgtttttaacaaaattcgccgccaagctcccggaaaatgtccttgagatgcgctcccagttttccttcaaccagttccacgaaatttcacgtgcctctgattgaatacctctaaggagaacatatgcatcttgattgcgaacctcattagtgaaaattaaattcagtgattcaagggcgatacccttatcccggcaagaagataatatgcctaagacttgtgatctttcctccccttcagctgactccttgtagatttttcggagagcatcataaccggatctgtttgaactactaacattctgcatcacagcgaggcatgcggcctttctagtatccggaggaagaagagaagtgccgcgatcacgtgtgaagatgttaaagcgcctaactccttcattgatggtcttaccatatccaagttggacaagtgcagtcaacagcagtggtctaagcattacatccaggtggctctcacccttcttggggtcccagcctaacttttctgcaggtgacaaaagaatcttgatcaaaagttgcttgatgtcaccagccaaggcaggaatagcatcggcagatactttagcaatacttgcggttacagtgtttatgtgtgaaagaacactataatcagcttcgtccggataaccgtagagtaaatgtagcaacgacgcaaatgtttgttggcgggcaatagaaagcgcatataagtcatccaggatgccaattttatccattagtgagagcttcttggtctccaacgcattttgaagtgcagctgcaagctcatcgtcatatttaactctgtaaaatccggttccatttatattcaacttagtccaaaagtttccgcccttctttcggtcaccacattgtgaaccaatgaccagcttatcatgtttaagtttcaacaacaactttttctctgtatcatatgcaccacagcctgaagttatagggacaatccacatgccagagccagaggacccatctaacaaaaactgggcctgcaacaaacagaaatcatcaagttcgtggaga

SEQ ID NO: 16260 - DNA, 683 bp, Triticum aestivum
  Clone ID: PAT_TA_16260
ggagctcaagggcgagtacatgtcgcccagtgacctcagcggccacggcacgcacgtcgcctcgacgatcgccggcggacaggtttcgaacgtgagctacggagggcttgccgccggggtggcacgcggcggggcgccacgcgccagactggcaatctacaaggtgttgtggggggcacgtggatcgggcagccacgcgggggtccttgcggccctcgaccacgccatagacgacggcgtggacgtcctgtcactctcgctgggacaggcaggcagcgagctctttgagacgctgcacgccgtccaagagagggatctccgtcgtgttctctgccgggaacggcggacctgtgccgcaaacggcgtggaatgctgtgccttgggtcaccacggtggctgctagcaccatagaccggtctttccctactatgatatcgctcgggagtaaaccaaagttaatggggcaatctcttcagaacaatgcatctattaacatcagtgactttcagacccttgtttacgcgaggagctgtagcatgcagtcgcttgcgtcaagcaacatcaccggtaaaattgttctgtgctatgcaccggcagaggcggccattacaccagctcggctagcacttcctattgtcataaattgtacaatgcaggccggcgcgaagggccttatctttgca

SEQ ID NO: 16261 - DNA, 526 bp, Triticum aestivum
  unsure (1)..(526): unsure at all n locations
  Clone ID: PAT_TA_16261
ctctctcgccagtcaggggcagcgacgacgacgaggagcggcgcctttggcggtgtcccggcgacggtcctaccgccgtcctcctgctccgagcgtgacttcacgtcccctgccgaggtcacggccagcctccgggcggcgccaggccaggcgtgggtgcgccgccgccggatctgacctcgctagggtagggaaggcattccaaggcacaaggttcgctcgctggtggaggtacgccggctcgccgtggccgtggagcgcgtcctcacgtgtctgtcgcggcgggtggcggagggcgttcggggagcggaccgcagatgagatcaaagagctccccttgccgtcctttgatttgagtaggttatcccggggagttagattccacggctgatttttggtaataaaagagccctttcccgcgccggcctttcagatggttgcttcccgcttcccctcaggcccccgnnccctttgtgncnccccggattctnccccccctaatatcccanaaatggggngagcaaaa

SEQ ID NO: 16262 - DNA, 841 bp, Triticum aestivum
  Clone ID: PAT_TA_16262
atatgttatgctacatgatttctaacatgtgacatacgtattttgtttaaaagaaattacattcttcagtttgacgaggtgaaacagcagcgacgagcacaatagtaaatatattgcacatccagagcacaacagcagaagcagtgcatctctaagttaatcatactaagcagcaagcttgctaactaaaaacacaatcatcactatcagaactacactaaaaagcatccgcttctgatgaccattgtttttcacattcagcgggccttcagtttgccccaacttctcttcaagagcctgattctgttccttcatcttgcgcaatgcatcccgcaaagcattattctgggtgcttcggtcctcaatccccatttccaggtctgcatttactcctctgagctgagtgttctccctccggaggttgttcaccgcgtcacgcagatcgaccaaaagttggcgaagaaagggcgtagtagggtcatcaatccatcgccaccacctgcaacctccgacccgagatctctggcaggtcagatacctacgaccaggatttccgttgctccaggagatccatctcgccgctttcttgtggcacgggcaatcttcagatggctcgtatgctagcggctgctcacgataaggaattggggaagggttcagagaatagccaggaggtccaccatgggaggacgagcgtgctccagatgacgaggaagaggattccatttgggagaccacaagcagcgaagacgcacgccacggataaggttaggtttggtgaggaggaggaggggattttgtggctcctcgctcccgaccggccggcctgagcggccgcaca

SEQ ID NO: 16263 - DNA, 514 bp, Triticum aestivum
  Clone ID: PAT_TA_16263
taagattgagctgagatttccgcacaccgggtgcaagggcatgagaggcgagagcattcctttcagcgggaagccggcaacgcatctcccccgctctatctcctctttctctcaccagaggcgcgtgatgaatcgaggagaattcctgagctccctggtgcaacagatgatctggagcggcactggggatggtggtaccagtagtatcatgagtagcttgaagccgtgccacgaggaacaagaggcgtctcccaagctgccctccttgtcttctccctccatgcttttctcccagcagtttcctcacagcccatcaggcctgggtcacatcaacggcggcacctctcttctaagcttgcatgacggcagcaccggcacccaggagagccacatgccagagtcatggagccagatcatactcagtgggggattggttggaggtcaagagagagggggatacagcgccaccacggctctcctgtcaaagggactagagaattggggggatcatcag

SEQ ID NO: 16264 - DNA, 1158 bp, Triticum aestivum
  unsure (1)..(1158): unsure at all n locations
  Clone ID: PAT_TA_16264
ctgcacgagggagaaagagtgacaaggagtggaggagcatagcttgaggggaagacacgagagagattgaaatggagaggagatcagtagtgttttgattctgaaggaggtgatgatcatgagaggcaagggacggtgtggaccgccccggcccacgtccgcgccgccctcgccggcgccagcgtcgacgcgccccgtgacaaggccttcaacgtcctcctggccctcggcaacatcgccttctcctacaccttcgccgacgtgctcatcgagatccaggacactctcaaatctcctcccgcggagaacaagaccatgaagcgcgcgtcgctctacggcctcagcatgaccaccgtcttctacctcctcctgggctgcaccggctacgccgccttcggcaacgatgcccccgggaacatcctcacgggtctggccttctacgagccctactggctcgtcgacgtcgccaacgtgtgcgtcatcgtgcacctcgcgggcgcctatcaggtgttcgcgcagcccatcttcgcgaggctggagagctacgtagcgtgccggtggccggacgccaagatcatcaacgccacgtactatgcgcgcgtgccgggccggccgtcttcgtcagtgccggtggcgccgctcaagctggtgttgcgcaccgtcatcatcatgttcaccacgctggtggcgatgctgctgccatttttcaacgccgtgctggggctcatcggcgcgctaggcttctggccgctgtccgtctacttccctgtcagcatgcacatcgcgagactcaagatcaggcgcggcgaggggcggtggtactggctgcaggccatgagcttcgtctgcctcctcatctccctcgccgcaagcatcgggtccgtgcaggacatcgtgcacaacctcaagaccgccacccccttctagaatatcgactgattattaacgagtactccatatttgtagtcgacggattattaactcgactgatctgagggacccatgcaaaggtggcctcacttctcctttttggcgttaatttgattgatcgatcgatccatccatcaaagtccatccttttttcctggctgttgattccaactttgcaaataatactaacgtagcttccaattgtcccaaaaacnanaangaaaaana

SEQ ID NO: 16265 - DNA, 2201 bp, Triticum aestivum
  Clone ID: PAT_TA_16265
gggggagccgcacaccgtccgggcacttggtcgcacagcagtcggcacgatctatggaactctgtcgcacgtgcgccctcgtggacacacaatctgatccggcaaggtcccgcgctggcggccatgtataacatgatttcgatcgtcaacaagctgcggcacgtcaacagtgcgattggcgacaacagcggggaaagcgccctccccgcactctgagactcgaagccgtccatatccgtggccggcggcataacttcggaccaatcttatcggcgccacagagaagctggtaaggattgtctccgcagtcctgcaggcactgctgctcacagcgtacatggaatcctaaaggaactagtcgacaaggctataaattaagctcatgagctcaagcagttccccactcttcgtgtggaagttggcaatgcagcttttgagtcgttggaaagaatgagggatgaaagcaagaagaacacattaaagctggttgatatggaaacaagctacttaactgtagatttcttcaggaagcttcctcaggatgttagagaagggtggcaaacccaagccactctattttcgatagatataatgattcttatctaagacgaattgggaacaactgttcttggcatatgttaacatggtatcttcaacattggaggaactccatcccaaaatctattgtgtactgccaagtccgtaagaaggcaaatcgctcattcgctcgaccacttctttactgagctgggcagcaagagagattaggcaactttcgaagctcactcgatcgagttaccctggggtgatgtggagcgaacgataacccccaccaagaggctggagcgggaccagagctcccaagcagagatcgacgcggttgcatggtcaaaatacttttttgtcgaattatcgtgccccagtgtgtgttctcctttactccttgtatggtgacatcgatatcctctctgccctgtttttgaggtgcatgtatccctgatcctttgtctcctttatcggtcatattatgctcttgctggatgctgaacgttctcagctttgtcatctgtttaattatgatgtttgttccatgcggtacacgatcttgcaaacttgccgcatgtttgctgccatctcttgtcagtaacctggaatggagtgcgccctggtggtgagaaaatttaccatgtctttgacaatcaatttcctgtggcaattaaacggttgcagtttgataagcaactgtcaatggaaaatgtgaggaagctcataacggaagctgatggataccagcctcacttgatagctccagagcaaggatatcggcgcctcatagaatcttgtcttgttagtatcagaggtcctgccgaggcagctgttgacacggtccatggaatcctaaaggaactagtccacaaggctataaatgaaactcatgagctcaagcagttccccactcttcgtgtggaagttggcaatgcagcttttgagtcgttggaaagaatgagggacgaaagcaagaagaacacattaaagctagttgatatggaaacaagctacttaactgtagattttttcaggaagcttcctcaggatgttgagaagggtggaaatccaagccactctatttttgatagatataatgattcttatctaagacgaattgggacaactgttctggcatatgttaacatggtatcttcaacattgaggaactccatcccaaaatctattgtgtactgccaagtccgtgaggcaaagcgctcattgctcgaccacttctttactgagctgggagcaagagagattaggcaactttcgaagctccttgacgaggaccccgcggtcatggagcggaggacaaacctcgccaagaggctggagctataccggagcgcccaagcagagatcgacgcagttgcatggtcaaaataattttttgtcgacttatcgttccgtagtgtgtgttcacctttactccttgtttggtgacatgtctccccttattctgagggtcatatatagctgattctttcttcccgttctaggtcatattatattcttattagatgacagcagctgtgaggtgtgtcatgtgtttgtgcttttgctccttgtgcttgaggatctctctctaggggggacacctttctgctgtaccttgtctgtatcacgtacgagttcatgttattatgatttcc

SEQ ID NO: 16266 - DNA, 1313 bp, Triticum aestivum
  unsure (1)..(1313): unsure at all n locations
  Clone ID: PAT_TA_16266
gcgcgcgcgacacggcccgccgccggcggaatcgaacgcggcggcgccccctctacgccctcctgaggccctgagccagtcggcgcgtgccccaccgagcttcgccgccccgcgccgcgacgccgaccactgaatcactgatgacctgatcagaccagatcaggggggaaaggtaaaattttaggggccctagatactcctgactgctagtaaggcctcagtcttgatgacgatgcccggattctgcccgtcaatggcggctccatctgccggccaccctcccatctgcctcgcccgacgcttcaggggcagcgggatcccaagacgtgctgcggccaccgcctggttgctcttcggcgaactccatcagccgaagcaggtccttccgccccggcgggcttggggcgaagcggcccttctgccaacaaagtctatcccggctacaactcaatatgggctctgttcctgatccagcgcatctttcccctggttggcttgccacccgttgcgacgactatattctttggcgctaatgatgcagcgcttctaaggacgaacaagccagcggcaacatgttccggttcaggagtataaacagaatctcaaaacaattgttaatcacctgaaggattgttccaagtccatggtaattttgcttatcactccacctcctatcgatgaagacggaagagaaagatatgcacgatcacagtatggagaagatgcgaggaggctccctgaaagaacaaatgaaatggctggcgtctatgcaggtcaatgcatagaacttgccaaagaaatggatgtacagtgtgttgatctttggtcaaagatgcaagccactgaaggttggcagaaactttacttaagtgatggactgcatctgacgccggaaggaaacgctctggtccacaaggaggtcgtccagaccttgagaggcgctggtctgaaagctgaagatatgccacatgacttcccccatcattccaaaatcgatggggtttacccggaaagggccttccagtgaagtggtttcaggcagtgtgatgttcaagttctgaaccgcttgcttcctcgttctttttgcttttccttgtgttttaatttttttttcttttggtgtgaaacttctgaactgtgaaatttcacgtccatttttcagcccattgaaatagttgggtgtgccatagaaaaattacaagtagatgacatgatttttcggtggattgctgctcagattgtctctactacaatttacaatacaaggaacacagtggctaatgtttgataatgncgccgacaaaaaaaaaaaa

SEQ ID NO: 16267 - DNA, 788 bp, Triticum aestivum
  unsure (1)..(788): unsure at all n locations
  Clone ID: PAT_TA_16267
ctccgcggcgctctactcctccatcatcaccgggtcgatgctgtgtgggcgcgctgtgtccatgcttgttgttgaaccggctggggcggcgggtgctgttcatcgaggccggggcgcagatnatcgcgtccattgtggtggtggcgacgatcctngcgctcaagttcggacacggggaggagctgtccaagggcgtgagcacggtgctagtggtggccatctgcttgttcgtggtggcgtacgggtggtcgtgggggccgctcgggtggctggtgccgagcgagctgttcccgctagagatgcggtcggcggggcagagcgtggtggtgtgcgtgaacctcttctggaccgcggccgtggcgcagtgcttcctggcggccatgtgccacctccggtggggggtgttcatcctcttcgcggcgctcatcgtggtcatgtccatcttcgtcatcctgctgctgccggagacgaagcaggtgcccatcgaggagatatggctgctgttcgacaagcactggtactggaagcgggtggtcaccaaggaccccaagtaccagggccaccaccagcgccaggaaatggccgccgccgccgccggtgccgtcaagcccgtcggcacctcggaatagatcgatccatgatgcgtgttttaataagatttactacaatgcattgggtgggtgcataggtcgtgctatataggaactgcttgtgtgtgttaacttgtccaagacctcgtgttcttacgccttagtaatcttattacgaattcgattaaaaaaaaaaaa

SEQ ID NO: 16268 - DNA, 524 bp, Triticum aestivum
  Clone ID: PAT_TA_16268
ctcgtgcccccgaaaccaacaccacacgcacgccgcgacatttcccagatatttcgcccctgcgcttttcttcctcctccgccgcaatttctcctagttatccctagcgcgacatgccggaggcacctgcacgggcagccggcggcggcggcggcgcctccgcccccgccgacgtggacgtcgtcacctccagcggccgccgcaagatcgccgcccattcctccgttcttgcgtcggcgtcgccggtgctggagacgaccctggagcgccggctgcagaggctgagggagagcggcaagggcggcagggccgtcgtccgggtccgcggcgtcaccgaccacgtcgcggcggcgttcgtccgcctcctctacgcccgcagcaggcgtggcgagggcgacgtggaccaggacgtggagaggtacgcggagcagctgctggtgctcgcgcacgcgtaccgggtgccgtggctcaagcggtggtccccggaggccgccggctcgcgcctcccgcctggcaccgtcgtg

SEQ ID NO: 16269 - DNA, 2542 bp, Triticum aestivum
  unsure (1)..(2542): unsure at all n locations
  Clone ID: PAT_TA_16269
ctcgtcgtcctctcctttataaatcgaaaaattccccttgcccccggcacaaaggtcctcttctcttgtaggtcgcgcccccgtgaacctggacgccatgggtgcttctcttttgaacgattgttcggatcgtgggtctccgtgtacccttctccgatccccgtttggtactcaatccatcgacccaggacttctgcactgaatgggcctatctgcactacaatgcaccatccacaaagaatgccaggtgggtttctggtacactacgccatggaagcccatttccggccgagctgccctcctcgtcggccgagctgggatggtgcactctgcaccggcccagcatcaaaagcccttcgcaacggcccgacctcttctatcaatcgaagcgacctgggtggcggctcctgcttcgctctcgcaatcttccctcctcctcctcctcctccgaagagcgacggcggcggctgcgggcgaacggcggatccaccggcggaaggcgaacagagaagccacaaggagaaggcaagaagggtttggaaggaggcaatccgcgagtccacccgcagaaggctagccgcgagtccacctgcagaaggctagcagcgaacccactggaagaaggcaaccagaagaacccccttggttgaatccattcggagcctactctagggtttggagacacgagaaacaaggcgtctgaactgtcgggccgccctactggtcatttgggcaatcttccctcctgcttcttcctcctcctcctccgaagagcgacggcggcggctgcgggcgaacggcggatccaccggcggaaggcgaacagagaagccacagggagaaggcaagaagggtttggaagaaggcaatccgcgagtccacccgcagaaggctagccgcgagtccacctgcagaaggctagccgcgaacccactggaagaaggcaaccagaagaacccccttggntgnatncattcggagcctactctangggtttggagacacgagaaacaggcgtctgaactgtcgggccgccctactggtcatttgggtttgagtgcactttgctatctctggtgtctaaactactggatttgagtctgtccaaggtgttctgagtgaatattgcaatctggttcttactaatggccgctgaaattcaccgaagccagtcactacttgacatggatgcatttatcgcccatgagcgtcatgcacatgcccttacagaggagagagccaatagtcctcagaacaggcagaggtccattcgtgatgtcttctgcatcaatctgtctgcagatccatcttctgaacaactaactgcgtactatgcggaaagcaatgcacgttcactcaatatctcttcattaagagtgcctggaaggttgagagatggcactcttatcgaagtaccagttactgcggcaacaccgaagaatattgaggacacgagtcatcacatcgtggctttccatcgagagtcagatagagctgtggcagaagttttagtggaggattatagtggatatgttgttgcgtccagatttatcccgcctaaagttaagaaggcaacagtacgtttttgtcacattggcggggccaagctggccgcaaggtttcagccagtgcatccaaccaagtatggtccagcttatgcgcatctcgacaaggtcaggcttggagttggcattgtccctcagatggttacttttctggagaagcttagcaagaaccctgagcaggctgctacccagtatgggtatatcatgttggcgaccctttatgttttggtctctgaaggccggaggttttgggttatccaggaatggaatgtagcgaatatccagggtttcaaacaggagctttagccccgtcgctttttctttcttgtcaaaaaatgtcttgctcttagcaagtgttgttatttggcttatctggttatccttgagaggacgcagcttgctgtgaatgcaacagctgctataacttcaagtgatgcaaaggctaatgccgtggaggaatggtgtcaaaggcaagaagatgtcgatgcaactggactggtgttctatcaacctggagtcgacatagacctcaacttacttgcaggtggtcagttgcttctcctaaggcacgactgtgtcctctgcgacaaagttctcttgcgttccaacggttatgatggctactgggcgaaggacatccaaatcgaggcgtcagaaatacctctggatcctgataagtgggagttgctctgatagcacatccaagtctagaccaccaacctctttttgtgtcggtctgaaattgttttgtcattcgtatacttcttctgccctgttgagggttctaatcattgttgttcagctctgatgtgttcctgtagtgccctcgttgtggctgctagcgtgtatcttctttcttgactagtgtatgttcctgtactggtccttactgtagtgcccttactgaggctttatatccatgtactcgctacatcgtgaatttgtgaatatatgaaggcaggatgaatatctgaggt

SEQ ID NO: 16270 - DNA, 967 bp, Triticum aestivum
  Clone ID: PAT_TA_16270
catggcccccccgtcccccccggccgcctccacgaagaatgccgacgcagcatggtacgacaagatggaggcctgcgtgacgccgctgccggaggtctcggacgcgagcgaggtggccggcggcgcggtgaagaagtggccgcagaggctcacggccgtgccgcccagggtctcccggggcacggtcaagggcgtgacggccaaggcgttccagcaggacacggagctgtggaagaagcgggtccgccactacaaggcggtgatcaaccagttcgagcagaaaggacggtaccggaacgtgctcgacatgaacgcccgcctcggcggcttcgcggcggcgctggcgagttacccgcagtgggtcatgaacatggtcccgaccgtggccaactccagcgcactcggggtggtctacgagcgcggcctcatcggaagctaccaggactggtgcgagggcacgtccacctatccgcggacctacgatctcatccacgccgactcggtgttcactctgtacaagaacaggtgtgagatggacaccattctgctggagatggacagggtcctgaggcccgagggcacggtgatcatcagagacgacgtggacatgctggtgaaggtcaagagcgtcgccgacgggatgaggtgggacagccagatcgtcgaccacgaagacggcccgctcgtccgggagaagatcctcctggttgccaagacgtattggactgccaagaaccaagaccaatagcaccagtagtatagcatctatatagtattgctcataagcacattgctcagaagatctcaaagttggatcgccatttgttgtagccccatgaactgcctattttatgctctttatttatgtctttatataggaattcgtctccaagtaagttgtaaaacacagcatcatttgtatgtgtcacttgatcgctaaatgccctcaggtgattaatagaagtac

SEQ ID NO: 16271 - DNA, 772 bp, Triticum aestivum
  unsure (1)..(772): unsure at all n locations
  Clone ID: PAT_TA_16271
ggaagctccaagggccaagggaggctgctggctgggtctcccccccccccccccccgccccccccccccccctcccccccatctcatccctctctggggggggctccccgcgccgcggagagtgggctctcgaagaaggggccgttggacacccgaagacgaccagaagctgactacggactacatcgagaagcatggccatgggagctggagagccctgcctaagcttgcaggactcaacaggtgtggcaagagctgcagactgagatggactaactacctgaggcccgatatcaagagagggaagttcacacccgaggaagagcagaccatcctccagctccactccgtccttggcaacaagtggtcagccatcgcgaagcacctccccgggcggaccgacaacgagatcaagaacttctggcaacacccacctgaagaagaagctgatccagatgggcttcgacccgatgacgcaccgaccggaggaccgacttcttcgccgcgctgccacagctcatcgcgctcgccaacctccgccaactcgtggagcaacgcccgtgggacgagcaaagcgcaagccagctgcaagccgatccatcgagcatccatctcgagtactacatgcctgctcaatcggaacaacattgcacaatccaactcagcacanaacacatcccactgactgacaatcgtctctagcctcnaaattctcttgctccgtacncaggntctgaggnataaggcaagcctatacggcaattcgntcagt

SEQ ID NO: 16272 - DNA, 438 bp, Triticum aestivum
  Clone ID: PAT_TA_16272
gctgcaggcccggccggaacgcgttcggtggccggcgacattggctgcacgcgctgcccgttcggttggttcgcgccgcgctcgtcgtcggcgtgcttcccgggccggcagcatcggtggcatcatccgcctggacgtgccgctgtccgagttcgtgcaggacgacttccagcgaggaatcgccaacgcacctcgagaccgagaagcgcaacattgaggtgtaccaagtgcgctcgggctcgaccgttgtctactttaccatcacggatcccgacgccgcgcagctgacgagcgacgccagcgacctgcgccgcctcggcggcaacgagaagttgctgctgctggtaccaatggtgggtgatgcagaacaagccgcatcgacgacctgccgttctcggtgctggacatgaagctgtttgcgcgcgtcaccaacgacgc

SEQ ID NO: 16273 - DNA, 764 bp, Triticum aestivum
  unsure (1)..(764): unsure at all n locations
  Clone ID: PAT_TA_16273
tacaacccatatagagtcatagcctgaacgggtcctgggtaatcctgtgataaaatccatgcctagcttatcccacttccattcgggtatcggcaatggctgtagcaatcctactggcttctgatgctctgccttcactctctgacatacatcacaaactgctacatactcggcaatatccttcttcattcctgtccaccagaaactttccttcaaatccagatacatcttggtgtttcctgggtgaatcgaatacggtgaatcatgggcctcctgcagaatcaacttcctgatctcgggttcattaggcacatatacgcgatcctcaaaccataaagtatcgtgctcatcctcacgaaatcctttggcctttcctttgctcatcctctcctttatctcttcaatctccttgtctgtcttctgagcttctctgatcctttccatcaaggtggactgaatctccaatgtcgctagatagcctcttgggactatctccaaacatagctcgcgaaggtcctcggctaactcctaaggtatctctcctgtcatgggggtgctgccatggatctcttgctgcagttccatgcgtangatgaagggttcatgaatcacgagtagcataggaacaaagtgatgagcaccggccgcggcacctttggtcatcttgttcttcaaacagattgcacagccagagcaaacaacattccacaccgangcagctangatgaacacagtantagtcgagcataaatatatgaatacag

SEQ ID NO: 16274 - DNA, 563 bp, Triticum aestivum
  Clone ID: PAT_TA_16274
cccaagcccgggatttgagggagaggagggattggtcgagggccgcgattgcttgctcttcctcagcctcctactgctcgcctccggtgtgggggtgcgctgcggtgggcggaggggaggccagggcatcgagaggcgaaccgagggaggagaggcgaaccgaggaaggaaatggcggcgtggacctccgtgggcctcgtggcggtggccgtgctggtcgtcggcatcgcaatgccggcctccgccgccgtgcagccgcccgcgcccgcgccctccagcgacggcacatcgattgaccagggcatcgcatacgtgctgatgctggtggcccttgtgctcacctacctcatccacccgctggacgcgtcctccccgtacaggctcttctaatctaatcaataattcgggttgtacctgtagaggtagctagcagctgtgcgatgatgatttaggtgtgtgtgtgtgtggtgttctgtttttgtatgcgcgtcagatgattatgtatggacatgtttggtggtggcatgattctgccatcatgtgagtgtttcaaaatttagtac

SEQ ID NO: 16275 - DNA, 606 bp, Triticum aestivum
  Clone ID: PAT_TA_16275
gacgtcgtgggagaggaggatttgtcgagagggagggccgcgattcgttgctcttccttcctcctcctgctcgcctccggtgtgggggtgcgctgcggtgcggtgggcggaggggaggtcgagggatcaggagggcgaatcgagggggcgggaggagctaggaggagaggcggcggaaatggcggcgtggacctccgtcggcctggtggcggtggccgtgctggtcgtcggcatcgcaatgccggcctccgccgccgtgcagccgcccgcgcccgcgccctccagcgacggcacgtcgattgaccagggtatcgcatacgtgctgatgctggtggcccttgtgctcacctacctcatccatccgctggacgcctcctccccatacaggctcttctaatctaatcaataattcgggttgcacctgtagaggtagctagcagctatgcgatgatgatgatttaggtgtgtgtgggtgtgtgtgtggtgttctatttttgtatgcgcgtcagatgattatgtatggacttgtttgatggtggcatgattctgccatcatgtgagtgtttggctatttagttcatgctaatgtgtgtatgtactccaaaa

SEQ ID NO: 16276 - DNA, 1396 bp, Triticum aestivum
  Clone ID: PAT_TA_16276
ccatctttctctcaactctaacaaaagcccaacgaacctccaccccagccatggcaaccaccctcgccactgacgttcgcctctccattgcgcaccagacccgctttgccttccgcctcgcctccgctatctcatccaaccccgagtctactgtcaacaatgccgcattctctccggtctccctccacgtcgcgcttagcctcatcaccgctggcgcggggggcgccacccgcaaccaactcgccgctacactgggggaaggcgaggctgagggactccacgcgctcgccgagcaggtggtgcagttcgtgctcgccgacgcgtcctatgccggtggtccgcgcgtcgccttcgctaacggcgtcttcgtggacgcgtcgctgcagctcaagccatccttccaggagcttgcagtgtgcaaatacaaggccgaagctcagtccgtggacttccaaactaaggccgcggaagttactgctcaagtgaactcatgggtagagaaagtcacaaccggtctcatcaaagatattctccccgcggggtctattagcaacaccactagacttgttcttggcaatgccctttatttcaaaggagcttggacagaccagtttgattcacgtgtaacaaaaagcgactacttctaccttcttgatgggagctcaattcaaacaccattcatgtacagctcagaagaacaatacatttcttcttctgatggcttgaaggtacttaagcttccttacaagcaaggtggggacaagaggcagttctccatgtacatccttcttccagaagcaccaagtggtatctggagcttggcagaaaagttgagtgctgagccagagctcttggagcgccatatcccaaggcagaaggttgcactcaggcaattcaagctccccaagttcaagatatcatttggaattgaagcatccgatttgctcaaaggtttgggtctgcaactgccattcggtgctgaagcagatctttcggagatggtggattccccaatggcacagaacctctacatctcatccattttccacaaagcatttgtcgaagtgaatgaaacaggaaccgaggctgcagcaacaactattgctaaagcagtcctgcgacaagcacggccgccctcggtcttggatttcatcgcggatcatcctttcctcttccttatccgggaagacacttccggtgtggttctattcatcggtcatgtggtcaatcccctcctatcttcgtaatgtgtttgctctgaagtgtcttgtcatttgcctcagctgttacatgtaaggggagggtttggacaatcaatcatgctacccatgcaataaatccaataaatgttctatgcttttgatgaatattaagctcgtctgtcggcatattaaaa

SEQ ID NO: 16277 - DNA, 1426 bp, Triticum aestivum
  unsure (1)..(1426): unsure at all n locations
  Clone ID: PAT_TA_16277
atttcgcctctcttcctctcaagtctaaccaaagcccaacaaaccaccacctcggccatggcaaccaccctcgccaccgacgtccgcctctccatcgcgcaccagacccgcttcgccctccgtctcgcctccaccatctcatccaaccctaagtctgctgccagcaatgccgccttctccccggtctccctctactccgcacttagcctcctcgccgctggcgcgggcagtgccactcgggaccaactcgtcgccacactcgggacaggcaaggtcgagggactccacgcgctcgccgagcaggtggtccagtttgtgctcgccgacgcgtcctccactggtggtccgcgtgtcgccttcgccaatggcgtcttcgtggacgcgtcgctgctcctcaagccatccttccaagagattgcagtgtgcaagtacaaggccgagacccaatccgtggacttccaaactaaggccgctgaagttactactcaagtgaattcatgggtagagaaagtcacgagcggtcgcatcaaggacattctccccccaggatctattgacaataccactaaacttgttcttgccaatgccctttatttcaaaggagcttggacagagcagtttgattcatatggaacaaaaaacgactacttctaccttcttgatgggagctcagttcaaacaccattcatgtccagcatggatgaccaataccttttgtcttctgatgggttgaaggtacttaagctaccttacaagcaaggtggggacaataggcagttcttcatgtatatccttcttccagaagcaccaggtggtctctcaagcttggccgaaaaattgagtgctgaaccagacttcctggagcggcatatcccaaggcagagggttgcacttaggcaattcaagctccccaagttcaagatatcatttgaaactgaagcatctgatttgctcaaatgtttgggcctccagcttccattcagcaatgaagcagatttttccgagatggtggattccccaatggcacacggtcttcgtgtctcatctgttttccaccaagcgtttgtggaagtgaacgaacaaggaactgaggccgcggcatcaactgccattaaaatggccctgctacaggcaaggccgccctcggtcatggatttcatcgcggatcaccctttcctcttccttctccgggaagacatctctggtgtggtcctattcatgggtcatgtggtcaatcccctcttatcttcgtaatgtgtttgctctgaaagtgtgtgttgtcagttgccctcagccattacatgtaagggaagggtttcgacagtcagtcatgttaaccatacaataaatcgaataaatggttatgctaaaatatccaataaattgccttttaatgnannaaaannnnannaaaaaaaaaaanagg

SEQ ID NO: 16278 - DNA, 1538 bp, Triticum aestivum
  Clone ID: PAT_TA_16278
gctttttttctttacactctgtattcctctcaggtctaaccaaagcccaacaaacccaccacctcgcccatgccaaccaccctcgctccaccgtacgtcccgcctctccatcgcgcaccactccccgcttcgccctccgccctcgcctccaccatcattcatccaaccctaagtctgctgccagcaatgccgccttctccccgctctccctccactgccgcacttaggcctcctcgccgctgctgcgggcaggtgccactcgggaccaactcgtcgccacactcgggacaggcggaggtcgagggactccagcgctgctccgccgacgccacgtggtccacggttgcgtgctcggccagcacgcgtcctcccgctgggagggctgccgcggttgtcgcccttcgccaaccggcgttcttactgtaggcacgcgtgccgacttgcttcctcaagcgccatccttccaagaggcttgcatgcagctcgcaagtgacaatgggccgagaagcccaatccgtggacttaccaaactaaggccgccctgaagttactacttcaagtgaactcattgggtagatgaaagtcacaagcggtcgcatcaagaacattctcccatcagggactctgttgacaataccactaaacttgttcttgccaatgccctttatttcaaaggagcttggacagatcagtttgattcatatggaacaaaaaacgactacttctaccttcttgatgggagctcagttcaaacaccattcatgtccagcatggatgacgaccaatacatttcgtcttctgatgggttgaaggtacttaagcttccttacaagcaaggtggggacaataggcagttctccatgtatatccttcttccagaagcaccgggtggtctctcgagcttggccgaaaaattgagtgctgaaccagacttcttggagcggcatatcccaaggcagagggttgcaattaggcaattcaagctccccaagttcaagatatcatttggaattgaagcatctgatttgctcaaatgcttgggcctccagcttccattcagtgatgaagcggatttttcggagatggtggattccccaatgccacaaggtcttcgtgtctcatctgttttccaccaagcgtttgtggaagtgaacgaacaaggaactgaggctgcagcatcaactgctattaaaatggtcccgcaacaggcaaggccgccctcggtcatggatttcatcgcggatcaccctttcctcttccttctccgggaagacatctctggtgtggtcctattcatgggtcatgtggtcaatcccctcttatcttcgtaatgtgtttgctctgaaagtgcgtgttgtcggttgcctcagccattacatgtaatggaagggtttcaaccgtcagccatgttatccatacaataaatccaataaatggttctgctaagacatccaatatataaattgccttttaataaagtcgttctcctaacgcaaaggaaaaaaaattggatgtttttcattaaaaaagctgcagcc

SEQ ID NO: 16279 - DNA, 961 bp, Triticum aestivum
  unsure (1)..(961): unsure at all n locations
  Clone ID: PAT_TA_16279
agtctgaacaagatcacggagatcgtgcggctacagcagatgctcaagaagtggcgcaagctgtccgtcgcgtcgaaggacacgacggcggccgccagcacgcccacccgcccccacggtcaccgccggcggcaacggcgagagcaaggccaagaagttccntgaagcggacgctgtccttcacggcagagcccgccgtcggcggcggcgtctgggccgccgcccaagggccacctggcggtgtcggtgggcccggcgatgcggcggttcgtgatcccgaccgagtacctcaagcaccaggcgttcgcggcgctactccgggaggccgaggaggagttcgggttccagcaggagggcctgctccgcatcccctgcgacgtgcccgccttcgaggccatcctccgcgccgtcgacaagggccgcgccggcggcaagcacaaggacgccgccttctgctactgcagcgccgagttcgccatcnccgccgangtcggcacccccaacaactcgctctncagataagcccgccnggccgccgagagcccngngtcagtcnccgggcaccgttagcactacctgaccaccatcctctcccaacgaaaaaaaaatgttctcntctcattttcctcctcctccggggtgttttnccnagcgcctnatggcnaaggatgattcnaccttccggtactcccccnaangtatttcctaatnntangattataacaactgcncgcattcttcnccggggaagattcggattanccggtgatgtaatnnatgatgaanccgancaatgnngtttcacggaaattgctgtgaaaataaggaggttttttnaaataaaaaaanancngggggggcctnnacaatccccttnngatcgtataccnctaangcgtcntttaaantcgantgnaacctggtacaantancctnaaaancccttcaaggnaangaaggn

SEQ ID NO: 16280 - DNA, 1529 bp, Triticum aestivum
  unsure (1)..(1529): unsure at all n locations
  Clone ID: PAT_TA_16280
atgtgccgcgcggctgccatgaggtgaagagagtcctgtcccaaaactcctcttccccttcttcttgccaaggaagcaaacagcaagcgggggcgtgcgcaaatggcggattcgtcggcgccgacgcgggtgatgatggcggtgaacgagtcgtcgctcaaggggtacccgcacccctccatcagctgccgctccgccttcgactggatgctctccaagctcgtccgctccaacaccgacggcttccacctcctcttcctccacgtccaggtccccgacgaggacggatttgatgatatggatagtatatatgcatcaccgacggacttccagagcatgaagcagagagacaggataagagggattcacctacttgagtacttcgtgaacgaatgccatcgattggggataaaatgtgaagcttggaccaaacagggggatccaaaggaggttatctgccatgaggtgaagagagtccagcctgatcttctagttgtgggaagtagaggcctcgggccatttcagagggttttcgtgggcacggtgagcgagttctgcgtcaagcaagccgagtgtccagtcatcaccatcaagcgcaagacgccaatcgaacgctccacaggaccccaccggagagtgatgctttcggtgcagccggtcctgaactttgcgtatgggatgggcatcactgcctgggatgggttgtaatgctgctgctgctggcgctggctgttggactcctggaacttggtcacaaactttggcagatgcgcgccccaaaacttgagcgcggagccgtcgtccaagtcttggacctccgcgcgggagcttggcatgggcttcatcggcgggtactttacctcgaagcccttctccagtcaagctgcgaccgcgttggtgccgtagtagtgctggtcggcgtaggccttcttcttggagagccggcggccgcacagccgccccgcgacgcaggcgacgacggcgaggaaggagatgacgcccagcacggtgaacaccggcgcgaaggagcccctggacgtggtggccggctgcgcgtgcatgatggggttggtggtggggtaatacggcatgggctgagtcatggaagccatggcagcttcttctctctgctgcctctcagctctcgagaactattctctgtttctcaaggaagggaagggtacggcccctcgaagcccttctccaggtcgccgccgaccgcgttggtgccgtagtagtgctggtcggcgtaggccttcttcttggagagccggcggccgcacagccgccccgccacgcaggcgacgacggcgaggaaggagatgacgcccagcacggtgaacaccggcgcgaaggagcccctggacgtggtggccggctgcgcgtgcatgatggggttggtggtggggtaatacggcatgggctgggtcatggaagccatggcagcttctcctctcctctctgcgcctctcgtgctctcgaaaactactntctgatgagtntctgcgtctcaaaggaaaggccctcgt

SEQ ID NO: 16281 - DNA, 631 bp, Triticum aestivum
  unsure (1)..(631): unsure at all n locations
  Clone ID: PAT_TA_16281
gccagtaagaagaacgcagccaacgacaacggcactgtcacggagaaaccaaagccgcggctcttgctcatcaaccgcggcgagagcaggaagttcgtcaaccttccggaggtctccgcggcggtgcaggcagccgggttcgagctgctggtcatggagccgagccgtgacatggggctcgaggagttcgcccgggcggtggcactcctggcgacgtgctgatgggtgtgcacggggccgcgctcacaaactcctccttcctgcgcaccaacgcggtgctgctgcaggtcgtggggctgggcctgggagcgccaggccttgcattaactacggcgatcaggccaaggcggtcatggtgcaacacatccagtacttcatcagcgccgaaggagagcacgctctacgaaaaatacggcaaggaccaccccccggtttgccccccaccctccgcacccaggcggggggggcaggccgctctgcgcggcctcggggcggaccaggccctcagtccccccatctcctgactgccccccacgccgcatcagcgaantnntacttaaacanaacncgtncnaattaagcanatttctggattttattactcaaacctttttnggggggtaaaacaann

SEQ ID NO: 16282 - DNA, 1011 bp, Triticum aestivum
  unsure (1)..(1011): unsure at all n locations
  Clone ID: PAT_TA_16282
gagggctcgcgtcgtgagagagaccggggcaagggggcgcgaggccgggagggagccgcaagggaccatcgatggccatggcggcgggcgggcccaacgccggcgcgaaggtggtcagcctgcgcctgcagtactactgcgtgttcgcggcggtgggcgtggcggtcatcgtgctctcgctcaccttcctgtccccgtccgccatgggcgccgtccgccagaacctcggcaccgtcgtggccgtggccacgaattccagcagcggcgacggtgcggcgcgggtggtaggaggcggggaggccgtggcggcggtggccgcggccaagccggagccggagaaggagaagccgaagcagaagaaggcggagccgccggtggtgctgttcaacttcggccactccaactcggacaccggcggcgtggcggcggccgggggcatccacatcatgccgcccgagggacgcacctacttccgccgccccaccggccgcctctccgacggccgcgtcatcatcgacttcatctgcgcgagtctgaagacgcatgagctgaacccgtacctgaaggcagtgggctccgactacagcaacggtgtcaacttcgccatggccggctccacggtgtcccacggcgtctccccctactccctcaatgtccaggtcgaccagttcgtctacttcaagcgcagatccctggagctcatcgagctaggactgaagggcccggtgagcaaggagggcttcgagaacgcgctctacatgatggacatcggccacaacgacgtcgccggcgtgatgcacacgccgtccgatcagtgggacaagaagttcaggcagattgtcgagcgagatcggcgacgcgatccggatcctgtacgacaatggcgccgaggaaagttctggatccatggcacgggcgccctgggctggcttgccggcctggtggtgcaaganaaagggngggaacacnaacgcaccggttgctttgcaggcacaaacgggngggcangct

SEQ ID NO: 16283 - DNA, 729 bp, Triticum aestivum
  Clone ID: PAT_TA_16283
ccaaatttcacatcgatagcttgtagcgacggcggcggctgcggtgaccccaactcgagtagctgccgcgtccatgtcagccacaccgtcggcgccggtgactcagccagattcacacaaagaaacgcaacaggctgcttcataataaaatgagagaccttgtttttatcaagttcaactccaaactcaaacaaaagagaaagatgaaaaacagggacccgattgtggaccacacatttgtagatgttgtagaagatgaagataatgagtggatcacaggtattgtgcctcatgaacctgatgaagttgtagaagttgcagcatcaacatcacaaggagcagttggtgcatcaaaaagaaagagagcgtcccaatctcgctctcggaagaagaaaaaactgctccctgtttttcgtgaagatgagttggagtcagctagttcttcttctgaatcggaagatgatgccatgcattcaccatctggttcatcaaatgagagtgattctgaataatttccaagttgtcgctgtattagattgtttacttgttggcttgttgccttgttggctagttcatctttaaactgatatgttgtactattgtcgtcctatggcagttgttgttgcccttctagttttttggacaagtaatttcgcatgtgtcgctatggactgctgtatttttatgttctccatctagttcatcataaaactactatgttgtattgtt

SEQ ID NO: 16284 - DNA, 737 bp, Triticum aestivum
  Clone ID: PAT_TA_16284
tcctactccgaatatttctctctcgcaggcccgacgcgacgcgaccccctcccctccctaatcattgattgattgcccctcgctcgaccgggccgaggtttctcccgccggcgaggagcgggcccgctcgcgcgcagacagaatccggtctgaagggcggttttgctcggctccggctcggtgtgtttggtggatcgaggggatggagcggcggcggtggctgcaggccgcggttctaatgtgcttgctgctgctttgctccgggagagaacttaagaacaaaagacaagcgccagcatataattccactctcgccaagacgcttgcagagtatacttcagcagtttatactaatgacctgtcacagttattcacctggacctgtgaaaaatgtggtgacttaacggaggggttcgaggtgatcgagctgattattgatgtgaaaaattgcttggaggcatatgtcggttttgcaagtgacatgaatgctgttgtagttgcattcagagggactcaggagaacagcatccagaattggattgaggacttattttggaaacaacttgattttgactatccaggcatgactgaagcaaaggtgcacagtgggttttattctgcatatcataatactacattgcgtgatggagtcatcaatggcatccagaagaccagggaagcatatggcaatattcccatcctggtgacaggacattccatgggaggggccatggctt

SEQ ID NO: 16285 - DNA, 1431 bp, Triticum aestivum
  Clone ID: PAT_TA_16285
cggcacgagggcgagctccacccccagcggtgcttgttccgtcgcctggattcccagtggcacgccgcactttggccctacagcatcagattgtggctgtggcagccatggtcccggactcgcggagcactcccggtagccgtttggtcctcgccgtgtctgtgttgctgggtttcggagtttcctctgcgtgccttacttcagttttcaatgggagtagcgtcccggggcagctgtcgggggcgcgggccagtggtttgtggtgggacgcgaggcgctccactcgtccctccgcttgggcctcgtacttccgtgggcgcgagcacattgtttccctcgcgccccatgctgggcttccgctgttccccgcgcgtccacgccctcttggtctgggggcgaaccggcggtcccccgttatgaagcctagaagaatccagaaggacttgcgtttcctatctactgctccacatgaggcctttcggtgggttaatggttttgcagatcagcaatgctatgtaaatctgttaccacaccccatggcatcaagcaaaaagcattcctctgaactcattccatttgatgccatgcttgatccatatgttaaatgtcggtctccgccaaagatacttgtcatcctgaatcctcgatctggacatggtagatctagcaaagttttccatgggaaagtggagcccatatttaagagacagcttgcaggtttcaagatggaagtgattaaaactacacatgctggtcatgcaaaatctcttgtatcaactattgattttagtacctgtccagatggaattgtatgtgtcggtggcgatggaattgttaacgaggtactcaatggtcttctgtgcagagatgatcaaattgaggcaggctctcttccaattggtataatacctgcaggatctgataactcacttgtttggacagtcttgggtgttaaagatccaatttctgcagcattgtccccggtcaggggaggttttacacctattgatgttttttctgttgaatggattcagagtgggactacgcattttggcacaacagtctcgtattttggctttgttagtgatgttcttgaactctcagagaaataccagaagcgttttggtcctctccgttacattgttgctggttttctgaaattcctgtgcttgccaaagtacagttttgaattggagtatcttccagtagcagatgttgatggtgctgggcataaaattgtggagggacaagaaaaggtcgatacgtcagacctctatgacgatgtagttcagaggtcgagagcagaatgtttaccacgtgcctcaagtttgtctagcattgattcaatcatgtctacgagcataatgtctgggggagaaccataagtttttagtccacatgctaataatgaaccgtctgaacttgtgcgtg

SEQ ID NO: 16286 - DNA, 396 bp, Triticum aestivum
  unsure (1)..(396): unsure at all n locations
  Clone ID: PAT_TA_16286
atctcggttgcgtcgttccacagcgtgggggcggagcgggtggtcgggccggcggcggagctcctcgaccagggcccgccggcgggcaaccacggcggtatatggacaccgacttcgccaccttcctggcttacctcgcctctgccngaggggcaagcacaagaccttcctccagtcaaggaggctcgccttcgcctgacgtccacttttgatgcctcaacatccgatttcattgacctttgcgtgcatgctgtatttccttagggaatccagggtaaaagccaacaccccataccacccctgccagcttggctttgacttgtacagccccgggtgatttttccacggggtatcccggttttgtggcatggaagatgtaccggatggggagaatat

SEQ ID NO: 16287 - DNA, 2560 bp, Triticum aestivum
  unsure (1)..(2560): unsure at all n locations
  Clone ID: PAT_TA_16287
ggtcgacccacgcgtccgcacaaataagagaaagaaatctacctcccccctcccctccccgactccggcatcccgctcccctcccccttcccctctccggcccgccgccagatcccctcgggccagaagagtccgtccggcacccatccctcgctcccccgccggcaccttgggcccggcatcggccgccgcggcgtacgtgtgagtttggcgggcggctcggccgaccgggaggcgggcggtccggcgccgcgggagggcaggggtccggccggtctccggagcggccttggagcgcagatcggcccgcccggcaagcggcaatgcagcaggcgcagcggagcaagagttcggcggaggtggacttcttcacggagtacggcgacgccaaccggtacaagatccaggaggtcattggcaaggggagctatggggttgtgtgctctgcccttgatctgcagaccaggcagaaagtggccatcaagaagatacacaatattttcgagcatacctccgacgccgcgcggatcctccgtgagatcaagcttctgaggctcctacggcatcccgacgtcgtcgagatcaagcacattatgttgcctccctccagaaaggacttcaaagacatttatgttgtttttgagctcatggagtctgatctccaccaagttattaaggccaacgatgacttgacaaaagagcattaccagttctttctctaccagctactccgagccctcaaatacattcatactgctagtgtttaccatcgtgacctgaagcccaagaatattttggcgaattctaactgcaaattgaagatatgtgattttggactagcacgagttgcattcaacgataccccaacaactgtcttctggacggattatgtcgcgacaagatggtatagagctccagagctctgcggatccttcttcacaaagtatacacctgccattgacatttggagcattgggtgcatttttgccgaggtgctgacaggaaagcctttgtttcctggtaaaaatgttgtccatcagttagacttgatgactgatcttctaggcacaccttcaatggatacaatttctcgggtccgaaacgagaaagcaagaaggtacttgagcagtatgaagaaagaaagacccggtcccattttctcagaagtttcctaatgcagatcctttgggagtaaaactcttggagaagctattagcctttgatccaaaggaccgtccaactgcggaagaggcattgactgatccgtactttagaggcctttccaagccagagagggaaccatcctgtcagccaatcagaaaaatggagtttgactttgagcacagcagagtgtcaaaggatgatatacgtccgctgacgcgtccggagatattggaatatcatccgcaattgctgaagagctacattgatggcacagagaggacaacctttctctacccaagtgctgtcgatcattttaagaagcagttctctcatcttgaagaaagcgatggcagcggccctgtagtcccagcagatagaaaacatgcatctcttcctaggtccactattgttcactcgactccaattcctgcgaaggacactcggccgctctttggcaagccttgcaacaaaacttcctcggagacagggaggtatgctgggaatggtcacagtgcttctcaggcttcacatgcggcacaagcagtcgtttcacggagagctgctggttcagcgttaccttatgacgcggcaagcaggccgacgattagcccaggatgccctcctcagcagcagatcccacaaatgtatgggcaatatcagcatcaagcacctcctcgtgctcctgctggtgctgggataccacaggccatggggggctatgcctgtggtgggtacaccaaaggcacagcgccgaatgctgctgctgctccagccatgagagcacccccctaccgccaccttccggcggggcagaagaacggtccgctggacagactggcggtggagaccaccgacatatacacgcggtcgctcaacggcatcgttgccgccgccgcagcatcggctggcactgccagcgcccacaggaaggttggcgccgtcccgtttggcatgccgacgacttactagcgtctgagaagatggcagcggcgcgtctctagacacttcggccggaaccgtagcaaccggagggaggcattggcctgaaataagttggcggatgaggatcgtctgacgacgacgaaggcatacagagatagtaggtctgaaatcctctttccggcttcccacggtcgacccccgggggaccgtggatgggtgtggccagacgagctgtttatttangtggaaaatgaaaattaantanccggttancggcggctggagacaggcaaccaacacagaaatntaatctgtactgtntacgcnacatcaacagactaattaattnattaaggatgatggcaattgttatcatcatatatccaancaanaaaggnaaaaaaancnatttttttttttttaaatttcccccagaggccctaattgttaaagg

SEQ ID NO: 16288 - DNA, 426 bp, Triticum aestivum
  Clone ID: PAT_TA_16288
tggatcccccgggctgcaggcaactaacggcagctcctcctctgtaatagctcttccctgtccagacgcttacgagatcctcaaaagccgctgggatagtctgctggaacataagacgtaacaagggtgccaaaaccttgttacaaatcgagtttcgttcgtccagcggaagccgaaattacagtgtagtcaagtgtgatagctgatgggaaccgctgctgattttgcttgatctctccaaggtgtacaccggagaagttgaagggaaaatacaccaccgcatttccaaaaagaatagatgcctctggatttcgaaccttgagccaacgaagtatagcagttgttgatagacaatatgatatttttcactctccccaactcatgtgatgtggagacaagtgggattctctaggatctgaatttgtg

SEQ ID NO: 16289 - DNA, 842 bp, Triticum aestivum
  Clone ID: PAT_TA_16289
gaatggctacatcaggatagattgctacggcggcctcaaccagctgcggcgcgatctgtgcgatggaattgcggttgcacgtcttctgaacgcgacaatggttctgcccaagtttgaggttgctgcatactggaacgagtctagacgtgtttgatgttgatcacttcattgagcaaactagaggttatgtggaggtggtcaaggatatgcccgaggagatatcgttgaaagagccatttaaggtcgattgccgaaaacagaaaggacattttgattatgtagaaacagttcttccagctcttttacaacatcgatatatttctctgacacctgccatgagccaaagaaaagatagatatccatcacatgcgaaagcttgttactgccaaggttgctacaatgcactcaagttgaacaagaaggtggaagccaaagctatggagcttctccaagcgataccaaaacctttcttatcacttcaccttagatttgaaccagatatggttgcctacagtcgatgtgaatacagtgccctttcttccaaatcactggatgctattgaagctgcacgtggggaggacaggaatgtattggttggtgatgctgctcatctgtggaggaaccgtggaaagtgccctctaacaccaggtgaaacagcatttatcctccaagcactaggtattcctacggagacaagcatttatttagctgctggggatgggctaatggaacttgacggcttcacttcggtctacaaaaatatgtatactaaatcatctcttctgactcatgaagatttttgagagaatgcatggcaacacaaaagctgctcttgactacta

SEQ ID NO: 16290 - DNA, 553 bp, Triticum aestivum
  Clone ID: PAT_TA_16290
gggattactggtgaatcgcttggcggaatgcatgcatggtttgtagcgtgggcgcggccgaggtacagtgttgttgttccaataattggtgttcagggatttcaatgggcaatagataatgacaagtggcaagctagagttgatagcattaagcctttatttgaagaagcaagaattgattcagggaagagtgaaatagatgcagaggttgtgaaaaaggtttgggacaagatagcacctggtatggcttcacagtttgatgctccctactcagttcctctgattgcaccacgcccgctcctcctcctaaatggtgctgacgaccctcgttgcccagtccttggtctacaagaacctgcccccaaagctgctgaggcttacgaaaaagctggttctgcggataagttcaagttcatcgcggagcccgggtgttgggcacaggatgaccgcgagcatggtgaaggaagcgagcgacttggttcgaccgcttcctgtagaaggcggttccaaatgaacatggcaccttgtacctgcccgggcggccgctcgatca

SEQ ID NO: 16291 - DNA, 403 bp, Triticum aestivum
  Clone ID: PAT_TA_16291
ggcttcccccgatcccctcctggatcaggatcaagcccaaacgcgcccccgaccccgccgatgccgcgtgccaccccgccgcacctcgtcggcgcctcggtgcccactgccattgccggacctcccgcgcctctccctcgtgggatcgaccgtgccgctcgaccccccttgcgaaccatcgccggacgccatcgccgcggtcctctccatcaccggcgctccccgtccccgtcgccgatgccacctcgccggactgcttcccctgcgtcgccgtcatccccgacctcctccccgcgccccactgccatatccctacggccccccacgtcggggcccacgctcctgccgccaccgtcgataatgtctataacactggaggagcctactactacgtgcaggccgc

SEQ ID NO: 16292 - DNA, 386 bp, Triticum aestivum
  Clone ID: PAT_TA_16292
gagggcctcgcgggccctatggatggtctgatacagcgcccgttgctcattcagtaagccaggatcatcggacacctatgagcaccttcgagagactgagacgacatgaaatggtaaggccacgcttgggagctctggtttgtttcacacttgtattaagatacaggtgtaatttactcgtcatcggaaacaatgcgtaaagtacaggcgtaatgaaaccgagggcccgaggtctataagtaaaaccggcaggttacgcgtgtaatttgagagaccggtgtatattttactagtcgaaatcgaccaaccaagcgcttcgcccgagaccatctgcttttatttacaagcatcagttttacatgcggttttggttgggaaacgacgat

SEQ ID NO: 16293 - DNA, 696 bp, Triticum aestivum
  Clone ID: PAT_TA_16293
ccgccccacccagccacagcgagctcaccgcacggagctccaagcctgctagcgcgtgtccgttcaccctagaccaagaacaaaatgggcatccaggcgagccgcgccctcgccgcgctcctcctggcggcgctggccgccgcgaccctgcggggcgcctcggcggtggtgcagtgcggccaggtgacgcagctgatggcgccctgcatgccgtacctcagcggcgcccccgggatgacgccctacggcatctgctgcaacagcctcggggtgctcaaccagctcgccgccagcaccgccgaccgcgtcgccgcctgcaactgcgtcaaggccgccgccagcgggttcccggccgtcgacttcagccgcgccgcagctctccccgcccgctgcgggctcgccatcaacttcgccgtcacccccaacatggactgcaaccaggttaccgatgaaccctgccagcggacgggtgaaccccgcgctcgcaccgtacaccgacacgcacccaacgtgctcggcggaccaacttaaaagctgcactgaccaaaataaaatcagcaaagatagtacaataagattgaatcagggcccttcaatcatgcatgtgccgaactgtttagttgattaatatataattcaattgttatcctgatgtattatttctgtgcttgctgctataaagtatatgcatgctag

SEQ ID NO: 16294 - DNA, 586 bp, Triticum aestivum
  Clone ID: PAT_TA_16294
tgcaggcctccctctccctcagttctggtacgacgcagggtgaagcctaagttcctgccatttaatgatgaattgcttgagaacacacttcaaatattccgtacttcgtacgcattcaggaactgtgaataccctatcagcgaaggaaaagccttgcagtttgtttatggtagcaagcaagccttgacgcctggtggcatccttgctacaactgcaacaacaaacctgtaccggagtcagcgctacaaggaagggatgaaggatatccagtctcagggctgcagccccgacgaagtcatctttggccctgacttcaaccaatccttgtactgtcacttgctctgtgggttgatatactcggacgaggtccattccgtgttctcgacgtttgctcacagcctagtgcatgcatttcaaacattggaggaggtctgggaggacctctgtgctgatataagagacggcgttctttcagaaaaaatcacagtgccatcaattcgcgaggctgtttcaaagattctgaagcccaaccccgagcttgccgactcgatccacaagaagtgtgcgggcttgagcaactggtacg

SEQ ID NO: 16295 - DNA, 512 bp, Triticum aestivum
  Clone ID: PAT_TA_16295
cgtccgcgaccgcatgcctcttgctcagtgtagtcttcttcctcaaccagcatggctgccatatgggctctggccattatccacctgcttctattgctcccactcctgcggtcctccattgtgttcgagctccacggcgacgtctatcctactggcctcttctacgttaccatgaacattggggaacccgcgaagccctacaaccttgacgtcgacacgggcagccccctcacgtggctggagtgtgacgcccccctccagagcactcacaaggggccacacgaagcgtacagaccaacaccgaccaacgtggtgccatgtgatgatgagcgctgcgtggcggtgcacagggacctcggcctcgcgcacgactgcactcggaacccagaccaatgcgactatgtgtttggttacaaggacggcgagtcatccttgggcgtgctcttggccgaccagttctccctccccaccaacaatgagaaccgacccaaccttgctttcggctgtgggta

SEQ ID NO: 16296 - DNA, 467 bp, Triticum aestivum
  Clone ID: PAT_TA_16296
tgactcttgctctcaccaccttggaagcttttcaccgtacaactgcaactccgcaagaaggctcaactagctagcgcgcgatgccgtcgctgtggcggaggaagagggcggcgacaacgaccccggcggtccggacgagccggcggatgccgtcgctcggggcgctgtggcgccgcctggtccgggcgctcaccttcggccgtgccggccgcgggaggaccgctgtgcggctgtgatcagccggagcacgctaggtgccgaccggcgcatgacgacgacgacgtccgccgtatatgcacttgtgcactagtttgtatcaagagtgttgcagtggctgagaatttttcgtggctagctgcgagacaaaatgtatgttaactttgtactgtattcgtatccaagcgcgttgtacttgtactccctctgtttattaagaaaaggaacgcctacgatttacctaaaaaaaa

SEQ ID NO: 16297 - DNA, 634 bp, Triticum aestivum
  unsure (1)..(634): unsure at all n locations
  Clone ID: PAT_TA_16297
tattactaccgtgtgagcggagcagagcactgggcaccacaaagctaacctcccgcgtcgtcctgcctcgctcctgatctcttcgccatggacgccgggtcctcatcctcgccgctgcgcattgtgatcgtcccgtggctcgcattcggccacctgctcccgtacctggaactctccgagcggctcgccgcgcggggccaccgcgtgtcctatgtctccacgccgcgcaacctcgcccgcctcccgctcccgctgcgccccgcggcggcgccgcgcgtggacctcgtcgcgctccctctcccgcgcgtcgacggcctcgccgacggcgccgagtccaccaacgacgtccccgacgacgaccgcgagctccactggaaggccttcgacggcctcgccgcgccgttcgcggagttcctggccgccgcgtgcgccgacgagaccacgcggcctcactggatcatcgccgactctttccaccactgggcagccgccgccgccctagagcaccaggtgccatgcgcgatgcttctcccgaccgctgcgttgatcgcacgcgcccactgcgtcgacacgcgaacactgatctccgttacaacaagagtatgaccggctaaaaacatgatacggtattcan

SEQ ID NO: 16298 - DNA, 1168 bp, Triticum aestivum
  Clone ID: PAT_TA_16298
cggacgcgtgggggctatgaaggatggtggattgcatgacccttctgttctagtcttcaaatcatcatggagtagcaaaagcaaagtcaaggagagtgaaatgttcgactgtcctcaaacctctatgacacagcgtcctagtaatgatgaagatattgcctttatgtcgataattgagctcggggagctttttaggacaaagaaaataacatcacatgaacttactgacgtatttttaaggagattaaaaaggtatggtgctgttcttgaatctgttattacatacactgaagaattagcatacaagcaagcaaaagaggcagatgacttgctggagcaaggaaaataccttggtcccttgcatggcattccatatggcctgaaagatataattgcgtccgcagaatacaatacaacttggggctcaaagacattcaagaatcaagttattgatatggaagcttttgtatacaaaagattgaagtccgctggggcagtccttgtagcgaagcttgtgacaggttcactcgcctatgatgatatatggtttgggggaagaacacgaaacccatggaacatcgaggaattttctactggttcatcagcagggccaacagctagcaccagtgcaggactggttccctttgcaattggttcggaaacagcaggatccataacatatcctgctgctagatgtggagtaactgctttgcgcccatcatttggaacagttgcacggaccggcgtcatgagcctttcccagccgcgggacactcgggcccctttctgctgtagcgcagcagactgtgctattgtattagatgcagtccgtggcgcggatgctggtgatccctcgtctcgtgaaattgctttagaggacccgtttcatgtcgacatcacaaaactcactgttggatatcttgacagcgctgagatggaggttgtcaaggtcctctccgccgagggtgctaagcttgtgcctttcgagttgaactacaccgtcgaatcggttcagtccattctaaacatcacgatggacgtccatatgcttgcacattgtgacaattggcaacgcgaaggacacgacgatgagtatgaagctcaagaccagtgggcggtggagcttcgttgcgcacgattggtcccagcaggctactatgtacaggca

SEQ ID NO: 16299 - DNA, 608 bp, Triticum aestivum
  Clone ID: PAT_TA_16299
ggcgggccgtgcatttcgctgcctgcgacggcgccatctccacgcgcttcctgcacacctgggcggcggccggcaccggcgccgtcgctccgtcacctcctgtcatcgacagaactctcgtagaggacgccacgggtctctacgacgtcttcgtcaaagccatgccgtcggccgacgagatggagcacgtcaaggtgttggacgacaagctcctcgccaccttcacactgtccaaagaagacatacagcgtgtcaaggacgtggtagccagcgaggcggcgcggcgaggcgcggcgccgccgcgatgctcctcgctggtggccaccttcggcttcatgtggtcctgctaccagcgagccagagacgatgcaggaagcaacggcggcgaccgcccgacgtacctggtcttccccgtcgaccaccgcgcgcggatgaaccctcccgtcccggacgggtacctcggccactgcgtcggcggcgccgtgcacgccgcgcccatggacaagctcgccgaagccggcgccggcggcctcttcgtcgcgtgcacggcgctcgctgcggccatcgacgaagccgtgcgcggcatcagatcacccgagacgatcgcg

SEQ ID NO: 16300 - DNA, 1428 bp, Triticum aestivum
  unsure (1)..(1428): unsure at all n locations
  Clone ID: PAT_TA_16300
cgtccgcggacgcgtgggccttagcatcagctgcaacctccccggcctacctcaccccacctttacgcgtgcacgcacggggcccagtccccttcttcctcgccccgctgagcaacaagatggggctcgaggctgcagtggaggcaaccgtcgagttcctgaacaaggcggtgaagccggtgcttgtcgccggccccaaactccgcgtggccaaggcggggaaggccttcgtcgaccttgtggatgccagtggctatgcctatgctataatgccatcggccaagggctttgtgccagagacgcacccccacttcctcggcacctactggggcgccgtcagcacggccttctgcgccgagattgtcgagtcggccgacgcctacctcttcgcaggccccatcttcaacgactacagctctgttggctactcgttcctgctcaagaaggacaaggccatcatcgtgcagccctgagcgtgtcatcgtcgggaacggcccggcgtccggctgcgtcatgatgaaggagtacctgtctgcattggccaagcgggttcagaagaacaacactggctacgagaactacaagaggatcttcgtgcctgagggccatccgctgaagggcgaggcgaacgagccgctgcgtgtcaatgtgctcttcaagcacatccaggacatgcttacgggtgacagtgcagtgctcgccgagaccggtgactcctggttcaactgccagaagctcaagctgcccgagggctgcgggtatgaattccaaatgcagtatggctcgattggatggtcagtgggtgcattgctcgggtacgcgcaaggtgcaagcgacaagcgtgttatagcctgcattggtgatgggagcttccaggtgacagcacaggatgtgtcaactatgctgcggtgcgaacagaacagcataatcttcctgatcaacaatggcgggtacgccatcgaggtggagatccacgacgggccttacaatgtcatcaagaactggaactacaccgcccttgtggaggccatccacaacggggagggcaaatgctggactgccaaggtgaagtgcgaggaggagctgacggcggcgatagagacggcgttgggggagaagaaggactctctgtgcttcatcgaggtgatcgcgcacaaggacgacaccagcaaagagcttctcgagtggggttccagggtctctgctgccaactccaggccacccaacccccagtagaccaagcaaacttgcctgcatcagtagtagtagcagcagcagcacgcacgttgcccatcaaataatgtgaacagtttatctttgctcttctgttatgttcttagttntgtgcctactagtgacttgtgagctgtggccatcgcctgtgttctatcatgccaatgctacgaagattatgagatatttctagct

SEQ ID NO: 16301 - DNA, 2516 bp, Triticum aestivum
  Clone ID: PAT_TA_16301
ggcgcgctcggccgtccgcacacgtcaacggaacaggttaacgaaatccccacgaaggcgtagaatattccccaaaaccccacgtcccccctccgccgccgctcccactccaccagtgtaccacccggatcggtcgatcgacagcgatggacacccacatcgggtccgtcgacgggccgtcgccggcggcggtgaacggcgcggtgggctgcccggcgtccgcgccggggtgcccgatcatgtcctcccacccggtggtctccccaggcggaggcgtcgctggggcgccaccttacgcgcgccgcctcgtgcaggtcggcgtcagcgacgtcttcgccgtgcccggggacttcaacctcacgctgctcgaccacctcgtcgacgagcccgggctgcgcctacgacgtgatcatgaactcgaactccacggccggggacgcgggcatccggcaacggggagggcaaatgctggactgccaaggtgaagtgcgaggaggagctgacggcggcgatcgagatggcgctgggggagaaggaggactctctctgcttcatcgaggtgatcgcgcacaaggacgacaccagcaaagagcttctggaatggggctccagggtctctgctgccaactccaggccacccaatccccagtagacagaccgaccaaagccacgcctgcatcagtagtagtagcagcagcagcagcacgcacgttgcccatcaaataatgttgaacagtttatctttgctcttctgttatgttcttagttttgtgccttgtagtgacttgtgccatcgcctgtgttctatcctgccaatgctacgaagattatgagatagtatcagcttgcatcgccaagcgggttcacaacaacaccacccccgacgagaactacaagagcatcttcgtgcctgagggccatccgctgaagggcgaggcgaacgagccgctgcgtgtcaatgtgctcttcaagcacatccaggacatgctgacgggtgatagtgcagtgctcgctgagaccggtgactcctggttcaactgccagaagctcaagctgcccgagggctgcgggtatgaattccaaatgcagtatggctcgattggatggtcagtgggtgcattgctcgggtacgcgcaaggggcgagtgacaagcgtgtcatagcctgcattggtgatgggagcttccaggtgacagcacaggatgtgtcaaatatgctgcggtgtgaacagaacagcataatcttcctgatcaacaatggcgggtacacgatcgaggtggagatccacgacgggccttacaatgtcatcaagaactggaactacaccgcccttgtggaggccatccacaacggggagggcaaatgctggactgccaaggtgaagtgcgaggaggagctgacggcggcgatagagacggcgctgggggagaagaaggactctctgtgcttcatcgaggtgatcgcgcacaaggacgacaccagcaaagagcttctggaatggggctccagggtctctgctgccaactccaggccacccaacccccagtaggccaagcacgcctgcatcactagtagtcgcatccagcagcacgttgccatcaaataatgttgaacagtttatctttgctcttctgttatgttcttagttttgcgcctgctatttaatctacatgtgggctgtggacatcaccgctgttctatcctgccaatgctaaggaggtcatgaattatggttagctaacccaaaaagcgactaacaatgtcatcaagaactggaactacaccgccctgtggaggcatccacaacggggagggcaaatgctggactgccaaggtgaagtgcgaggaggagctgacggcggcgatagagacggcgctgggggagaagaaggactctctgtgcttcatcgaggtgatcgcgcacaaggacgacaccagcaaagagcttctcgagtggggttccagggtctctgctgccaactccaggccacccaacccccagtagaccaagcaaacttgcctgcatcagtagtagtagcagcagcagcacgcacgttgcccatcaaataatgtgaacagtttatctttgctcttctgttatgttcttagttttgtgcctactagtgacttgtgagctgtggccatcgcctgtgttctatcatgccaatgctacgaagattatgagaatttctacttgtcgtcggctgctgcaacgagctcaacgcgggctacgcggccgacggctacgcgcgggcccgcggcgtcggcgcctgcgcggtcaccttcaccgtcggcggcctcagcgtgctcaacgccatcgccggcgcctacagcgagaacctgcccgtcatctgcatcgccggcgggcccaactccaacgactacgggaccaaccgcatccttcaccacaccatcggcatcccggacttcttacaggagctacgctgcttccagaccgtcacctgccaccaggcgggggtgaccaacctggacgacgcgcacgaacagatcgacacg

SEQ ID NO: 16302 - DNA, 631 bp, Triticum aestivum
  Clone ID: PAT_TA_16302
ccacgctcagggaccccggccacgcggcgtcctccgcatgagtgaagacaagttaatatttacccctaatgatccacgctcactaatgaagctcaatgttgatttccgaagcatcaaaggccacaagtttaacaaggtagatggcagcaaaccaacgccgccattattgaatctttcaaaagattctgacagggggcgtccgatatttttgagtttgagaatgttggtaaccgtgatgtgggtcgcgactttgtagctagggttttaggcaaacatcaaggtactgtgcctgctagaacaaatgtacctcctgaaaaatcagctgtgtcaactggtccagaacagctcagttctgccgaaatggaacggcggatgaaattgctacgagaagacagtgaactgcagaagttacataagaagtttgtgcttggtaatattctccaagagtctgaattttgggcaacaagaaagaatttacttgacgatgaaacaaacaaagcatcaaaacaaaagccaggtttcaaaagtgctatgctagctgatgttaggccatcagctgatggacagacaaacaaggttactttcagtctgactactgagattatccatcagatttttgcagaaaagccag

SEQ ID NO: 16303 - DNA, 607 bp, Triticum aestivum
  Clone ID: PAT_TA_16303
ctgcaggcgtcaccggcgccgccgggtacatcgcctcgtggctcgtcaagctcctcctgtcccgcggctacaccgtccgcggcaccgtgcgcgacctcggtgagaagaagaccggccatctgaggtcgctagagaacgcatctgaaaatctcaagcttatcaaggccgatctgcttgattacgacgcgatggcggctgccatagagggaatgccagggagttttccatgtcgcgagcccggttcctaagggggatgtgactgatccagaggttgaagttttgggtcctgctgctactggtacgaggaatgtactggaggctgcgtccgccgccaaggttcggcggctggtcgtcgtgtcatccatagtcgccgtcgatatcaacccgaaagattggcccaccgacaagatcaaagatgaaagtagttggtcagacagagagttctgcaggagcaacgaggactggtattcggtttccaagatcaccgcagaagaggcggcgctcgagtacgggcggcggaccggcctggatgtggtcaccctcaacccggcggtggtgtgcggtcccctgctgcagcccacggtgaacgcgagcagcccgttcctca

SEQ ID NO: 16304 - DNA, 500 bp, Triticum aestivum
  Clone ID: PAT_TA_16304
tcgtccctcgcaccgcgcggctgatgcaggagccttccgaaccaaagccaaagtcgaaggaggagcgtgtggctgcgatgatcgatcagcttgatgagaataacgcgccctccgtcgccgcgcgtctcgaggccatcgaacggatgcgcacgcctcctggctctgctcaatcaacgggagaagcttcgcggcctccgcactgcagacatcgatcccgagggagcgatgcgatacctggatgcgctggccaagcgcgtcgtgcaaggcgaggacaaaggcagaggcgtgcggacaccgggggagatcactgactatgctgacacagacaactctcctggaggcacttactcgcgcgctacgctaatcatgcagctcctccgcgacaacctcggtcaatggatcggcgacgaggatcgcgtgcttcccgaggagccactcacaaagctaggatgaatgtacaaatgtgtgcgaaaaaaaaaaaaaaaaaaaacctcgagggg

SEQ ID NO: 16305 - DNA, 1170 bp, Triticum aestivum
  unsure (1)..(1170): unsure at all n locations
  Clone ID: PAT_TA_16305
gcgcgtggccgcggcccgggtcccgcacctgcctggtcgccccaagacccctgatattcctagttggagcccccattcccctgctcgattggctgctgaagcgtgttgaccagcgctcgccgcgagtggtcgtctctaccaaaagcctatcaataaataagaacacattcccacgagttcccataaaaaataggtttgtatcaaattggagctagtaaccaatcccaacatggaagatattgaaaaaacttatataaacaaaaaatctcaaatatccttcatcgtgagacatataaccatcactataaataagaaccaggattcctacagtaatacattgtattttagcgtgggcgcggccgaggtcaatcaagtatccaaattctaaagaaaaatcattattgacggtccaagaccatagatattgatagatcgaacttccatttatttgttgaatagacagttgaactgagaataccatagctatacttaagagtaaaacactaggaaaagcccatatgcgacgaagattttttgttgctgtcggaataagaataaggccaaatcccattgacataataactggaagtgggagaagagggattacccatgcatattgatatgtatgttccataagaaaagaaattgcaatttttacttcaatttttacttcaatttttctataaaattgtttccgattcaccaaaccaattcttatctctttctgaaagaataaataaaaagaataagaaaaaatactgaaattccttaatttttcaaaaatttatctcattgaaataattaaaaattaagaatgggtttagttggttaaattcaaaaagttaataaaataactaggtaacgaagttattttattacctaaataaagatatttataaaaataaaaaaaaaaaagctgaatccttctactctcaactcgtcagccaccttgatattcctttgaacaaaacagaaaaccccaccggtgcactgccccggcggccccacccaatcaaattatgatacctactctttcgctagcctttccaaaatgcctgttacaggctctagatacctattttgttgcggttcctcctatgttccgtcgacgattcctccatccgctcacccgcacatgggaggtctcccctttacccgtaacnaagggnn

SEQ ID NO: 16306 - DNA, 570 bp, Triticum aestivum
  unsure (1)..(570): unsure at all n locations
  Clone ID: PAT_TA_16306
tcaagagcatcggccatatctagccaggtgagtgtggtggatagccaatacttatagcctgacctcctgccgatcccaggctagtagctgccatggcttctgcatcagtccacaagacgatggccaccgtgttcctgctggtccttacccttgggtacctgatggttgccgctgatccgtatttgcaccaccaggatgctcgacagttgttcgcagagcacaataatctctctgcgaaactgggcctctcggaggctgcaagggtcgtcgtcggaccacaagagcaacccgggaacaactgccgtcccgaccgatgctgataaggaagccttgtgcccttgctttccctcatgcgattgtcgatgttcaattgaaaccatcatgtgccatgtgctacaatagtcacgccatgagcaagtctgtgtgtgtcgcgngcgtccgcgccgcgccnacctgngaangatcattcgngcgcatcgtttaagtcggataagttgttgatcgagtctagnttgttcangatgtgtgaanacgttnccatggtgcacgtngattgagtcagaaaagtnt

SEQ ID NO: 16307 - DNA, 700 bp, Triticum aestivum
  Clone ID: PAT_TA_16307
cagcaccagttcgcacgccaggcaacgaacagcgggcataaggaagaagccagcgagggcgcagccgggaacaatggctttgctgctggtgcttacaattggcaccagcatgcaatggccatgccgtcccgtccgatgccaggttcaatggtggaaggcaatcgtatcggagaaggcgtggatgagtccatccggaagcttctgttcaagctaggaggaagctctttcgcggccctgccagccccgccgtgccttcctccgccaatgtacggggaagctccaaacttcgtggcgccatcggtgcacacggccccgctaaacgaaggtggcatccactgttccggcgtgctgcctgcactggagctggacgagagcttccagttcagccaggtcaagctggacgggctggaatgcttcttcggcatgggggaccagagcatgaggtggaatgaagtgagccccttggtttgccctaacactactgtcgcgtccagctcccaagcgatgcagcagtactgcctcgtagaggagccggtcgaccttgggatgcagtagccaactaagctattggtgtttgttctcatgtacatgcatgattgtggattttgtgggtgtaaatttgtagcattcatggggaatggtgaaagatgatgagagctctgaattaagaacaataatgcctctcacactcctagatggg

SEQ ID NO: 16308 - DNA, 1085 bp, Triticum aestivum
  Clone ID: PAT_TA_16308
cgtccacccacgcgtccggcccttttttttttttttttttgaaactagcatgtctaccagcttgtcttgtatattcagaattcagaatgtcaatattctgcatagagcagcttagcgcagtagctgtaaaaggcaatcatccaaatttcctctacaatgacccttacagctactttaacttaccaagctagcagataagcactataaatctacaacaacaagcttacatggccaccagacgatgcatatctatctggaagatgtacatacatgatgatgccatgagtacatttatatcagtcggtgcctaggagggaggatgtcagaagcgcctcttctgctgagggtacccagggttctgcatccccatcccttgatcagccttccttctcaactggtgtggatgagactggccacctgcgcctctctgcattggaatgttaccgggattcatcccaaccatgcctgcttggggtgctgcgccaaaggcacccatgtttgcaccaggaggcattctttgcataccacccataggctgttgcatttgccttgggatttgtcttggtacaggctggcctcctggaggtccatttcccgatggcggttgagttggttgaaggcttgttgttccttcaaaatctgttgaggtatctactggacgaacaggatatgtcacaattttctcgcctggctgagatggtacaagtgcatttcgtccaggtagcgggtccatccggaagtacctagcaaagaggtggatgtattcagaagagttgatatatcaaactttattccccaatatcagaagagttgacatattaaactgtaatcgccaatatcgccgcattacaactatgattttgtcgtgttccctgtatatttaaaatattctacagcattaggacatgagtttatctcaaatcggcattgtttcaatggttaaaagttatgtgtaattagcaatgacaacattaggtacagatcaatcctaccggaagaacctttggttccaggttttggccgcttttgctttatgcttgtgatccatttcggcattcttctaataggaaataacacgaattctg

SEQ ID NO: 16309 - DNA, 562 bp, Triticum aestivum
  Clone ID: PAT_TA_16309
tccgcaagctatcacagccctgaacctgcggccgcggtcgagttagttttggtgatctgcattgcagagttgcggcaatggtggctcagggaagaggcggtgcggccaccggtctggtcgccggcgtcgtgctcctgtgcgtgctccttccaatcaccggcgcggccgcgatggcgcggcaggcgccaaggacgtacgtggtcggcgacgacaaaggctggggtccgcgacctcaactcatggtggccgaaggacaagaccttctacgccggcgacgtgctcgtgttcaagtacgacaaggagctccacgacgtgacagtgctgggcggcaaggggtaccagcggtgcgaggtgccgaggcacagcagcaagagctgggtgatgcgcaccgggaacgaccaggtcacgctgcgcaagggggcaacaatctacttcatctgcggcctgccgggccactgcgacaagaacatgaagctcgccatcaaggcctggtagatccatcgatccggccgcatcatcatcatcaatcttttgaggattgcatgcttgccctggccgtcgt

SEQ ID NO: 16310 - DNA, 608 bp, Triticum aestivum
  Clone ID: PAT_TA_16310
aggcccgtccccgagaacatcctcaagaagaggaagaccctcgagcaacagcgcgctgagcgtgcgatccaggccaaggagctccgcaagaagtctggccgccaagcgcccaatcatcttcaagaaagcgccgagtcgtacgtccgcgagtaccgaaaggccgagaaggagctgatcagcgctcgccgacgagccaaggacaacaacgacttcttcttggagcccgagcccaagctggccttcgttatccgcattcgtggtatcaacggagttgctcccaagacccgcaagatcctccaactcttgcgtcttcgtcagatcaacaatggtgtcttcattcgcctgaaccgcgccaccacccagatgctccgcctcgtcgagccctacgtcgcctatggattcccgtcgcgcaagtcggtccgtgagctcatctacaagcgtggcttcgccaaggttaacagccaacgcatccccgtcaccgacgacgcggtcattgagaacggtcttcacaactccgagatcatctgcattgaggacgtcatccacgagatctacaccgtcggcccgctcttccgacaggtcaacaagttcttgtggccgttcaagct

SEQ ID NO: 16311 - DNA, 631 bp, Triticum aestivum
  Clone ID: PAT_TA_16311
caagcttctaggcgaggacggcagggggcaggtccccgcgcaagtgaagggcacaatgggttacttggaccctgagtactacatgacgcagcagctgacggagaagagcgacgtctacagcttcggcgtgctgctgctggagatgatcacggccaagaagccgctggagcgcgggcggtacatcgtccgggaggtgctcgccgcgctcgaccggagcaaggacctgtacggcctgcacgacctgctggacccggtgctgggcgcgtcgcccacgtcgctgggcgggctggagcagtacgtggacctggccctgcgctgcgtggaggaggccggcgccgaccgcccctccatgggcgaagcggtgagcgagatcgagcggatcaccaggatggccggcggcgcccccgagtcggcgtccgagtccatgagctacgccagcaggacgccgcgccacccgtatggaggtgacagcccgtccgagtacagcggcggcgggctgccgtcgtcgagggtggagcccaagtgaagctagctagctgccatggccatgtaccgtcccatatctggtgtgaggctggcgcgtgggctgaatttgtgtgctatgttttgtacagcttacttgccttatgtg

SEQ ID NO: 16312 - DNA, 775 bp, Triticum aestivum
  Clone ID: PAT_TA_16312
gcacgagtccggctgcagcgccggcgccaacatcgcgcacaacatggccgtccgcgccgccgcgcccggcgcggtgccggagggcgccgccgtccggggcctcatggccgtgcacccctacttcacgggcaaggagcccgtgggcgcggaggccgcgttcggccccgacgtgcgcgacttcatggaccgcacctggcgcttcgtgttcccgggctcgctcggcctggacgaccccaacgtgaacccgttcgtcaccgacgaggcgcgcgccgccgtggccgggatcccgtgcgagcgcgtgctggtgtgcgtggccgaggacgacgtcctgctcaaggagcgcggcctgtggtacgcccgcgagctcaaggccagcggctacgccggcgagatcgagatgttcgagtccaagggcgtcggccacgccttccacttcgaccagctgggctccggggagggcgtcaagctgcaggagcgcctggtgaaattcatcaagaaatgagcgcccggtgaatggattcggcatgggaataaaagattaactcggacgctttgatttgtcggacaatctttggaaagtttgagatgtaatgcgtgcgtgcaaagttgtttgatgattcgttggtgattataacagagcattttcgatcttgcttggtcgatttgggctgagatgattctcaactctcaaggaatcctgcagatctggaggccctggacgagctttgttgatcaatcgccataaagggacgaaaacagatctggatcctactgt

SEQ ID NO: 16313 - DNA, 487 bp, Triticum aestivum
  unsure (1)..(487): unsure at all n locations
  Clone ID: PAT_TA_16313
tggcgcgccagcgagtcgtggccggagaacgtgctcttcttgaggtacgagaagctgctgcgcgacccggccggaaacgtgagaaagctcgcgcggttcgtcggcgtgccgttctccgaggcggaggaggaggccggcgtcgtccgcgngcatcgtcgagcctgcagcctcgggagcctgaggagcgtggaggtgaacaggacgggctacatggacggcctcaagttcccgcgcaaggccctcttccgcaagggcgtggccggcgactgggcgaaccacatgacgccggagatggcgcgccgtatggacgatatcgtcgccgacaagctccgcgccacggggcttacattccagtgagctcagagaaatcaaaatttccgcagtgtcgcgacgagatcaatttaatcatttccgtaactttattaccagccaaatgtttcagtttatcataagcaagcatacacgatcacgcttccgcgtcacacga

SEQ ID NO: 16314 - DNA, 880 bp, Triticum aestivum
  Clone ID: PAT_TA_16314
ctcgtggtcattcaactccacgcttgctccgccccggaaagatcatgacaagaaggcagcggttgttggatggttgattggaggagctatggcgttgcttgtgttgtggtgcatcatctcgtatttcaagtggacaaggagccccagttcaaaactttctggctccaagtggaggagccagacagctcgagtaccgtgttctggctgctgcaacggatgacttctctgaggagcgggttattgggcaaggtgcctttggagtagtctacaggggcaccttcttcaaggtaccatcatcaggtgcgccctcgagagaatccgatggtccgtcctccacggaatcttgtgccgcttcaaactcgagctcgaaggaatccgcagatgacatcgaggtggctgtaaagaagatcaagaatgggacaaagggaggagacttcttggccgagatgaacaccattagtgaagcccagcacaagaatctcgtgaaactgaaaggttggtgctgcagggaaaacaatcggaacttgctcgatttcatgtgttgggtgctgcagggagaagaaggatgccgagctcttcctggtctatgaactcgtgccgaacggtaatctgtactaccagctaagcgagagtgagcaagtaatagcatggccaacaaggtaccaaattgtgaaagacataggctcggcccttgtttacctccaccacgagtgcgaaccttacattctgcacagagatatcaaaccaggcaacatactcctagacgacaaattcaatgccaagcttgctgacttcgggttgtcgaggatcggcaaccaggataacatgactttgatgacgaccgcgatagggacggaagggtatattgatccagaatgta

SEQ ID NO: 16315 - DNA, 844 bp, Triticum aestivum
  unsure (1)..(844): unsure at all n locations
  Clone ID: PAT_TA_16315
ggaacaagcacgcccgcaggaggtcgtgcaccatgcaggagctgcagcgcgagctggccgcggcggaggccggcggcgaccagcagcagctgcggcagtggatgcagcggcgcgcgctggagctggagaagcagaagctggcgtacgaggtccgcgagtacgcgctggagaagcagcgccacaagtgggagcagttcaaggccaccaaggagtgggacatggagcacgagcggctgcggatcgagcgccggcgcgtcgacggccagcgcatgctgctcgtgctcaagcagaaggagttcgacctggacctcgccgaggcctacaacaactactcgtcgtccgtggaccaccacccgggcgcccagaccccgccgcccgccggcttccagcagcagccgggctccagcccctccaccacagggcaccccaactagctaggcaggcacggccaggacaccatgcatacattagatttagcttttcccttaagccaccatgcatactccatttttacttttccttcgccagcatgaattacttttcgctttcgacccgttgtaaacaacagtacaagtggaccaataacctgtgagatgcctaggccccctggtgttgagttccttcagccttggattttttgattcttgcccaaaacattcaggacactttgcttnaaaantccccatggaatttnaagntcaaatgaaacnanaanctatcatgtgaatatgggaaaaaacgnggaatccgnattaagcatcatctcgtataagaatcgcncacattatcacatnatatagcagggcggctccattaaagctattccgtgacnnccctgnaagtt

SEQ ID NO: 16316 - DNA, 1283 bp, Triticum aestivum
  unsure (1)..(1283): unsure at all n locations
  Clone ID: PAT_TA_16316
gctctctgcctctcccgatcagcggtctcgtcattctgctccgctgggcgggcctgggccctggctgcatccccgctctcgcctgctgcgggccggcggccgccgcgtgggctgcacccccctgttgctccccgactgcctggagaatggaagccttgatcacgcgctgtttggaaagggaggcttgaacctagactggccaagacgattcgagatatgcttaggcatagcaagaggtatagcttatctccacgaggagtcgagcgtccgcattgtgcacagggacgttatgccctgctgtggcttgctagatgcccctctcttcccgtggaccgcggtctgcggccgtgccttgctgtatgatgaccagtcgtcgcctgggagcacatgggtcgctggctcagggggcgtcctcgcaccgtaggttggtggcagtggagccgctgtctgaaacatctcatcagggaaaaacggaatttgcaacggaaatagaaactatatctcgagtgcaacaccgtaatctcgtgaagttgtatggttgctgccttgagaggcaataagccactgctggtttatgagtacctggagaatggaagcctggaccatgctctggttggccaacggcgggcaggccctcccgggcctccgcgtcgcgcgcttcgcttaggcgttgcaagaccccccgccgaccgtcctggtcaagcgtgctgccgtggcttgctggacaccacgagggacatggaaggccaggcgaataatccgttacattgcacgccaatctcaatcctaagatctcggaatttcgggctggctaaactttacgatgaccagaagacgcatgtcagcacgaaagttgctggcactcttcccggcggccgccatgctgcgggcggggatgccgccccgggcgaccgggaacccgtcgcccgtcttcacccccatcatcgacgagggcaggtgaggtgcgtgtgcgcgccaaggtgtttagtagttgccaccgccaggtgggtagtatgggcgaaggagagtatttttatttccccctgccgcgaatgctaaattatttccccgggggtatgaatgcaatagcttcccagatatatgtaagcggaagatctccttgcactggcccttctcgtcccgcacagggccttggccccgcttgccgtggactttgcagtgatactatgcacccccccgcggccgtccttccccttccggtcttaccnctaaggctctttaaagccggngggaacctggtncaattaccctgaaaanccttt

SEQ ID NO: 16317 - DNA, 553 bp, Triticum aestivum
  unsure (1)..(553): unsure at all n locations
  Clone ID: PAT_TA_16317
cgtncgagcgctctttcacattggacgcacaacccagccgagcgttcctgtacaggtaacatcaaattccctcttcgtagtctggaggcgggagattcggaagccatggcggaggagcagttcctggccgcagctgtgggcgccgccaagagcgccggcgagattatccgcaagagcttttacctaagcaagaaagtggagcacaagggccaggtggatttggtgacggagacggacaaggcatgcgaggatctcatcttcaaccacctccggatgctctacccggaccacaagttcatcggcgaggagacgtctgcagccctcgtgtcaacggttganctaacctaaaaccacacntgngatancanaccccctcnaatganaaacaatttngttaaaggttccttttggngcgctcncatttggctacaaattggaaatccacacgntgggnttgttanacccaccagaaggtttcnaaagtttccngggaaagggttttccaagnccccaattnaaaacnccaaaangttggggaagnctangggaaagg

SEQ ID NO: 16318 - DNA, 877 bp, Triticum aestivum
  unsure (1)..(877): unsure at all n locations
  Clone ID: PAT_TA_16318
cctccatgacggtgtccgacctcatgttgtccaccgggacatcaaagctagcaatatacttctggatcaggatcttaccccgaaaatttccgatttcggcttagcgaagcttctaccttcagatgtatcacatattagcacaagagtcgcaggaacgctaggttacttggctcccgaatacgccatccgaggacaggtgacccggaaatcagatgtttacagcttcggcgttctgctgatagaaatagtcagcggaagatgcaacactgatacaaaactaccctacgaagatcagattcttcttgagaagacgtgggcatactacgaccaggggcagctggacgagatcatcgacagctccttgggcgaacgacctggacgttggatgaggcgtgcaaggttcctgaaggntgggcctcccgtgcaccaaagaacgtgaccaaancggcggcccgacatgtcgacggtgaccccggnatgttgaagggcgaggaggacgtggagttgcatgagatcaccaagcccgacgtgatccgggacttcagggacctgaagctgaggagcaaggccacgtcgtcgtcgctgctgacctccatcgtggcgcgctcctcgccgtcgtcgtcgtcgtccaccggcaacaccacccgcacctccatcaccttcaccgccatatcggaccgcccctgaccggtgaaggcaccgaagtgaggataatgcagacacgaagagactgcagaggaaactgtagatagccgtagcgcagcccaggtttttccttttttctcgtgcttgtatggtctgtgtggtatagtggtcttcatactttcattcactttactctctctttttttgggcggggcacttcacttgattgttt

SEQ ID NO: 16319 - DNA, 951 bp, Triticum aestivum
  unsure (1)..(951): unsure at all n locations
  Clone ID: PAT_TA_16319
cagacatgatcaacaccctcgacggcgtccgcgacgagaccggcgccagcgcctgcccctgggccgtctggacccgcgcctggaccgccgaggagaaccgccacggcgacgtcctcaacaagtacatgtacctctccggccgcgtcgacatgcgcatggtcgagaagaccgtccagtacctcatcggctccggcatggacccgaggacggagaacaacccgccccggcgcctggtgtacacgagcttccaggagcgcgccacggccgtctcccacggcaacaccgcgcggctcgccaggggcgcacggcgacnacgtgctggcgcgcacttgcggcaccatcgccgccgacgagaagcgccacgagacggcctacagccgcatcgtggagcagctgctgcggctcgactcggacggcgccatgctcgccatcgcggacatcatgcgcaagcggatcaccatgcccgcgcacctcatgcacgacggcagcgacatgagcctgttcgagcatttcgcgtccgtggcccagcgcctcggcgtgtacaccgcgccgggctacaccgacttcgtcgagttcctcgtcaagcggtggaagctggaggcgctggagggcgggctctccggcgaagcccggagggcccggggcttcgtctgcgggctcgcgccggaggatgcggcgcgcggcggagagggcggccgacagggccaagaaagacggagcccaggaaggtcaggttcagctggatctttgatagggaagtggttgtctagtgttggtctgacttctgagactgagatagtgagatgatcctgtcactgtccttctgtgttcttttgttttctctctttgcaaagttgttctatagtttcttttgaatttggaaacaatgtactactatcagtttgataatgaaatgaacttacagtttgataaaaaaaaaaaaaaaaaaac

SEQ ID NO: 16320 - DNA, 616 bp, Triticum aestivum
  unsure (1)..(616): unsure at all n locations
  Clone ID: PAT_TA_16320
caccgacaccgcccggtgcgaggcggcgaggcagcaggcggccgcgtcggagcagctgaatgtattcaccaacgatgacgtctccttcacgggatacccggtggtggggtaccagcaccgcatccaggcgttcggcacgtgcttcaatagccccgaggatggcctcctcacttcctgcgcctgggacccgcgcatccgaggcttcttcaactacaactccggcttcagcatcccgctatccaacgcaccggcattcatagccgacatgcaacgtctccgggacctcaatccggactcgttttgttcttctgtcgaccccaacataggcgtgctcctacgatacgttaaggcatcatccgcttatcttggcaagccggaggactcgatcggtgtcgacatcatcttttaccggagccacactgaaggcatgccgcgtgcacatgctgatctggtggacgagatcgagcagatggcgttgcataagtacggcgggatcccgcactggggtaagacccccgttcccgccttngggcatcccaaatnccaaaatcaaganttctangggaaagnagnacattaaangggctcccaacantggctanaggtccggataang

SEQ ID NO: 16321 - DNA, 915 bp, Triticum aestivum
  Clone ID: PAT_TA_16321
ccgaccccgcgcactgcataccccgctagctgcccgctcgtgcatcgaggctcggtgaccgtcgcgccctacaagctcgtcttacggaccgtcctccgttggccgccaccggtgggccccatgtggttcccatgctcccgcccgctgcctggccgcccccgcgcgtgcgccttccggcctcgacgacatcgccaacatgtgcctcatcctccaccttattggggcatatcaggtctatgcacagcccatattcgctacagcagagaggtggattgtctccaggtggccagacacctggggcttcgcccgcgcaggcaccgtcagcatcccgctcatgcagcgaggctcggtgaccgtcgcgccctacaagctcgtcctacggacggtcatagttattgcaacaactgtggtggcaatgatgataccgttcttcaacgcggtgctagggctcctcggcgcgttcagcttctggccgctaaccgtgtacttccccataagcatgcacattgcccaggggaagatcaccaaggggaccaagtggtatctcctgcaaggtttgagcatggtctgcctgatgatctcagtggcagtggggataggctctgtgagcgacatcgtggatagcctgaaggtctccacccctttcaaaactgtcagctagaggatgtacaagacttgtagaatagcggttgaatctgtaggctgagtctctgtactgtatcgtatcatttttctctgatgtccacgtatcgggatgtgatatccgatcagttccgcaaagatttggagctaacagcttagctggatcggttgtaatgacccattggcttgtttctactacctctaaataaacttgcaagaatgactaacatgtgaaataggaagtactgtgttaaagacaagctcctctttgat

SEQ ID NO: 16322 - DNA, 836 bp, Triticum aestivum
  unsure (1)..(836): unsure at all n locations
  Clone ID: PAT_TA_16322
cacacagagcacacagtttgtttagctccatccttcctcgccaccagcagcaggagatggcccagcgccaagacatcatcattagccatttctcccatccagggcacgagctcgtgaagcgccaccacactgggccgttccgctgcgatatgtgctgggaggacctatccggcacggcatacatctgccgtgccggctgcgacttctgcatccacgagtcttgcgccggccactcacagacgttctcctcccccgagcaccatgtgcacccgctcacgctcgtccagacccgccgcgacgcaaccctctcatgcgatgtctgctttgggctatgcgcccctggctccttcctctaccgctgtccaccatgcgggttcgatatgcacccaacctgtgcgctgctcccccaagtcgtgcgcagcgtgcgagatcctacgcacgacctcacgccggtcgtccccgacggccgctgtgccgcgtgcgacgccgggcgcggggcgcgcgtcgttactaccgctgcacggcatgcaacggtcgactaccacatctcgtgtgcagcgagcaccggcgacaacaacagcgctcatgaactcaagatgcccttgacgctcagatgtacgatcaaggtccaagagcagactagaaagccatcttgggactgtggatctgcctatatgtaccagaganactctaatgtgatgctctgaccatctgcttggaagtcacatgaataaatgctcacattntacaaatagatacgntacaattgagtgtgttagtcaaactcaatcagttgntnatgtgactccttttgggaaaaaatctnntnggtgcag

SEQ ID NO: 16323 - DNA, 539 bp, Triticum aestivum
  unsure (1)..(539): unsure at all n locations
  Clone ID: PAT_TA_16323
gttggatgcgtgcttcagcaacctcatggtgtctagcggcggtggaagggggcaggctgaaactggtggcgctgtgcctatgttgtcaggatggaaggaccttccaatggagctgcttatgcggatcatatcagttgcctggagatgatcgaattgtcgttgtcgcatccggtgtttgcactggctggcgcgacgcngttaggatggggggtcactaatctttccctctcatggtgccagcagaacatgaataacttaacaatatcatttgctcacaagttcacaaagcttcaggttctcactcttcgccaaatcaaacctcagcttgaagacagtgcagtagaggctgttgccaactactgttatgatcttcgtgagctagacctcagccgaagtttccggcttagtgaccgttcaattgtatgcgctggccaacggatgtcctcggcttacaagactgaacatcagtggggtgttccaagttgcagtgacagtgccctaatctaccttagttgccactggaaaaacctgaagagctt

SEQ ID NO: 16324 - DNA, 807 bp, Triticum aestivum
  Clone ID: PAT_TA_16324
gcagtgcaaagacaaggggccgaggccgtggcggggttgtgggatcggtacctcgtgcatatcgtcgctgatcctgaagctccggccggagaggctggcagaactgatcggcgtcgttccggccggcaacccggaagacccacgatcatctatacgaggccatcaacacttacttagtggagcaccccagcctgtccggcgaggagaaggcggcgctttgcgggcacctcgagtgcccgcggcggtcgcacgaggcgtgcatccaggcggtgcagaacgagcggatgccgctccggttcatcgtgcaggccctgttcgtgcagcagatgcacacgcaccgcgccttccgccgagcgctccgactcgttccggtacatgctctccggcgagctgatcccaggcgtcgcccggcgcgtacacgccgagcccggggtgccccgtccccacgagccagccgctgagcaccaccagcccgtacacagacgcccacaccaacgccgcgctcgacgggaagctccgcgcccgcggcgacgacgacgcggcgtcggactacgagacggcgagcttcaggatccaggcgctggagcaggagatcatctcgctgaagaagaccctgcagcggcacaacaccctgaaaggaggctcggtccgcaaggacagcaaagagccgagcttcagggcggacgtggcggcgccggtagcgatcaggcggcgagcgcccgtgtccggcagctgcatcgggtccatgcgctggggctcgcagcggcgggtccgccgcaggatcctgcgcgtgtttacgagactggc

SEQ ID NO: 16325 - DNA, 530 bp, Triticum aestivum
  unsure (1)..(530): unsure at all n locations
  Clone ID: PAT_TA_16325
tgcaggaattcggcacgaggcttctcctcctccttgtgcgttctcgtgaggagcctgggatggcggagggttgacgaggagcaacagccggttctgttgttgttcctctacacactgtcccactgtcgcgccatctccggtaactgatatcgacacgagtggaatccatgccttttggaagagttgctgaaagcacttgaaaagcgcaaaattcagctgatcctcgccaatcccgggccggcagtgatccagaagctgcggtcagcgaaattcacggacctcatcggcgacgacgagatattcctgtcggtcggcgatgcggtgaagaaatttgctccaaagtcagccctgaacgtctgaagaaggcgcgtcgagcgaagcattgtacaggcgatgcaaagagatgtgttggtgtgatttttatagaacaaggagcacagaggtacacgccatagttcgtgcaaaggtaaataatggaggtgtgtgggagttgggagcgcatcangttgcaangnggtganaaaaaggga

SEQ ID NO: 16326 - DNA, 690 bp, Triticum aestivum
  unsure (1)..(690): unsure at all n locations
  Clone ID: PAT_TA_16326
gataagacaaatatctcagcgattggtagcaatagagtggcaggctcacggcataatttgtcaagtaaggttttcagtttgtccatggcttctttgaggatggccgtgctgctgttcttggtttgcactctcggtgtcgctaggaagatggaagcggcaaggatgatgcagagaggtgaggttgtggtgggtaatggaggagacggtggccgcaatgcgctgcagcacgggttcgtcgacggccaccggccaaggcctgttgcgtcgttgacgatgggggacgacgtcgtcgaggcgccgtcgagccaggcagctggtggagacggcgcgaagagggaggtgccaggtgggcctgacccgatacaccaccatggcagcatcccgccgaattcggtcgctccatagaggcatgcagccagagagccctgcgttcggccagtggtgcccaacgccacgaggactccctccgcctgcatgcgtggtaccgccgtgctggcctggctacccccgtactttctccttgtgtgcgcagcccacgtggccgcccccgggtgtgcggtctccaaaatcatcatggtattacttaattgattgtgtgtggaccgactggcgtctcagttgctgtcacggtgtatacaacacagttagttggtnagattantatataagtattaatccaaaaaaaaaaaa

SEQ ID NO: 16327 - DNA, 380 bp, Triticum aestivum
  Clone ID: PAT_TA_16327
caacaacaagtggctcacggttggctcgtccctgcaggtttaccctctcttcgttaccatcgctgctggtatgctcctccctgcttactatggcatgcgtcttctcacccagcacaacgacattgtgatcaacaagagaaacccctaccagttcgtcaacaacacctaccccaagctctttgaccgcgagacctctcttggtttcaaggccaagatgtttggcgtcgactccagcggtgagaactagagagaagaacatccatcttctccacggcacacgagacccatcttctcttgtcttttctcttctatgagcctactctcacgcaactcctcagacgaaagaaaaaaaccaacaaagaacatggtcgatctcaata

SEQ ID NO: 16328 - DNA, 454 bp, Triticum aestivum
  Clone ID: PAT_TA_16328
gtcttaccacgcagcaagagagagtgcagtagctaggtctctctaacgacaagcttgtgcgagcggcaacgacagcggcttcgggaagaggcaatgcagcgggcagtaaggcgcttgtcgccggcgccgcgttcctgtgcatggccgcggtgctacctggcggccacccctgctgccgaggcgggggcgacgacgtaccttgtcggcgacgccgccgggtggacgcgcaacgtccacttcggcgggtggctggccggcaagaccttccgcgccggcgacgtgctcgtgttcaagtacaacagcacgttccacgacgtgccgtgggtaagcaagggtgggtacaagaagtgcaccgtgtcgcccaaggggttcgccccggtgtaccgcaacggctacgacgcggtgacgctccccaggggcacgcactacttcatctgcggcgtgccgggccact

SEQ ID NO: 16329 - DNA, 375 bp, Triticum aestivum
  Clone ID: PAT_TA_16329
ccgtccgcgaaaggaacaaaaagacggcgacggaagctccaagctgctcccggaccactgcggtcgtagaagccactgcggtagccgtcaccgcacttgcggggagaacactcacgcggagggagacccctccactccaatggcggcgatcaacgcgccgctgcatcctcccctcgccgtattcgccgccgcgccctgccacggagtgcgcttccgccgcgctccactcatccgcacggcggcctcctcctcatcgtcttcgccttcgttctcctcgtcctcctcttcctcctacggaggtggtgggggcggggcccggatttctaacacactttccacttggtgtgcctttccgatctcctattgaaaactttt

SEQ ID NO: 16330 - DNA, 506 bp, Triticum aestivum
  Clone ID: PAT_TA_16330
gctccctctcccgcgtctcgctttccgctccctgactgacacaacaaaatccaaaggtagatccgagcaagaatccatggaagccgagtcgagaaagctcctgctcctcgcgcccatcctgctctgctgcttcatggccagatcggaggcgcagtcgcagcacatcggcgtcaactacggcgaggtggcggacaacctgccgccgccggacgcgacggcgcggctgctcaagtccaccgccatcaccaagctccgcctctacggcgtcgacgcgggcgtcatccgcgcgctggccggcaccgggcgtctccctcgtgctcggcgtggccaaagggcgacatccccgccatcgccgccgaccccaacgccgccgccggctggctcgccgccaaagtgctgcccttcctcccgggccccggcatctccgtcttcgtccccggcggcgacgtgctcgagtccggggacgccgcgctcgccgctgcgctgctcccggccatgcagaacct

SEQ ID NO: 16331 - DNA, 972 bp, Triticum aestivum
  unsure (1)..(972): unsure at all n locations
  Clone ID: PAT_TA_16331
ggtactgctctttgggcccccggcaccggaaaatcacgatgatcgcggccatatccaactaccttgagtatgatatctacgacctcgagctcacggcggtcaataacaacatagagctccggaagctcttcattgagaccaagggaaagtccatcatcgtcatcgaagacctttaattgctccgtcgactttaccggcaagcgcggggacaagaagtttggtggtgagagcgataacatgaagaaagagcgcaagcaggacgccgatngcaccaagctgaccctttctgggatgctcaacttcattgatgggctgtggtcggcgtgcggcggcgagcgtatcatcatcttcaccaccaaccacaaggacaagctggacccagctctgatccggccaggtaggatggacaagcatatcgagatgtcttactgtcgcttcgaggccttcaaggtgctggccaacaactacctggacatcaccatcaccgcccaccatttcttcgagctgttcactgagataggtaagctgctgcacgaggtcgacatgtccccggcagaggttgccgggtacctgatgcgcgcggaggaggagtatgctggcgcgcgcctcaagggtctcgtggaggctctgaaaacacgcaagggcaacgcgcccatggataaagcgacagcgaaggaagaaattgtccatacagatgttggaggcagccgaagctaaataaaggcagataaacgggaagaagaatgaaaggacgaggccggccgcgtggtagcacttcgcagtacgtgttttgaaagtgtgtgttgccgcatggccaggtgctcaaaatttaaacttgatgcatttaatttgttctccgtttaggctgtatagttgttgttttgtatgcatgtgtgatctactccaaaactgtgtaacctaacccatgcatttacgttcggtaatactacccattttttcaaaaaaaaaaaa

SEQ ID NO: 16332 - DNA, 959 bp, Triticum aestivum
  Clone ID: PAT_TA_16332
ggcacgaggcggagacgcgcgcgagctcttcgccgccgaggtctcagccgtggccgcgcggctgggctccaccgtgcgccgcacgatcgaggagttcggaagcgccatccagggcgagtcgtcgaggaggcccgtgcagggcggagagatccaccccatgaaccgctacgtgatcaactactgcggccttctcgcggactgccgcagcacgctggacatgatcctcgtcaacaccgcggatgcggtcgacggcgacgaagccaccggcggcggcgggggcgctacgtcgacgccgtcagggcggtgcatgctcgagctgctgacccggctgctgcgcaagatggacgagaagtcgtgcctctacgacgacgccggcctgaagcacatattcctcatgaacaacctctactacatcgtgcagaaggtgatggactccccgctccgggagctcctcggcgacgactggatccgccggcaccgcggccagatccggcagtacgagacgggcttcctcccgggcgtcgtggatctccctgcttttcctgtcctcggggacgacggcggcagcgcggcgccgacggtcaaggacaaggcgaggagcttcaacgcggcgttcgaggagctgtaccggagccagacggcgtggaaagtgatcgacccgcagctccgggaggagctccgcatcgccgtgtcggagcggcttatcccggcgtaccggtcgttcctgtcgcgaccgaggccgcagacgggatcgtccagcggcagccggcactcggcgtcgaagcacgtgaagtacacccttgaggatctcgaggactacatgctggacttcttcgaaggcgtgcagaagttcgtcaagtgatcgggggaccggagcagaggacctctgcttgtgactccgcaacattcttcagaggcagctttgtgctgccgggacgtgatcgggcgatgcactgcgg

SEQ ID NO: 16333 - DNA, 616 bp, Triticum aestivum
  Clone ID: PAT_TA_16333
ctgcaggctgtcacagagggagaagagaggagaaatgggaggagttctcatgcagcatcaccaaatctctcgcactcctctgcgaaaagcggccttcgccggatcatttgctctccaaagagatgttgcttctccatcgcgctccacggcggggttctctgccgtgctcctcttccctgacgggccgagccgaagcccaacgggtcctccacttcaagaatggcggtcaagaagcacagcaaagaagagctcatggagttcttcggggccatccaggccgccattgccagggactctcccaagccgcccgggaggacgaggaagccgtcgtcgccggctgacacgctcgaagatgccggcacgaagatgaaaccacacgagggactgcagcaagacgggcagccaaattttgagggcatgacggtgcccgagctgagggacttggcgagggtgagggggatgagaggttactccaagctgaagaaaggggagctgattgatcgtctgagaggtgcttggtcgtctgataattaacaagtcttcctctccgagacagaaacagaccgaactgattcggcttacaatcgacttttcttgcgtctgttgttttcactga

SEQ ID NO: 16334 - DNA, 594 bp, Triticum aestivum
  Clone ID: PAT_TA_16334
gcctcgtgccgaattcggcacgagcgtccgccccgtcggtacacctgttattattactgtagccagtttcagttaaggtagaatggcgtggacggccgtggcggacgcgaacgccgggggattcggggtcggggccgccggagtggggcaggtcctcgacggctccaacccggccatcgtccggctccggcagctcgtcgacgggccccagtcctcagaggggtggaggcggtgctgggagcagggcgtgacgccgtgggacctgggcgagcccacgccggccgtcgtcaagctggtgcagtccggcaccctccccgccggcaacgtgctcgtcccgggatgcggcggggggttccacgcggtgggccctgtccggcggcggccgctccgtggtgggtctcgacgtctgcgccgccgtcagccaccggcccacgctgccctcccccgtcgtgcccttccgctccgccgccttctgctcccggtcgcccccgcccccggtccccctcggctgccccttcgcgtacctctaccgaccatacacactctccgactactaaacaagagttaattaatagctatgcttatgctctcatg

SEQ ID NO: 16335 - DNA, 606 bp, Triticum aestivum
  unsure (1)..(606): unsure at all n locations
  Clone ID: PAT_TA_16335
cccgaatgtcggcgtcctcggaaccttcaagagcagctcgtatgtcggaaatctggagctttgtgggctgcccatccagaaaggttgccgtggaaccctcgggttccctgcggtggctgccgcactctgaccccctctcctcctctggtgtttctccaatcaccaacaattattaaacccccgcactttctgaatggcgttgtgatcggttcaatgtcaaccatggccgtcgcgctggtcgcggtgctaggcttcctctgggtatgcttgctgtccaggaagaagactggtgtcaactatgagaaaatggacaagcaaactctcccagatngtgcaaagcttgtgacataccagtggaatcttccgtattcgtcgggcgagatcattagaaggctggagctgcttgatgaagaggatgtggttggttgtggcgggtttggtacggtgtacaagatggtgatggacgacggcacggcattcgctgtccagaggattgacctcaaccgagagaggcgagacaagactttcgagaaggagctcgagatcctgggcagcattaggcatatcaaccttgtcaatctgcgaggatactgccggctctccaca

SEQ ID NO: 16336 - DNA, 727 bp, Triticum aestivum
  unsure (1)..(727): unsure at all n locations
  Clone ID: PAT_TA_16336
attcaaaagatgctgtgagaaactctgtctgtaatgagngganataaagaggcatngcttaccattattgaagtcttcatccatgatccgttttataaatgggccctttcgccacttaaagccttacagcgtcagaaggaaactgaatacaatgactcgtgcctggatgtttttcaagaggcgtgcgaggtcaacaaggacgcggcccgtgcgatactccgcgtcaaacagaagctggacggttttgaggacggcgagatgaggagcgtagagggtcaggtccagcagctcatacaggacgctgtagacactgatcggttatgccagatgttcccagggtgggcaccttggctgtgaagcacccatgagaaagaacatagatgggagattccgaacccgcggtaaaagcgatgttgtgactgctagagaaacttttacttttggtgcccggcgcctgtttttgtgcgtgaaggtgagaaacatggatggagattccgaacccacggtaaaagcgattttgtcactgcttgagaagcttttactttcggtgcttgctcttgtgcgcgaaggtgggagagggacttatcacatcatacatgggcctgtaggtgtacatataactgttgtagatataaaggggcctcttgtctggaggatgtacgcggaagaaaggtaaaactcattagtgttgacgaaatgtaaaagaagttgcttttcaaaaaaaaaa

SEQ ID NO: 16337 - DNA, 638 bp, Triticum aestivum
  Clone ID: PAT_TA_16337
cgggatcggtggagactacaaaatggaaattttattatgttaatgtgcaaggaccggccactgttgaggctacactcacacagacaattcccgacacccaattcgttgatttggatttttttgttcagaagaacacattcccttctttccttagctattttgaaaaggacattaatgataacgccgtctcttacactccacatccccgatgcatccggcctctactacttcggcatctacggctaccaaggcggcgagtacacattcacatacacagtgtcctccccttgcaaatgcacacccaacaacggcgagtgtgttgaagggacgactgtgtgtcagtgcttcagtgggtttgccggtgatacgtgcaatgtgtcttatgtcaaagtcgagtccgcgcagcagaatgccaaaattaatgcattgggatggtactattatgccattgaggtgaatgttcagtcacgcgctgtgttatttgaacttatgttaggcggcactgagcaagagacacacaaagcggacttatatgtggccgcgaaccgccctcctacacgatatgactttgattatgccacccctgataagtcgaatgagacacttttgaagatccaaatcacaatgcccgtcacccc

SEQ ID NO: 16338 - DNA, 909 bp, Triticum aestivum
  unsure (1)..(909): unsure at all n locations
  Clone ID: PAT_TA_16338
aatgcagaatgagtacctgtatgcaagtttcccagataggccggtgncgtaaatcatcttgtatgtataccgatcagtnggatgagtnnnggtacaatcccagtaaggagttnntaggntgttaatcgngagtggntnggttcagcnatcggtgtctttgggtgtttaaccantccggaaggcgttgggaaaatggatnggttgagaatgtagtactttgatggaaggantcattagggaggtatgatgtccngtggataaacttgggaaataccgggggtaatntcggacggntagatcaaaagtaggaggttggattgaggtattgctctataggangacagtnttacacttgcaccggaaaatggtatttaaaggagaacatggtcgggaaccacggattgcaaaaggccagatcccagatataacatgaacttatacccaagggaataattaattttaaaagaagcttcgatgagaagatgtacatcgtgtccatgggcatgaacacaaagttcaaggtcgactcccacttctccaatgcatatcctttcatttacttctcgcgttcgatgaagttgtagtgttgaaattttatatggcaaaataccagaagagtatgactcgtgaaaactttcgagttcacacatattaaggaaggcataggttcaagccatcggggcttcttagaacatataccacgaacttcagaagtaaataacacaagctcaaaagtagagcatggttgataaagcagaggatacaatttaccaaaggctttatatattcatggaaaagctcacaaggttatttgaatatgaggatattgtgagataaactccaacaaaggatccggtggtcttcaagggatctgatgtgagcatcggtactcaaccagaggaaaaaaga

SEQ ID NO: 16339 - DNA, 1248 bp, Triticum aestivum
  Clone ID: PAT_TA_16339
ccacgcgtgggcgggagagatctgagcaggagagtcgagccctcggaataaatcaccgccaaaacccaacccgaagcgcacaacagaaacacacagaacggaggccgacgccgcgagagagggacacagatccgtctcgccgaccgatcgcgcacgcgcccggatcgatctcgctcgtcccgtccgtgccgccgccgcgttcggagcggcgaggggtcgacggcggaggagaggtgctgcccggatccgcggcctgagttgatcggggcgtgatccgcggttgtgcggcaatgacggccgaggggacggcgcgcggcggcgccggcgaggcgccgaaggcggaattggcggcggccaaggcggtctccccgacgggggaggagcgcgagggggtgggcggccccttcgtgatcgtcaacggcgactccgacggccactcggaccccggctccgacacgggcgccggggccgagccggattcccgcccggaggaggaggatctgccccgggccaatgcagccccggctgctgacgcgggcggagatcaccccaccgccggtggggaattggccgctccggacggcgccgtcggccttccatcttccaacgggcatgctagccccgctccggtggagtctgaggctgatggcgtgggcgaagtagaaggtgagggaagccacaattctgaagctggaccgggggaccagggcactgctgccgctggagagcttgatggtcaagatgcagcaacagaacttaagattgaccatgctgacgctgctgatgattctgctccacctgccgtggacgtcgtgcttaatgtcaaggatggagaaagtgaaaaaggtgctgccactgaggttgttgctcctgaagaacagcaggatgaagagaagaatgctccagcggagagtggttcagataaccccgccacacatgctgagtctggttccattgtcttggattctgagggcagtggcgagcagagcaaaggagaagagattgctgctgagatcatggagccaggtacagatggatcaggtatctcgggggtgactgaacagcatgatgctgacacaagtgtgactgccactgatcctgtgattcacgttgatgagggcaaacatgagcatgctgcagtcacagagctgttggagcaggatgggagcaacgggcatgaccatgttgagcagattgctgattctggcacatttgctcctgaaaatgaagctggtgggagcaaagggc

SEQ ID NO: 16340 - DNA, 419 bp, Triticum aestivum
  Clone ID: PAT_TA_16340
cgtccgcggacgcgtgggcggacacgtgggcaaacaatggagcagactgcggcgtacacgctgctgctcccggacgacgccctccgcgagatcctcctacgcgtctctaccgacgtcggcgccctgttccgctgcggcatcacctgcaagcggtggggacgactcatcgccgaccgctccttcctccgccgctgctggccggagaacgctgctggctcatccttcctgctcggcttcttccagaaggagttgcccaaggatcagccgcgatatttctccccgatattgccggggtcagtattcggttcccatcgtcgttccctgaccacctttgtctctggcgtgccggccggcgtccttaacaaagcgatacccgatcgccgcgcgacatggcctcctcctcatgcgtcacatggcca

SEQ ID NO: 16341 - DNA, 418 bp, Triticum aestivum
  Clone ID: PAT_TA_16341
ccgtccaaacagtttcgtgtaaaactctccacccagtctcccagctcagctcagcagttgattcggcgataatccgcaggcatttcggcgaatgaggaacctaaccgacaaaaggattatttttctgaatcctatttgttacatatgagtcgactgttgatacatgtttgttagggataactttggcaacatatcatacaaggatggttgtggtactccgtcagcaaagcaactctgatccctccaactctcaggttttttattcctctacttaatgatgcatgggtgtgtacttggctggttgggctacgtggttagattgattttctggaatcctttcagattgttggactatacagagctaagatagaaaactttcagatgttgtccagattggctgccttcaatgctatgtgta

SEQ ID NO: 16342 - DNA, 471 bp, Triticum aestivum
  Clone ID: PAT_TA_16342
caggctcgccgacctccagaaggacgatggaccatggcatacaagaagatccgcttgaggatcgaggacgtccaggcccgctctgccctcaccaccttccacggcctggacttcaccaccgacaagctgaagtcgctcgtccgccgctggcagaccctcatcgagtcgttcgttgaggtcaacaccaccgacggctaccgcctgcgcctgttcgccatcgccttcaccaagaagcgccccaactcgcagcggaagactgcttacgcccagagctctcagatccgccagattcgcaagaagatgttcgagatcatgacccgcgaggcggccagctccgacctgaaggatctcgttgttaagctcatccctgaggtgatcggcaagcagatcgagaaggagtgccagggcatctaccccctgcagaacgtcttcatccgcaaggttaaggttatcaagacccccgagaacgac

SEQ ID NO: 16343 - DNA, 396 bp, Triticum aestivum
  unsure (1)..(396): unsure at all n locations
  Clone ID: PAT_TA_16343
cgtccggcaagccgcaaacatcctgtgctttcccatccgcccatcttccaccgccgccgccgccgacagggcggtctccccttcctggatccgccgccggatgctcctccgccgcaccgccgccgcagcagcgcagcgctcctcctggttacccccctggcgaaccatcctcccgcacgtcggccccgcccgcccttatagcgctaccacctgcacctgctccccacaccggcagcggctgcgcacaccgcaggttacggacagttcgcttactaccaccgctgcgccccgaccgttcccggactactctccgccccgccccgactcgccggccgacgatgccctcgcgagccgtntcgccgncgcgctcctctgctttgccagcccaggctccct

SEQ ID NO: 16344 - DNA, 725 bp, Triticum aestivum
  Clone ID: PAT_TA_16344
cgccgtcggcgtccccggcggccgcaacatcaacatgccgccggcgcagtacgacgcccacttcctccaaaggcagcatcagcagcaacaacatcagaaccacaaccacaaccacaacgtcgtccggcccaacgcagcgaacggcagcggcaacccgccggcgggcaacgcggcgcctacatctgccccggcgacaagcgggacgccattcctggccatggtccagtgatgatcgagcaagacgacgacgacgacgctagcgctacaaaccaagaaagcccaggtggtaccgatctcgatctctcgtgtgcccatacggatctacatctccacatgcatgcccacttgatcgatcgattgataccccctgcctgcctgcctgccggtgctagctaggtaaaaaccctacacagaaaatttacttttgctccttccaatccaatccaatccaacaaccctaaattatttccattattgttattattgttattattcctggtgcaccatatatatatatatatgggcggcgtatacatgatgtacatgtcacacatcttcaccacactgtacgtcgaggcacggtagatgaaatggcgtgggttttgacctttttagttttcgaggatacttttggagttaccatttttgtctaacaaaagttactgtccagcatgtgtcatgtaagacttttgtgctcttgttaaatgttgatcactgtcaagaac

SEQ ID NO: 16345 - DNA, 300 bp, Triticum aestivum
  Clone ID: PAT_TA_16345
cgtccggtcgctcgcaccactccctcctccctcgtcagtcatcgtctggtcctctcgatgggggaggagtaggggatcccgccggatgagaggcttgcgggcacggtggcgggcgtctccagtagcggcggcgacctgcaggccaagggctacggcggggcgctcgatttgatccagcttaatggactggtcccttcaggagagagaaggaaggagaggagggagaaagagaggaacgaggagagggagctgcagcggcagatgggagagcatcaccgaccatcgcatctcccccccccc

SEQ ID NO: 16346 - DNA, 2349 bp, Triticum aestivum
  Clone ID: PAT_TA_16346
gaccttgcgtccattgatggtgatgatgacgaggcttgcttttttgatatgggcgtgtatgaagagggtgaaactggcaatcgacttgcattgtgggaagattttgaattaaggggattttcccccttggtgcctgcacatattatcttggatttctcaagcaagcacacatttggaagtgatggtcgacccacgcgtccggttgaagaaagcacgggcacaacggatactttctgcagggaaggctctactcaattttgtccagattgatcaactgagaatatattttgacccatcttcaaggaagtttgttgtggccaaggagcctcctgtttttggagctgccatctctactcatagatctcgcaatgcacctgaaacaaatgctgttgagctggaacatgaaattggtaatttttttgatgcagtggcaactaatcttggagcaatgcagtcgggagtacagttgtgttcagagggagaagatgatgaagaaattgttttcaaacctacagcgtctgagaagctcccaaaagtacttaccgaactacccgttaatggatatatccagcctctacagatgtctactgctgggtggccaacaatgggcggaccagttactattcagagtactgcatctgcatcaggtcctggaaactgtaatgttaatgagtcacttcccatgtcttctggtggttgggctttcaatggcaggcaagaggctatttctagcaatgtttcaatgtcgacaacttacgaatttgtgcagcctgttgagatggctacttccagctgggcaagtaatggtgcaccacttgttggccctctgaacacaatgcctactttctcagctgccatctctgatccgcgtgtatctgcagcaatggttccacattttggcagcccagattattcaaaattgctccttgaacaagaaaaactcttaatgatgggattaaataatgttcatttggctggaaatggatttcctgagcagaggtttcagggtggaccgagtggatacagtcaatggtatattctccacatgtatctgttgaatctgtgcgcaacaatacaagtttgatgcataatcaggtgaaagcgactgaagaaaccatcccatccacttctgattcaattgtaccatcagtagcagcatctggtgggatgacaatcaatctcactgatgcacctgtagctgtatcaaagaagaatcctgtaagtcgtccatcaaggcccgttggtcctcctccaggatttaaccacatcactccaaaacgccatgatgatattatgccatttgagaagctgcagcaccaacagatcgatgattacagctggctggatggctaccagccatcaatggaacgtgttcataactcaaaagctatttatcctgatgttgccactaccagcagtgcattcaccactcccttccctttccctgggaaacagcaggtttctggggtgcacaccttaggggccagtgagaaaacatggcatgatttccacctttttgaccctgcaaagcagaatatggttcaaaaccaccaacaaattaatcagcatagtggtcaagtggctgaaaagcagccggcaaaacctatcggatctggccgttatcttgtgtgacggagtagcttgtacctggatggttactactggagtcgctgaggatctgttggagtaagtggcacagcttgatatacctattcaattcggacccatacctgcagccctttcatagtgttaaatttcttttggagaatggtggtcttggaagcatagcaagtgctgctgttaggtttgggtgtgccaggtcttccggggccagttggaggttggagggtgattttgatctggggactgtctgatggagatgaattgtacgcagaacgcttggatgctcaggcatgaggggtttgatcgaaggaactcgaatccagtcactgtaggcgcgctatgtgcttcagctctcattggataaactgtctaccttacagagaatggccagtgtgtggctgctgtggtggagactaaatgccgtttagtgttgctcgtgctcatctatggctactatgaattaagttcgaggaacagttagcttgctggcaagttggccctcgaagtatactgcatctacttatgttgcatcgtttgcgtttgctgtcggcaacagcacgttataatcctccttctgcgaggaagttttacttccatatatcactatatgatttgaacaatttgttttggtctttgttgtccggtaccggtgaactcaactttttttgtgcaataagtttcttgttaccttgtcgtatgcaaaaaaaaaaaaaaaaaaaaaaaaaa

SEQ ID NO: 16347 - DNA, 1028 bp, Triticum aestivum
  unsure (1)..(1028): unsure at all n locations
  Clone ID: PAT_TA_16347
ctcgtgccgaattcggcacgaggcctacgcctcgccagatcgcacctaccctgccggcctgcccccatcacatcaatacaagtgttcgctcgctacgtgccgtcgtctccggagaccctccgtgcaccaccatggccgtgtcggagctcgaggtcgacggcgtcgtcttcccgccgctcgcccgcccgccgggctccgagcacgcccactttctcgccggcgcaggcgtgcgggggatggagatcgggggcaacttcatcaagttcacggccatcggcgtctacctgcaggccgacgccgccgtctccgcgctcgccgccaagtgggccggcaagcccgccgccgacctcgcctccgacgccgccttcttccgcgacgtcgtcaccggcgacgttcgagaacttcacgacggtgacgatgatcctgccgctgacgggcgcgcactaatcgggcaaggtgacggagaactgcgtcgcctactcgaaggccaccggcgtgtacgcggacgccgagcccgccgccgtcgacaagttcaaggaggccttcgggccccacagcttcgcccccggcgcgtccatcctcttcacccactcccccgccggcctcctcaccgtcgccttctccaaggactcgtccgtgccggagtccggcggcgtggccatcgacgacgcccggctctgcgaggccgtgctggagtccatcatcggcgagcacggggtgtcgccggcggccaagctcaacctgggccaccanggtcgccgagctgctggaggggggccgccctcccccggggggnaaccnggccccgaagccttttcgtttcggtgttaaaaaaccggggggcatcaccgcgcttccntcacggtgttgtngctttttttgctggtgtttccnttgtnggactcctgttccctccatttcctcaacgtttgttnggtttctcccctggaacatcaacatgcgtggataataanatccgtggggattacttggnttaataaaaaanctttntttanaaaaaaaaaaaa

SEQ ID NO: 16348 - DNA, 742 bp, Triticum aestivum
  unsure (1)..(742): unsure at all n locations
  Clone ID: PAT_TA_16348
gggagaaaatgaaatccttcctccgccgctatgggcctccttgtccaggcccctaacctcgccggcgctcggcgcccgaccgcccgcgtcctccggagcgaccgcggcgggcggttcaaggtcaccgccgcggcgtccggtggctctgtgaaggaggaggaggaggagaaggggaccggaaagaaggagaagatagtgattagagtcttggaccccgttcgcgagaggaggctgccgccgcctctgttctcggccccagagactccggcagagtccccggcggcgattcggcgcccggaagaggacggggaagaaaggcggaggtactacgtgaacatggggtacgccatccggacgctgagggaggagctccctgacgtattctgcgaggaacccagcctcgacatctacagagaagatattgtcttcaaagatcctctcagtaaattcgtgggtattgatagctataaaaggatattctgggcgctgcgctttaccggtcagattttcttcaaggccttgtggattgacattgctactatatggcaaccagtcgacaatgtaattatggtccggtggatcgttcatggcatccctagattcctacaggatggtcctagccgctttgatggcatgtcagagtataagttggataagaatgggaagatttaccagcataaggtgggcaatgttgccatgaantttccaaaagaagttaaaatnttgcccgtccaaaanccaa

SEQ ID NO: 16349 - DNA, 990 bp, Triticum aestivum
  unsure (1)..(990): unsure at all n locations
  Clone ID: PAT_TA_16349
gagggcgctggacacgctgtgcgggcaggcggtgggcgccgggcagctggacctgctgggcgtgtacgtgcagcagtcgtggatcgtctgcggggccgccgcggtggcgctcacgccggcgtacgccttcgcgacgccgatcctcgggtccctcctccggcagccggccgccgtcgcgaccgccgcggggccgtacgcgcggtgggcgatcccgcggctgctggcgcacgccgccaacttcccgctgcagaagttcttccagacgcagagcagggtgtgggccctgacggccatcaccggcgccgcgctcgccgcccacgtcgcgctcacctacgtcgccgtcaaccggctcaggtacggcctccgcggggcggtcgtcgcgggcaacgtctcctactggctcatcgacgccgcgccgggcgcctacctggtcagcggccggttccccgacgcgtggaaggggttctccggtgtcgccttcaggaacctcgccgccttcgtcaagatctccctcgtgtccgccgccgtgatctgcttggagttttggtactacgccgcattactcattctggtgggtctcctcaagaatggccagctccagncttgaaatatcatgtcacgtctgcatcaactacgagttctggaccatgatggtggcgctgggcttcagcgaagcggtcagcgtcagggtgtcgaacgagctcggagggagcagacccaaggatgccaagttcgcggtggccgtggcggcgatnacatccgcactcatcggggccaccttcatggccgtcttcttcatctggaggagaagcttgccgaggctcttcagcgacgacgaggaggtggtcgacggagcggcgaggctggggtacctgctcgccgtcaccgtcttcttcggcagcatcgggccagtgctctcaggcgtggctgtaggagcagggtggcagttgcaggttgcattcgtgaacatcggttgctactacttggtgg

SEQ ID NO: 16350 - DNA, 688 bp, Triticum aestivum
  Clone ID: PAT_TA_16350
cccggtcgacccagcgtccggcctcctgggtggcgcagggcaagtactacacccacgccaacaacacctgcgccgccggccagcagtgcggcacctacacgcaggtggtgtggcgccgcaccgccgaggtcggctgcgcgcaggccagctgcgcctccggcgccacgctcacgctctgcctctacaacccgcacggcaacgtcaagggcgagagcccctactagcggccggcgtgtcgggctggtggcggcgcctcttgcgttggggacgtcgccgccgggcgccggagcatcgatcgctgttagagttaaaagtacgatctagcttcgtgtctcaggttcagttaaggatgatttgtgttgtgcacttgtggtgcatagaataactactgcttagatatcagaaactcatgtggtgacgtgcctagcatattgtgtggaaaatgaacttgtcttgtgctcggcgagttcctacttccgagggtgaacttgttatcggagaagtttttttattataccgcgccgcgccacttcttgtccttcaacacaaacaaagcctgcaggcgccagcaccaccgctcctcctccacttcgattcaaatcacacatcagctccaaggaaggaagccgtcagccttgtccggccgcggcaagggagggaagggcctcgactagggcgcagccaacct

SEQ ID NO: 16351 - DNA, 835 bp, Triticum aestivum
  Clone ID: PAT_TA_16351
tacctccaccgtccgcggacgcgtgggcggactctcagtcctcacttcactgctcactgctcgccattactgggctcacccaccccagatctcatggctccccagcgccgccaccacgcggcgtgcctcctcgtcctcctcgcgctgtgcgccgcgccggcccacggcggcctcgcgctgccggccagggtcagcaaggcgctggcggcggcggccaacgcgacggcgacggcggacgagttcctggcgccgcacaacaaggcgcgcgcggcggtcggggtggctgcgctgcggtggagcgccgacctgacggcggcggcggcgtggacctcgtcccagcagcagaagcagaagaactgcgcgttcgcggacatgggcgccagcccctacggcgcgaaccaggggtgggcgagctaccgcgcgcgcccggccgaggtggtggcctcctgggtggcgcaggggaagtactacacccacgccaacaacacctgcgccgccggccagcagtgcggcacctacacgcaggtggtgtggcgccgcaccgcggaggtcggctgcgcgcaggccagctgcgcctccggcgccacgctcacgctctgcctctacaacccgcacggcaacgtgaagggcgagagcccctactagcggccggccgggctgggctgccggcgtgtcaggctggtggtgtcgcctctgcgttggggccgtcgccgcccgcgccggagcatcgatcattgttagagttacaagtacgatctagcttcgtatctctggttcagttatggatgatttgtgttgcgaacttgtggtgcctagaataactactgcttagata

SEQ ID NO: 16352 - DNA, 1694 bp, Triticum aestivum
  Clone ID: PAT_TA_16352
ccccgaggcatcttcgtgcggaccgtggagctgggcagcgtgtgaagctagatattggtgtatccactgatgtgattggatatgacgccaaatgtcgtagaccttataccaagggggagagagcaactgagaaatcatcgtttcatgttttctttaggtgaacgatcaaacattttgaaggagattgatcagcctggcttggtaccttgtatatctgaagctaattccttgaaatacccatatgaagttatttttaggagcctacaaaagcttctgatggacactgctagctctgagtatatttttatcaaagcattctttcgcgatgagtcgatgttttatcgagtttttgaaggacctgttgcagtcgtccgcccacgcgtccggcttactcttgcaaatagtcatgatgcaatatgcctgatgctcatgatctgcataactaaaaagcaccagctggttatgtccaacaggcggcttccttgtctagatacatatttggataaggctctgatctatctctggccacgtttcaagacagtgtttgacatgtatattcaaagcttgtaccaatgtgatgcgaaaatgttatgggtggatgggacccatccacaccacattgtaaggtgctacatggagttcacagcatctcttattcaacttaatgctgaatgtggagatggtcagcttgatatgagcttgaaaaggttgcggttagctgttgatgatctacttgttagatttgccgaaaagtttgcaactcaaaaactgaaacacctgttgcgcttcatggagtgcgccgcggccctctcctcccgccgggttaggtttgtgctttcatgcaaataactattcatattgtgctcctttcagcctatttgggtttaccatgcctatttatttcaggaagctggtgaagaagcaaaagaactgcgaagatattttgaagagaagctggaaagtaacctggtgtcatttgtggatgaattgctcatggagtattttggtgatttaattaaatttgtgaagaaccacatttccgaagacctaatttcttacactgagtgcccaaacattgctgatgttgagccggttgtgaagaacttcgccgtgaagtggagaactgctctagagctcatgcacaatgaagttgtaacttgttgcagtaactttgtgtctggtatggcgattctaaaagcagcaatggctcagttgcttaatgactacaacagactctcagaatgtgtgaagatgatcccaggtggatcttctttgaacaggaatctggtttctatcacctcgatttcatacgaaatcaggaaatattcaagaacactctagttacttgaatagcatggcagccacgaacgtatcctacgcctctgtgtaattgaggctcaaataaatgattgcggatggactctcaggatcaaagctggagaggaacttgtgctctgtcaagcaataaagagctgaaaaatacatcagtgttgatattttttaatccctgtaccaaataatgtcacttgtagttggatttcaacattaggcaatagtgcaaattaggatattatttattttttcttatagcttattttattggatatactatcgctgaaagttgtggacaaaatgatactcgtcaattatgtcctagtcacagttttttccaaaaaaaaaaaaaaaaaaaaaaa

SEQ ID NO: 16353 - DNA, 515 bp, Triticum aestivum
  unsure (1)..(515): unsure at all n locations
  Clone ID: PAT_TA_16353
acgacatatggtcgaccctaacatgtgtgagaatgtgcaccctctcaacggcgagaagaaaacatgtatcggctccgtggaatcaatggtcgagtttgtctcatcgatgctcgggagtacacgcgacctacaagctttctcctcattcccaggttgccccatgaaggtgtggtgaacaaggaaggaggtacaaagtagtggcgtcatgaaggcccactgagtcgagtgagactgcgacatgccacggcatgaacttcccatatgcggtgtttatgtgccatgccatgaaccctactagggtatatgcggtgacgctngagagcgagcacgacggttgcgaagcgcagaagatggaagtgcttgtcgtgtgtcacctcgacacgtcagggtttgaccctagtaagatgccaaagggcatcaggcctgggcaggccccagcttgtcactttgtcggcagggacaccgtcctctgggcgcctgctgctgctgctgccaccaccaccactgctgcttaa

SEQ ID NO: 16354 - DNA, 433 bp, Triticum aestivum
  Clone ID: PAT_TA_16354
cgtccgcggacgcgtgggcggacgcgtgggggcggcggcagcgcccgtttcatgggcccaaggcatgctccgccacggccctcccacggccctccgccggccaagcggcgtctctcggcaccggtggtactggcgtgttcctgccgcgcgcccaggggtaccagtaccagcacaaggctgcgagcaaacctccggccaaaggtaacgcccggcgcctcttgctttcttgcgctccgttctgcgttactgctgctacggtttgggttttgcatggatctcgtgttgggctttgggccgcttgggtgcatggttgggaataccaaatcttcgctgcactcgtgtgaacctactgcgcatgcttcttcatcagttattgatttccctaaaaaaaatcagttattgatgttttccttggcatggagtactacttttc

SEQ ID NO: 16355 - DNA, 595 bp, Triticum aestivum
  Clone ID: PAT_TA_16355
cgtgcgtggacaggttgtgcactggccaggaggaaataggcggacgggcagtgtagcaccagcctcgggatgccgagcgccgtgcaaatgcccgccgtccacgggttgcacctgttcggcgacgaggcagtccggccggcgcggcagcgcacggacgttcccctgcaacggctcccgccatcttccagatggcctggaagaaggcgaggtacatggcactgctgacgtcgtcgagcagctagtcgaggttctccagcccctccggcagccccagctgcggtccgggaaaggggagctccgcgagctcgacggcgaggcccgctctccgggcgctgtcgacggtgaccctgttccgcgcgccgttgacaggcgtggtgacgacggtgacgcgcggcccccgcgcggcgaggagacgcgccaggtccaccatggggatcatgtggccttgcgccaccagcggtaccagcaagaagtgtagctccgacgccgccatgtcttccccgctctacgcactggtcaacaatggcggcagcaacggcgagcggttcaggcttatccatcgagctggacagtgtgaggcgtccggcacgaccga

SEQ ID NO: 16356 - DNA, 724 bp, Triticum aestivum
  unsure (1)..(724): unsure at all n locations
  Clone ID: PAT_TA_16356
atacttgatcaatttataccaacaccacacgtacgtacgtagtggccctaaacagcgccgcttttgcttgctgctcgtttggacgggctgtttttcttttttcttttgagtagatagatcaaccaattagacccaaaccaccctcttcttccttggtctcctagttacaatcttcccatagtttcttccttgccatgcttgcgtgtgctgccacgtacgcgtgccttgcgtgacaatcacggcacatatatttggttttatcatcagtgaaatgtgtcacacccaccctatcagcttatcatcatcatcgtctatctactcggagccggggacttgggggccaccaacagctccgcaaacttcatcaccttgggagacgctctgcagcacctcgtagggcgtcacgtcccccgtcaccaccaccttcttgttctccaaatccacctcaaacgacgacacaccttccatcttgggagatgtgcttctgaactttcctggcgcacccgtagcagtgcatggacaccctcagctccaccgcctttggctccagatggaaggcgggtctcgccccccccccgccctagtccttgggcggccgctgcccgtcccccttagcgccgatacccgccacggcgtcnttaaantcngacnggaaaccgggtnccaactaacgctgagaaaacccttccacngntaaacaaaggcnacgttcctcaanttcanc

SEQ ID NO: 16357 - DNA, 625 bp, Triticum aestivum
  Clone ID: PAT_TA_16357
gcggtgattgtgccgatggagccgatcaaccatgtcgatgccaacggcgatccaccaccaccgtcctctgaacatgactcaactcgtcctcggcggcggcagccttaaatttcccaaccttggcagcggtgccactcatgaagaaggtgatggcggagtttctggggacgttcatcctcatgttcatccaggtgtcctccataatcatggacgagcagcaccacggcgtggtgggcctcatgggcatcgccgtgtccgttggcttagcggtcatggtgctcgtcttctccatcatccacatctccgggtgccacctgaacccggccgtgagcatcgcaatgggtgtcttcggccacctcccgccggcccacctcgtcccctacatcgccgcgcaggtactcggctccaccgctgcctccttcgccggcaacgcgatttaccaccccgtgaaccctgggatcaccaccatcccgagcgtcggcacggtggaggcgttcgccgtggagttcatcatcacgttcatccttctcttcgtcataatagccgttgccacggaccctcatgcagtgaaaaaattgatagcagtggcggtcggtgcgacagtagtgatgaatattctcatggc

SEQ ID NO: 16358 - DNA, 410 bp, Triticum aestivum
  Clone ID: PAT_TA_16358
cgtccgcccacgcgtccgaagaaatcgttccgttccgtgcccgccagctccgcaatcttttatgtgatctcgggccatcattcataaaagcaggacaggttctagctaacaggcctgatattattcgtgaggattatatgagcgaactgtgtatcctacaagatgacgttcctccatttgctaaccaggtggccttttccataattgaggaggaacttggccagcctctagaacaactattcagcaaaatttcatcagagacaatagcagctgcaagtctgggccaagtctaccgtgccacactaagagaaaccggcgaggatgttgctatcaaggttcagaggccagggattgagccaataatattccgagatctgttccttttccgcacgctggctttctttttgaat

SEQ ID NO: 16359 - DNA, 637 bp, Triticum aestivum
  Clone ID: PAT_TA_16359
gcatcactccgatgtccaagttgcaagggcaattctcgagaaccctaatgacaaaacgaaggttcatctagtctatgcaaatgtcacacctgaagacatcttctgaaggaagagctggacagcctggccgaagaatatcctgaccgcttcaagatcttctacgtgttgaatcagcctcctgaagtctggaatggtggtgttggctttgtgtcccaggacatgattaagactcactgtccagcacctgctgaggatatccagatcttgagatgcggccctcctccgatgaacaaggcgatggctgcacaccttgaggagctcggatacacaaaggagatgcagttccaattctaagtttccggagctccaaaataaggcccccaggccctacattatccagcatggagactgtccgacccctcttgatatcttccagaagcgatgcatttttagtcttgtagtacctcctttttcgcggccaaatgttagctgcatagctaggcagaggcccacatttcgctcgactccacctctattattggtttgaaaaatgagcatagggtgagtccaacagtcgactgcatcaccgttttttttttggcgaacaagatcactcattggtaaaagtttgtactgt

SEQ ID NO: 16360 - DNA, 1345 bp, Triticum aestivum
  Clone ID: PAT_TA_16360
cgtccgcggacgcgtgggcgcgcccctagcctaccccagctatcaaaccccgccccgaggcgccgcgcgcccaaccaacccccgccccgagggacagcgtcgcgagggagacagacagacagccgcgcgggaggaagggggccatggatttcctgcaggggcggagcgtcgagaccatggtggccgtcgccgtcgcggtcgtcgccgtcgccgtgggcggcgcactcctcctccgccgatccaagaggcccaagggctgcttggatcctgagaacttcaagaagtttaaacttgtggaaaagacacaaataagccataatgttgccaaattccgatttgctcttccaacccctacctctgtgttaggccttccaattggtcaacatatcagttgcagaggtcaagatgctacaggtgaagaagtaatcaagccttacacacctactacattggattctgatctcggaaattttcagcttgttataaagatgtaccctcaaggaagaatgtcgcatcacttccgtgaaatgaaagttggtgattatatgtctgtgaagggacctaagggtcgtttcaagtaccaagtaggacaagtgagagctttcggaatgctggctggtggatctggcattactccgatgttccaagttgcaagggcaattctcgagaaccctaatgacaaaacgaaggttcatctagtctatgcaaatgtcacacctgaagacattcttctgaaggaagagctggacagcctggccgaagaatatcctgatcgcttcaagatcttctacgtgctgaatcagcctcctgaagtctggaatggtggtgttggctttgtgtcccaggacatgatcaagacccactgtccagcacctgctgaggatattcagatcttgagatgcggccctcctccgatgaacaaggcgatggctgcacacctcgaggagctcggatacacaaaggagatgcagttccagttctaagactccggagtacagcaaaataagccccccatgccctacattatccagcacggggactgtccgacccctcttgatatcttacagaagcgatgcatttttattcttgtagtacctccattttcgtggccaaatgttagctgcacaccttggcagaggcccacatttctttcgactccacttttatcattattggtttgaaacatgagcattggatgagtccaacattcgaccgaaagaaatcacggcatcgccttttttttttttgcgaacaacaaaaaaatggtaaaagtttgtattttttttcccaacgaataagtagggtggtgccttcaaaaaaaaaaaaaaagtcgacgcggccgcga

SEQ ID NO: 16361 - DNA, 801 bp, Triticum aestivum
  unsure (1)..(801): unsure at all n locations
  Clone ID: PAT_TA_16361
cagcagcgccacccagaggttccatttcgagccgaagccggcgagcgagaagccgttccacatcgagatcccggcggcgaggagcggcaaggagccggaggtgatcaccttcagctttcgacaactcggtgtgcacctcgtcggcggccacgntccttcttcaaccaacttgagcagccagctgatcaccattgtttcggggacctccgcctgcgcgccggcgtccaggaaggcggcgcacaaagccgacgatgacggcaatgccactgcccgaagaaaaagaagccgagggagaagagggtggtgaggatgccggcggtgagcgacaaggtggccgatataccttccgacagttactcgtggaggaagtacgggcagaaacccatcaaaggctctccacacccaaggggatactaccggtgcagcagcatcaaggactgcccggcgaggaagcacgtggagcggtgccgcggcgacgccgggatgctcatccgtcacctacgaggaacgaccacgaccacgcgcagccgctccacctcgccaagctcaacggcaactccgaaagcctgacgaaaacgccggtaacaaaagaacctgaattttatgcatggntggacatgcaatcaacctgaccaaatctgaatgcaaatgaaaattgntgaagaaggcaanattcnctgcgtcnttccaatgtntaaatgaacactgattgcctttgaattgtanccaaccaaaaatcctccnttcaaatgcttgttaaattcctggtanaacaatgctaacttgcttgtttgtttcant

SEQ ID NO: 16362 - DNA, 568 bp, Triticum aestivum
  Clone ID: PAT_TA_16362
ctcgtgccgaatcccccccgcggccaactatagctcacactagcgctctcccgatcgaccgatcaatggcgtcgctgtccatgagcgcggccgggagggcagggtggacgccgaaacagaacaagctgtttgagcaagcgctggcagtgcacgacagggacacgcccgaccgctggcacaacgttgcccacgccgttggtggcggcaagtcggctgatgacgtgaggcgctactacgaactgctcgtccgcgacgtcgccaacatcgaggccggcaaggtgcccttccccgcctaccgtcccccctgccccggccccaacgttggctacgaggccgacaggctgaagcacttgaagatctagcgagatagatggtatatacatggatatgaagcatgtgcgtgctggccagcatggatggggatatcctattatatgatatgcatgcaagtcatggcgtgcatgcaactgtatatgcaaggctgctagcttggaaagaaagagtcgacgatgcatgttcatatggttacgttgcttgatatatttgcaataatagctagtacaataca

SEQ ID NO: 16363 - DNA, 406 bp, Triticum aestivum
  Clone ID: PAT_TA_16363
cgtccggcacgcctctagaggccctgggcgacattacatctctgtactacgacgaagagcgtgaggagatcatcaccggcaaccatcaaggcctcatccatgtgtggtcaaattaacagcttggtccagtgcaggcaggttacatcaggcaccaggggatcttcgttagcatttagctagtagtggcaccagtttagtgggcagcctgacctagccgtgggtatctttcgccgcatgggccttcatgttgggaatgtttgtgtatagtactgtagttcatccatcgccagcctgttagctatttgacatttgtcatgtgttttttgggggatccgtgtagctttaggagatgcttatcataggggtcatcgaagagggatggtttcgggtgcatcgcatgtaagca

SEQ ID NO: 16364 - DNA, 826 bp, Triticum aestivum
  Clone ID: PAT_TA_16364
gatacagaagtgagcagcaatgagtttgtgactccatcagcttttattttcctgtacgagatgcagctgttcctgaccttccgtaatcgatcggtatcagtttggaatttcccgtggtgaactggtgacatcctttgaggatcatttcttgtggcatcctgattgcaatacaaacagtatttacataactagcaaccaagacctaattatctcttactgcaaagctgaaccggatgatccatcttcagaagacaatgcctgctctataaacatcagcgatatattgactgggaaatgcatggccaagataaaggcagggaacctgtgcaaacagaagtcgtcgaagttcctgtgtacgcctctagaggccctcggcgacatcacatctctgtactacgatgaagagcgtgaggagatcatcaccggcaaccatcaaggcctcatccatgtgtggtcaaattaacagcttggtccagtgcaggcaggttacatcaggcatcaggggatcctcgttagtatatttagcttgtagtggcaccagtttagtgggcagcctgacctagccgtgggtatctttcgccgcatgggccttcatgttgggaatgtttgtgtatagtactgtagctcatccatcgccagcctcttagctatttatcagctgccgagttgacatttgtcatgtgttttttgggggatctgtgtagctttaggagatgcttatcataggggcatcgaagagggaaggtttcgggtgtatcgcatgtaagcattattgacctttaagctattaaaaaaaaaatgagttaaaagtgctaaaaaaaaaaaa

SEQ ID NO: 16365 - DNA, 1480 bp, Triticum aestivum
  Clone ID: PAT_TA_16365
attcgacccccggcgaagcaaattcagatgctcggtgcacggctcggagatgcccttgctccccgatcccaagtcgtcaggttcgctgcacctcccgtccccgtggtgccctcgccgtgacctcaccggcggccgctatgacctcgccggcttccacctcttcctggttctccggaatcgtgcgcacagcatccggcaatcccccttcttcagccatgcctcccgccggcggcgtcacctccgcccccgtctcccttcccgacacccctgctgccgtgagcggcaagggtggcgtcgttgcccctgtagccaccacaggcgtaggtgctcgcaggaagcagctccagggcacgctgttcaagtacgggcccaagtccgctcaggttgcgtttaggactggtgattttacccgtcaggtgattttcattggtggtttggcagatgggctcttagcaactgattacttggaaccattgtcacttgcgttggaggttgagaaatggtcactggttcaaccattactttcttcatcatatactggatacggaatttccaccttggagcaagatgcattggaacttgatcagctcatcggttacttgataaataaagataattctgaaggagtaatactgctcggtcacagcactggttgccaggatattatacattacatgcggacaaactttgcatgttccaaagcagtttctggggtaattttgcaggccccagtaagtgacagggagtatagggcaactcttccagaaacaggagaaatgatagatctagcagcgaaaatgattagtgcgggccgtggaatggatttgatgcccagagaagcaaattcagatgctccaattactgcctacaggttccactccctttgtgcatatatgggtgatgatgatatgttcagttctgatcttagtgaagatcagctgaagcagagacttggtcatatgtcaaccacacagtgcctggttgttttttcaatggcggatgagtatgtccctgaatacgtcgataagaaggcacttgtagacagactctctcgtgcacttggagattcagagaaagttgaaataaaatggggaaaccatgctctttccaacagggtgcaagaggctgtcgaggttattgtagattttgttaagagggagggacccaaaggatgggacgatccatggagctagatacaatagtcatatgatgcaatctttacccccctttacctgttagaatctttcgtttttgtagttttcttagtcaattttctatgtactaatgttctgatctatttaattttattgtgtaaacccttgtctagtacttgattctcgatctcgtgttcatctgtggacattcagatatgctgtttgaaaattgtaagttgtaatgctactatctctggaatgttcctctttgtctattcagagtgtttttttaaggcttaaaaaaaaaaaaaaaaaaaaaaaaaaaa

SEQ ID NO: 16366 - DNA, 1107 bp, Triticum aestivum
  Clone ID: PAT_TA_16366
ccagcggaaattgaccacagggcaactttctttggcttctcttctggacaatattcagtattacaatgtatgcagaagactgacaaatagatggacatgattaacatggaactccaacatttgattgaacatagaagttgcaatatcatcctccccacaagagcattggcgacagacataaatacttactaccaacctagatagactcttttgctcactatggcagacgcagcagaccatttagagcacttatttggcaggaacgatgacataaaaataaaagcagtatcacgggatacaccacaccacccgtggcggcaggctttgcctgtcacgcagccacctgctaaaccgaaactcccatagccgcacaccaccacacagaccagacaccttcctggatctcggccagcggcacctctaccggacaatatcataaccactcaccggggacacaccacgccttgccgaacacccggcccgctcccaacccgacaccacccttcatccacggtcgctcggagtgacacggcgccaggggcaaccgcactgaagctctggtacatgagcaggccaccgccgggaagctcctgctcgacgacatcctcgagcacgtacgaggagccctccgcaccgcccgcccatgatttggcgaagccttggccaccgaagatggtgacggcgagggagaagtctgacgggcggaagcatgacagcaccctcttgatcaggtcactgtaaaccagggagccagggttgaagttcatcgcttcgtagctcgcgtagctgaagccctcctcgggagtaacgtggattgtggaggctgcagggccgcagacgccgttcatcgagtagccgcacgggtcgaagtcgaagtcgcagatctccatctcggggatgatagcagagatccccgagaccttggtcatctccttggccgaggagcagccgccgtcggcagacttcttgaagaacaccgcggccttcccggcgtggagcgcagtcatgcacatctcgagcgtcaccatgggttgctcagactcctcagtggcgtagtagacgtgccacatcttcttgggcctgaacgcatcacccatcacatatgca

SEQ ID NO: 16367 - DNA, 438 bp, Triticum aestivum
  Clone ID: PAT_TA_16367
cgtccgactcactgtcactcagctctcgcttcccccaagccccaacacagcctccgcctccatggatccccgcggcggcgacttcccgtgcatcgtccaagccctaccctccgtggatccgaacgaagccgcctccgactcgccctgcatcgtccaggccctagcggcgtccccctcgccgtccccttccaaagccctcgccctcacgcccgcggccagagaccagccgccgcccgccttcaaatcctccaggcccccgagcccccgccgcacgcgctccggccgcgcgcccgagtggaccgccgccgagaccctcgcgctcgtcgccgccgtcgccgccgtggacgacgacggctgggcccgctccgtctccgccttccagaagtgggccatcgtcgccgagaacatcgccttctccgatgccggtggggcgccctc

SEQ ID NO: 16368 - DNA, 1047 bp, Triticum aestivum
  unsure (1)..(1047): unsure at all n locations
  Clone ID: PAT_TA_16368
cagtacgtggnatgacagtggcatctgatcctcgggctggtcttgatttccgcagtaccaccaactgtaaaatctctagctgatctgctgaattcagaactctttatatattctgatccgcggatgtgatccagctggtacacggttgttagcggtaccgacaattctattccctgtactgtggtgcggtttccgtctttgcccttgcgtctgtccgttgcattaggctcacttaactttttcactttggaggacaatctttatgtaaggctgcaagggttagttgttccttgttgagccttgcaagatattgactgccagctccacgccgatctgctcctccgcatggcccgcccgtgtgggagagcgacccccggctcccctgccgatcctggcaagtgggggggctgggcgtcctcccccggcggcggcggcagctcccccctccgtgctgatgtattcccctccctgctctgctgctggaagcaacggcgggcggagcttcgcggccggagccaacccgctcgcgttgctggaccatgccatggatttcgacgagcacgtcctttttcctatgcacaatgcagggatgcaagatggagttcagttctacaatcctactgctggtggtacgtccgcggacgcgtgggtgagcatggagaagggtttgaagggcggtaaaaggaagggctcgggcgagggcagttcgactatgcattcgcaagaggaaaccggtgccatgtctcagagagaagtcagcatggagcgcgctggcgagaaggaaggcgatgctgctagcaacagagaggactacgtgcatatccgggcgaagcgcggccaggcgaccaacaaccacagccttgcagaaaggtttcggagggagaagatcaacgagaggatgaagcatctacaggacctcgtcccaggctgcaataagatcacaggcaaggccatgatgctcgacgagatcataaactatgtgcagtccctgcagcggcaggtcgagttcctctcgatgaagctctcggcgggcagccccgagctgaa

SEQ ID NO: 16369 - DNA, 413 bp, Triticum aestivum
  Clone ID: PAT_TA_16369
cgtccggtcgcccccatggcgccgccgcccctgcctcctcacctcccgtggcccgccctccccgtcgcgtctcttctctccgtcgccagtcgcggaagccgctgcgctcctcttcctccctagctgcagcgcgcgggagggcaagaagttgacccgaggtcacccgcctccaatccgacgtgcgaggcaccaagaggctgcctccggtcaaatccgtctgcatcccacgccgtcatcatctagcacgagtttacctcatcatcgttctcctccaagcgccccgtgcgagacgagccggccagatccacgcgtggtggcattgcaggacctgctcccgcgccttcgccgacgccaccggcccgcacttcccggtcaggtactagctccccgacaagggccttgacacgctcatc

SEQ ID NO: 16370 - DNA, 421 bp, Triticum aestivum
  Clone ID: PAT_TA_16370
cgtccgaaactatgctgtttcacttaaataccactcaaactttgttctgtcattttcatccacttaaggccaattttttgttctctgtgctatcatttaccctttttaaaaatgaatcgcattcaattaccttatatataaaagtgagggtgtacaagactccacatagctcaagctgtgctcataagtcatagcagggcaaattcttctgctcataagtctcaggttccttgttcataggacttacttttattatacgtaacatgcattagagtgctgataccccaaatctgctttgtctattatgctacttgaaaaaaagtggctggtggttaatgcatatgctgtcactagttgccaggtatgatggtcttgaaaaaacagatatcctttgcatgacttgtataatgccaaacaaagt

SEQ ID NO: 16371 - DNA, 590 bp, Triticum aestivum
  Clone ID: PAT_TA_16371
ccgtcccgcccaaaacccctccacccccctgccacgcggccgcccacgcgtccgggcggcccccagctaccctccccccccccccccctaaaaccccccgcaaagcccccaccagcaaagccgccccacaaccctcatcaccatggctccgggggacgccggcgtcgagcagccacgtaaggcgcatcgcgtggccaagtcgggcgcgaaggcccggaaaaagggcaaaggcgcccccggcgacgatgaagggggcgagaggaagaaccccaaggcctttgccttccgttcagcaacaaaggcgaagcggctacaatctcggtcagcagaaattgaacaacgccgtctccatgtgccaatcatggatcgctctattggggaaccacctccttttgttgttgtagtccaaggacctccgcaggtcggaaagtcgctgctgataaaatgtctagtaaagcactacactaaacaaaacttgtcagatgtccgcggtcccatcacggttgtatcaggtaaaagcaggagggtgcagttcttggagtgtccaagtgatatcaatggaatgatcgacgcggctaaaatagcagatc

SEQ ID NO: 16372 - DNA, 441 bp, Triticum aestivum
  Clone ID: PAT_TA_16372
cgtccgcaaggatactgcgcactccgatctataatatcagctctctatagcgaccgtcgctgtcgcccacctttcgccctgtaggcaagaacaagacggcatggcttgtgcgagtgccgcgatccgaaccataaacagaaagattgccccacactaccctgtcacaactgtgggggaactcttcacacccgaggcacttgctgttacacggatcctgtttaccgcgttggagaaagatgtcccagatgtggtggttttcaacacggggtacccggcaagcccccctgcccagtccaagaagctcatgctcgcccgcctatgtgcccgcggtgtcaagtgccacatcgtccaagagactgccctcatcgtggagccgaatattccgggtggacaagctccgacagatgcacgcaatgcaatgaaactggtcattttttcccc

SEQ ID NO: 16373 - DNA, 270 bp, Triticum aestivum
  Clone ID: PAT_TA_16373
cacaggttcccgagtcgacggcgtgccagtgccgcgcaacacgggctacgaggggtacttcgaccagtttggcgggcagaggaactactacgcgaacccggacgagcccgaggtggggatccggcagatcatcccgtacatgctctttctcgtctcccccattttcttcgtcgcttttatcgctttgagaaagtctttgatgctgtaatataagaaacgagaaagctatattcctgccgtccgaatttttgcaaaaaaaaaagagagaag

SEQ ID NO: 16374 - DNA, 492 bp, Triticum aestivum
  unsure (1)..(492): unsure at all n locations
  Clone ID: PAT_TA_16374
tttncntccccnagtnggcccancttgtnttggatttcncnttgtgcaggccccaggggancccntttggccattnnttttgccaaagttgaanttcccccccccaaaccgacccggtccagccaaggaaggccaaagatttttcattgttcagntttcagggcggcggatttcttgaaggtcgacggcgtgccgatgccgcgcgacacgggctacgaggggtacttcgaccagtttggcgggcagaggaactactacgcgaacccggacgagcccgaggtcgggatccgggagatcatcccgtacatgctctttctcgtctccccgattttcttcgtcgctttcatcgctttgagaaagtccttgatgctgtaagaaagcaacgggaagcgtatgctagttcacagcttcattgtctcatagtatgctgatgttcatctttgctcgttgccttttggggcctggcttaaaaaaaaaaaaaaaaaaaaaaac

SEQ ID NO: 16375 - DNA, 419 bp, Triticum aestivum
  Clone ID: PAT_TA_16375
cgtccgggatggtctcaggaaggagaaggatgcacgcgtgatggagttcaacgccgtgatcaaccgtctcctctccaaagttcctgagagccgccgcaggagaaagctctacatcagaaccttggcggtggttccactcacagaagactgcggactgaacatgatggacggtttgggcatcgctgggagggtgtcgtgtttctgaaggtgtgctgtcggtgctgaggggcggcaaggaggctctgatgacccgctggtggagtggaccaagaccagcaagtccagcggaggggagctaggtccgcaatccacaggcacagcacagggatgaccaacatcgtacattacgctgaagccactggcatgtactacatgcatatttgaccaccgctaagcagactgtgtctctcttgtgctaa

SEQ ID NO: 16376 - DNA, 578 bp, Triticum aestivum
  Clone ID: PAT_TA_16376
ttgcgccgcgcagctgcacggcgcagcattgagggcggtgcagtcgcggcccacgctggtgttgcgctctggtgcgagcgcacgtcaggcctctgtctctcggcccactctcaatgcggcgccgagacgcccgtacggccggcggtcacgatgagcacaagcctgtccggaaacccggcgtccggtacttcacccgcgctgaggtagcccgagcactctttcatcgatgacgcttggatcgtcctccacggtcacgtctatgatatcacaccctggatcccccaacaccccggcggaaatatcattctctcgcgcgcgggcaaggatgcaactgacatgtttgagcgtattggacacagtgactacgcacagcaccgtctgaaggagttttacattggcgaggttgagggtgagaagagacacgacaatattggcgaaggcctgccgtggtactatcagactcggcttggtcaggatgcgcaccgcgacaagtcgccccggccattcgacttccggcagccgggtgaggtcgaggaggtggcgaacttcctgcacggcccgccgctcggcaacaccga

SEQ ID NO: 16377 - DNA, 432 bp, Triticum aestivum
  Clone ID: PAT_TA_16377
ggtgagccgggcggcggccgaggagatgcggcggaggacgacgacgccgctgccgttccaccggaacagcctcttcggctacttcaggtccaacccggccatccactccatcagccgcaagctcagcagctactcgtcgtcgaactccaaccgcggccggagcgccaccgccgccgccaactgacggccgacgacgcagctcgctcgcccgcgcgcacatgcatggcgctggctactttggcagtaggaaaaaaaaaggaagagaacagtttttattcgtttgctcctgcttgggtttgctctcctgatctgtattctttcttcatgtgtgaatcaccacaaaggttttcatacaagtgtagatatgtacctacgcaagcacatgcaactccgcaaatcctttgcacatttttgcccccgaaaaaaaaaaaa

SEQ ID NO: 16378 - DNA, 415 bp, Triticum aestivum
  Clone ID: PAT_TA_16378
cgtccgcggacgcgtggggcaagggtggtagggtcagtctatatcaagatgcccatgttcctgatgattttcgtcctaacattgaaattgaaggtgggaggacatatgaacaaaataaatgctgggaagacatttgccatgcaattgtcgaggctcatcaccttatttaccttattggctggtcattatatcaccctatcaatcttctacgggaatcgacaaaacctttgcccaatggagtcccacgaaccattggagagattttgaaaagcaaggttcaagagggagttcgtgttatcgtgttgctttgggatgacaaaacatcacacgacaaatttcttttgaaaacggatggactgatgcatacacatgatgaggaagctcgaaagttttctaggcattcaaggtgtccact

SEQ ID NO: 16379 - DNA, 1246 bp, Triticum aestivum
  Clone ID: PAT_TA_16379
gggccgtggcgccggccgaggtacttgtgcatacttttctctctgttttgcctcatgtatctggccctgtgtgttttgcggttgacgatgctatgttccgtattgatccttatattgcgaggattttcaaggagcgcaacaaccttcctggtagtgaaactcagcaatctcaacttatgcgatttaagcttcgtgtgcttactttactggagttatatcttcagaggaatccaggaaaaaaactggtgctggaggtatatgctttcttaatgcaagcttttgtgaaatcacatagcgccgatggcaatgagcagttcaggcaacgtattggtggtatattgcagaaaaggatattcaaagcaaaagaatgtccaaaaggctttgatgttgaactcagctagacttgaaagttttgctgcagaaggctctgcatctggcatcacggtcacgatacaaaccagttgcttctgcggcccaaaatgccacgtttcggattcccacgagtatcaattccaagggttgttccaagcaggaacttgcaagtgtggtcgataagttccagtacatgctgaacgactacttcagcaacaagaaatcgcggctgaagattggttttgtgaaggaggctgtccgcaggaacccctgggtaggacgggagcttttcggctttgctctacagaagatcggcagcaccaaggctgaataccgaagagttcaaactttggagctggtggactgcatattgaaatcctgggtcggcgacgatgtctcgagcgcatcaaaggttttgaagaagcatatggctctgctgtgcgagctgatgcaggaaatcctcacaaagatgcccgaaaacaagtcgcgtcgccaggaggtgcgtagattctgcacgcgggctctgcaaaccgtgacgaggctcaatctgaaagagaagtttcagaagaagctaagctcggaagcgtacaccctgtgtgaggcacagctgggagctgcatttgttcccttccgacagtgatgcatgtgaattcttgcctgaagacggtgaattgcaccagaaattactttgggctgaattaattttgcttgtaatatcagctccttaggttggattaaattaaactgtattttttttcgtgacgatacctgaaacagagaagctagctgtcagcaatatggaacagtatgtggatgtacgacagttgtatgaacgcctgcatatgttgttgagattagatttaaaaaaaaaaaa

SEQ ID NO: 16380 - DNA, 417 bp, Triticum aestivum
  Clone ID: PAT_TA_16380
cgtccgaagtagtgctgggcgaggtggcagcagccataaagattgtcttgaaatcaagccagccaaatttggttgtgaaacttgatatgcaacgaatagaagctcaggggtacgaaggaatcaatgccgactctgtgcagctatcaataataaattatccaaaactcaagttaaaatctcagcatgttcgtgtaattgatgaagccaagttgagaatatatccagatggaacagatagatccaaactccagtttgagctgcacaatctcaagtccatgcttccaaaagtgattgtgaagggtattccaactgttgaaagagctgttgtcaaccccgttaaaggacgtgacaaaaccatcgaaagatataacctgctggttgaagggaccaaacctgttagcagtattgggcgctcca

SEQ ID NO: 16381 - DNA, 949 bp, Triticum aestivum
  unsure (1)..(949): unsure at all n locations
  Clone ID: PAT_TA_16381
agctgctactcacgtccgcccacgcgtccgcggacgcgtgggctctccgctgcgtcccttttcgccagatccgacgcccttccggcttgtcgttgcctcgccgccgtgacaaagttgggagaagggggttggccgtcgtcttgcggttgggccggagcagcggtgggctggacgccgcttcctgctgtcttcgagcgatgggagagggttagggtctgtcgtttgccgttcgattggtgactgttgcgggttggcagcgcgccgtgtagctgcgagacaacttccttgttgatctgccgtcctgctgcagtgttatatactgtcgaattccaaaaacgaggtctgccacacgcgcatatcctcatctggcgtaaaggagacaaagatggtgatcactgccctagctgctcttgtcccaggaaacaagaagttgactattcgtgtgtatgtctcaaggctgtggcagcatcgtggaactactgataatggtcctatcattcatactgacatggtgcttgtggatgctgagggttctcatatctatgctgagatctctaaagactgggtaagcaagtttatggagaagctcagggaaggctgtgcttatgagatttgtcagtttctggtgttcccaaataagcgttactttaaggccgtcgatgcagcaaacatgatctgtttcaatagattcactacggtcaatcctaataccgacctggaggttgcgttcccgttttgcactatgcacctgtccaaccttagtgtagattatttgtaatcagtactatgccccagtatacctgcataagactactaccctttgctattgtaattgtaatcagtactatctagatggatgatagcaggcaatgtatacctgcataagactactaccccttagctctcnnatttatgaacctgtcccggtgtttagttggtattacgtatg

SEQ ID NO: 16382 - DNA, 442 bp, Triticum aestivum
  Clone ID: PAT_TA_16382
cggcagggccgactcgagcgcacgcgtgcgagaacgcacgcctcatccgcaacccgcgatcaccggccccaaaaagaacgcatcgccgccctttgccttcgcctccactgccgtccgcgccaccgccctttgcctccgcccccatcgccggtacgtaccgctgccctttgcttccgccacaccgtcgttcgcgccgccgcactttgcctccgccaccaccgccgtccacgccgccgcactttgcctccgccaccaccgccgtccgtgccaccgccctttgacgccgcctccatagccataccagtacgaaagaaaaaataacctagccccgccactttctcgcggcgctccggcccgcctttggccaccttcccccacccccaccccctgccttaccgcgcacccttaaccggcccctgccttccaccccggagaaaggtga

SEQ ID NO: 16383 - DNA, 554 bp, Triticum aestivum
  unsure (1)..(554): unsure at all n locations
  Clone ID: PAT_TA_16383
gcccagcagccccagtntcctctagcagcccgccagagccccgtggcggcagcggcccgtgtgatccgggtggtcccgcacacggcgcgcaccgcgtcggagtcggcggcgcgcatcttccggtcgatccagatggagaggcagcagaacggcccgtgaccgagcgaccgcatgcggtggttggccggcacaaagaaagaaaggaaggaagaaagcttagccaattagcgcttgggagtatgttgttatttttgagcaggcaatagcattcctatatatttgtccctcggcgtcggtaaaagcgaatttttggcgactgtaaatatgcaaagcaaagcaggacttgtatctatctatctatttatctgtctatctatgccacaatgaaaactgttaactgttagttttagggtgtatgtctcaggcaaaaagaagtgaaacctgggagtgatgtctctgctgtattgtctatgtatgtgcagctatattgcctgctgatatcttataaaagaaatttggtatgtctcatacttataaaaaattggatgttcntt

SEQ ID NO: 16384 - DNA, 753 bp, Triticum aestivum
  unsure (1)..(753): unsure at all n locations
  Clone ID: PAT_TA_16384
ccgggctgcaggggacacttgatatcaagtggagttgacaccacaaaggtacggaaaatatgtcaagcaattgcgttgctgtcacctgcagcttttatgatgctttcctctgtcgatcttggactccctccctgggtagttgttgctttccttacgggtggtatatcactctccaacttcgcattatcaggtctttattgcacccatcaagatatatcacgtgaatatgcaagcattctcctgggaatcacaaacaccgtaggggccgtgcctggaatcgttggtgtcgcgctagtcggctatcttgtcgacacaactcattcttggagtatgtcgctctttgctccttcgatcttcttctacttaacaggcactgccgtctggttgacatttgccagcagcaagccccaggatttcaacaagttggcatcggagtcgttagcagagagtaatcagtagtcaaaggaccattcagaaggaaaatccgttgggagtttagctcaccctgcccagcaaatttggagctcctgggcactggatagactgggtaggaacaagtagacagtgtatgtacatgccgcatgggcatccatatacggtagagatctctgtatattgttatattgtataggccatttctgcagtggatgtatgttaagtggagtatgttgtggcacaattttggnatggaagtgcctgtcactgttttccattgctgggagctgtgttgtcccatcctgaaacactgattat

SEQ ID NO: 16385 - DNA, 792 bp, Triticum aestivum
  Clone ID: PAT_TA_16385
gcggactgcgtggtgaccgcgccgcccactgcctgccgcgcgtcgacgtctcggatcccctcagccttatccatgcacgcgctagctcaaacccaagcaccgcaccggcgctcccacacgccgctggcggccgcagcccggtgatctaagctaagctttcccaggtcccagccagcgctcgaggccgatgccgctcgccggcattgccctcgcgcctctcctcgtctcccctctcgcgcctccctctccccgtggcagcgttgccgccgtctctgcagagcccgcgagaaggcgccgcgcgctacggcgagtgcggtgctccgccgcagcggcgtccggcggaggcggggtcccccgcgagctctcccgcgcgacgctgctctggagggcggccaagctgcccatctactccgtggcgctcgtgccgctcaccgtagggactgctgctgcttataaccatgcggggctgttcttcgccaggcgctactttggcctcctggctgctgctctccttgcgatcaccgggctcattctgagcaatgacctgtatgattcggggactcgcgctgatatgtaccagcttgattcgcccgtcgacgctgttggctggtgggcagtgacacaatatgctgcaaacgttcctcttctgttcggctttggagggctattttgggcctttacagaagcaggagacgtcaggttcatcactttggttctatgtgcaatcctttgtggttatgtttctcaggtgttctgaagcgtccttcgagttcgagctccgcctcgatctca

SEQ ID NO: 16386 - DNA, 470 bp, Triticum aestivum
  unsure (1)..(470): unsure at all n locations
  Clone ID: PAT_TA_16386
cgcgaggccgtgcagcacctccccataagatgacctctcccactcgccgcaaggaactcgacgtcatgaagctgatgatgaacgagtacgaggtgaatgtaggagagaaccccgcagaatactttatcaccttttacggacccaaggatagtccttacgaaggcgggaanatggcgagtgcgtgttgagttgccgcctacatatccattcaagtcaccctcgattggcttccagaacaggatctttcatccgaacgtggatgaagcttcggggtcagtgtgccttgacgtgattaatcagacctggagtcccatgtttgacctggtgaatgtgttcgagagcttccttccccagctgctcctctaccctaaccccaccgatcctctgaatggcgaggcagcggcgctcttgctaaaggagccggagaagtacaagaacaaagtgcgcgactacgtgcagcgctttgccgc

SEQ ID NO: 16387 - DNA, 658 bp, Triticum aestivum
  Clone ID: PAT_TA_16387
ccacgcgtccgattagccacgaagatgaggatatctccctcgtcagcccctctcacgtcatcctcgattccttccgctccctcgcgacccccgccgccgcctcctctcccgctaccgccgcgccagggcctcgcctcgccctcactggccaccggcgacctccaacccttgttctccgcctcgtcgccatagccaccttgagctcgagcagagcggcggctcggcaggagggggcaacagccagccgcgcctcgtccgtgtcgcgtggtggcccagatgcggtcgtcccgtgctctgcctccacgagcgcggcctcgatccagactcggcaggaggaggggagcagcagctggccatgctgtgttggccgtggaggaggaaggagctcatgtggctagggtttggctaccctcgtcatccatctcctcgatctctctctgcctggccgtggtctgaaggaggaagaagggacgcagcgaaatcgagcgatgcgggctgcaatagcctaaataggggggggtcgagaccacgggagcgggagcgatggccatttgcccccgccccactctctttaccttttctatggagatgctttgctggggacatatgatttcatcccattctgtactatccatcagttatggatttctctcgccac

SEQ ID NO: 16388 - DNA, 617 bp, Triticum aestivum
  unsure (1)..(617): unsure at all n locations
  Clone ID: PAT_TA_16388
ccgctgcatttctgactatcggtgcgatcttccttcctgagaccccgagcttcctgatccagcgtgatggcaatgtcgacgaggcgaagatgatgctccagaggctgcgtggcacgatgggggttcagaaagagcgcgacgatctggtcaccgccagcaacatatccagggcaatcaagaacccgtaccggaacatcctgaagaagaagtacaggccgcagctcgtgatagcgctcctcattcctttcttcaaccaggtcacgggaatcaacgtgatcaacttctacgcgccggtcatgttccggaccatcgggctaggggagagcgcggcgctcatgtcagcggtcgtgacacgcctctgcgccacagtcgccaacatcgtggccatggtcgtcgtcgacaagttcgggcgcagaaagctcctgctggtaggcggtgttcaagatgatcctgtcgcagttcactgtcggtgcgatcctggctgtgaagttcaaggaccatggagtcatggatcaggagtatggatacctggtcctgatcatcatgtgcgtgtgcgtggcagggttcgcctggtcctggggacctctcacctacctggtgccaacagagatctgnnn

SEQ ID NO: 16389 - DNA, 959 bp, Triticum aestivum
  unsure (1)..(959): unsure at all n locations
  Clone ID: PAT_TA_16389
tcgcaagaataaaaaagataatttctaatgtccgtcaagatgtttggggaagatgatcaagaaaatctgtacaaccttgttcaggacaaagctacatctggaaagcagggtcttggcatcaaggacctgccgatgaaagttggtggccagcgttggaaggggaacaaaacctctcttggtgatagtgatgaggaaaactcaacccagtctgaattatcagaagtggaagaagatgaagacgaggaaggatctgccagtgatgctaaagtaaatgaagtacatgtgaaaaccgtaaaagaagtttgcgtggatgctaaacctaaaaccaagttcaagaagctttgcaaaaaaattcttcgtcaggctccatctcagtccatgaaattgaaggagctcaaggaagctgttgaagaacaatcaactattttgtccgacttctcctgtagacgtgaagctctatcattcttgaagaggaagctccagggaagcaagaaatttaatctggagggcaaaagggtgcatcttgtatcatgaagcaaatacgaagcctacgggacacaatatgattttgcgtgtggctcctgcagtcatatatttgtcgattgttgctaaagacaagatacatacaggctgtgcaccaagtggcacggtatagatgtaaggagtcataggcccttgggacgggggccaaaattttgcaaatctggctagctgctggaaatttgaaagtgtgtgctgagtcatctgtatcgtaatatccatgtagctgatgcatctataggtgtttgtaattttttttgttgggtgtagacttgtatttagaggatggttatgcctattgtgcattggctgtctcgggtttagactcgctcatataagtctccaaactcactttgctccaaaaaaaaaaactaaaaaaaaaaagcgaaaaaaaaacctcganacacctgcccgggngg

SEQ ID NO: 16390 - DNA, 744 bp, Triticum aestivum
  Clone ID: PAT_TA_16390
cgtccgttgagaggcaagccttatcacttgaattataattgagaaagagcaggagaatggcgaggggagctcccaatggtaggggcggtgttcgttcccacaaaattgaggattatgatgacgctgtaacaaaaaaggctccaagtgggaaaagggttagaaaagaaaagaatgatcttgctgctgaactcaaagatctaggctggtcagatgcagatcttcatgatgaaacaaggccaactactatgagtgttgaaggagagctgtcacagattcttagagaagtagcaccaaagacatcagagggcaagaaagctggtggtattgacaaatcccaggttaatgctcttaagagacaggccctagtgctgaagcgtgaaggtaaacttgccgaagcaaaggaagagctgaagaaggctaaaattttggaaagacaactggaagaacaggagattctgggcgaagcagaagagtctgatgatgacttggctgcaattattcataacatggatgatgataaccaggatgacatattatacgacaattcaagactacctgctatcaatttcgaacaaatactggctgtctctgatgatcttaactttgatgggaatttcgatgttacagacgatgacatcaatgacccagctatggctgctgccctaaaatcatttggttggagtgaagatgatgacaaccaaatggacagccatgcacctgtttcttctttgaatcgagaggcag

SEQ ID NO: 16391 - DNA, 725 bp, Triticum aestivum
  unsure (1)..(725): unsure at all n locations
  Clone ID: PAT_TA_16391
tcggcccgaggccaaggttgtctcactcccggaaggccggccgtggtccgagtctttctttggttactagaaatagcggcgccggtggtaaagctgcagcggggatcttgtctgtcggccggccgcccaggaatgtgcagcatgcaggcagagcattgccagtacatgacggagcccgagcagatgtatcaccagcagcagcagcagtttcatgatcacaggctgcacatgtcctcgaggcctagcttgtccccggagaagaagttcttcatgaagggccaaggaggggcaggaggaggaggaggnaggagatgcggggctcatcctgtccacggatgcgaagccccggctcaagtggactcctgagctgcacgagcggttcgcggatgcggtgaagaagctaggagggcctgacaaagccacgccgaaggcaatcatgagggtcatgggaatcccgggactaactctgtaccatctcaagagccacctccagaaattcagacttagcaagaatctccaagcgcaagctaatgccgtccatgcacaacatgtttatggcttcggcacagcgacggataaagcgtgtgaagggcatggatcaccagctgatcacctgaaccgagagacgaacaccagcaggtctatgcacataaacgacgctctccaaatgcaaattgaggtccagagacgactgcatgagcaaatagaggtacaaaggcacctgc

SEQ ID NO: 16392 - DNA, 543 bp, Triticum aestivum
  Clone ID: PAT_TA_16392
gtggatcccccgggctgcaggggtccagaaaaagcgatactgatccacggggtggggttccctttgcttggcaatttgtcagtcaactgtcgtgtcccatggcttaccttcgagcaaggagcaatgccaaagctcagaaatcttgaactggaaattcgctgatagccccacaagtcgggagagcgttccttcagggtatcactaacctgctgtccctgtcagaggtggccatccgttacaacgtacggtacgccaagagccccaccgtgaaaatggcagaagcggcggtgaggaaacaagttgccgggcattgcgacctcttcatcaacggcatccaagaccagccagaggaggctggagacggtgtagccgtcatcgaagacgttcaagttcaagctgaggatgctccggaggctgaaggaggggcgaccgcaagtacaagcgagattgacattgttgacaccgcccaactgtatgaccagagcactgcctcggcgcattctcactggtatccgtaggcgaagatcacggcgagccgcagct

SEQ ID NO: 16393 - DNA, 723 bp, Triticum aestivum
  Clone ID: PAT_TA_16393
gaggccgccccccccactcctccctctcctccggccgccgcacggagaaggacgagccatgcaggccgccgcagcgcgcgcgcgccgcctcctcgcgtcaccagcggcctccgggatccagggaatcctctccgcctctcaccgcgggtgcgcggcggccgccgagctcgttctcctgccccatctcgagaatggcttccccgcctcgcgctcctctccggatcacaccaggagcttctcctcccacctgccccgcactttgctatcgcaaaccgcaacttctcattgccggtgtaacaaatcagtgtgctatcacatggcaagagctcatttgtcgacagactcaagcggaatcgaccaacctaaagaatctgcagaggagctgtaccagaaaatgctgaagtctgttgaagcccagactatgccgccaaatgcctggttgtggtcaatgatcagtagttgctccagtgaggaggatataaaacttctctttcagattttgcagaagctaagaatattcaggctatcaaatcttcgcatcaatgcaaccttccgccaccccctcggtatgcgaggtgccgcggcgtgtccgcgtgggggtggccttggccatgggttggaggtgctacggggtcgcattgtttatggaataacgccaaccattggttctgcccattatctactgcaacatgctaaagagcacaatgatactaaactaatgga

SEQ ID NO: 16394 - DNA, 854 bp, Triticum aestivum
  unsure (1)..(854): unsure at all n locations
  Clone ID: PAT_TA_16394
ggaagaagatcgccatcgggtcggcgaggggcctggccttcctccatcacagctgcatcccccacatcatccaccgggacatgaagtcgagcaacgtgctcctggacaacaacctcgacgcccgggtgtcggacttcgggatggcgaggctgatgaacgcgctggacacgcatctgagcgtgagcacgctggcgggcacgcccgggtacgtcccgccggagtactaccagagcttccggtgcaccaccaaaggcgatgtctacagctatggcgtcgtgctcctggagctcctcaccgggaagaagccgatcgacccgaccgagttcggcgaccacaacctggtcggctgggtgaagcagatgctcaaggacaacaagggcggcgagatcttcgatccgacgctgaccgacaccaagtccggggaggccgagctcgatcagtacctgaagatcgcctccgagtgcctggatgaccggccggccagaaggcctaccatgatccaggtcatggccatgttcaaggagctgcagctcgactccgacagcgacttcctcgacggcttctcgatcaactcctccaccatagacgaatcggcagagaaatcatcgtcgtaatgttttctgtttcttgtttcttgtttcttttttcatgctctgggaatggaaggatagaacagcgagatactccaacatttagtttacaaaaaaaagccgtagtncctccaatccacccgggggagtttgtantttgtgggtcccatcccctgttatatataagctccaaaatatgaaagagggacatgaaggtagtacttttatttgccaagaaaagatcaaccttatgctcnttttcaa

SEQ ID NO: 16395 - DNA, 1826 bp, Triticum aestivum
  unsure (1)..(1826): unsure at all n locations
  Clone ID: PAT_TA_16395
cgcccgcgggcgcgtgggttgtcttctacgacagagatcaactagctcaggccatacaacctccaaggttgatcttcgaactacaaaatcaacccccgggatgtcatgatcgtgtgagggctcgtgccctgtgtctagttaattgtagtgagagggactctctccatcttaattgccaaatctaagcgcttggcgtttccagtcacgagtttagacggagttctactgtccctgaatgacttgacgaggtcttccagtggagttaccaagccctcgatcgattggctgctggggatgttaatctggcgccttgttggtgttgaacaagttggttcatcgaccttgtagtcatacaccagtgatctgaaggagcttgttgttgattaccagattgccttgctgatcatttcgggtcacttgttcctgggattgagaaggctttgaatgataaatcttctacctccaacctggagattgaggcccttgcatttactaggattgttatggcttcccattcaccctctgtgtttcatccatacatccaggcacttttctggtccaatattatctgctattggagatagatattacaaagtcaccgctgaggctttacgggtgtgcggggagctggtccgggtgctccgcccaaactttgaggcacgttccatagattttaggccatatattattccaatctataaagctatattgggccgcttggcgaatcaagatcaagatcaggaagttaaagagtgtgccatatcatgcatgagccttgtgatcgctacttttggtgatggtcttcagagtgaattaccgtcatgccttcccatacttgttgataggatgggcaatgaaattacacgacttacagcgtgtcaaggcatttgcggtgattgcgaattcacctcttcggattgatctttcatgtgtcttggaccatgtcgtttctgagctcacagctttccttcgaaaggccaacagagcccttaggcaggcaacattgggaaccttaaattctnctggttgtcacatatggggagtcaaattgggctcgtcctcttatgatcgcgatctagaactagtccggacgcgtgggcggacgcgtgggtgtgcatcaactattgaaatgcttaaaggcattctaaatgatgacagttctactaattctgctaaacaacacatggccttgttatgtttgggagaaattggaagaaggaaggacctcagcagtcatattcaaattgagaacatcgtcatcgaatcattccagtcaccttttgaggagataaagtctgcagcatcatatgctcttggaaacattgctgttggcaatctatccaagtatttgccatttatcttggatcagattgacaatcaacagaagaagcagtatctcttgcttcattcactgaaagaggtaattgcgcgacagtctgttgatcatactggccagagtgagctccaggactcaaacattgtgaagatattggcattgctctttaatcactgcgaaagtgaggaggaaggagttcggaatgtggttgctgagtgtttaggcaaaattgcacttattgaacctaacaaattaatccctgctctgaaggaacgcacaactagcccagcagcaaacacaagggctacagttgccattgctataaaatattcaatcgttgaacggactggaaagatagatgcaatcttgtactctgagatttctactttccttatgttaattaaagacctttgatcaaacttggcttgttgtgggcagctgtgctcaacgcaaggacagcagcacgtcgcacatgcctgtcactatcttt

SEQ ID NO: 16396 - DNA, 2506 bp, Triticum aestivum
  Clone ID: PAT_TA_16396
gctgcgcttggcggcttagtttccacgaaacacctgcgagaagaacagcagttctggctttaagcacacgctcccgcaatcacataaatttaatacatttgttgtttccatctatgacacggctctggtatgtttggccaatcatgatccaagtctggatgttgaacagtgttccctatcatgcataagccatgggattgtaaattttcgtgctgtgagtcgagggaattggccttcgtgcctacccatacttgttgataggatgggcaatgaaattacacgacttactgcggcctgtcgcatttgctgtgtttgctaattcacctcttcgtattgatctttcatgtgtcttggaccatgtctttgctgagctcacagctttcctacgaatggccatctgagctcttaggcatgtagcattgggtaccttaaattcttgagaaaacaatcaggagcaaatctatgacgcgtgcagtgaagaaggagattgagcgcaaagaagacttgcttcgcagtgctcttcgagcaatcgctgctgtaaaccgcataagtggcagcgactacagcatgaagttgaagaatcagatgagcaagatagcggccacccctctacttgacaagaagaacaattcggtgcgcagcgaatgagtgctgaatatttttctgtatatatgttggaatataggcgagtcaaagttggctctgccggtttcgaggcgatgctcctacctaaatttgcgatagttggttatcctttatcgattttggtagaaatgcagtggtgcggtaactaccaaggagggaattgttctctaatgaactgtttgtggctaaaatattcgtagtagaccatgagcagttggtttggttaacgccataaaagcattgaaatagtgcatcacattaaagttttacaaaagctgcttaacaactcatggttcatgtgacgagaagtacaatttggaagacggccggactttgctcaacattttcctgttgagatgatcggcattgtatcagtcaagtcagcttttcggtgtagaggcgctgctgcatcctatgttcttggaaatatatttgaaggcactcatttccactgctaggcagtcgcagggaaactgtctttcaaagaagagaatattcagtatctcttgctgcattcactgaaagaggtaattgcgcgacggtctgttgttcataccggccagagtgagctccaggactcaaacattgtgaagctattcgcattgctctttaaacactgcgaaagtgaggaggaaggtgttcggaatgtggttgctgagtgtttaggcaaaattgcacttattgaacctaactcattaattcctgccctgaaggaacgcacaactagcccagcagcaaacacaagggctacagtcgccattgctataaaatattcaatcgttgaacggactggaaagatagatgcaatcttgtactctgagatttctactttccttatgttaattaaagatagtgacaggcatgtgcgacgtgcagctgtccttgcgttgagcacagctgcccacaacaagccaagtttgatcaaaggtcttcttcctgaattactgcctcttttgtatgaccagactgtcgtgaagcaagaattgatcaggaccgttgatttagggcctttcaagcatgtcgttgatgatgggcttgagcttaggaaagctgcctttgaatgtgtggacacattgctggataactgtcttgatcaagtgaatccgtcgtccttcatcgttcctttcctcttatctggcttaggtgatcattatgatgtgaaaatgccctgccatctgattctctcgaagctagcagacaagtgcccatctgctgtacttgcagttttggactcactagttgaacctcttgagaaaaccatcggtcacaaacccaagagtgacgcagtgaagcaggagattgatcgcaacgaagacatgattcgcagtgctcttcgagcaattgctgctgtaaaccgcataagtggcagcgactacagcatgaagttgaagaatctgatgagcaagataacggccactccttcacttgccgagaagtacaattcagtgcgcagcgaatgagtgctgaatatttttctgtatatatgttaggaaataggcgagtcaagttggcacacatacctgctggtttcgaggcgatgatccaacctaaatttgcgatagtagattgtactgtaccgattttggctgaaatgtggtcgtgcggtaactaccatgcggagaaaaggatgttgaatatctttttctgtacaaaatatggttttagaccattagaagcttggtgtggcaatttaaaacgactaaagcatgaagttcaagaatctgatgaacgtgcccaccgccaccccttctcttgccgagaagtacaactcggtgcgcagcgaatgagagctgcaattttttttgtatatgttaggaacgtctttgctacggggcaaaaaaaaaaaaaaaaaaggccccta

SEQ ID NO: 16397 - DNA, 785 bp, Triticum aestivum
  Clone ID: PAT_TA_16397
ggctcctcgatttacttatattatgggcattatcaagtatgaatgaaattaaagcagcagaaaatctgctggactcactacgctcaagagtctcttcaatggacacgaagagacagcaagtgatgcacaaggcaattcagctagccgatgctgtttataaatatggaaaaggagagcacaaggcggtgtttgacaccctgggtccagacttcgatgggcttagctataaaatgattggcgcatcagatgaacaagtggacgtcttcaatgaagtttggtacactgtcctaataaatgctggagagacgtctacagcgattgagctgctcgtcaaacaaatcagcaaacgacagggcgcgcctttcctgtggcgcttgctggagaaagcatacgcagtggagggcagaggtgcggatgcttcagtggctgccgagaaggcaaatgctctacaagctgctcagtttcattagcgtctagttccggctcgttcgcggaaaggttacatgtactgttgatgtatgtatgggtgtaactatttttgctggtacgcacaatggaaatttcatctaataaatcatagtggaggacagtgctttgcacaactccctctgttgcaacaaacccagctcttttctgcagcgactgcgcatacacacgcatgaccaaaaacaaaccaacacattttgttttcaaatgcacatgtatgaggctggagaaatgcatttcttcacctgaagcacaatgcactggagagacaatcttcttcctgttttaaaaaaaaaaaa

SEQ ID NO: 16398 - DNA, 699 bp, Triticum aestivum
  Clone ID: PAT_TA_16398
gatgcagaaatttcgtccgcggccggtgggcgagcctgtctcgtctcctctcttccccttcctctccggaaggtcctgacctacatctctaccgccggccgtgcccccgcctcaccgccgacgccctcgatcgtcccccctcccaaccccctccgccgtctccgtgcccgttcctcctcgtcgcgtccctgctgtctccgccccgtccgcgattttgggcattggggggttttcagtaatttcagctctacctaatcatgagtctagcttgtctcgtatgccatggcatgagcagcccttcacagtctttcagaagctattcagtctcaagctcagaggaggaaaacaggtgtggagctgctgttgcctgcctatcgcggaaaattttggccgcaggacctgctaaccgtgtgggaacctcaaaggtgacacctgtaatggccactgcacaaggcatcgagggtgctcctcgccttcaacggagccgtgctgtttcaagggatcttgtcagggactggaacttctacgagatcgttattgggaactagagtagcacggtgccagcagttatccccaggctggacattggattattatctggcacgagttgatgtacattttctagtatacatctggatatctatgtactatattagtacgcgcctcaatcaaagagcaaattgtttaacagttactggt

SEQ ID NO: 16399 - DNA, 585 bp, Triticum aestivum
  Clone ID: PAT_TA_16399
ctgcaggtggaaaatctagagaatatctacggtgttcttccagagattgattcgatatgggtgtacgggaacagctttgaatctttccttatcgctgtgataaaccccaaccaacaagcgcttgagaactgggctgggcagaacggggtcactggaagcttggcggaactatgcgagaacgcgaagacaaaagagcattttatagcagaactcgcaaaggctgcaaaggagaagaagctaaaaggctttgagttcgtaagggccgtccatcttgacgcggtgccgttcgacatggagcgcgacctcatcaccccgacgtacaagaagaaacggccgcagatgctcaagtactaccagggagccatcgacgcgctctacaagagctcgaagtaagagtgcgggcactctgaacagcagcgaaactgtttctaaatcctcgacgcttccatcgaatcctcgtgtgtgcgcgcgtgtgtatgtaaattaattaacacacaagactttgttgtcaatggttgcttacgtttttcacacgatgatgatattccctccgggttaattatgcaaggcttgttgctgaaaaaa

SEQ ID NO: 16400 - DNA, 798 bp, Triticum aestivum
  unsure (1)..(798): unsure at all n locations
  Clone ID: PAT_TA_16400
acactgaggaagaagctatggttcaaaggattcaaaaccgccgcctctgttntttgttccctgtctccgccatcgtctcttccctgcctccgntgcaccggntcctccactgaccacatgtgcccgtggacttccacaggcgatccctcctcctctgaccacatgtggctcgccagcaccagctgctcgcatcgcattgtttccagctggcattgtgtcaccatcanaatccatgnagcacttttccagcctactcttgttgagatcagcatatggcctggatatgtatgtcgatgcaagtcacacttcaggctatccatttccagccagttaatcattttggcagctcatgtgtctcaatcttacatcgtacacatgtactggcatttgacatggagcactgcagttcgcatgttccattgcatggtaaaatgaggacaccggggatagcccgatcgattgattgaactggaggtaccacatccttattccactggttccttcgagcatcggccagattctcttgctgtgtgcattggataacttcctagatgactgggcagcttctcgtcccatgagattaacagtttngagtggaagcgtaacttaatctcnggattgcttanacacgtcaacaactgctaccaaccttgancnnattgnactaatgntgnctnggtgnntctncnaacctggcncagagntcaatcctttcnacganaatncnaggattncccccaanntcnggncnaaggtttcaacctaattgcaanangtncnnaaaacanaatnacaaga

SEQ ID NO: 16401 - DNA, 615 bp, Triticum aestivum
  unsure (1)..(615): unsure at all n locations
  Clone ID: PAT_TA_16401
cccgggctgcaggcctccaccggcgaccgacctcaacagccagcaatgtcggggtcgcggcaagggaggcaaggggctgggcaagggcggcgcncagcgccaccggaaggtgctgcgcgacaacatccagggcatcaccaagccggcgatccggcgtctcgcgcgcaggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgacaggggcgcaccctctacggattcggcggctgatcccatggtctccggtcgtgtcctcttcgtctggtgttagcgagccatggtttgttgttggtgtctcgggtgcgtgtgttcgtactgtgtagttgttggaaggcgatgaatatgaatcaatggaatcgttgttcggggcaagctctctgaagattttgattgtctgccagtgcgatttaacagtcctatctgaatatattggattggaggaaacaaaatgatggtgcgtttcctaattgcttcacagcaaaaaaaaa

SEQ ID NO: 16402 - DNA, 659 bp, Triticum aestivum
  Clone ID: PAT_TA_16402
gagctcattggattctttgacttgttggttcgatttctcttctcaaaggaacccccaacaccgccgtcggagcagcggcggcagcaagaggagaggaggagcgagatggcgccgcccagcaaggagccgtgcaagaaggaggcgtgcgacatccaggcctgcctctcccaagaacctcttcgattccaagaagtgtttgaaagttattcagtcactacaatctgcgtgggcgcggcccgggtacaaatcaacacattgtggttctttgtcgggcttgctcaaaaacatttcaaagtgatgtaataagactatcactcaataaaggtaattttaggtctgcttgggagttaatcaggatatcagtttctctaatccatcatgtatgactgggaaaaataataatgcgccatcctcaacctgcagaaaggtcctgtggctgctagttgttcggtgctgagtttgtcaaacacatctctttaagagggatactgatattgccgtatagctgtattatcctttgtatttcttatgctcatgtgcagatgtaattcaagaaaataagtgaaccctggccttgttgtacaccaatctgcatttatgatatgggaagtgtttttttgaaaaaaaaaaaaaaaaaaaaaaagtcgacgcggccgcga

SEQ ID NO: 16403 - DNA, 817 bp, Triticum aestivum
  Clone ID: PAT_TA_16403
cccacgcgtccgccatccactggccatcttatctactgtgtctcacctaccacccaccctcctctcgatccttcctgctcctctctccttataccatacaacctcgctgcaagaaaccagaccgaggccatgtgctcatcagcttcttcctcgtaccatgaggcatgagaggaagctcctgctcatcccttcccggattgcggcggcaaggtcgtcacctttgtctcgcgggccggagcccggttctatatgtgcgtaaacaaggatgctagactagcggcttcatgagatccaccgacacttacctgccgaagctaagttgctatgacctgccccacgtgcacggattgcagcagccgctgttgtccgtgcatccatcgtcgtctctccaacacagatctcgtcgggagcagcctttccccgacgaaacacagatcaaccaccaagctgcacatgtacgtcctcagccacagattctgcagtcggcccctcactccggttcttcgtggtgttgctcgtctgactctcatcgcgtatttggtgctcctggccggcagcaacctggtgcttgtgttagcgtggttggttctgattttcgggcagcataacaattagtatttctttctagctaagtagagccaggtggcagcgtccaagatgtactacgaacatatgtaatcccaaatagattttggtactaagcgctaagtcctttatcattagccctagtgttttcttgtctgtaatctcgtgtaagcatcggtttaagtaaaaatactactgctgccaaaaaaaaaaaaaaaaaaaaaaaaaaaaa

SEQ ID NO: 16404 - DNA, 760 bp, Triticum aestivum
  Clone ID: PAT_TA_16404
ctgaggtttactctgaagttgataaatgcatagaaggattaactgaaagttcacataaatcactacatacactatttgttattttgaacaccgtcttccccaaattggaggtatctcttacaaatgctagtgaggggcgggctgtaccattcactcatgacgaaaactcatctcaacttatctgcgaaagattgccacaggttgatgttgagagtccacaatggagtgaggccttaacaacagatgctattagtctgatctatgaaaacctccacaagctagatagttttgtttcctctcagctttcaagtcataaaaagccaagaaatatgaccatatactggttaccccgtccgtgtggagcaattggcctctctgcatgttccctatggcttctgcgccatagtagcttgatgggaagttctgacatggacaactggattcaagatgctaaggagtcagttgctggattctgggatgaacatgttgagagaccagtcatttccattagagatgagctattcgagacattcaagcgaacagataaacgtgtaatggaaagggaagaggtccaactaaccgaagaatcattgcacaggatgttaattaccttctgtgagcaaacttcaaaggaaaaactggcacaagatgcatcattgcaggagttgctggagattgtcatgaaaaggtgcgaaaaggaatcgatgcattcaattcagaatctggtcagtggagaattagcacgggccatgcttattca

SEQ ID NO: 16405 - DNA, 703 bp, Triticum aestivum
  Clone ID: PAT_TA_16405
cggcccggcacgagctcctcatccgtttccctctcctctctcttccttcgccaaacccgaaagctagcacgccgtagtacttggccatggccgtgcaggcgcaacacctctcccacgccttcccccacgacctccacgcctacaacagcgtcggtgctctggaggacgagatgacgggcggctccctcttctttcccgagaacctcaagcgcgggccggaactggagggtgctgggaacacggtgttcggcgacgttccgcgcgtcgatcccacttggcacgacaacaccacccgcagccacggttttgcgcagaggaagcgggcgcgcgtcgtcccggaggcgccttcgtacttggagaatcagcgcgggcaggggcttgtgcccgtcggtgatgtgctgaccagggcggtgggctccggcacggcgtccaccagtgggagaatgatcaatgccgccggcccgccgcaggacctgctctcgcagctgtaccgtcagggcatggagatcgatgcagtcctacgactcgagactgaccgcatgcgcgcggggctggaggaggcgcggcagcagcacgtcagggcgctggtatcggcggcggagcgtgctgcggcgaggcagctgcgtgccgcggaggccgcgctggagctggcgcgctgccgcaacgccaagctgtcatagaggctcacccagatttgcgccga

SEQ ID NO: 16406 - DNA, 407 bp, Triticum aestivum
  Clone ID: PAT_TA_16406
gcgcgcagccctgccagtaccagagcgtgatcgtccgagtacaccgccaattcgtcctccggctcgccttcgaaggcgacctctgcaaacccgacggaggcgaggcggatcatgaccctcgggcttgccgtccacgacccatcacggtgggcacgatcctcttcagcccgggcagacggcctacatgtacttcatgatcggcgacggcggcagcgtcggcgacccatggaacttcgcgcagaacaaggggaccctgctcgggaagatcatccggatcgacgtcgacaacatgccaagtggtaacaacactcctagttggggcaactacggtatccccaaggacaacccgttctcaatggacccggagttcgcgccagaggtcttcgccatgggtttcaagaacccgt

SEQ ID NO: 16407 - DNA, 881 bp, Triticum aestivum
  unsure (1)..(881): unsure at all n locations
  Clone ID: PAT_TA_16407
agtgggatctagcgtaggagataggcgcgggtgctggcggggcgcggcacccatgttgtcatagccgcccggaacctcaccgccgccgagaccatgtgccaggccgcaacttcgcagccgacttcactgagaggggcctaccgctcaacatcctccttcagagagctgaacggggcgaggctggaggcgtcagtgagggcgtacggcggtgccggccagaggaaggtgtccaacaaatggttaggatgttacctccgcccgcgggtttgtgattcccctcgcgtactatcgctttctcaagtcaactcaagcaacaattcatgtggctcgctcaatcagtcagagagctgaacggggcgaggctggaggcgtcagtgagggcgtatggcggcgccggccagaggaaggtgtccaacagatgtcgaagagctgaacggggcgaggctggaggcgtcagtgagggcgtacggcggcgccggccagaggaaggtgtccaacaaatggagagtgtcctatatggggaagcaaagcagcggcatgctgctcctttggaaggtcggctcctgggaccatttgtgctctgcttgataccatctctttgtattgttgctgcattgatgctgagatggacgcatttttcctgggaatttgggttgtgacaggcaagacttattgtatgtngaggctttgtgactcactttaagtgttctttcctgttaatactgtaaagccaagatgggatgcattttttggtgcctgtantgttccttcctggtacccaagtaatactgtaagtgagatcatgtatganagagaattantgagtgttgctgttcaaatgtgtaaactggaaatcagtgaataaaaagacaaatgttcat

SEQ ID NO: 16408 - DNA, 507 bp, Triticum aestivum
  Clone ID: PAT_TA_16408
gcggagaagctctgcaaaaagatctggtgcaaggcctgcaaggccgtcaaggagatcgagatcgtaaaacaatggccgccgccgcccccatgcccagacaagccaaagaaaccaccatgcgcatgcacatgcccgccgccgcccccgcccccagacccgcctccgtgtcccccgtgcccatgcccgcccccgcctcccccgcccccgccaccaccatgcgcatgcacatgcccgcctccgcccgagccgccaaaaccatgtccatgtcacccgaagccatgcccgccggctcctgagcacaaaccatgcaaacctgagcccaaaccatgcccgcctgagcacaaaccatgcaaacctgaggccaaaccatgcccgactgagcacaaaccatgcaaacctgaaggccaaaaaagcccccgagcccgtgcaggacccgcccccgcccccacccccttacgagttcctgcccttccccgtcccggttcccttcccgatgcagtgccagag

SEQ ID NO: 16409 - DNA, 1424 bp, Triticum aestivum
  unsure (1)..(1424): unsure at all n locations
  Clone ID: PAT_TA_16409
atatacttctatcggccttgccagccttctcatctaccaagcatctcgggtagttctgcttcagtgaccattcccctcatttcagaagcacttcgtctcggccttgggttcaaccttgggtttctccacttgagcagcaacggatttgccatttcatcaactatcacgttctagcaccatccctacctgatatttctgggcttgatcacgtgtatcacttgaatcgccattctgaataccattcttgtggtgtgccaaaccattcaaggatttactcaaatatacatagtatgcattattctcccataatgaacaagtatcttgcgatcaacataatccaatcatgtctatgctctacgcagacaccaaatatcaattatacaggtttaaccccaaatctcgattcgtagagggagcatgcgatgtttgatcacatcaaccttggaaacacttccaacacatatcgtcatctcacctttagctagtctccgtttattccgcagcttttatttcgagttactaacacttagcaaccgaaccggtatctaataccctggtgctactaggagtactagtaaagtacacattaatataatgtatattcaatatacttctgtggaccttgcctgccttctcatctaccaagtatctagggtagttctgcttcagtgaccgttcccctcattacagaagcacttagtctcgggtttgggttcaaccttgggtttcttcactagagcagcaactgatttgccgtttcatgaagtatcccttcttgcccttgcccttcttgaaactagtggtttcactaaccatcaacaattgatgctccttcttgatttctactttcgcggtctcaaacatcgcgaatagctcaaggatcatcatatctatccctgatatgttatagttcatcacgaagctctagtagcttggtgcagtgactttggagaaacatcactatctcatctggaagattaactcccactcgattcaagtgattcttgtacccagacaatctgagtacatgctcaacgattgagcttttctcccttagtttgtaggccaagaaaattgtcagaggtctcatacctcttgacgtgggcacgagcctgaaatcccaatttcagcccttggaacatctcatatgttccgcgacgtttcaaaaacgtcttcggcgccacaattctaaattgtttaacattaagtgaactatcatgtagtcatcaaaacgtgtatgtcaagatgttcacaacatccacagacgacgttccgaggtcaacacaccgagcggtgcattaaggacataaccttctacgaacaatgaggacancctcaatttactgacccatccgcataattgctactatcaacttcaaactaaattttctccaaggaacatatctaaaatagtagaactaaaa

SEQ ID NO: 16410 - DNA, 1872 bp, Triticum aestivum
  Clone ID: PAT_TA_16410
cccgcacgaggctctggttcaacagcttccttattgagaggtcggcgctgccgcccaaggcaatggccgggacggtgcttcaatgcatgcagtcatgcgtcacccgaacactttctgtgcaaccggagtttcaatacgcggtcgctgcccttgcacgaggctattgaagaacctggtcttgtgggagatgaggctcccttggccctatctacgcctgtacagacaaattaaaaagaggatgattctggtcttacttcagctcattgaagaacctggtcatgcgggagatgaggctcccttggcactaactgcccttataaaggacagtgtggaacttgcagaaaacaagccttttcaacaaatgcagttgcgaagcttagcaatcatttgttagcaaatacattggagacaaggcgggcagtgaccatattgcttgctttagctgaactttgctcaaaacaagaagagtcaagatctcaacttatgtcaggccaggtatcaacattgatacttgatgcgttgaagcacgattgtgtggatattcgtgttgcagcatgttcatgcctgaagaatatttctaggtcatcaaaggtgcttagtgcgggccgcttatcctgtgatacagttattgcccccttagtccagcttttgtacgactcatctacttcagttcagattgctgccctgggtgctatttgcaacattgcagtgaatttaacacccaggaaattggctcttgaatcccaaggataaagacctcattctgaaggagctaactagtcgttggatccaacattgcgtctgcgatccgggtcggcccggtcgggtactgtcctcctcgcgggtcccgaggcttctggccggattcgggaggtgtgaaccgtatctactctctcaagcctcatatgcgattctgaacattctgttcaggaacagaccttggcgctggtacagaatcttcttgatggatatgtgggctctgttaactacgtcattggtgaagatggcatggttataaatgcaatctcaagacaactgaacagcgcgtctgccacaggagtttgcatccagggtatgttggtgcttgcaaatatggcagctgggaatgaattaaacaaggaagctgtaatggatgttactgttcctcaccgggcagatcgcatcaaaccatcttttgtggtcaacttcctgcagagcaaggataaacaattgagagttgcaaccttgtggtgcattctgaacttaatttacccaaacagtgattcttcatctactcgagtagcccgactccaaaatgctggtgtaatttcacaagtaaaaaacatgataaatgacccctgcttggattgcaagcttagagtacgtatggtgcttgaacactgcttagacaatgccgctgccggtttcatgtgatgggtcggcaagccattgacgtttacggaacaccatacaccatacagcaatcgggcaaaggaaagctgggcgtgcttggcaccgagatgcaggccatgagcgcgaagtccttactggtctctccctgtattgagcctatcactgtaattttttctcacgagaacccgatgacaactggtttctgttgcggaaaggctggcacgcccttgttgtaagtttgtaagcatgccacttggagaacatgagtttgtgagtatgctaccttgagaacctgagctgcttgcttgcgacctgaaggccataggcacaaggtccagagaatcccattttgtagtgccacaagaacctttggttgtgttgtgacgaagagtgtataatcgatccacccgcttgttgcttgttgtaaattgcagttatcccttacaatgatcggtctgcctcggctccaaaaaaaaaaaa

SEQ ID NO: 16411 - DNA, 531 bp, Triticum aestivum
  Clone ID: PAT_TA_16411
cacgagggggatccggaagaagtcggacgcgctcaatggagcggttcgacgagatcttcggcaggatcatagagaagagggtcgaggccgaccaggccggcgccgacacggcgggaagacttcctcgaatacatgctcaagatggagaaggaaggtggcgacgggaaggccgccttcaccatgaccaacgtcaaggccctgctcatggatatggtggttggggggacagagacgacgtcgaacacggtggaatgggcgatggcggagatgctacaaaaccggcggatactgcggaaggtgcaggaggaactcgacgcggtggttgggatcgatggcgtggtggaggaatcggatctcccgcagctgcactatctgcaactggtggtcaaggagacactccggctgcacccggcgctgccgctcatggtgccgcactgccccagcgaagacacgaccgtcggcggccaccgcgtcccggcgggaagccgcgtgttcgtcaacgcgtgggcaatcatgagggaccccgctgcg

SEQ ID NO: 16412 - DNA, 922 bp, Triticum aestivum
  unsure (1)..(922): unsure at all n locations
  Clone ID: PAT_TA_16412
gaggnagggcactcgcccgccctcctcaccttgcttccgcagaaagatccatttggttggnctggcggtggctcccctgcacaccgcagtggtaaagtcgcgcccttttgtgtgtgcgcttgccttgccgccgcggcatccgtcccgccccgtggataactagtgatagatctgggaggcgcagatctgaccggtggtattctccttcccgtcccgtcggcgagtgtttgctgggagaaaatttgttggggccatggggaagaagggcaagtggctgggcgccgtcaagaaggtgttcagccctgagtccaaggagaagaaggaggagaaactgaggaagaaattggctgcaagagaccccagtccaccagatctaacaccttctacttccttggaagtcaatgttttgatgccgccgccgcctcccgccgttccttctccgcaccaaactgaggaggttcaggtccgtgatgttgagctggagcaggagcaggagcagagcaagcatgtgaccgtggaggcagcccctgatgctcctgcgcagactgtcggcggcattgccccctggatgtatcgagcggaagagctcgcggcaatcaagatccagaccgccttcagggagatacctggcaaggagggcactacgagccttgaggggccttgttagattgaagtcattggtcgagggtaattcggtcaagcgtcaagctgctagtactctgcgctgtatgcagactctcgcacgggtgcagtcacagatacgttcaagaaggctgaagatgtctgaggagaaccaggccctccagcgccagctcctgctgaaacaagaattggacagtttgaggatgggggagcactgggacgacaccactcaatccaaggagaagatcgaagcaagtctgataagcaggccagaggctgc

SEQ ID NO: 16413 - DNA, 903 bp, Triticum aestivum
  unsure (1)..(903): unsure at all n locations
  Clone ID: PAT_TA_16413
gacccacgtccccggacgcgtgggcagcaatggcgactctttctctccctgtggcacacccgcaggtctccctctggcgacaagggcggcggcgactgcatggcttgccaagctgccagttcagacacgccgggagagtgcaatccagctacaggggactcgaagctctgtatgatgatgggtacgggacggtcaaggacctggactacttctatcaggcacttgggcagctggttgagcatgacagtgggccgccctgctggttatgccccgtcgacgccggctcgacagtcgaggatgctccgctcatgctgtatttgccaggggtagatggaatggggatggggctctgcatgcaccacaaggctcttggaaggatatttgaacttagatgcatgcacattcctcttcgcgaccgcacgccgttcgaagaacttgtcacaatggtagaagatgttgtgagagcagagcattccgcttctcctactaagcccatctacatattggggaattcatttggaggatgcatagctcttgcagtcgccgctcgcaatcctggcactgatttggtactggtactagttaatccagctacatcatttgagagatcacgcataaaaacacttctgtcggttttcagcccgttgtcggaccgcgcctgtattgcagctgcagctctactgaattacaacatccacaatgaggtgaacatggcactgagtatgatgaaaagtgggaggcatccttttgaagcactcagcagattgacaagtaacatgtcatcttccctgaagcattcgaaaatgctggacaaactaccaaaagacacactaaaatggaagnnnaaactgatcaaacaggctgcatcatacgctaatagccatatacaatcagttacagcnn

SEQ ID NO: 16414 - DNA, 344 bp, Triticum aestivum
  Clone ID: PAT_TA_16414
cgtccgcggacgcgtccgctactgcgcaccgatcgatctcagagtccacgaggcattagctagaactagaggagggcagagctcagggatagagttcagatagagagggagggagatctccttgacgatccggcgaacatgtattatggtggccagagcatgtcttctgctgcgaccggcggtcgtggcggcacggccagcaaggttgcgccatggatcctcgcctgcggctcgctgctctgcaccatcatgctttttctcgactatgaagcctcaattggttagaactaagttatgatcggcgacacttttccgaccacggacatggtgctcgttcacaacgg

SEQ ID NO: 16415 - DNA, 497 bp, Triticum aestivum
  unsure (1)..(497): unsure at all n locations
  Clone ID: PAT_TA_16415
actccacttctctgcccccgcctccccgcgcgcgcagggcccggcgaaagggaagcaagatgtacaccgcccggaagaagatccagaaggaccaagggctgtcgagccctccgagttcgaggacaccgtcgcgcaggctttctttgacctggagaatggcaaccaggagctcaagagcgacctcaaggacctgtacatcaacactgcaatccagatagatgttgttggcaacaggaanggcctgtggtgatccatgtgccgtaccgtctgcgcaagcccttcaggaagatccatgtcaggctcgtcgggcagctggagaagaagtttagcggccaggatgtggtctttgttgcaacaagaaggattgtgaggccacccaagaagggttctgctgttcagcgccctcgcaccaggaccctgacagctgttcatgatggtctcttggaggatgtcgtgtaccctgctcagattgtggggaagcgtgtcagataccgtta

SEQ ID NO: 16416 - DNA, 485 bp, Triticum aestivum
  Clone ID: PAT_TA_16416
agaagggcattgattgatgctactactcacaccgccgcagaagaaaggaataaggatgatgctgcctggcgctacaggaagaaaagaatatagtccaactgctgatgggtgctgatccagagttagctaattatcctgcagatggcgtttcacccttgtatctagccatcttgctggggaagagtacaattgcattgattctgtacgataagagtggtggcaatctctcctattccggagcaaatggactaaatgccttgcatgttggtgttcttccacacagagactcagtgatgatggagttcctagtgcattggaacaaaagccttactacccaagtggacagagatgggagaacgccacttcactttgcttcatcgctgatttgagcggactggctcgtatctgacacttgagctccttggcagacccccttggtgtcatattggtatggattccccggagatctacatcggtgctcgaga

SEQ ID NO: 16417 - DNA, 326 bp, Triticum aestivum
  unsure (1)..(326): unsure at all n locations
  Clone ID: PAT_TA_16417
ccgacccgctgcgtgctgccctcgccgaggtcgtcgccgtcaagtccttccctgcgccatcggctgcgtagtcatcgcctctcagttaggcgtatgttctaataaatacgtaggaatccacaatcagagatttcctcagtacgtaatatcgtcgtcgatttagtatctgcacgttttggtattgtagatcatcaatcgaacatatatatacagtgttcttttcttgattgaggcacggttatccctcggggggtcggtttgtataatgaaggattttgtanacacgtgcaagcacgcggttggtcnaactactangtttatacatc

SEQ ID NO: 16418 - DNA, 237 bp, Triticum aestivum
  Clone ID: PAT_TA_16418
gggagagagagagagagaactagtcttgtttctgtcgggtcaaaataaatattccctccgttccatattaagtgtagctgatttagtataatatttagtacaaagttatactaaatcaatgacatttaatatggaatggagggagtaacacagaggcgtgggtgtatatgaactcgtaaaatcgaccctttttgtttccttcaatggaaattgtgattactgcaaaaaaaaaaaaaa

SEQ ID NO: 16419 - DNA, 886 bp, Triticum aestivum
  Clone ID: PAT_TA_16419
ccacgcgtccgcaatccccaaacccccagccgcctcccccctccatcccagatccggacactcccccggaaccctagcccgccggccgcacgcgacccaaccatggcgccgccgagctcgccgccctcggccgccgcgcccgcgcggtcctcctcgcgcaagcgctccgcctccgccaaggccgccgcgcccgaggaggccacggtcaccaagcggccccgcaaggggaccacgtccggcaagaagaagccgccggcgcccaaggccaagaagcagcagaaggccaccaaggcgccgcgggagaagaaggaggcgacccccgcgcccgcggacgcggggggcggggaggagcccgacgaggaggagctggccctcggggaggaggacgagccctccgcctccggcgagcagcagcaggcggggcaggcggcggcggccaagaggcgcgtcgcgcagccgtccaagaaggcccggaacgtcgccgccggagacaaggagcccgagttcctcggcgagcccgtccccgccgacgaggcccgcgccaagtggccccagcgctaccagcgcggctcgcccaagcggcccgaggatgaggaggacatgaaggcgcgcgtccactaccgctccgccatggtcgacggcgtggtctacgcgctcggcgacgacgtctacgtcatggctggggaaaacgaggctgattacattggccgaataaccgagttttttgagggtgttgacaagaccagctacttcacctgtcgttggttcttccgtccagaggacacggtcatatctagagccaaatttgtcaatgatcacacgcatgacccaaagcgtgtctttctctccgaggaaaagaatgataatctggttgattgcatcatat

SEQ ID NO: 16420 - DNA, 1269 bp, Triticum aestivum
  Clone ID: PAT_TA_16420
gccggcggcctacgcgtcggtgctccctgacccttcccctacacgcgccgaagccctaacacgcagctccggcggctgagcccgcagtccgccccctcgcaccttcgtccccagcgcgcgcgcacccccacggacagctcacgcggcgaggcgcagcctcctacgaccccccgacgaagcaggcggggagcccgacgctgccccacgcggccttggccagatgacgagaaccagcggcgcgaacggcggcgggcagcaggggtccgggaagctcccgcggaagcgcttctaccgggcgcgcgcgcacagcaacccgctcagcgactcgcacttcccgatcccgatatcgcccgacgacgtcgacctctcgcagcactacccgcgctacttcccggccgacaagggcgagcacggtgatggggacggggaccccgaggcgccccggatccgcttcgctgacgtcgggtgcgggtttggtgggctgctcgtcgggctctcgccgctcttccccgacaagctcatgattggcatggagctcagggacaaggtgacttgagtatctcaaagagagggttctggcttttgagggcatcaaatcccaggacaatatgacaacatatccgttgtgcgccccaattcaatgaaatacattcctaactactttggaaaggctcagctctccaaaatgttcttcctgttccctgatcctcacttcaaggagaagaatcaccggaggagggtgattagcatgcatttgctcgatgaatacgcttacgtgatggaagcgggaggaatcatatacactattactgatgtagaggagcttggtatatggatgcgcacatgtctggagaaacacccactcttcggagctgttccagaggaagagataaaagtcgatccagttgtgaagctactgtctagtgccaccgaagaaggccagaaggtcgcgaggaatggagggcagactttccaggccatcttcaggcgcatctccttgcaagaggaataagcaattttggaagttactaagctcttagcaccagtgtactttcctggacttcgctagatggatttgtgccatttctatacatttgtgtagcataatttcactatgcagtagtcttacgtagctctgctatcttgaatgtttggctctactttacgaaaaattctggaagattgctatgagtgcactctcagatgatgcgagttctctggattcccatgttctagtagggggcgtgtttgggaactgttaaaaaaaaa

SEQ ID NO: 16421 - DNA, 526 bp, Triticum aestivum
  unsure (1)..(526): unsure at all n locations
  Clone ID: PAT_TA_16421
gtaaccattatttctgccggaccccccgtagacggacgcgtgggtgctgaagagaggattactatcagatggactttcaagaaattcaatgaaggcaacatgagagagatactggacccgctgctggaagatcgtgtggacgaggaggtgctggagaagcttctgagtttggcgttccagtgcgccgctcccacgcgggaggaccgtccgacgatgaaggaggtcggggagcagctgtgggagatcaggaaagagtatgggaagagcgtcaggagagtgtgaaatcatttgctctttaaccacgaccagagcatacgcaaattctttgtatgaacatcctgacggtaaacgttttgtgctcacaaaatggaatgcgctcttgaacaatgtacagacgaaccagcgatttgtgtcttccttcctaaccactttgcagtctggtttctccgtggaaaaaaaaaaaaaaaaaaaaaaaaaaaaaaaaaaaaaaaaanaaaaaaaaaaaaaaaaaaaaaaaaaagggggg

SEQ ID NO: 16422 - DNA, 1988 bp, Triticum aestivum
  Clone ID: PAT_TA_16422
cggacgcgtgggctaacagacagctaccgggccaaggtgtcggacttcgggtttgctagaagtggccctagtgacacagagaagacacacatctccacgaaagtgaaaggaactgctggctacctggaccctgagtacctaagaacgtaccagctcactcctaaaagtgatgtcttctcttttggcatacttcttgtagaaattatttctgcccgtcgacctgtagagctgaagcgggccgctgaagagaggattactatcagatggactttcaagaaattcaatgaaggcaacatgagagagatactggacccgctgctggaagaccgcgtggacgaggaggtgttggaggatcttctgatcttgtcgttccagtgcggcggcgctcgcacccgtccgggcatggcgctactcctggggctgccccgtgtgggtgcccgggcctgcccgctagttcacccgccgccgaggagcccgcctcacttgtggttccgtccccggccgcgcctggtgtgcccctcccttcctgtggtctcctgcgcccctgttttcatgccctcggtgagctaggggggaggcgggatgctacaccccgtcgccccactcctgttgcccctcttccagcctgtgccggctcctcgccggctggtgagacccctccatctccccgcccagttcctcctggccctgcctcctccgccccccctccgcgctctgctcgccctgctccgctcgtcgtccgctttggattccggttccgagccaaccctcctgtggacctgtggaaacgatcaagtttccatcttggagacctctgacggccttcaaaacctgtccatcaatggggttttggtgaaggaccgtgctgaaggctgcgacaggctccggtcctactttgggagtggttgcctcaggtgcgatgagcggtcgcaatcctggaggggtgcgtggatgcgctactgcagcgatgatgggagtcaatctagctatgtaactttaactccaaacataccaaggaggcttttgaagcagtcgtcagagaatggcgcaaaagctgaagatgacccatgtgggaacacgggtctacacgaaaataaacatgatgccaatgattcttccgaaaaagaggatcctctgttggctgtgcctggtgtgcttctcctatgctgtggtctcatgctcccatgttttcatgccgaaagaaaagaaggaagaagacacaatactacatccattcagcgcaatgctgttgattctctttcatccttcgacgtaagcacatcatccgagaagatcccaccaactccacatcgaatacctccaagcccatctagattcgcaccgtctccgcatattgctcgagttggatctgttgacttaagtgtccagcagattctcagggcgactcagaatttctcacattcatttaaattgggtgaaggaggatttgggactgtctacagggctgtattgtcagatggccaggttgttgcagtcaagagagctaaaaaggatcagtttgcgggtcctagtgaggagttcagcaatgaagtagaactgcttgctaagattgaccaccggaatttggtgagattactgggttatactgataaaggaaatgagcggattattatccctggagagcgtgaaagcatgtgctcttttacccacgaccagagcatacacaaatactttccatgaacatcttgatggtaatgttttgtgctttcttgctcatgcactcacttatctccatctatatgcagagaagacaataatccatcgcgatgtgaagtcatcaaatatacttctaacagacagctaccgggctacgtgctcgctctgcgcgcttgccagaaatgccccccgtgacacagcgcacacaaacatgtccccaccagtgacagacactcctagctcccgggtccctccgtaccgaaggtgaaaatctttccctttttgatctggaaaaaaaaaaaaaaaaaact

SEQ ID NO: 16423 - DNA, 1144 bp, Triticum aestivum
  Clone ID: PAT_TA_16423
ccccccctccacgccagacctcccccaccgcaggaacctctctctccctggtggtttcgtcactgcgatactcctctggatcccgccccggcggctttcctcctccctctcggctgccgcatccgctctgccgcgcgctccacccccgcccttcctcaccatcacgaggaattccacgtgcacgccgatgggcagggcggcggcgctcaattcggtcagcagcactgacaccatcagtcggagagagagtggaaagggcgcggaagggagcacctgtccctctcccggtgttcccggcgcaccgtcgcccctccaaacgttggtggtccttgtagcagtagattgcgcgaaagttgtggtcgtcactcatccaaaggctcgccgactcacgaactcgaggtgacgggcgccgcccacatatgctgactccgcctcgcggaaaccccatccttgtcgcggtgccggcggttggcttcaaggcgtctgtccctacacatggtcagcataagcacatgcccaaagtatcttagtttgcaaggagccaactgcaggcgcaaacaattttgctggtggtcaaagccctattctattgttgtgatactggtgagcttgcacggtgcagcagcctggagaggcggctaacggcgcacctgcgaagcaacaataaacacgtctgatgccaacatgccaagatagaaaaattgcatccggcagactgtttacgacattgtggcattggactatgagaaagttacggtccttattgatgcaacaaccgctgcaaggccagatatccatttggcaagtattagagatatgatgactattggcgtggaaacaccaaccttggaagagtggcgccgttaggttagtaggtggggtgctaaattcttggaactgacaaacgctccctctccatttggtcctgacaagtgtaattatattagtatttgcatataacttctaatccgtccaacatagagttaatcatacagtgtcatgtggtttccctttatatatagaggacttaaggcatgggtatgggtataagccaactccaaaccaaaacagggcaattgaagaaggcaggtgctcggattatacaaatttgatgttttaaaaaaaataaaaacaaaaataaaaa

SEQ ID NO: 16424 - DNA, 538 bp, Triticum aestivum
  Clone ID: PAT_TA_16424
cttatttacctgggccatccggcaccctccaagtggatacgtccaagggaataaacgaccttgttacaccgttcttgagttgtgttcttatcagagcacttagaaggcgatctggacacttggtccatggaaaacctttctttgcaggacgtttctaacatagaagcagactgctattggtgtctctcaaagtttcttgatggcatgcaggaccattacacctttgcacaaccaggaatacaacgccttgtattcagattgaaagagttggttcatcgaatagatgaacctttatccaagcacatagaggaacaaggattggagttccttcagtttgccttccgttggttcaactgtcttttgatacgtgaggttccttttcatcttgtgacacgcttgtgggatacctatcttgctaaaggagattatctaccagattttctcgtgtacatatcagctagctttttgttaaccatttggattccgagtgatgttccctctgtctctttcttccccagtggtcagagaagctgcagaa

SEQ ID NO: 16425 - DNA, 584 bp, Triticum aestivum
  Clone ID: PAT_TA_16425
gtgatacattggttgagcaggtaatgtaagcttatcttgtattttcatttgagggatcgtaactggtaccttttgtttttgttacaaaatgcccccttaacaaccatttgtgaataaccaaattacaattgaggattctcactgtggttcatgcaacctattattgaaagtaggccgccatctctctgcctccactttgatcttggtactctcgccttggaaagcgatgctgtttgtcttgctccactcataaattcctgtgctggtccttgtacacctgcttcttccttgatagccaccactgctgcatagtgtcttgagaccgcagtcttgctgcaattgccagcccagtgaggattgctcagcccaatccggcacatctacgggcatcgcacagaataatgcttggccatctcctgatgctgcgcccgtagaggacatgtgcccaggttttcagatagtggtgctcgagtctgttgcctgttggcagtccaacagcgatgttgaccggcaagcccaatgaagaatcgacatttgagaggcaacttcaccttccagaggaacttttggcagctgccatagct

SEQ ID NO: 16426 - DNA, 556 bp, Triticum aestivum
  Clone ID: PAT_TA_16426
gagtctcttctcttctcttctcttctacagtacgactgtgagtgtgaggccaaggacgatggaggggaagaatagagtggccgccattgccgccctgtgcatgctccttctcctcacgctgccaaagccatcccatcagcagccctccggagtcaactgcaagtgctaccggcggtgctaccctgcgtgcaaggaaaggatccagccgttgccctgcaaggtcaagtgtgctggtcgctgccccgacgccattgatcgccttgcctcctgcttgatcgcctgtggcatggactccatctgtgaccagccagcgccgtcagtcgatgttgaggtttgcaggaatgtctgccacgatatgtgggtcgcgagtggcgccaactaaccttgaagggctgcgagcaggtcggtcatgggatcataaacatatgatgtcgaacagctgtggttgctgcatcagtcgatcaaatgtgtttcgctttggtgcatcacttgtgtgaaaatttgccaatcttcagattatcgatccatgtgcaaaccctgcctattttgattaaaa

SEQ ID NO: 16427 - DNA, 630 bp, Triticum aestivum
  unsure (1)..(630): unsure at all n locations
  Clone ID: PAT_TA_16427
gggaaacaagccacttcagtttcctcctctactcataagtgtaccagcttcactactagtgtgtgtgtgtgagcagcaccgtgtgctctactagtttacactagctgtagtttagacttggttgatcctcggacaactagctactctgctagttcgggccaacactgaccgtgaccggattgttcatcacctcccacgttgtacaggcaaggtactccatagcctctcaagaaggtactcccggtgtgacgtgcagtgtgcgggctgtcatagggtaagaactattatcagtagcgtcacaccgaccgcgatggctaagtattttgaatgtcttgctgggaagttttgaagtattgatcggcaaaatgcaatgggataaaaaccaatggcgtgtcaaaaatgggcacccccctggtcgccccaggaggaaaaaagctgcggatgacgcttgaaggtgccgaggaagaggaagaactgcaacacctgtgaatgttgccaaaatttccccttgtaattgattgaagctgttactataatttcagattatgtatcaggcattgtaaattcccttctaatccagtgggtttatgtcagtgaatatgtgaattcagatattgccattgtcgtnnn

SEQ ID NO: 16428 - DNA, 3993 bp, Triticum aestivum
  Clone ID: PAT_TA_16428
gaggaaccacacacggcgcagtgcggccaggctcgtcgagcacatcagcacaaagcaagtagccgccaggaaatggacgcgacagcggaagctagcagtggagaaggagcacgccacgcccacggcgcaaaagatgaccggccggagaagaaggttccgttgctcggcatgttcaggtacgccgaccgcctcgacatgctgctcatggtggtcggctcgctcggggcggtgggcaacggcgtgtccgagcccctcatctcggtcctctttggagacgtcatcaactccttcggcgagagcacgaccagcactgtcctccgtgctgtcaccaaggttgttctcaacttcatatatttgggcattgggacagcagttgcttcctttcttcaggtggcatgctggacaatggcaggagaaaggcagtcagcccgcatccgttctttgtacctgaaatcagttctgagacaagatattgcattcttcgacacagaaatgacaactggcgaagcagtttctagaatgtctagcgatacggtcataattcaagatgctcttggtgagaaggcagggaagcttgtacaacttacatctgccttctttgggggttttatcatagcattcacaaaaggctggctcctgactcttgtcatgctaacatcactaccattagttgctatcgctggtgcagtgtctgcacagatgctaacccgggtttctagcaagcgtctaacatcgtatagtgatgcggcaaacacagttgaacagacaattggatctatacgaacagttgtgtccttcaatggtgagaagaaagctatagaaatgtacaataaattcataaaaagtgcatacaggactgttgttgaggaaggccttgtcaatggttttggcatgggctctgtcttctgcatcttatttagcagttatggcctagccttctggtatggtggaaagctaatcattgacaaaggttataccggagggaagatcgtcactgttttatttgccgtattgtatggcgcaacttcattaggtaatgcaacaccatcaatttctgcaattgctgaaggtcaatctgcagcatacagactgttcgaaacgattgagaggaagcccgaaatagattcagatgataccagcggcatgatcatggaaaatatcaagggttatgttgaactaaaggatgtgtgctttcgctaccctgcaagacttgggcagttaatattagatggattgtcattacaagtagccagtggaacaacaatggccatagttggagagagtggaagtggcaagtcaactgttgttagcctagttgaaagattctatgatccacaggctggtgaagttttgatagatggagtcaacatcaagaatctgaatcttgattggataagagggaagatcggccttgttagccaagaaccattgttgtttatgacctccattaaagataacataatctatggtaaagaagatgcaacacttgaagagatcaagagagcagccgagcttgcaaatgcagcaaacttcatcgacaagttaccaaatggctacgatacgttggttggccaacgtggcactctgctttctggaggacaaaaacaaagaattgcaattgcgagagccatccttaaagatccaaaaatccttttgctagatgaagcaacaagtgcattggatgtggaatctgagaggatagtccaggaggcactcaataggataatggtagaaagaaccacactcgtcgttgctcatcgtttgagcactgtaaggaatgttgactgcatcacagtagttcatcaagggaaaatagttgaacaaggtactcatcatgcattagtgaaggatcccaatggagcttactcccagcttattaggctacaagaaactcgtggtgatgaaagacgtaaaatacaggattctggagtgcccaattccttatcaaaaagcactagtttgtcaattagacggtcaatgactaaagattcttttggcaatagcaacagatactccttcaagaaccccttaggattatcagttgagttgcatgaggatgaaatcacaggtgaacagaacaaagacgacctttccaatgggaagacccttcagaaagcaccaattggacgtcttttttatcttaacaagccggaggtaccatttcttctgctcggtgctatagcagcatcggtgcatggagtcattttcccattgtttggcatactaatgtctggcgttataaaagcattctacgagccaccagataagctgcggaaagattctagcttttgggcattgatatctgtagttctggggtttgcatctttcattgcaatcccagcagaataccttttgtttggaattgctggtggcaagcttatagagcgtgttcgtactctgtcatttcaaaatattgtgcatcaggaagttgcttggttcgataatccctcaaattccagtggtgcacttggtacacgactctcagttgatgcattaaatgttcggcgcttagtaggagataacctgggccttatagtgcagtctacagctgcactgatcactggctttgtcatagcatttacagcggactggaggcttgcactgattatcacttgtgtcattcctttagtgggtgcacaaggttatgctcaagtgaagttcttgaaagggtttagtgaagaagctaaggagatgtatgaagatgcaagtcaagttgcaactgatgctgttggcagtatcagaactatagcatctttctgtgcagagaaaagagtggttacaacgtataacaagaaatgtgaagctttaaggaaacagggaattcgaagtggaatcgttggagggcttggttttggtttttcattcttagtgttgtatcttacatatgctctatgtttctatgttggtgcacagtttgtacgtcagggaaaaactacttttgcagatgttttcaaagttttctttgccttggttttggcagctgttggggtttcgcaggcaagtgcattggcatctaatgcaacaaaggcaagggattcagccatttctgttttcagtattctagacaggaagtcgaaaattgacacgagtaacgacgagggcctggtattggaaaatgtcactggtgacattcatttcagtaacgtcagtttcaagtacccatcacgccctgatgtccaaatattcagtgactttaccttgcacattccttccagaaagaccatcgcactagttggagaaagtggtagtggcaagtccactataattgctttactggagcgcttctatgatcctgattctggtataatctcagtagatggagtcgaaattaagagcttgagaattagctggttgagggatcagatggggctggtaggccaggagccagtacttttcaatgacacaatccgtgcaaacataacatatgggaaacacggagaagtgacagaggaagaagtcacggctgtggccaaggcagcaaatgctcatgagttcatatcaagcttgccacagggatacgacactctggttggcgagaaaggagtgcaactatctggtggacagaagcagagggtagctatcgcaagggccattataaaggacccgaagatactactacttgatgaggcaaccagtgccctggatgcagaatcggagcgcatcgttcaagatgcattggatcgagtcatggtgagcaggaccaccatagtggtggctcaccgcctctccacaatcaaaggggctgatatgattgcagtcctcaaggaaggcaaaattgcagaaaagggaaagcatgaggccctaatgggaatcaaggatggggtctacgcttcactagtagaacttcgctcaaattcctgagtagaattgtgtattgtttgacttttttttctttcttcttttactgcatttgtttgttcctagtacaattatttggccatggaatacaatttgtgatttgagaagtgaatgcaagaggttagcggtttgttg

SEQ ID NO: 16429 - DNA, 800 bp, Triticum aestivum
  unsure (1)..(800): unsure at all n locations
  Clone ID: PAT_TA_16429
gtcgccgtggcaatgcaggtcgtcctcggcgcgttcctggcgctgcgcgcctggcagctgcggcggctcgacagggccgaggtgtcctcctccacgcccctcacctgacctgaccgcctgctctgctccttgctcgtcccgccaggtccgtgattcgttaattgtccgtgatctgaaatcgtcgctgtaaggaaggaggccatgaacgcatgcctattctccattaattccatttttacacgccgttcttttcgcatgtgttgggcgccagtgcttttgctgtagggtgtgtacaattcgcttctgctccgtgcagaccctagtagacaggccatgtgatgcactgatgtgagagctgtggtgtctgttttatttgtgagtaggtactagtactagcaagtgatccagattccgaaatggtgacatgttgattgattcgtgtggggctgggactgattataggcttatagctgcttgcttagatgggcatcaatgtacaaactacagagtgattcaaattatttctgtgggtgccgtgatcttagctcttaaggtatgtcacctgtgctacacttcaagagaatcaacattgcttgctccatggtgggaatgattgagccagcgattacacaatgaattgcacttatgaacttgggcctttgtcaccccngcnagatggttantggattaacaantgatggaaacctttttttaaaanaagcgggtgtactgacttgttcnacaccccgggcnaaccgnnttcttccaacngcacggattcttccaancncacgtcnccc

SEQ ID NO: 16430 - DNA, 691 bp, Triticum aestivum
  unsure (1)..(691): unsure at all n locations
  Clone ID: PAT_TA_16430
atgaggctccatccgccactgataagaaccatggggaacctcgcgagctggcacttgtgatcgtcaacgacggctctggtgcagcattagtcacggaggaagatggcggcgaggctccagcagccaagcggccgctcttggcctagcgtggtcgcggccgaggtacgccagagtgcagcacccagccctgcaaactgccccttgtggcagctgacgaaaactctgctccggccctagcctccgacaaggagggtgacaccgaagctccatttgtgaagcacaagcgccgtcgtcggacctgcagatcagagccggcaaaatccacctgcggctctccctcgacatcaattgcagacaagaaggccggtggcaacgttgcatctgctccacccaagggccgtggctggttgcgcaaaccgtcattgatggctgccgccgccgatgaaattacacccaatgaggctcgatcatgcacaggtcaagccgcgccgcaaacctcgcaaacagtttctgctgaacttttatgatgaggtacctgcccgggcggccgctcgcctccgcactgctgccaaagtgcccgggggcaacaaagtccgttantctgaacatggaactcaatgaaatcgtcacatagttgaaagacactcttgattcctaaatgcatgcacaagacatacttttgtgttcaacn

SEQ ID NO: 16431 - DNA, 703 bp, Triticum aestivum
  Clone ID: PAT_TA_16431
tctgggagtacctacatgtcatcacagggaggtcagcaattgtcgtcggagtcgtggcacttttcaccggaatgaagcatttaggccagaggtatgacagtgaaaatgtagaggagctcacctgggccttgatgctgtgggtgctttctgccatagttatagctctgtccctagaatataaagaggtcaaacgaaggggcggcgaccgaagcttcagagggcactgggttctaggtaacaccgaggaagatgactcggttgatctcttgcatcctgacagctctgccaggagttcagaatctaggccttctggtgtaatggaggtgcagcttgagcctctcaccagatgagtagtagaatagcgtagatcaatctgtatctcccagtgtcagatacacacacacacacacaccaagtcctgttttcagtcatacaacagaaacagatggtgtccacaagcacggtgactttccgctcagaaagaaaattgaatttctcatgcttgtttcttctaccatggcagaatggtaccaggctacataggatcttcaaattatgcctttgattccttgcgtcacactgttcagattgtatagtgtacattttgttttttcacaatagacaggcacaatttggtacattgcccccccaagtaattccttttcccatcagattttgagagagagagagaagatatacattt

SEQ ID NO: 16432 - DNA, 426 bp, Triticum aestivum
  Clone ID: PAT_TA_16432
ttcagacacggatgaggcggagcacgacagctcggccgagatgaggatgagggcattggcctgccctgcctcggtcgctcccggactgggactccgagagagggatggatcgatgtgctcgccgcgccaactgaagcacccgacgcagtgcccctagtgatcgaggagatgaccgacctggacaacggcgcgatcacaaacgaagaacccagcggcgcagagtccggcgttctccccattactttggacgtgcagtacaacggcgatcgcaatatagcctacgacgattcagttaggcatcgtcagtcttttgagtgtttagcttgccacgaattatcatgtaccgaattgttgctttgcaacacagagagtaatgcaaatgatctcgctcttgcacaaggaacaaaaaaaaaaaaaaaaaaaaag

SEQ ID NO: 16433 - DNA, 595 bp, Triticum aestivum
  unsure (1)..(595): unsure at all n locations
  Clone ID: PAT_TA_16433
ggcaaacctagatccccaaattcgcgctgcatccacgccttgcgccgcaacaaaccctaggccccaaatccgatccgcgcccacctcttgcgctgcctgccatggccacctctgccgccgatgccgccgccgccgccgccaccgttccctcgtatcctgcttgggttctcctcgaaaagaagggctacgacgacgagctcgaccgcgtcgacgccgccagcgctacgtcggagacattcggcggtcgcgccgtcaaggtggccttctacctcgtgcctccgccggaagtctcctacttctgcttccacctctccaagctcgagggcgacgacgacgacttcgacttccagccactgtttctcttttcagctaagggtttcgtcctctttcgtttgctcttcatcaatcgaagcgacaagaagcaatctcgtcgaggtacttcatgtacaaggcaaggggcggcaaaccgtcgctcgaacctatcccgtcaactcctctcagtaccagttgcggctcgacatcctcctgcctcgttccctgccccgatgacnnnnacaactatgtccttgccgatctctctnnnggtnnnnacctt

SEQ ID NO: 16434 - DNA, 930 bp, Triticum aestivum
  Clone ID: PAT_TA_16434
cccacgcgtccgctcatcacagagcagagcagagcagaggagcaaccctagctgcagcgcagcgtatcccacccacccaccccccgacccctatcgcccgcaccaagatggcggcggcgccgacgaccttctccggcgaggtgtgggcggagctgcgcctggcggacgcgcgcgacgtgccgcacatccacagcctcatccaccagatggcggagttcgagctcctcaccgacctcttcgccgccacccacgagctgctggcctccacgctcttccccacgccccggccggcccccttcgcctccttcaccgccctcatcctcgacctgtccccggcgccttcccgtccccgcgcggcggcgggcgcgtgacggccgggttcgtcatctgcttccccaactactccaccttcctggccaggccggggctgtacgtggaggacatcttcgtgcgcgcgccgtggcgccgccgcgggctgggccgcatgatgctgtccgccgtcgccggccgggccgccgagatcgggatgggccgcgtggagtggtgcgtgctcgactggaaccagaacgccatcgacttctacgaggggatgggcgccgaggtgttcaagcagtggcgcatctgccgcctcaccggccccgccctcgaccagtacaagggcgccggcgccggcggccaggaggagcaggacgccgccgggaaggccgagtaggccagtaggagaggacagatctgggctcccgagactggtaataataaaggtggtggattttgcctccacttggtgatgtattcttccttgctactgatagtgatttagtgcattgatatgttcttcatggagatgcattatggacctgttcttgccttccttgggaaggagtattgaattggaatctgaacctgggaatactccccaaaaaaaaaaaa

SEQ ID NO: 16435 - DNA, 497 bp, Triticum aestivum
  Clone ID: PAT_TA_16435
ctgcaccacgcggaaaccagcgagggaataggtcacgccgctctcctcgctcccctctctctcctgcgacatcggatctcgcagccccgtcgccactgtctacatcgccggcgggcatcctcgctgttgaggagcatggaggatgcagattctggaagtgggcaaacaagtacatataatacttcagcgtgcccgacatctgatttcgcatgcatcggtccatcgccacgtatctcttctcgaacagaatcaagcattttgaagaacatttttatcatggggctcctgaacctgcgagccatggccatgatcttcatgcacaaactctgaagcttacccgctctgcaaaggcactgcagtagttttcatatgtattccttttccttcctgtgctccgttaatgcatgtatcagctagtgcgcgttgctttttcatgcgggtagactgctggcctatcaataatacatctccaaacgtttgtgtgcaaaaaaaaaaaa

SEQ ID NO: 16436 - DNA, 1351 bp, Triticum aestivum
  unsure (1)..(1351): unsure at all n locations
  Clone ID: PAT_TA_16436
ccacgcgtccggtctcctccagcttcgtgcgggcacgcctccaccgtccgcccacgcgtccggccgccgccgcgggcgcgacgccagcgacggcgcggaaggccctcgcgtccacgacctccgccctcctctcctcttcacccgcgctccgccgccgcagcttgtcctgctccgccgcatcagcagcgaccgccccgcgcatcgcgcagcagccgccggacctgctccggtgggtgcagcgcgagggaggtttcgtgcacccagctctccgagtggccgatcaccccgagtacggcctcggggtgtccgccacggcggccgacggcgtcatccccccgggagccgtcctcattgatctccctgggcgcatcccgctacgactccgccacccagccgatgctgcggacgcagtactgatgcagctcgccgaccgagtccccgaggaactctggtcgatctggctcggcgcgccgctcctccaccagaggactaaatccggccccttccggcgcccgtttgtcgcggacctaaaacagaagcttggtactgtgccctcaggagatcatcctttttgtggacaagatgtgcactcgtcttcccttggatgggctatgtcagcagcgtcttcacgagcattccgtctgcatggtgaaatcccaatgttgttgccccttgttgatatgtgcaaccacagttttagcccgaatgctaggattgtccagaaaggagatgtggagagccctgatatgtcagttaaggttgttgctgagacgcagattgatcaaaacgctgctgttacactgaactatggttgctaccctaatgatttttatcttcttgattatggatttgtagtaacatcgaatccatacgatcaagtggaactgagctatgatggtaatcttctcgatgctgctagcatggcagcaggggtttctaatcccaacttttcaacaccagccaagtggcaacaggatatcttgtcacagctaaatctacacggagagggtgctgttctgaaggtcagcttaggaggtccggacgtagtagatgggcgcttattagctgcgcttcgagttcttcttgcagctgacccggataccgtgggtaagcacgatctggaaactttgatgtcgcttggcacgaaagctcctctgggccctaccgtcgaagcctcggcgctccgaactgttctcgcactttgcgccattgccctccagcacttccacaccaagataatggatgaccaagccgtcctgaagggagaaccccctcttacaactgaactggccgtccagtttagattgcagaagaagctgatgctccgtccgacataatgcaaaatccttan

SEQ ID NO: 16437 - DNA, 554 bp, Triticum aestivum
  unsure (1)..(554): unsure at all n locations
  Clone ID: PAT_TA_16437
ttccttccttccctccccccttcattccttcattccttggagacatggcgatggcggcgcccaagctcatggtgccgggcctgtgcctgcttctgctgatcatagccgctcctcttgctccctggatctcaaggggcgacttgcaaggagctgagcaagacctatgactctcccaactgcgagaccggccgatgcgtggagcactgccaagtggagggctacggtagcggggtgtgccaggggagctacttcgacccctacaagatactctgcttctgcaacaaaaactgctgagccgccagcgacggcgcattgcttcgggccggggtgtaataagatgttagctaaggcgagccgtcgtcgatgcgcgactcgcacaagtttgtagttgtaataggtttcatctgtaccaattttattttcaactgctcgtctccccagtaagaattgtcctcaacttgccgaaatggtnccctgtccccctttnatncgtcctgtgaaaagattcaactaaaaaaaanaaanaaaccnagggggccgtaccaatcgcctaa

SEQ ID NO: 16438 - DNA, 624 bp, Triticum aestivum
  unsure (1)..(624): unsure at all n locations
  Clone ID: PAT_TA_16438
actgttgactagatcgaggtgctagcggcccgatgcacctggcggctaccggatccgtccccctacggatccactagctcaacactctccgccaccgccatgtccaccatggtggccagcaatgcaaggtgtctcttggcgttcggccgtccccatacggcggcatcatgtcggcgccccacgtccaggtctacgctcttcgccgtcggcagcctccaccatgtcgccacctccttgctgccggatgagacatcctatgcatcattgtcatcttggttgccggtgaaagcctgctctttctcctctgggatcgatttcaccttcatcttgctctgccacgggtggatcttcagtcccctggcatatgtgttgtccattctatactcccgccggctggccagctgtgtgtgtgtcgtgggtggcttgacgtgcgcgctctattggcattgtaagcgggcagttgcaggcaggggacgagctggcgcctccttgcagaggaggtgtaggcttgcatggcaccaccgggtgtgcgcctttgatctgtcgtggtctagtgttcggcaacggcgaagtgctggctgtgccgtcgcacaggtgcgtctctcatcnaatattgcaattgac

SEQ ID NO: 16439 - DNA, 1028 bp, Triticum aestivum
  unsure (1)..(1028): unsure at all n locations
  Clone ID: PAT_TA_16439
ggcagaagctgctctaataaaaaaattgctcgaagagagtggtaatgacataaaggggaagaaacaacctgtggaaatgacaaattatggcacctctatgtataaccagggtgccaataaaacgaagcccaaggcaaagtgcattgaccctagaggagagcacgccaggaggagtgaaaggaaaagaggcagggagcaaagggggaccaacaaactttgtgtcttgtctgtggagcttgtggaaagcttgggcacatgcggaccaacaaactttgccccaagtatgggcaggatccagaaacctcaggattggatgtgatttcctacagatctaatcctcttgatgaagcaagtcatgttcaaacaacgaagccaccggccaggaaggctggtgagccaaggtttcttctgaagttcctgaaactgaagggcccgattgcatcgaaaagatcaaaccagtaagattcagatgtggtgcacctgagaagtccttggagaggaatatgtcagtggcaggttctttggtttctgataaactcacaatggatgctaatgatttgagatctactggaacgtccagcaagattaaaatatgcagtaagcctaagactgaagattatcctcctgacactcctaagccatcaattgtgatacggcctcctgctgaagtagagaaggatgtacctcgtaagaaggtcatcatcaagcagcctaaaggacatgtagaccagctaagagctattgaagttaggagtggtcaggagcctagaaagataaggaaaattgctgaattgtcaagttttgagaagaacagcagagatgatgatggttggtatgctggagagcccagccagatgaattcctcacatgataggttgggtcgggatggtaacaggaaaagcaaagaagtaatgggagctgatgaatcctggagagcttttaaagagcagcgagagagacaggaacagaggctaattgaagctaggatttatagccgggaggaagagcnccagaaggcaaagaagaaa

SEQ ID NO: 16440 - DNA, 735 bp, Triticum aestivum
  Clone ID: PAT_TA_16440
gcggccgcccgggcaggtactgatgacgtggagtttttcgagtatgtcgaagcggttaagttgactggtgatctaagtgtccccgctggacaggtaacgttccgtgctaaggttgcgaagggcagccgtcttgagaatcgtggtgcataccctgaagagtttggtgtgactgccagttataaaggtcaggggagaatagcgcaacctggattcaaaaacccgcggtgggtggatggtgagctgttggtgctcaatggcaagagtgcaatcccacacattggtggcgcagagctcggtttcctgtacagcgtgcccgagcagagcttcctggttctctttgaccgccttacgcttcccgagtgaacgagatctcgccgagacgagctggttctcacatgggagggaattccatggagagacaaactggcctgatttcaggcggccaaaagtaggttccgcgcggctttctccgtcatcctcatcctcaccagagcgagcttcctgtgacagatggctggctcctcacaggagatccactcggttcggcattttcgagggtacagagaaacatggcattctgcgtcctgggaatatggcttggtatattgagctgtcatgtgacgtgatacaacataacaaacttagggtggcaaacatgcgtcccggttagagttccggcgggcgtgtcccgggttccgggttcggtcatttgttccacttgttgtggcaggcctt

SEQ ID NO: 16441 - DNA, 2507 bp, Triticum aestivum
  Clone ID: PAT_TA_16441
gattcggacgagaaatcttgccttgatggtttatatcactgttggttctgccgcaaatcctattttggaatttttggaagagtggggcacagaaaattttgaggagatatcaccggcagtcattcctcaagctgctaaaatatttgtcaatggttgttgggttggaattcataggaatcctgacctattggtgaagacccttcgtcgtttaagaagacagattgatgtcaacactgaagttggtgtcgttcgtgatattcgtctgaaagaacttcgactctatactgattatgggcgttgcagtcgcccactgtttatcgttgaaaaccagaggcttctaattaagaagaaacatatccgagcattgcagcaaagggagactcctgatgaaggttggcatgacttggttgccaaaggatttatagagtacatagacactgaagaggaagaaactactatgatctctatgcccggccgcgtcctcgaaacttcgaggcataatccaggggaggcatattctgagacttatacgcactgtgagatccacccttcattgatacttggtgtgtgcgcgtcaattattccttttcctgatcacaaccagtcacctcgtaatacatatcagtctgctatgggaaagcaagccatgggaatctatgttaccaactatcagttaagaatggacacattggcctacgtgctgtactacccacaaaagcctcttgttactactcgtgctatggagcatttgcacttcaggcagttaccagctggcattaatgcaattgttgctattgcatgctactctggatataaccaagaagattcggttattatgaaccaatcttcaatagatcgtgggttcttcagatcactatttttccgctcttacagagatgaggaaaagaagatgggaactcttgtcaaagaggaatttggtcgtccaaatagggagaacactatgggaatgcgccatgggtcttatgataaattagatgatgatggccttgcaccaccgggaacaagggtctctggggaagatgtcattattgggaagacatctccaattccacaagatgatgctcaagggcaagctactagatactcaaagcgtgatcatagtacttctctgcgtcacagtgaaagtgggatggtggatcaggttctgttgacaacgaatgctgatggttcaagatctgtccaggtttgaacgcgttcagtgcgcgtaccacaaataggagataagttcagcagtaggcatggtcagaagggaactgttggaatgacttacacacaagaggacatgccatggacaatcgaaggcatcacgccggttgtctttgggagtccgcatgctattccatcccggttttctctggggcagctcattgagtgtattatgggtaatgtcccggctcacatgggtatggaagcagatgcaactcctttcacagatgttactgtggatattgtctgttacgcacggcacaagtgaggctatcagttgcgtggatttgagaccttgttcaatggtcatactgggagaaaattgactgcaatgattttcttaggtccaacttactaccagagacttaagcatatggtggatgacaaaattcactctagaggtcgtggtcctgtccagatactgaccagacagccagcagaggggcgctcacgtgatggtggtctccgttttggagaaatggagagggattgcatgattgctcatggagctgcatttttcttgaaggaaaggttatttgaccagagcgatgcttacagagtgcatgtttgtgagaagtgtggactcattgccattgccaatctcaagaagaattccttcgaatgcagaggctgcaagaacaaaactgacattgtccaggtccatataccgtacgcatgtaagctcctcttccaggagctcatggcgatggcgattgctcccaggatgctcacccatgaggtcaagggtgcgagggataagcaccgttgagcttgagtgttgtattcgggtgcctgactggaactgttttccggggtaccttgttgcggaacttaagaatgagtatagctcttctgatatggattttggttctgatggctaggcattttgaagagcgatcatccttctgattgtgtcctggataccgtcagataccagacccagacatgaagttacttaggttctttattacattagtattcatttactaacaggactaataatgtgttgtaacatcatcttttgacagtcttggcttttaagagctcaactcgaacgatgtttgtatgaagacagttgcatgaatttctgggtgaggcatgagtagccttcttattacattagtgttcatttactaacaggactaataatgtgttgtaatatcaggaaaccaaggaaaccctggaacgcatttaatttagattttagaaattttaataaggcataacttttgaactgtgtgtcgaaattaaaaaaaaaaaaaaaaaaaaaaaaaaaaaaa

SEQ ID NO: 16442 - DNA, 2804 bp, Triticum aestivum
  Clone ID: PAT_TA_16442
gtcactgcgtctggcgcccgcccgcccaaaccgagccacccacgccgccccgcccccccccacccctcccgacatccccacgcaactgcggacgaccggagcccagctgccgcccccggcggcgggaagacaatccccgcccctccccgctacttatacgctccgctcggctcggctcccccctcctcccctcacacccgctccccttcccccgtccctcccccgccccgcccccgatgcaacccctctcactaacgcgaaccatggcgccaatccagtgcgtcctcgcagcgaaactgctgctccccttcggagcgctcccctgctgcggtggcgcaccgacgcccatgtgcgtgagcccctcactggagcacgagaccaacgattccaagaggaagctcctgaagcttgcgctcggaggagtaggcctgcccgccttgctgactgccaacaaggcgctagcccatgaccaaggtgtgacttcctgccgtctgtcctactcgactttcctcgagtacctaggcaaggccagggtgaagaagggcgacctgtttgagaacggggccattgctatcgtcgcggcaatcgctcccgaacacggcgaccgcgggcagcgggtccgtgtgcaccttcctggcctcagccaggggcttccccgtaagtttaggggagaagaacacggactatgctgcccacaacttgcaggatcgcgccggtttactcctgttcatcccttgttgtaccttgtcggtgactctgcttcttggctgcgccctattggtgatgtggggcaggggacgggatgaagagagcgtggggccatgggtgacccgcgaccccctggcattcagcaaggtcttggccgaactgctggagggttcgagactgagccgttacgtgctctgatgttagcggggccgacggagccgagctcagctgccgggaactgggtgcccactggtggccccccgcggccgtccccggtgttggttcgcccgtcgctaatggggttctgagagttggttgttgttggaggatgttgatattgcttgggatggagatcgcaggacaggctctcgtgggcatggtctcgtaatgtggttctgagttcgtggataagtcagttggtattggtgccgcacgtgtttgtgctctcgtccagaaggcctaccagatgggtccttgaatagtgttttttgatgcacttgatgctgtagggagggaaaggggaacagttatcggtggtgggaacgatgaaagggagcagactctcaatcagctactgactgagatggatggttttgagggcaacactggcatcattgttgttgctgccaccaacagggctgacattttggattccgctttacttagacctgggcgctttgacagacaggtgagtgttgatgttcctgatgtacgtggaaggacagagattctcaaggtgcacggtagcaacaagaagttcgatgctgatgtttcccttgaggtcattgcaatgagaacacctgggttcagtggagcagacctggcgaatcttctgaatgaggcagccatattagcaggccgacgtgggaggaccggaatttcctcgaaggagattgatgattcaatcgacagaatagtggctggtatggaaggaactgtcatgacagatgggaagagcaaaagccttgttgcttaccacgaagttgggcatgcagtttgtggaactttgacgcctggccacgaccccgtccagaaggttaccttagttccaaggggtcaagcccgtggtctcacctggttcattcccatggatgacccaacgctcatctctaggcagcagctctttgccagaatcgtcggcggccttggcggcagagctgctgaggagatcatattcggagattctgaggtgaccactggagctgccggtgacctgcagcagatcaccggcttagccaagcagatggtggtgacgttcggcatgtcggacatcggcccgtggtctctgatggacgcggcgcagagcggggacgtgatcatgcggatgatggctcggaactccatgtcggagaagctggcgctggacatcgactcggcggtgaagcagctgtcggaccaggcctaccagatcgccctgcagcaggtgagggacaaccgcgtggccatggacaagatcgtggaggtgctcctggagaaggagacgctgagcggcgacgagttccgggccatcctgtccgagttcaccgagatccccgtcgagaaccgggtgcccccgacgccccaggcggccgtcccggtctaggtttgcccgcgtttatagggttggagaatttgttgttgttgtaagatgttcatatttcttggatgtacactaattcctactggaggcacggcatgtaatgtaactcactcgcggttaattataagatgtaattacctgggaaggatttttgcgtgagggctcctggtttcccatgggaagggaagccctgattttctgacgcagagggggaaaaaagagccttggatatggtcttgtgaggtttccccatttcgaacctgaacttctgcgttcaacagttagttaatcgtatgatctttcaaacgaaatttggttttactttggttttgttggtgaatttatgtacaaaactgatcgattgaactatggcaatgtgtggattgtaccccacaagtttgtgacttatacaagatctggctagtgcatcactactctgatttaaaaaaaaaaaaaaaaaactcgagactagttctctacctgcccgggcggccgctcgaaatcacttagtgaattc

SEQ ID NO: 16443 - DNA, 656 bp, Triticum aestivum
  unsure (1)..(656): unsure at all n locations
  Clone ID: PAT_TA_16443
acatcaccaaaatcgatgatgattgcacaagttattggaacagccatgggttgcattatctcccccctcacgttcatgctcttctacaaggcatttgatattggtaacccagatggtacttggaaggcaccttatgcactcatataccgcaatatggcaatacttggtgtggagggcttctcagtgttaccgaagtattgcattgcaatatctggcggatttttcgcatttgcggcaattttcagtatagcaagagatgtcatgccacacaagtatgcgaagtatgtgcccctaccaatggcaatggcagttccattccttgtaggtcggagcgtgccgccgcccgggcgcctcgggagtttgatagtttttgcatggaccaagataaacgagaaggaggctggcttcatggtgcccgcagttgcatccgctttgatatgtggggatggcatatggacgtttcctgcttcaatacttgctcttgccaagattaaaccaccaatttgcatgaagtttctacctgctgcctaaacaaccgaaaagtgtgctagtgaccaaagatgcgttgaatttccatagttgtgcctccctgaactatatttgcaatgtgttgtgtttatttgagatgttttagtacctcggccgcgaccacgcna

SEQ ID NO: 16444 - DNA, 579 bp, Triticum aestivum
  unsure (1)..(579): unsure at all n locations
  Clone ID: PAT_TA_16444
ggacgccccggcggatcaagcgcatccgcaacccgcgcgcggcgcggggcacctacaacgagtacaactacagcctgctccggccggcgcggcgggccgactacgtccgcgtcgtcttcgtcgacgccgacatcctggtcctccgcgccctcgacgcgctcttcgcgcttcccgcagctcgccgccgtgggccacgaacggctccctcttcaactccggcgtcatggtgctcgagccgtccgcgtgcacngttcgacgcgctcgtccgcgggcgccgcaccgtccgctcctacaacggcggcgaccaggggttcctcaacgaggtgttcgtgtggtggcaccgcctgccgcgccgggtcaactacctcaagaacttctgggccaacaccaccggggagcgcgcgctcaaggagcggctgttccgggcggacccgcccgacgtctggtccgtccactacctcgggctcaagccctggacgtgctacagggactacgactgcaactggaactgccgcgcccagcgcgtcgccgccacaagccaccccgctggtggaagtgacacaaatggggacanatccc

SEQ ID NO: 16445 - DNA, 603 bp, Triticum aestivum
  unsure (1)..(603): unsure at all n locations
  Clone ID: PAT_TA_16445
tcacgcacatcatcggcgccggggtcaggataacggccgccgggggcgtggtgggcagggcggaggtggagcgcaaggtgaggaggctgatggacgccggcgacgcggacgggcagaaaatgcgcgcgaaggcggcctgggcgcagaaggcggcgaggtcagcggtgagcgacggtggcacctcgcgcgtcgcgttgctgaagctggtggaggagctccaggggagctactgtgacgtcatggtggcgaacaaggatcgctcttaataatcaaatcaatcggcggcgacgggacgatacggacgcgcatgatttcggaaaataacctcagctcctgtgtacgtgcaccgatgtgtaagtgcgtaatctgttgtgtgatatccgcgtactcctccattaattctgtagcgtcgtgatcgtgcacttcatcgggctgctgctcatttgctttgttttagctattttatttgtgttcgactaaagacactttaatggtgttttgcaaaactttccgattatgtgtgtatatgggggccggtaccaatccctaaggatctatacccgctatgctcnttaactctactggaaaccnggtacactaacc

SEQ ID NO: 16446 - DNA, 714 bp, Triticum aestivum
  unsure (1)..(714): unsure at all n locations
  Clone ID: PAT_TA_16446
tgctggcaactttgttgggcctccaatgcatggtggtttcatggtgcaatctaatcatcattctctgcagaaaccatacaggaaaccttgttccagtcatgcatcaccctacctacatgatgaaagaggtcatcatgattaatgatgatcctcctgaatgcagaagtgagccacaagtcagtatgcatcctcccactggaacctatccaacatcaatctccgtcccaaacaattttgggcccaggccattttactgccatccacccccgatgcaaattttgccaagggagaattttgctggatcgatgcctgttttcccaatgtttggtgctcaaaggcagcaagtcagatatagccaatccttacatctcaccccgtctcgtgtccagcctccacaaggttacataaacccacatgtctactatccgcaggatttacggtgactactcaagtaacccaaatgaccaagagaacttgaaatgaatttgtgatgggtctaaatactgggattaagtggatgaacccgtcttaaaatgcctgactctcaacaggattttttttccacataaatttgcttcctttaattgncttttcaaggtacacatatttgcccncaaaggttttaattacattcngcaaattgcagtacattatacatggattttttccaataatgacaagcataatttcactattatcaaataagcaatatat

SEQ ID NO: 16447 - DNA, 969 bp, Triticum aestivum
  unsure (1)..(969): unsure at all n locations
  Clone ID: PAT_TA_16447
ccgaaccccagctagcttgcttagcttaagctccccacacacccgatagccatggcctgctacaaacccttcctactaccagagtggtgtttgccaagacatcaaacagaaggagcatctcttccacttatacatgaaccagatttttgatggtcagggtgtcaccaacgccaaccaagtcactgttgccaagccatcaggtcagctttcggggtttggtcacaccattgcaaacgactggaccatacgtgatggtccggctgccgatgcaaaccttgttgcacgtgctcgtggcatgcacatgggtgcgggcaaagtcgaccagaactggttattctgtcacaatatattgttcactgataccaggtttaaggggtccagccttaaagttcttggcgatttcgtaagcggcaaagatagtgaatgggcaattgtaggtgggagtggagagtttgcctatgcacaaggtgttgtggtcgccaaagaaatccaaactgtaccacctactcctgggcgtacttgggagcttcgtatcagtgctttctgtctgtgcatccccaaagtgaccccagtgacaaagatgggaccttggggtggagatggagggacatcctttgacatcacggagctgcctcgttctcttcaaactgtgacaattagatgtggggacgtgattaactcggttatgttttcctacactgaccaaactggccaaaagaaaacggtcggaccatgggggggtgccgccgctcgtcctgcctcgctcctcgtgctcctgccgtcttgtcaccggtccttgggcagcggttccgtggactggacaatgtacatctctacctggcagcagcgttcaacatatgggcctttggaaacaaatggacccttagcagcagntccgatgtacacattggggatcancactgctggggtcgtatcacttgcgttagctgcaatacacatgatgtctac

SEQ ID NO: 16448 - DNA, 412 bp, Triticum aestivum
  unsure (1)..(412): unsure at all n locations
  Clone ID: PAT_TA_16448
cgctctggtcgcaagagcagcagtgtgaatccgatggtgatgtcaccatcccgggcagctaacagtccacccaagggtttgcctgccgtcgtggatgagctcacctatgagcagttgcaccatgtcaccggaggctttgggagatgataaccttgtcaagcatggggcgctccggggacatctatcgtgggtgccttaagaagagtggcttaagatgttgtcgtagcaaaaaggtcgacgtggaaggagcagtaagaagaacatangtgggaattaagctttctntgtcgaaaaaatcccaatgcccaaggatttgttcccattgcctggggccattttgggtcaanggatgcacnaagggaaattgctangntgttacaaaggtacaatgntccaacaggggaagattttg

SEQ ID NO: 16449 - DNA, 594 bp, Triticum aestivum
  Clone ID: PAT_TA_16449
cgtccgttgactcatggggcaagctgaagatataattgttgtcaggggacggaccattgctcatggacgttctgtcagtggagcggtggttgtcctcgaggaaactggaaattatctggatgaggttctagtttcaattaaaggcacttcttcgcaagttcagactgcgcatcatctcatacaggaggtgctactgggcgacagaaaatttttaccacccaggagcaggggttactgcaaccctgacgctggcccggtcaggccgtggttcgacccgtgcggcgctccagcgagtccggagtacgccccgcctctgtacagcgactacctgtcatcgtccagcagcgtccgccactatcactctgctgcttaccacgggtacaggctgtagcacacagaaccgagcgactgaccgcgcgcctatcctcatcgccgcgcctaacctaaagatccccacccgaaccctgcctgattaagtagagattgaatggaacggctttgccatcacgattgctccgacgctacgccccagcagttacttgcctgtggtagtctgtctgcaaaaaaaaaaaaaaacccacgcgtccgcggacg

SEQ ID NO: 16450 - DNA, 710 bp, Triticum aestivum
  Clone ID: PAT_TA_16450
gccggccgccggccgggcctctctcgcccgaaccagacgccgcaccaatcccgcacccgcacagcccatcggcgacctcgccggagaagagaggagaaggtgagagatggaggcggcggcggcggcggccggcgtgcaactgggcacctcgaagccgcagatcgcgacccaggcggagatggcggaggcgcgcctgccgatcccctaccgcgaccagtgcgcgcacctcctcatcccgctcaacaagtgccgcgtcgccgagttctacctcccctggaagtgcgagcccgagcgccactcctacgagaagtgccagtacgagctcgtcatggagcggatgctccagatgcagaagatccgcgaggcgcaggcgggcgccaaggtcaagggcagcgtcaccatcggcgtgcccctcgccccctccacagccaagctcgcctgatccgtctgattcaggactggttggtgactagagcttgaagggcgctgtgctcgcaaggatcatgaatgttgttcttgtatgaacgaaacatctgtttgaattcggcataaagttaactcttttcttttcttgtacccctctgccttccctccttcggttcaagtttaagtttgatggaataaggaaccagctgtcgtcctatactcgacgagtgaaatgacaagcttgaagttttgaatgaaaaaaaaaaaaaaaaaaagctccccta

SEQ ID NO: 16451 - DNA, 1180 bp, Triticum aestivum
  Clone ID: PAT_TA_16451
cccatccggaccggcccggcccagtcgcaggccccgacgcgagcccgccccgcgcccgcgcacggcccacccggcgaccgcgcccgacggaagagaggagaaggtgagagacggggccgaagcaggcgccgcaccgagcccgcacccgcacagcccatcggcgacctcgccggagcggagaagagagaagaaggtgagtgatggaagcggcggcggcggcggccggcgtgcagctgggcacctcgaagccgcagatcgcgacccaggcggagatggcggaggcgcgcctgccgatcccctaccgcgaccagtgcgcgcacctcctcatcccgctcaacaagtgccgcgtcgccgagttctacctcccctggaaggtgcgagcccgagcgccactcctacgagaagtgccagtacgagctcgtcatggagcggatgctccagatgcagaagaatccgcgaggcgcaggcgggcgccaaggtcaagggcagcgtcaccatcggcgtgcccctcggccccctcccaccgccaagctcgcctgatccgtcagattcaggagtggttggtggctaggagctcgaagggcgctgtgctcgcaaggatcatgaatgttgttcttgtatgaacgaaacatctgtttgaattcggcataaagttaactctttctttcttggtcttgttcccctccgccttccctcctttggttcaagtttaagtttgatggaataaggaaccagctgtcttcctatactctgacgagtgaaatggcaagcttgaagttttgaatgcagtgcatggcctctgcttttgcatctgccttgatgtagtaggagcctattttacaacatgaatatctctccttacgatctgttgctatattaaccttgtgagattactggttattgtggtcacaggccccaacgtgcgagctcgcccagcaatgcatcctacgtactgtgggagttgcgattactcgtattgggcggaacagatctaataattcttttattccacttattaagagggatctttaactaagaaatagacctaccagctaaaagagggtatcctgagcaattacaaaaatggggttcattgatattctcgtatagtagatgctatcacatgtacagtcatactcaattcgaggaggatcttttatagtttcacacataagaggat

SEQ ID NO: 16452 - DNA, 483 bp, Triticum aestivum
  Clone ID: PAT_TA_16452
accctgattcttcatcaacatcatccaggataccatgctcagatgataggtgtacagctgctctccagacaggggaagcactctgccaaccctcagacgccccaagcagcccatgcggttacactttcacgtatggtgatggaagtggcacgtcaggatactatgtgtccgacactatgtatttcgacactgtcatggggaatgagcagactgccaattcttctgcctccgtcgttttcggatgtagcaactcacagtcaggtgacctgatgaaggcagatagggcagttgatggaatttttgggtttggacagcatgaactgtctgtcatttcacaactgtactctcttggtgtatcccctaaaacattctcccattgcctgaaaggttcagataatggtggtggtattcttgtccttggtgaaatcgtcaaaccaggattagtatgtactccacttgttccatcacagcctcattataact

SEQ ID NO: 16453 - DNA, 653 bp, Triticum aestivum
  unsure (1)..(653): unsure at all n locations
  Clone ID: PAT_TA_16453
ccctagccttcctcttctacctttgctccaaagatggcccgggcctccggccccaaccccggcccgggccttcctccggtccgccgccgcacggagcccattgattcccctcggcgctggccacgccgtccccgctgctgtcggcgccgccatctccgccgctggcttggccgcctgccggcctcttgcttgtgccccggtgttccgccttgagaagccggtgggcgtgggcggtggtggattttgcttggagactgtgtgggtcagcctcgataatctgtggttcgctgctcaagccaccgtcggggtgttcctgcacctgattgacactccacctggcagttgggcagcttctacttcctttattcttccctccttcattggccattcccgctctcaaacgcaacttcgccgaaccccgacgacctccacccgcagcatgtcactcctgctcccggcgcgatggccaagctacacgccggcgccacggcccaagggttacgcgtccggcaaggtccgggattgcggccggcagctttcctggccgtcgctcgcgtgccgattggacaanaagccgtaaaagcatcaggggtaactttgatttcataggtcacggtaccacnggtntagtcctagancatgcaccnccaant

SEQ ID NO: 16454 - DNA, 316 bp, Triticum aestivum
  Clone ID: PAT_TA_16454
catattgctagataagagcatgacgcccaaaattgcagatcttggtttgtcacgggtttacgcttcatcagaaacacatcaaacagagattgtcaaacggaacacatgggttattttgccaccagaatacttacaacatcgcctaatatcacagaagttcgatgtgttcagtatttggcgccataattataaagatggtggcaggaaatactgggtcttcccgtcgttctcagatgcctcccatggagtttattaagcttgcaagtgaatactggaccaaaaggttgcaggccatgccggcctcgtactcgtcaca

SEQ ID NO: 16455 - DNA, 622 bp, Triticum aestivum
  unsure (1)..(622): unsure at all n locations
  Clone ID: PAT_TA_16455
cagcactaggacaaggtgaaccaagcatggctactcgtcccgtgtcctacgcgctcctcctcgtgctcacgacccttcccctagccctcgccaccagcttcccacaccgcgctctactccagacatgccagccaagcggcaccatcgccggcgagtccggcagctgcagcacggagaacgactccgagtgctgcgaagacgggcggcgctacagaacgttcgcgtgctccccgcgcgtcacgggaaggacccgcgcctcgctcacgctcaacagcttcgccgacggcggggacggcggagggaagtccgagtgcgacgagaagttccacccaagactcccaagatggtcgtggcgctgtcgaccgggtggttcccccggcggggggcggtgcgggaagcgctcgtgattccgggccgccnaacgggaaggaccgccaacggccacggtggtggacgaatgcgaccccaacacggggcgccacggggcagccttcgtgccccccccttgacaacattgtgacggtcgcggcntttggatgccccggctcanaggttnanggtgngcggtaatttccaacntgactagtnncactcaaacngaagccaatcgttcgtgttatat

SEQ ID NO: 16456 - DNA, 1079 bp, Triticum aestivum
  Clone ID: PAT_TA_16456
tcctctgcaacctgttcgacgagtgtcctgtcgtaaatacatccccttcccggcgccaggggtttgcatcacaccctactaccgtctcactcgtcactcggcgcaatgcttccacgatgtcgcctgctatgacggtctgatcaaattcgtcgagatcgtccgcgatggacctgactgcatgataaagggtaaaggctggcgagccaccacatggatcagaaacatctcttggggaggttggcgcaagcacaccagagttgatgttgctaacatctcggttgacccaagatattctgctctgttgcctgagctgtggaaccatgagacccataagctagagctgaagaaactggttttcttactacccaccctgagcgtgcgcaacgatgatcttcttcacatcatggccaaggtgggtggggaacatgacaaggcctgggtcatcgccgttgacatgaaaagtacggttgtggagggactagccccggtttcgaccggacggtactgccccagtacaatgttctccccatgtgccttccccagttacctcaacaacatgacccaggaaacaagtctgaagaaccactcgttggatgtgatggaggaatcttggaagaagaggaaattcaagccgagcacaggataagagggcctgagatgggcaacccagtggacaaatactttaagaggatgagtgcttcacagtgtgctctgcaagtgctgttgactcaacgctggttcagggaacttgatgaatggttggattctcaggggtcagcttgtgatgcatgctgcaaatcactaccttactggtgtccagcatcagctctgtgtttcgatattaaggcagtggtaaactatgcttcctataatggtgaaggagaaggtgcttccatggctgtagattcctgcttacgagctttggacgatttctataaactactgaaggagtcacctctgagtgatccatcaacaactgaagccatgaagcgtcaaatcagggttgcccttggagctctagacagcatcttggaatttgtaccactaaaccgtatgcccaggagcatacaaaaggcgct

SEQ ID NO: 16457 - DNA, 496 bp, Triticum aestivum
  Clone ID: PAT_TA_16457
cgtccgggaaaacctctgttagctcttcctctcgcgaaaatccccaaattactttgaggatctcgatttccctagcaccaaatcaccaacatcctcacaccatgtcgtggcacggcgtcttgcccgacgaagaggacaggatcgatctccccctttacatctcgcccgccactcccccttacatctcgcccgccacacttctccccaaggtgagagcttacgagatggcggcgccggattcgatctgcgtccaccacctggtggcgcgaccggcaggaggtgagcacgccaaatgattagctgagctcaagattgtggaaggggcaatcgggaatctgagcagggaggcattgccagggccggtgtatgggttccaggagctaggtctggcggaagcagttctgcacaacttggcgaggtgtcagttcgagaccccgagtccgttgcagtgctactcgatccccatggtgctggccggccgggacctgttggtttg

SEQ ID NO: 16458 - DNA, 542 bp, Triticum aestivum
  Clone ID: PAT_TA_16458
tccagccgggtgggcatgcgccgatctccagcaccgacaagcagataccgcctgatgctgagtccggcatggtctactcctagcctagacggcttcaggcagatgagataccgttgatcgtagatgactttagacgcgccgctcggaatgtcattgaggcggggttcgatggtgtagagatccacggagcacatgggtttttcttggagcagttcatgaaagatagctcaaacgaccatactgacaagtatggtggcagccttgagaaccgatgccgctttgccgtggaggtgattgatgctatcatccacgagatcggtgtggatcgtgtgggaatcaggttgtctccgttcgttgactacacggattgcttcgactctaatccacatgtgctcagtacctacatggtacaacaactcaataagcacaaagggtttctttactgccacatgatagagcctcacatgaccattgtggatggccgcatgcagataccccatgggctattgccctttatgaaagcatttaatggcacttttatt

SEQ ID NO: 16459 - DNA, 643 bp, Triticum aestivum
  Clone ID: PAT_TA_16459
cgtccgcctgacctcttgcccagccgcagccatcgatctagggttttcttcttcgctcatagattagatcggcggcggaggtcaggagaatcgaagcggaggaagggaagggcgatggcgaccaggatgtcaaaggaggagctggcggcgtatcagccgaggccgggggtgcgctgtgagaaggcggcggcggaattcttggcgaggaggaagaaggagatggagtccgagcctgaggagtcccgcaccgacataaacgcgtacgaagcaggcctctaccgtgtgttctgggagcagatgttcggcaagaacggttcccgctacgaggacatcacaatgatccctcccatggctttcactgatcatggctgcaagtttgccggcgtccagtccactatacagattttttccgtcaaagtcgaggagacaacgggagggttggtgtggcccttgcatgtctacggtatggttgcggtccgtgacgtcgttgaccacaaccgaaatgttatcttccatcgtgaaagggataactgccaaatcattaccacaatggatccatatctggcactaacgggtcctacccggggtgttgtggtgtctgttcatcctgtgtactttgaagttcatcttaaggtgaaaggtc

SEQ ID NO: 16460 - DNA, 427 bp, Triticum aestivum
  Clone ID: PAT_TA_16460
cgtccgcggacgcgtggggacctgcaacgcctgcgccacatgttactcaccaccggcgccggcggcggtcaccaccagctcgcctccgccgctactatcccagcgagtgggccttgttatggtgctgcgctgccgagccagcgggaccaccacatgtgcgcggacctcttcagtctgccgccggcgacgatgacgacgacgtcggccacggagcagtattccgagttcttggcgatggctgctgccaatctggcgaagaagggcgtcaggcccgacggtggtcaggaaatgagcacaaacaagcggaagcgcgacgggcggtcgtcgatgcttgccgcggccgacgttcttgcggcccacgtccagcagcagaccatcgacgtcgagcgcatcctgcttaaacatgcgcaaaatttgtggactactc

SEQ ID NO: 16461 - DNA, 619 bp, Triticum aestivum
  unsure (1)..(619): unsure at all n locations
  Clone ID: PAT_TA_16461
gacaagcgccgctccagcatccacgacatcaccaccgtcaacattcccgacgacgaccacgccagcaacaccaacccctcgccgtcgccgccctccgcgctcaccgccacctcctcccccccggagcagttcggcgcgctcgtggacagcaagccgcctcctctcggcgggcaccaccacttcatgccccatctcttccggcgccgtgaaatctggaggccagcaataacggctaccacggcgactctgttctgatgcagatgcaatgcggccagctccagcctctcggttgaccagcggttccttggagcagcagcagcccagccgccatcggagaaagctgcctcgtcgtcgggcgtgcacgaggaaggagaaccacccagcgtcgcacgtgctcttggtcccaagatcatccatgcaggaacacactggacggacggacggacggagagggagcacgagatgaggatgagcggcaaggcagcaggatggatacggcattcccgcggtgtaacgcacgccacggtgaaatattacaatattctccnatattcaggagtccnattgcactccgagcatggagaccatgggaacacttagttggaacaactacacagng

SEQ ID NO: 16462 - DNA, 459 bp, Triticum aestivum
  Clone ID: PAT_TA_16462
cccacgcgtccggagataccttcctgcccatcatttccagagcctaatgtccgaagaggcgcatggtttgatgttgttgctgtgaaacttccctgtacaagggtggcgggttggtcgagagatgtttcaaggctccatttgcagctctcagcggcgaaactggccgtgacctcttcaagaggcaaccggaaggtccatgtgctctttgtgacggactgcttccccatccccaacctcttcccctgcaagaaccttgtgaaacatgaaggcaatgcctggttgtataggcctgatttgaaagcagtaagggaaaagcttaggcttcctgttggatcatgcgagcttgctattccacttaaagcaaagggggggcttttaccccccgacccaagaagaccaaggtctgccaccgggcttgcgttagcaagtgaatatgtatgtggtgccatcacagcagct

SEQ ID NO: 16463 - DNA, 631 bp, Triticum aestivum
  unsure (1)..(631): unsure at all n locations
  Clone ID: PAT_TA_16463
gcacgaggcctcgtgccgaattcggcacgaggggcgcggcaaaggtgttccttcctttcaagatcccactccccgtccccgccgccgccggcctccccgcttcccccctctccctccccgcccaagaagaggaagcggcccgatcccgatgaagaaggatatgccggggagagcgacgtggtgcaggcggtgagggcgatcggagagggattcgtgcgcgccgagctgaggaggatggaggcggccagggagtcgcagcggatgcgcnnngagatggcgctgcggcacctcgacgcgcagcgccggctcctggaaggtctcgttggccgcacccgcgtcccgttggaatgaagcggtggcgcggcaaaggtgttccttcctttcaagatctttcgtgctttctcctggttacacactccctggcgagttgaggtgttagagctgtgtccttcgtatacttcacatagatgtagatgcgtagagagcaaatcctgctgtttttactgtcttttgtatagttgtctggccgagtggaagcacttcttatgggaaagaaagtggtctggccgtgtcgtggcccggctcttgggaaagaaatggatcttgggttttctaaaacaaaaaaaaaaaa

SEQ ID NO: 16464 - DNA, 422 bp, Triticum aestivum
  Clone ID: PAT_TA_16464
atgtgcctgctgcccctgctccttggccgccgcttggacatggcaagcatgcatggtcaggtagccgtcgggtaatatttcaacttttgccgtggtagtacattccaaccaaattagaagtagaggtcgaacaagaagatgaaactgaagttttgggttcaggagctgtggatcgtgttgtgtagctagtagtgtagagctggttcgggttattattttcttctcgaaggacttgggttcagtgtcgtggcagctggctgacgcttttaggttttgttgtgtcatgtgtaattgtaattgcgaagatggatgtgatagagtcgatttcagtggtggtctctcgcgtgacctggaaagtcaattttttatgcaattatcgtaataattaaacagtgatgtcaattgtagttaaaaaaaaaaaa

SEQ ID NO: 16465 - DNA, 549 bp, Triticum aestivum
  unsure (1)..(549): unsure at all n locations
  Clone ID: PAT_TA_16465
cccacgcgtccgcccacccgtccggatcaatcctccttcctctcctcctccccgccggcgccgctgcccacctcccatggccgccttcgcctccgccccccagcaatccaagcccctcgtgctcggctgcggcgccgtctccgtggactacctcgccaccgtcgcctctttccccaaccccgacgacaagatccgcagcctcgcgctcaaggtcgagggaggtggcaacgccggcaacgccctcaccggagccgctcgcctgggcctcagcccaaggattatatccaaggcgtccaatgatgcactgggaaaaaacattctcaaggagctgcaagacgacggagtagacacttcctatatgacgatagcagatggggggaattcacccttcacctatataatcgtcgataaccagacgaaanactcgcacttgcataaacaactcctggtttatcccccaatgaagccaagaaggaggtcacnaaanggaaaacntgtttgctgcctttacaatngggtnaaaaatggggtttttttggtngttaanac

SEQ ID NO: 16466 - DNA, 417 bp, Triticum aestivum
  Clone ID: PAT_TA_16466
cgtccgcccacgcgtccggcagggtggagcggagcggagctctaggaggccaccaccccaaatctgcgttcgcacgcacatcgccattttcaccgccgctgcgcccgcacgacgctgcaggtggcgcagccgccatggacgaggaggccagcaccaaggccgccgccgctgctgccgtcgccactgcagccaagggccacactccgccgacgccctcgggctcggggtcgccggagggggggaaggaggaggtgggcgatttggtggagagggttgcggagctggtggacgagatcgcggtgatctccgacttcaggaacgcctaccggaggcagttctgcaatctgtcgcggcggatccgcctgctcgcgcccatgatggaggaggtcaaggaaggaccactcccgttgccggagg

SEQ ID NO: 16467 - DNA, 1208 bp, Triticum aestivum
  unsure (1)..(1208): unsure at all n locations
  Clone ID: PAT_TA_16467
gttccagctctgccccatgccgtctgcctgctggattgctgcgccggctgccggcgatagcttcccttggggtcctccgcgtgcgcggcgccagggacccctggacctggggtcgtgtctggaacgacatgagtttcgcgtggtcgcggccgaggtacagcattacagtggcagcagccaactgtgccttccccttctgtacgctctgttgtcagcaaggggacacaatgttgtactccgggccgctgcgtcgtgtccgcgtctccgccgccctctctgcggcctggtgccggccgggctcgccctcgcccgcctgcgtacgctcttttgcggcgccatacctgggagattgctctctggcggtccgtccgctcgctgtgatgccaccgcaccccttctcttcgtggccttgttttgaaggataagatatccgtgtatgacttgggaaacatgcgcatgggctgcgcagactacgggtgttcgttgacggacaacgtcacctcctcatcggggaagaaccagtacctgaacacggggcagcttgacatgaacggagcgccgcggcaccacagcggtctggtgcctaccgttgtcgccgtcgcccttgtgcatatgctcatttttgggcgccctatttagtagatagcacactggctgactgacctaacattgtgattccaccacacccattctttacttagcgaacggggcctatgccgttgtcgctgcgccccttccttcccatggcacgagcattcttgctgtacataaattacagggagaaagagaagaagaaaaaaagtaaaaaatggtttatcgttcatggtagtggcgtgctcagaacgtgtttccgacctgattacttngagaggcgttgttctatttattcatgggatcccttaatcatgtacctgaacctgctgccgctgcctcccaaatcctggaaggaaaacagaggaggatattatggcccccatggcggacaacctgcacacattgatnctanaacatcattgccatttccatagtnacgggattccatgaaantgtgtttgggtagctgatttccccatntaggccctagganccaattccttttacgcacgtcctggnaacaataggtcncatgttgtttccaccactccctaacccctnaacnatccttcnaacnanccccaagtnacaattagacttaacaatntagacct

SEQ ID NO: 16468 - DNA, 525 bp, Triticum aestivum
  unsure (1)..(525): unsure at all n locations
  Clone ID: PAT_TA_16468
gtggtgcgtactccgcctagtgcccatgccgcggcgccgcgcgcgcgtgcgtgagactcttgatcccgcgtcgcgctctcacgcgcacgggttgaatcgatccatctcgtgccgatcgtttcaccggtttgcccatggcggaaaaagttcattttaaaccttaaacttatagatattcggcgaatcaaacattggagtccaattctctgtcgtttgcaccctgaattaacaaatttcggtttataccaatccagatgccgttcccaaacagggattattgacgtgncaaaggtatggccgggatgggtcgttccgcgcgccgcgcctgcgtcgatcagagtgggccgacccagttctgtccatcattttccttcgttctctccacaccccctgccttccaccttctctcgcgacggccatggtgaacggtggttgatcagcggggctgtgggatcgtgacgacgcgacgacncatcgaagaagaagtgaaatcatggaccctagtgagattttgaaagtttaatt

SEQ ID NO: 16469 - DNA, 642 bp, Triticum aestivum
  unsure (1)..(642): unsure at all n locations
  Clone ID: PAT_TA_16469
ctcgtgccgaattcggcacgaggtacccttgaaggttccttctggcctgcgccctgtatattttgcatcagatgatgatagaagggaatctcagagtcctgctaggcctttgctaagctcaagaggagcgtccagtaatgttgagcatcgacttataaaccacacagttaacttccagaaaatgtggagtagtgaacaagaagttcggagccggtgtaaacttcttggggaagcaggttgcaagacgatggaaggatttttagcatctggagacccctatgccctagtgggtatgtctcaattggagatgtcgctcatgttggcatccatccaccacattttgctgctatctacaagaatgttaacgacaattttgtgctaccccttgggctatgacctgggttggagaaattgccccgaggattacaggagccatgtatcattatggcaaccaaggccacctgagggatacgtggctctgggatgtgtggctgtttctgcttccgaagagccccctcctgattgcgccttttgcgtgaatgagagttccgcggagcatgctgtggttgaggatcaggnttccaanctaccatgggatgcacattncaantnaaacaatcctgaattatgaaccgctcaaaa

SEQ ID NO: 16470 - DNA, 1015 bp, Triticum aestivum
  Clone ID: PAT_TA_16470
ttttttttttttttttcttcgtccgcggacgcgtgggttttttttttttttttttttttttttttttttttttttttcatccgggattttttttttgcgagcccctgcaagcataatctcccattcaataccttcgataataaactatatttccttacatacatctgatcgatccagaacttttcacatactaatgtttcgcaagggaaagtacacatgaaaaatcaaagcggatcagtgtctactgaagcttcttggatcttggaaccgaagacgacaactctttactggatgatctgatgatgaaaagaactgtttccatcagcatgccacccaccactcctaagatgcctccagcagcattcatgacaggactgttgctgaacagagctttgaaagtagcaaaccccaccaaataacccgtgaacattatgaccacaacatgcagaccgaatcctagctgatccttgtaagaggagaagggttcggtgttgtcctccttaggcgcgacatccttgacgagctcggcgtactccttcctctcctgcatctcccggagcttctccagcctcgccttgagctcatcgctcttctcgcggggcttggggctggacagcacgaattgagcgccttgcaagagctgtctgagaggtgggcggccgcgggagcagtcggcgcaccagatggcgcggatggagcggtaggggacggcccgctcagaagagagggcggaggccagaccccggaggtcgtcggagaggtcgggggagccggcggcggaggagaggaaagagcggatgggatcggtggcggtgacaacgagtcccggcgtagcggtgccggctgacatggctgctgcttcagatttgggatgagaccatacggcgatgagcaggggtgacgacggcggtgagatctgatgggcggacgggagaattcagggatgccggcgaggtggtatgtgggagcggcgcgattacgatggtcgtgtcgacgtcggtccccgcggctcacg

SEQ ID NO: 16471 - DNA, 555 bp, Triticum aestivum
  Clone ID: PAT_TA_16471
catgaactattttcctgggtatggtaagatgcctggatacgcgcctgttttcaccgacttcctgctgagcctagaccagcagaaggtgttcaagcgacgaccgggctatacctcgggcgagggctgaagagtcgagaccgaccaacttccctctgacctttgccagtatgttgtctcttcgcattcgctgtgtgtacaaatgaatgtgcatatcaggaggagagggatcatcagatctcatctgtggtagagttgggcatcagtagttgcgatgataaggcagcgaggactgtgttgaactgtaattattaatccgcattttggcacaactgtgttctcttcatgttctcgaataatcttgttcggcctagtaattattaaaacgcagacctgcaacacggcggggttgctttgcttctaccgtttgtgcgaggaagaaccgcatgctactcgttcctaggcttgtagcgcgccttcttcgccctgactgcctatgtctgaagcttctgtggtggcacaatgttaaggtacgtgtgaagcttcaaaaaaaaaaaa

SEQ ID NO: 16472 - DNA, 668 bp, Triticum aestivum
  unsure (1)..(668): unsure at all n locations
  Clone ID: PAT_TA_16472
gtggttgtcatgccaccggtaccaggtccatccatcttccttgtcatgaccggggagggcgaggttcaggcagactccatgtcagacggcgagaaggcgaaggaaggcgacgtcttctttgtgcccgcgcacaccgaggttaggctctccgcttctggccatgcgacgatncagctgtacagagctggggtgaacagcagagcattgtacgcgtgcaacgctgctgctgcggggaagaggtcccagctgcagaacatatgcgaaatggcgagttagcttgggcgctgatatacatacagtataggccgatgggtgcaagtgctgatgtaatatgtatagtccaatggacgagtaaaaataaggtccttgatgcctttagaacaaggtcccttgcatatagaggtaccctggcatgccctccgctctgcggttactgatgatggggtcggtgaataagaagtttcagtcctgctgctaacctgtaaaagttcagtgaccggatgtaaaccgtgcagttctccagttgagaagataattggagatgctgatataccagtacctgtgcattgcacattgcagcgttctggttgttcctcttggttgccaggtccgggtggaagatcgctgtcgggacgacggatccgatccgtccacgacatactgaaggt

SEQ ID NO: 16473 - DNA, 769 bp, Triticum aestivum
  unsure (1)..(769): unsure at all n locations
  Clone ID: PAT_TA_16473
cgtccgcccacgcgtccgcccacgcgtccgccactataaggcctccaggtgcactcaacaacccaaagctgaccagcaacatctccttgaacgcgtcgatagtggcgtctgttcttgtggcgtcgcgcctgccgtcttggctgcacgtctttgcaatcatgctcttctcattgcaggtcttcctgtttgcgccactggtcacattttgtatcaagaagtactcctgtagactccatttgatattctcctctgctctcatggtcatgaccctgggcgtcacgtaccagctgcatcgaatgctcttcattttgctgctggctctcgtcgttttcatctcgcttgtctgcccctactggcttatcaggattcaggagtacaagtttgaaatcaatggcccctgggatgaagctaaactctgctttgatataactgaatgaatagcagcactgggcttaatcaggaagttacatgtgcacaagattgatctcactgtatgtatctatgactgatgtactgctagtctcttttgcaagtttccatgtgtatgtacatactcttgacttgttaacttgttttgctactgtggctctaaatgcttggcaaagtcttgtgttctgcactctggtctggtgatgtattttctcgaggcattcaaggccccaaattcagtgttgaaatatatagtgaaacatgattctgtaatctttgatcaagtcaagggggtgtcttgctcattctagcaacacnatattttctctgttaaaaataa

SEQ ID NO: 16474 - DNA, 824 bp, Triticum aestivum
  Clone ID: PAT_TA_16474
gcggccgcgtgtcccttctcggctccccctccaggtccttggcctccttgcccggtgccggtcccggactccttgctggcgagggggtctcatgccatctgcatcgctcctgctcttctctctggggcttgtgctcctctgcctcacctcaggaagcaccgtcaggctggccgaggcacagaaaacgtggtgcatggcgaagccgtcgtcggacgagaaggtcctgcaggcgaacatcaactacgcgtgctccaacgtgagctgcgccgttatccagccgggcgggccatgttacctcccaaacaaccgggcggcccactcctacaaccccataacaacctagttgtcggcacaccgccgtcgccattgaaacctctactaccgccgcccaacggccggccactacctcggcaactgttacttctgccggactcgggacatcgtctgtcaagccgccgacccccagttacggttgctgtgcacctactactcatctctcttccttcgccgaggtcgagcgatgcagatgggtcccaagtaggttcttcttgtgttttagttgggcgggacgaggagctgcatgttgttgtgagctacagtaactaactgctccagcatgatgattaatttgttgaggtgcagagtgtgtgttggtgtgggttaactgctaagtcttgtgtttgcctgttattgttggagatgtcagatgtccatccattcactgatcgatctctccggtggggaacttgttaatccatgtttgtccggttacttatttattattgttgtccaaaaaaaaaaaaaaaaactcgaggcccgggcgg

SEQ ID NO: 16475 - DNA, 530 bp, Triticum aestivum
  unsure (1)..(530): unsure at all n locations
  Clone ID: PAT_TA_16475
gaaaaacaggatatctttcctctgagtttagatagatctattttttcaatctcccttttccttactaagatactctggtagagcagtagtaaactctgccgtagcagattatttggcggtcattttcttcctaacccctggtcgcagctggttgcacacgacgataacgctgggtgccccaacgagactgcagccccccctgcagggactttcaagccgatattgtcccccgaggagatggaggatcagctggagcagttcacctcggtgatgcaggagaagttcctgtcaggccaggactcggagcacatggactacccccaagatcgacgacgacgagatgctggacgaccactggtccagggaggccaaactacgacgcgggaggacaagtacttcaacgaaggatttaggacggtccacaacgtaagtcggctgctatttaagtttgcaatactcggtcaagtgggcgtacgtcggccaatgtttcaagaccctgtagtgttggtttggtaagcagcatggtaang

SEQ ID NO: 16476 - DNA, 878 bp, Triticum aestivum
  unsure (1)..(878): unsure at all n locations
  Clone ID: PAT_TA_16476
cagagattgcgtcagtcacaaattctgagagttattggatccttttggcagttataggtcgtcaaggaagaagataatcacttactactagcatgcacaagattttcaacaaatatcagaaaatggttcacacgtatgatcctaggtctgaggctctggaaaccattctttcaatcacggagacacactcaactcaacaatatgggtgccctagttccagattcagtttcattcaagagacccttgctcccgtgcatacaacagatgaagagatagccttgtcatctgacctggctaaggcgactagagagatcctactccgcctcccagctgaatcagccatacggtccaaatttgtctgcaagcagtggttcagattggttgagagtaaaaacttcattcagtcatattttcagcataagaacatagacggaaagcctaaagtcatgcttgtggtccagagcactggacggttgggcttcagttttgctccattgaataaatgcctcccagaagctcctagtcgcagtacattgcttgatacaaaggtggtttgctccaagccttgccatgggctgaacttggtaagcaccgagacgaaggactatctctgcgatccatgtacaggtttccataggggcttctctaacctggggccaaatttgcacctacgctcgagaatgcctaaaatagaagagcatgcttttacagtcggcaataaaaatgttggcttgactttcaacagtttgactcgtgaacatgttattgtggaaatcttctatcaccggaaggactttgaatctcgtcagtatgacatggcatgcacgttacacgnggtgtaacactgcnaatgctgccaagngaacccataccacctc

SEQ ID NO: 16477 - DNA, 455 bp, Triticum aestivum
  unsure (1)..(455): unsure at all n locations
  Clone ID: PAT_TA_16477
gtcagaagccggtaagtgattatnagaaccgttagagaggcggacttcctaccaagtaattgtcgttccgtttccggaaatgcggaaaagtcggaatcatngaatcaantccttngacaaggcttggcgagtgtgttgagtcaaccctggtcttccgatgcacacaacagcagcagcagcatttacgtagctagcctcatatgcatgtatggctgcatgtcggcagcagtagtaaaactggaaagaaattactagagctcccgtatccttagtaactaaggaatgtagcacgtaagccatgaggtcactcatgcactggacgtcacctagtgcgtagcatagtcggttcagtcagctataaaaggagctccacccctccggttgtaagcattcccttccaagcatttgagcttcagacaactagtatcccgtgaaaaaaaaaaaaaaaaaactcg

SEQ ID NO: 16478 - DNA, 965 bp, Triticum aestivum
  unsure (1)..(965): unsure at all n locations
  Clone ID: PAT_TA_16478
tcaggcacaaacaactgatgctagaactagtcttcaggagatatcttcaaagagagcaggcatacagcaagagatggctacatgtaagcagaagctgagctttattgacaaaagaggccccgaactagaggctgaaaagaaggttgctgctgctgcaaggaactttaaggaagcagggagaatagccgcagaggcaaaagcactgaattctgagaaggaagaactgcgtgctaaattggagaaagctggtactgatctggaggttatagaaaaggatatcgcagcaaccactgacaagatacaggaatgcgaagggcttattgtgctcaaagaacaagagtcagccatggcaagttacaaaaggctccgtctggactcctccgctgctagagcagaattggactgctgcaactgaaacagatgacggcgaggaagtggagatattacgcaaagaagctgaagcccgcggaatctaaagcgctggaactcaaaacattggttaacctcccaaccggatagcgacgaatatatatttcagcctgtagttcctatagcattcataacgaattcaacatggcagcacttggcaagagatggcattttcttttggcctctcccctgagacatgaattggatagtggacttttagacatggctgtgctttgatacacttggtaaagttttgccccgtagcagaaccctcctcccggcgaatatgcccgcccccctgctccgcgatccggtcggcacctgcggtctgctcctgacggtactctgtttggacccgataccacctgttctcccccctctggtctcttgcgggattctcttccgccctctgttttgtgtacattaagactgtaattcttttgttgtgctggttttttattgatatacagcgacgggtntcagtcagaatgtaatcagaataatggtccattaataaacttcntctgcttngcatc

SEQ ID NO: 16479 - DNA, 655 bp, Triticum aestivum
  unsure (1)..(655): unsure at all n locations
  Clone ID: PAT_TA_16479
ctctctcctcgctcgcgcccctccctctcccacgcggatgacgctcgcggccgcggcgtgtccgcttcccatggtcgtggcagtcctgcccgcgcagacaattgggcttgcagcgcctcacctcctcgacctcccgttccggcggaccatccctccggaaaccgccagcagctggatgcgacctcaagtggcgtcgtccttcccagatctgggccaagcggcttttgccctccctcttcgacgggaggtgcccatcccgcaatttgtcttcgagcagccgcacccaccgggacgcacctgcttgccgggctatgacgccacccatccctaaaccgctggcggcggcggcaacaagccggcgacgccttcgccaaggttgcagcgattgaaaccacactagggttccgggtgctgttgggaggggcgagcgtgcggcatgggcctctagcctttgggacacatctccacacgcataagctaggatcttgcagcagcggtcgcggccaatgacgccccatcttcccttagcccgcgaccgttgagccccgcggtgacagcatgcactgcccctgtccttcacatctcaatgtcgcagtcgtgnnnttcctcgtcnatcagnnnggaatcttggtgggcaacttcttcttcgccatnn

SEQ ID NO: 16480 - DNA, 1119 bp, Triticum aestivum
  unsure (1)..(1119): unsure at all n locations
  Clone ID: PAT_TA_16480
cgtgttatcaacaacaggctcagtgctctgtcctttcacataagagagtactattgggttgatatgaagaagataaatgagatttatcgctacaagactgaggagtactcacatgatgccatcaataagttcaacatctacccagagcaaatcccatcctggcttgcagattggattcctgataagggtggttaccttataggaaacctacaaccagctcatatggatttcaggtttttttctcttggaaatctctgggcgattgtttcctctttagcaactcaaaagcaagcagagggtatcctgaacctcattgaaaccaaatgggatgatatagttgcaaatatgcctctcaagatatgctaccctgctctggagtacgaggaatggcgtattatcactggttgcgaccccaaaaacacgccctggtcgtatcataacggtggatcttggcctacattgctatggcagttcaccctagcctgtatcaagatgggtaggcctgacttggcaaggagggctgttgaagccgtggagaagaggctctcagatgacaagtggccggaatattatgacaccaggacaggaaggtttattggaaaacagtcgaggctatatcagacatggacaattgcagggtttcttagctctaaaatgcttttggactgtccagaggtggcatcaatattaatatgtgacgaagatctcgagctactggaaggctgtgcttgtggccttgagcaacagcgctcgcatcaaatgctcccgtcgtgcagcccaggtctcaagtccttgtgtagttacatatacttttgcttgacagcccaagacctgcagtgcttcttctaatttactggacttttaagacacagaagttggcacttgtaatctcaccagggtatccacttcatatgccggttattttggcaaagttggtggtcccataatccatcgatacaagagtacactgttgtatagatttcacgtaatcgtaattgtgtacacgaggccaattaactcaagttgactggcagttttatacagatactatcatgtaaatattaccacttgtaatcaatttattctgntaaaaaaaaaaaaaaaaaaaaccggcacgag

SEQ ID NO: 16481 - DNA, 517 bp, Triticum aestivum
  Clone ID: PAT_TA_16481
gggtcggccggtcggaccagtggagcccgatgggaaagagatccccgttagcttagtgtatgggcaagtagaattagccgcaaagtattcccaacaggattgtaggctagacagcctgttggatggtattgaagaggaatttagtcagtctatttgacaatgtattttaaagtgacatgtgaaatgccttctagccggattgtagatcgtttgtctttgccgaccttttcgcttcaacctcgggaccctagagttcggagtgtgtccgaataccctctcggttaagaaacaacctgggtatgcatggagaccaggcgtaggggtcattagtgctttatcagacaagtgcccaactagttatgttatattacatggttagtaagaaacatcttccagggagaatagttccgttaagggttcctttccctgggaggcatgccctaaagtgcatgtccggactgcgaaaagagcagaaaaacatctgggggcagataaataagtatggaaaaatcaacct

SEQ ID NO: 16482 - DNA, 751 bp, Triticum aestivum
  Clone ID: PAT_TA_16482
ccaacgcgagaagacaacagaaggggtttgtcattgcggaccttttcgcttcgacctctggaccctatagtccggagtgtgtccgaataccctctcggttatgtaagaactggggcatgcatggagacaaggcataggggtcataagtgctttatcagacaagtgcccaactagttatgttatattacatgggtagtaagaaacatcttccagggagaatagttccgttaagggttcctttccctgggtaagcatgccctaaagtgcatgtccggactgcgataggaaacacaggaaaaaacatctgggggcagatatggaaaataaataaaaatcatctttttttcgccgaccaaatattcccttaagaacgctagctttcggcttcacccagtctgaggtacacacccggctgacccggcagtaacaatcgcagaggtgctccctttaccgcctagccgaacaatcgggaatgtaggggtaagcacaggagccaggcaacccagcttggcaaaaatcttaagtcaaattgatgcatatttatggctttataacgatgattacggaaggcaacccttgtatattaaatacaaatggcgatgatatgtttattttgactccgttgcgaccgtttatcagttgaaagtggcccatcgtcggcttctacccctttgtagatactacgcatggtgtccccccaataacaagacaacccttagccgacgtctcggtgccccaaagcggttgtgtt

SEQ ID NO: 16483 - DNA, 1199 bp, Triticum aestivum
  unsure (1)..(1199): unsure at all n locations
  Clone ID: PAT_TA_16483
gcatgtatgatgccttcttgccgggctgtcacatccgcccgaacaggttcggcaggtgatgcagggtgttgcccaggccttgtggccgtccgtccccctgccagagggcgttgcagagcttgcgaagaccctccaaggagcacggccgcggttccgattttcgcaagctccagcctgtccgcagcggggcaggcaaggcgaggccgcggaggagactttgttaacccaggaggcccctgatcacctggccgtggtctgtcctgtggggcgcaagggacaaggggatgccagttagtttgttttagggcaagctagatttggccgcaaggtattccaaccgcatgtccgggctgaccaaaagatagcaggaaagcaactgggggctgataaataaacaggtgaaagataatcttttagttctccgaccgactattccctaaagtacactatctttctggcttcacccagtctcaggtacacatccggctgacactggcagtaacaatcggcaagaggtgctcccattacaaccgagctagaactagcgggcaaggcataggtgaaatacaggagcgaagcaacccagcttagccaaaaagttaagtcatatcgatgcatatgtaggaaacatcttccagagagaatagttccgttacgggtgcctttcgctgggtagccatgcattaaatgtgcatgtccgaactgcgaacaagaatcgtaagattcggaacctctgggattatgtggtaaaatagctcaaagcgcgcccttagtgctccgatcgaaaaggaacgtaaggacgcgaactctcggcactaacgtgtaagaagagaccgaggaagggacaacgcaaatcccgcgctagcgtgctcccctagcgtctcatccaggcttcgggcaagggggccgataccaatccccataagatctataacccccacggctccttaagtcctaccgagaatccggccagaagcgtcatatcgtcggtgccgggccgcggcccatgcccgcggctcgatcgtcatcgttgcatccccagacgggtccctcaccgccaagactgggtcatcatgtcgctctccttgggggctgagtggtcctttgattggcggaggatagggcaccacaacgttggcggggggccgccgccngcttgaaactcagctgtgttnaaaancgaacggcttgcactcann

SEQ ID NO: 16484 - DNA, 573 bp, Triticum aestivum
  Clone ID: PAT_TA_16484
acttggagacgaggcaatggcttttgagctttgggagcctgcgactggctcgacaggtggcatcagcaagcgccggccggcctcgtgcactgctgtgggttgttatcttcgggggcggtgcaccccggtgcgcttcccctgccgggaacagagcagtcacaaggagctgcaatgatgcgtgtacatgtaacagttgtccaagctctggaactttttcagaaatcattgctcaaactgtatggtcatccagatgaggatgttgcaaaggctaactggaaatacatcttcgcagaaactttacagtcatccagatgttgattttgcaacccctaattggaactacaaatgtctgcagataggccagaacagtgtccatctcaagatcgatgggagagtgttgcactacagaaagatagtcttgtcactacagatagatagtcttgtctgtagatattgaatatttagatgctactttctcaaatagcttactgaatttattgtctgtatgattgtgtatgacgaactcagatcgtgtttgttcattgtaaaccgacctagttatgtaatgaaatt

SEQ ID NO: 16485 - DNA, 533 bp, Triticum aestivum
  Clone ID: PAT_TA_16485
cccggtcgacccacgcgtccgaggagaggtggagacattgactccggcgacggcgagtgggcggtccggcgatctcgcaggtgttccgccgaccatggaattcttgctgcagccaataaacagaactctgcttgaggaggtcaatgaaagtaacgggacaataggagcccgtgcggttcccagtggccgcgccggcggacattcctgctccagccccggccgggtcaagtgcggacggccagatctatcggccggaagcggcaggcggggacaagcctcaggggtccgagcactcggtagagcagttggaccccaagacgccaggatggacgcaaagggggcgcctagcggcggctgctcccggccggcccccttgtgcggacagggtcacgacgctggagaagaccgtgagggagtttgcggagcatccaagagacatagttatgatgccaaagattggaaccagtttcgacaccctcggagaagcatatgacttttacaatttgtactcatggaagaaaggatttggtatt

SEQ ID NO: 16486 - DNA, 532 bp, Triticum aestivum
  Clone ID: PAT_TA_16486
gccctttcaggctcgtgtcggccgctggcacggggttcgccgccccaaggaaccgggaaagggaagcgacgatccggtgtgcccctcctcgtcctcgaatcccgccacctctcgtctccggctttatcttcgccggggcaaggaggagatctcgcgggagggggcgggcgaagcgggcgtccatcttcatcaggctcgtgtcggccgccggcacggggttcttctacgtgaagcgcaagaaccctcgccggatcacggagaagctcgagttcaggaagtacgacccccgcgtcaacaatgcacgtcctcttcacggaggccaagatgaagtgagcgcgcgcgtcttcgccggaagatggaataacgccgtcgagccctgtaacgaacctgagagagagagagacatctgttcttgttccttgttattttttccttgcctgtactatcgatggactgagctgcggcgcggtgcagctcatctgttccttcttgccgcaaatccaagtccgttgcatccccatcaaaaaaaaaa

SEQ ID NO: 16487 - DNA, 968 bp, Triticum aestivum
  Clone ID: PAT_TA_16487
tggcggatcgatcgagtcggcgagagcgatggcggcgctccggcacgcggcgaggcgtgcgctccagcagggaggagcgcaggtgaggccttcggtcgtggcggagggacctcggcggctcttgctaaacggcgcttcccctgcccgccggcccatgtccacctcctccatcagtcgcaagccgacatctagtgccaagcctcacggcgagctggaattgctggaaatgcgattcaagaagacgaaggaagagttgtttgatttgctcgtagcagtgagaagggcagaactttacccacagttgtcctgggaagacatccaaactcatcggctcatcactcaccttgctgctcaagtggagcctaggcctcacgaccccaattggcgcatgtttcgacgaacaagaagactcaacgattttaacactataaccgttcctctgggatattttggtctgttcgcctactgcgtggcaactaacatgagagaagatggcgctacaagcaagaatagtgaagccaatttcgtctccgagccagagaacgatatgaactagctttatatcagaagtctagatagtctatgatatgaactaccccctccgttcctaaataagtgtcgtttcaaatatgaactagctttgtattacaagtctagaaagtctcctgagcgtatgtaattagtaatatgacatctagttgtagttgtaggatttgctggatgctggcaacggtaatggaatcagcctgaagttggagtggttgtgcaagtccttttaaattaactattatgtgacgaaagagaaacagaaaatcaagcgatgtctttatgtgcacaggtaaaaaaagaaagatgcttgaggaggggcacaagctgctggctttgatgatgcaccagctggacgacctgagcagctgcttgagggatatggagcttcggggtaccatcaggggttggggattttaact

SEQ ID NO: 16488 - DNA, 367 bp, Triticum aestivum
  Clone ID: PAT_TA_16488
agcagcctccattgcacttcggaggagtgctggcttaccatctccctaagtgggagaatggatgtcataatttgtgctagtagggttacgcgtccgcgcggcccttgccaatttgaaggtcgttggtcgtggatcgtgtcatcctcgctgcggtgcgactcgtgctcccctgcttcttgctcattcacccgtcggttcctccttctttgtaccagggtggccgtcgatctcatggcatcggctagggtctcgttgctcggctcacactcgtgcttacactcatgctagtggtgccggctcgtggctgatggtggacttgtcccggtggcacttgtggtcattatcttggtagcgcgcacgtgtcgcg

SEQ ID NO: 16489 - DNA, 229 bp, Triticum aestivum
  Clone ID: PAT_TA_16489
ttaatatatattgccgtgccgaaatggaagaaggcaacaatagagatgtggaggttgtgtatcattaaattgtaattaggggttggcttaattctgtttgaattttttgtttgcggcggaattatgtcaggttgtggataccaagttaccaactattgcttcattcgctcacctgcacaagtctggaaaataaatctacttagatacattgttcgtgaaaaaaaaaaaa

SEQ ID NO: 16490 - DNA, 328 bp, Triticum aestivum
  Clone ID: PAT_TA_16490
tcataaggactcggcgatcctggcagacgttagcataagcatcaaagaccaggaaattggcaagcacatgaaattatcaggcaggttgcagttcaacaatcgcgtctcgagatggggatgggagaagttcatatcgctggaagacttcaaggactcctcaaaaggttatctcgtgaagaaaaagtgctgcattgaagctcaggttgcagtcattggttcctccaagacggagtagctagctagattattcggcctccacgataatgtcatgtctcgtgcgtgcgttctatacaggcttgaactgcgtttctgcaccctacaagaaatc

SEQ ID NO: 16491 - DNA, 2586 bp, Triticum aestivum
  Clone ID: PAT_TA_16491
ccccctcgggcggtcagggggctggctgcgagcgtcggaccgagcccctgccctgcccccccgccccctcgcgccgctgcggctctcccccccggtttccccccctcccttcgtcgcctcgtctcgtctcgtctcacggtccgtcccccgccgccctgcggcgtggccgcttctcggcctcgccggcccggcccggccccggctgtggccctgtgccgcgccgcgcccatccgctgccgcgcgtggcgggggccctgccgcccttccctccccgggcgggggggccgtggtgctgctcggcggggtccggtgaccggcgtgagccaccacggtccgcccgtgccgcgtgccgccgtggccgtctttttttcggggttcggcgccgcaaggcgacccgggttgctgcaaatcgttggtaggcgccgctacggtgtccgccgccccgcctgggtcgcccactccggcgagaaagtggcgataaaaaagatacatgatatctgggagcacatatctgatgctgcacggattctccgtgagatcctgtatatatataacggatagttccctgctataaaaaagaacaaccacgtctcggcccctccagcgagaggcctcctcctggtgagtcctgccgttttcctccgcaggcagtctgatctccaccaggttataaaggccaatgatgacttgacaaaggagcattaccagttctttctttaccaattactccgggctctgaaatacattcacactgctaatgtttatcaccgggacctaaagccaaagaatatattggcaaattccaactgcaaactgaagatttgtgattttggattggcacgagttgcattcaacgatacccccacaacaatcttttggacggattatgttgcgacaagatggtatagagctccagagctctgtggttccttcttttcaaagtatacacccgccattgatgtctggagcatcggatgcatctttgctgaggtcttgacaggaaaacctttgtttcctggtaaaaatgttgtacatcagttagatctgatgactgatcttctgggcacaccatctatggatacaatctctcgggtccggaatgagaaagcaaggaggtatctgagcagcatgagaaagaaagagctgatttcgttttcgcataaatttcccaatgcagatcctttggccttagacctgttgcaaaggcttttagcgtttgatccaaaggaccgcccaactgctgaagaggcattgtctcatccgtactttaaagggcttgccaaggttgagagagaaccatcctgccaaccaatcacaaaaatggagtttgagtttgagcgtagaagagtgacaaaagaagacataagggagcttatatttcgtggagatattgggaataccatccacaattgctcaaagactacaccaatggaactgaaaggacaacctttctatacccaagtgctgttgatcaatttaggaagcagtttgctcatcttgaagaaaatagtgagaacggccctgtagttccaatggatagaaagcacacctctcttcctaggtctactattgttcactcagctccaattcatggcaaggaacaaccccgtattggcccatcaagggataagccttcgcctgacgagtcttataaaaatcatcgagattcagaaaaatattctggcaatgtccagagaacctcacaggctccacaaagagtgccaacagcaagaccaggaagggttgttggtccagttctgccttacgaaaatggtggcatgaaggatacatatgacccacgaagagtggcagcaatgaactccggttatcctccccaacaacaaatcccgcaaatatacggttattatcagacaccggcaaagtcagcttgctccgagccatcgcaggccgaaatgtatacgctgcaccagcaggcctatgcttgcgcaaacagttcaactgtgcctgatgttgctctggacatgagagcacctcccttccatcagtcagcagggccgaaaaggggttcttctgataggctatcagcggaatcaaacctatactcgagatcccttaatggcatagctccaactacaacaggagtggcggcaagtgctcacaggaaggtcggcgttgttccctacggtatgtcgcagatgtattagtggccagtcaggcgcatccgacatgccttcctggagtgcggctggtggcttaacgaaacagcgagaaacgaagtggcggatcaagcttgggtggggatgccgcaaggtttacagcgcagggcagcccagggtttgatgcttatgtgtgctgtctgatctggaagcgtgtgaagctcttcgttctgttccgggccatcagcttgttgtatctgcctgtgtgcacactggatgggggtgggtagtcagtccagtggcttgtaatctgagctatttaggcgccggttactttttctagggcgaggagacagaaggggaaggaaggaatgctaacccgttttctgttgtagagagatgtttgtcatcaatgtgcaacttcagaaagatatatataaacttataaagcacacttttgctgccaaaa

SEQ ID NO: 16492 - DNA, 661 bp, Triticum aestivum
  Clone ID: PAT_TA_16492
ctcacagtcacagatcggcagaagacaatgtctccattcgtatgcgtcgccatcctgttcctcgcactggtctcgccctcgccggcagcggccagcatccccggcactagcaacaatggcgccgccgtcgccgcccctagcgtgcccacggtgacgcagttcctgcaggcgcacaacgacgcgcgccgcgaggtcggcgtggcacccctgacgtgcaactcgacgcttgagcaggacgcccagagatacgcgggccggcttggtatccgctgcaagctggagccgctgaagtgggacgccccgcatatctacgggcagaacagctactggggcagtgggtacaacgatggcgccgccgtcactggctcgtgggtgtacgagcggcagtcgtacgatcaccgcgccaacacgtgcgcgcccggcaaggtatgcgggtcctacacgcaggtcgtgtggaacaccacgcgagagctcggctgcgcccgccgcacctgccggagcagccgcgataccgtggctgtttgcagatacttccctcccggcgactaccgcggcgttccgccatactgagcacatctatacggaagctacgtccggaaagatgtgtctgttcaaataatgtacggtgcgaaacaaggcgttcggtccggcgtcttatggt

SEQ ID NO: 16493 - DNA, 1160 bp, Triticum aestivum
  Clone ID: PAT_TA_16493
gatccacctgcgacgagcatatacagtctccgccggtccagtccagatggcggaggcggcttactggtcatcgcttccaccggacctggttcgtcgcatcggcgactgtctcctgaccaccaacgacatcgactactatatggggatgcgggccgtctgccacaactggcgctctgccaccgcagacccaggtcaacttgacctcctgcgcttccgtccacggctgtggctcatgcttgaagaggaacccaaggacgcccgcgacgatacccgcctcttcgtcaacgttgtcaccgggcgcttcctccgtcggcgcctgccgctgctccgccgccacatcctgatcgcaacctcggacggcctgctcgtcctcgggcgcaccgagctcccgctcgcaattcgcgtcctgaaccccttcacgggttccatgctccgctttgccacgaggatcccttgcgacgaaacgatggccgcggtgaccggctccgatccggctctgatcttctccttcgacttcaggcaaggcctaaaggtttgctgcgccgaccaggccagcgcgctcttctgtgaacaggcgttccctcgcagccaggctctcatcgcaagcatcgtcgcctacgcaggccatgcctatatggtggatgcaaaaggggtggtagatcaagagcgttggtacggtgagccaccgtcgccgcaaggtggtggccgagatgttggacgtcgtggcatgcccacctgaggcaagtgcaatgtacagcttcttccttgtggagtccgccggcgaactgctgctcgtcctccgtgattctagttcatggcgtggtgccaaggtcttcaaggtggacgttgagcggggggcgctcgtgcccgtcaagagcatcggcagccgcgcgctcttcctcggctgccggtgcgtgtccgtcgacgccgacggtttcccgtccgtcgacggcaacagcgtctactacgctgatgatctgtacgggatgagcaagatgtacagggttgacctccgcagcggcacccaggagaacatctcaagcctctcggaggagcctcgtagcgacagccttcgagttcgcccttacagctttgttcaggctctgctcaactactgcatgacccttccggatgtcctagctcagctgcgcccggttctg

SEQ ID NO: 16494 - DNA, 458 bp, Triticum aestivum
  unsure (1)..(458): unsure at all n locations
  Clone ID: PAT_TA_16494
ggccgcggtggcagggaggccgcagagatcaggcggcgttgacgctcagcggcaatgtggcggcagacgctgagcggcaatggcggcagaggacatcgacgacggcgacggtgatgcgggcgacgaggacacgggtgatggcaacgcgtgcaatggcggtgcgggcgaggtcgtcgacctagctgactcggacgacgagtagactaggattatcctgttgtttaattagattagaattagttgatgtttaattagattaggattagttaatgtctaattaagtttccgtaatgtttgattgtaatatgaatgatgtttccgtaatgtttaatgaaatattggttatttttgaacgtacgccttttctaggatattgcnatncaaaaattgncttgnaaaaagccgattggncnntgaaagaacngcccccngcttttaaaaatgttagcanataagtc

SEQ ID NO: 16495 - DNA, 782 bp, Triticum aestivum
  Clone ID: PAT_TA_16495
gccacggccctcgcggtagctgctggtggacaccaagtccaagaaggtgctgttcgcggagggctggcaaggagttcgtcgacttccgtcttcaggcctgctcaccctgcccatcggcgccgtggtgaagctcatctccgccggcaccatgcacgggagcatcggccgcctgtaccagagcgtcgacaacatcggctcctcctacctccagcctaacaaggaccggacgcccgggagctgctgctcctgcaggcccccggtcgcccgggggcctccccctcctccccgccggccgcggccagggtgctcccctgcgcaggctactgcgccaccgccaccatgagaggccaaggctgcgtgcccgcagtgcaagcaggccatggccaccgaggtcacgttcgtgctgccgtccgccgcgcccaagacctcgtccacggcggctgcggccggcgacgagaccggcgggtacgtacaggggctcgtcacctacatagtcacggacgggctggaggtgacccccatgtccgccatctccagcatcaccctcatcaacgagttcagcgtccacaaggacgtgcagctcgccgagaagttcgtcagcgtccgcatggacgaggggctcggcctcctcaaggtggcactgcgctccgacaccgtgctctccgacgtcttcctcgcagagaagaagtgaagtgatcgacgatgcacgtaccgtacgtgcctctgctgagggaataataatcattaactgaactattgttcggtctttcctaaggtgtcga

SEQ ID NO: 16496 - DNA, 407 bp, Triticum aestivum
  Clone ID: PAT_TA_16496
ggaccggccgggccgggccgcgctgcccgaccaccagtccgtcctctgcttcctcaacggcgtctcccacctcggccgcgactgctgcgtcgccctccgctgcatcacgctccactcctggccgcccatgcgcgcgtcctccggcttggcctcccacgaggtgaacgcccaccgtggcctccgccacccgcggctcccgcacggccgtcccccgccgcgccccgccgtcgtcgcggcgcgtggtgcgcaagcatggtgccgcccaaagtggggcatttgtacagtaccctcgcgaaataaaatacgggccggcgctcgtgggaacgaaactaccttcaggaaaaaaaaaaaaaaaaaaaaaaaaaaaaaaaaaaaaaaaacccctaaaaaaaaaaaaaaaaaaaaaa

SEQ ID NO: 16497 - DNA, 557 bp, Triticum aestivum
  unsure (1)..(557): unsure at all n locations
  Clone ID: PAT_TA_16497
gacttagacgtactctccgagagcacctcgtcgccgccagtttgccgcgccccggcgtgcctcgggacgggagcttcccaaggcgcagcgccgccgactgccacagggaagaagaggaaggtggctggtggtggtggtggtggcggtggcggcgatgagcttcgttcagagctgcgcgcgaaggagatggctctctccaaggccaagggcgagatcagccagctgaagaaggagctgggcgatgcccagaaaagggaggttgccgaggcgcagcacgcattggcctacgcggcgcaggtgctcaagccggaaggcggcgggaagggcgctggggccggcaagcggcggcgtggcgcccagtgatcacgtacgtcttgaccaacggtgagccgagtgcacttggctgcggcgtcaaggtttttagcaaacgtagttntgttcagagttggctggtgttggctggtgagtctgcgttgcaacaaattacgagcttcattttgtggacttctgcaaactattattgaaatctgccttaggtttcaaaaaacaaaaaaaaa

SEQ ID NO: 16498 - DNA, 563 bp, Triticum aestivum
  Clone ID: PAT_TA_16498
caagacctcaactggcagtcccagcggaccccatccgagctagctctcccgttccagtcaatggcggacctcttcttcgggggaagccccttccggcggctcctctacgcccgccccttcgcctccgccacggccgccatggactgggtggagaccccgacctcccacgtcctccgcatcaacgtcccgggcctgggcaaggaccacgtcgaggtccaggtggaggacggcaacgtgctcagcgtccggggcgcggccaaggagaagggaaacgaggggaacgaggaggcggcggtgtggcacgtggcggagcgcgggaagccggagttcgcgcgggaggtggcgctgccggagcacgtcagggtggagcagatcagggccagcgtcgaccacggcgtgctcaccgtcgtcgtgcccaaggagcccgccccggcccggccccggaccaggcccatcgcggtctccagcaagctgtgaggccgccatgaaccgaccgggttcaggagtactgttactgcggtgtatgcttgtgtcgacgagctgtgtgcgtttcacttgtgatg

SEQ ID NO: 16499 - DNA, 944 bp, Triticum aestivum
  Clone ID: PAT_TA_16499
gcccccaccccggccccccgggccggcaacgcgtccgcgcccaggcaggcccgccgcagcgggggagccgacgcactcgacgagcccaaggcttcgccggacaaggggaagacctcccgctcccccggcgatcgcgaggccaccctcctcatgtagatggtgctgatgcaggcagatccgttcctgagcgagctgaccaacatgtacgagcggagcacggagaatgggctccgtgtgggtcaccagtggagcgatcgtcagatgaacgtgtcagtcgaggttgaagacagatgcgcgaggtaagggggcgcctgtcgagcaccggtgcatggtccgcgcctccgatggcaagaggaacatctccacctcgctgtctgcaatggagtataggaaatgccaaggttcatatgccctgggtcttaaggcgcacatgcatgccttgaaagaagagggagaggaaaggacaggaagtatgaagatctgaggcaggggtaaatacagtgagaaggaaacaaagaaccaggagaaatttttttcccagatgtgtgcaagatataatgagacgtgttactcgcagaatttatccgcgagatattacgcctgtaatttcctatatagacgcgctccttcgcctgaccttttgatgatgtgtttgagtcggatcctatgactccctaaacctctagggaaggctttctttgtctgctatttgtgacccactgatgtgtttttgctgtttggaccagccttgccttttgatggttttaggcctctgctagaactgatggatctgtcacttggagcttggaaaaatttgccatgggtgtattggtttcgtgttttcatgtcgtgtgatggcctgaggcctgtgatgtggggtttggtgcgtccctccctccgctgctggaacggcctaaaaaaaaaaaaaaaaaaaaaaaaaaaaa

SEQ ID NO: 16500 - DNA, 540 bp, Triticum aestivum
  Clone ID: PAT_TA_16500
cccccgaacggggctagaacactcgtttacccgcctcctgtctccatcgtcaagatggagatctccgtgaagaccctcaccggccagaccatcaccatcaaggccgatccttcggacaccatctacgtcgtcaaggcgaagatccaggaccagcagcgcctcgtctttggcggggaggagttggaggacgggcgtactctggctcactacgacgtccgagataactcaactctccacttggacctgcgccaggccgaggagggcgtccccgccgtggccggccagagctctagcttcgccgtggggaagcccgagccccgagggcggtcgcaccctggcggactatggcatcaagaatcaggacaccattcacctcctactgccacgacgcttccgaggtgagacttgatgcatgggttcttgccggctcagttttctacacggtgtggtcgaaatatgttctgttggctatttgtcccgtcgtatgtacggtgcatgcattgcctgcaataaactagcgcaagagtgcgtgtgaacatg

SEQ ID NO: 16501 - DNA, 555 bp, Triticum aestivum
  Clone ID: PAT_TA_16501
cagtgcatcctggtcaccagcgacttcgatcactacatggacatgcgggctgtctgtcacaactggacgctccgccctcgtcgacccgtgcagcgactgcgccggcgtcgacctcctgtgcttccgccctcggcactgggtcatgctagacgaggaggaggagcccacggacggcgcccgcctctttgtcaacatctcgacagggcgttttctccgccgccgcgtcctggtgcttcaggaccacatcctcgtcggcccttccgacgggctcctcatcgtcggcgacaggaagccccagcatgctgtccgcgtcctcaaccccttcactggctcgctgctccctttcaaggtgatactaccttgttaccgggccaaggcagtggttggaggcggcgggcatgagcgcccaacgtcactcgtcttcgggctcgactgctgctacgattacgacgaccccgtctggagcgcagatccggccagcgactacgtccgcatcacctacggaaatggcccggtctgtctcggaagcatggtcgcccacgcaggccacgtcta

SEQ ID NO: 16502 - DNA, 524 bp, Triticum aestivum
  Clone ID: PAT_TA_16502
ccccggtccccctcgcacacgccgccctggcggcggcggcgggagcggtggggggcggccccggcctgccgctcgccgcggcggcccgccggggcggtggccgcgcagcggccgcggcagcggggggggcccgccgccggcccccattcgtcacggcccgcggccccggtgccggccgctccgggcccgcgtcgtcggggctgtcgccggccctggcctctggcgacgcgtcccgcgcgcccggtgcctccctctgcgagcagccggcgacggcgcggacgccggccctgttctcgggctacgcgtccggcacttctatgtcctcggtctgtgtggtactggcgcgggcaaggcctctgtctgtattcgttgcttggtggttccttgccttgcgagggtcgcgcccgttgctgcctgccccggctgtccgtccctggcgctggctgttttgggtcctggctcctgcgtgcattcttgccctggcccttgaagtaagatttaaaacaacctacagaacaaactgg

SEQ ID NO: 16503 - DNA, 1640 bp, Triticum aestivum
  unsure (1)..(1640): unsure at all n locations
  Clone ID: PAT_TA_16503
tgcaggnaattcggcacgaggcctgaattggattctcaaactgctccgtgccccatgggtgaggacaaggttggtgaactcgatgtagcttcgtcatgcaatgtccaagtggaaccagagaatgcatcctattgctcacctgaatctgattcccaaattgcaccgggttctttgaattccagcgcgctagctgagagatcaacagcggcttctacttctgtcatgcatagtaccgaggaaaactatcgggtctctcctgttccaccacacactgaaccgtttcaaagtgtatgcagtgaagatcctccgaaactacctcctcttcctccgcttcagtggaggcttggaaggcctcgtttgggacttctgagtacaaaagaccgtgcgcctgaccctgcaagcagaacaacttccattttgcctgtatcaagccaaaatatggataatggcctagtttcacttgacggaatggcagaaccaatagccttagtttcctctcaagatatcaaagagaggcatcagaattctgtggtggacacgtccgatcaaagggtagaatctggaatgccaagggaaaatgacaggccattttcagaggcttgttggaacatcaagcatcaggggcatatcatttcatcaccatcggaggctgaagaacatctgaatgacagtggggccactgcacatgtaattaaccagcaagattgtcaacagcacctcttgtgttcagatatttcagacatcgctaaggctctcagttctacagatccagctgcatctgaggatgacaaaacggtggatgatcacaatgctgcacgtaacgtgcatttccacaaagtgagctcttcaacaccagggcatgtttctgaaaatggtagttgccagcaatctcagcacggtgaatcattatcagggacttcagacaatgaggagcatagttcaaatgcatcagatgaggagaagaatctgaaagaccagtcaatcacaagaggattacctttagacacaacaaaacatactgcatcaggctcagtgttagaagaaggcacccaggagagtcagttaccggaacaagatgcggataacctcaagggtggtctgtctgaaggccagtcacatactgcagaatcaatggtatctgaagattatccccatggtgatcataatttggacacagagagtatacttcagccgaacccgtcgtggcctagcaatataagtaaatatcttggtgactttgatgaaggcggctatgcacacgctgagcagccaccagtgatgggatggactgttggacctcagatgcttcatcctaattatggaatatcaacggaagggagcagatttgaacccgaggtcacagattatcggttaaccagaaagccagtttcagtgagaaatatnccaagaaatcccttgttgatggctggtgctgctcatgatcgaagcacgnatgccccanggttcaaaactttgctcccgccccnagaataancccaacacccatggatnaaaaactttggggctttgagcanataaaggaacaagggtggggaaactttccccccccgcnnataaacccaaagcccccatggataacatctgggnttnggncnnannnnggaacnanantttnncct

SEQ ID NO: 16504 - DNA, 442 bp, Triticum aestivum
  unsure (1)..(442): unsure at all n locations
  Clone ID: PAT_TA_16504
gacgatgcgttgtccttcctccgtcaccatgcccagggaggggcagaggatcaagtactcgagggagctcctgctcgccgtcgccagctccgacgcctgcaaggtgctgcccgcgggcgtcgacctgtccaagcaccccgattacgtgaaactctgggttcgcgcggagacttgggccgcccgctcggttggaggagcagcacctggacgccnagggaagtcggaattgcctcagcgagcgcgagagccggagtcttttcaagcaggcgtaggacgcaaatcgaagccatgcatcagattcttcagtactgcaggttgccgctttggtgacaactgtcgcttcatccactacatcccgggcggctacgtggccctcgagaaactgggcatcctgagtggcgcagctcccgctcttccaccagcacaaggcgtggagaatccc

SEQ ID NO: 16505 - DNA, 470 bp, Triticum aestivum
  Clone ID: PAT_TA_16505
tgacggcggcgctcgcgctcgatcagcggccacgcgaaaaaatggagggttctgggctgaatttcctgctcgacgccgttgacaggttcccattgcgagaggagttcgccaacaacatcgagcagccagatccggttcctatggccttcttgcccaacaacgaagctggtcttgccgttcatgaagactcgaatgctgggtctgggtgcgctaagcagcttggcggcgatgggactggcagagaaggattagtgtccaccggcgtccgggatgcatctcccgacgaggtccgcgcagtcgaccgaccgagtcattctgggaggacctagatggacgaaaaggctacacccaaaccctcccattcttgtgctgtaaattttcaactgtgactgctttctcttcgtgtacatagcctttaacggtaaaactgcaaaacccttaataaaattgtcatatccaaaaaaaaaaaa

SEQ ID NO: 16506 - DNA, 1009 bp, Triticum aestivum
  Clone ID: PAT_TA_16506
ccgccgccgccccgcgatgtgcatcaccggcggcacgggttcatatggctcgtggctcgtcagctgctcctctcccgcggctacgccgtccacgccaccgtccgcgacccacgtgatccgaagaacgcgttcctaacgcatctcgtcggagccccggccaatctgccggctgttcaaggcggacatgctcgactacgagacggtcgcggccgacgttcgccggctgcgagggcgtgttccatgtcgccactccagtgcccgaccaaaagatggttgatccacagaaagagatgatggaacctgctgtcaagggcaccatgaatgtgctcaaggcttgctcagctatgcaagttcataaactcatcgtggtctcgtccatcgccactaattgcttcaacccggattggcctcgagatcaaatcaaagatgagacctgctggtcagaccaggagttttgcagacagactgagaactggtattctcttgcaaagactgaagccgaggagatggccctggaatacggagagaagaacgggctgcacgtcgtcacattttgccctggtctggttttcggccctctgttgcagcatgtggcggtcaacaccagcagcaaggtcctcgtctacatgataaaaggaggccccgacacgatgaacaacaagttctttcccatagtagacgttcgtgatatcgccgacgcattgctcctgttgtacaacaaggcagggccatctgagagatacatatgctcactggaccaaatggacctaaaggatttgctggcaatcatgaagaacatgtaccctagctacacttatgtagacaagatggttgatgtggattttaacgttggagtcacttcggaaaagctgaagaatttagggtggaaaccaaggaagttggaggagacactcgcggatagtatcgaatcctataaaaaagcagggcttcttggggtttcagatgaatggaagccggcatggatcgtcatctcggacgcgtgggtcga

SEQ ID NO: 16507 - DNA, 954 bp, Triticum aestivum
  unsure (1)..(954): unsure at all n locations
  Clone ID: PAT_TA_16507
gnaaaacctgccttacgaattaaactagttgatcttgctaacaaaccagattggttgtttacaattaacccagaaggtaaggtacctattgtaaagctcgaggacaaatgggttgctgattctgatgttataacacaagtgttagaagaaaagttcctcaaccatccttggcaactccaccagaaaaggcttcaatagggtcaaaaatattctccacattcattggctttgtcaagagcaaagataccaacgatggaacagaacagacactacttagtgagctgacttcattcgatagttatctaaaagacaatggtccatttatcaatggtggaacaatttctgccgctgatctctctcttgctccgaaattatatcacatggagattgctcttggtcactataagaattggtctgtcccagatgcacttgcacatgtgaaaacatacatgaagactattttctcaatggattcatttgtcaatactcggggcctgccagaggatgtcattgctggatggcgctcaaaagtcatgggttaaatcaccatagtaaagagagacaaggctatcggatgataaagggtgaagatgtttccaagttacgtgtatgagctgcagacatttactgaagaatttcagtgtaaagctttgaaggtaattctgtcagatcttttttcttttgctcagtatcaaatggaaggtgtcaatataaacggtatggaattataatttgtcatggaacctcgttttgttaaatgtataaataaagaggcatggctgtctccattgttgcattgttccccccacacgttactcgccaaaatatacaagctgtgacacggacaaagcttttgacaagttgatgaaagatccacagattagctggcccatttgttgtaaattgtaaattgtaaatagtaagtatttccttgtgaaaaaccccacaccaagc

SEQ ID NO: 16508 - DNA, 1188 bp, Triticum aestivum
  Clone ID: PAT_TA_16508
cgtccggccgcgtccgccgcctcctcccggcccgcgcttcgccgccgcgccgcgccttcactgcccgcgcctcggccgagcctctggaggtttgcgccaaggcctccatcaccgtccccgaccgcctcggcgactgtcctttcacgcagagagttttgctgacgatagaggagaaaaaccttccttacgaattaaaactagttgatcttgctaacaaaccagattggttgtttacaattaacccagaaggtaaggtgcctattgtaaagctcgaggacaaatgggttgctgattctgatgttataacacaagtgttagaagaaaagtatcctcaaccatccttggcaactccaccagaaaaggcttcaatagggtcaaaaatattctccacattcattgggctttctcaagagtaaagataccaacgatggaacagaccagacactacttagtgagctgactccattcggtagttatctaaaagacactgggccattcatcaatggtggaacattttcgccgctgatccccctcttgctccgaaattttatcacatggagattgcccttcgtcactataagaattggtctgtcccagatgcacttgcacatgtgaaaccatacatggagactattttcctcaatggattcatttgtcaatactcggggcctgccagaggatgtcattgcttggatggcgctcaaaagtcattggttaagtcacgcatagtaaagagagatgagtctatcgagtgataaagggtgaggaggtttccaagttatgtgtatgagctgcagtcctgctgatatttactgaagaatttcagtgtaaagctttgaaggtaattctgtcagatcttttttcttttgctctcagtatcaaatggaaagtgtcaatataaacgttatggaattataatttgtcatggaacctcgttttgttaaatgtataaatagagagacatggctgtctccattgttgcctcctttatttaaaaccttactcgccaaaatatataagctgtgatacggtccaagcttttgggaagttgatgaaagatcaacagattagctggtccattctgttgtaaaatgtaaattgtaaatagtaagtattcttcccatgtgatttgagtttgttgcagaatcagtgattatatgaaccaatcatgtaataatttaaaaaaaa

SEQ ID NO: 16509 - DNA, 324 bp, Triticum aestivum
  Clone ID: PAT_TA_16509
agagcggccccctccagccctcctgcttcagcttcgttctccacaatcggctggacacagcatgacagccacttacttttagccctcggctttgagaaatcctggctccgcctctggcttcagcgaccctagtcaggggtgcagcacggatggcggttgctccggcgggacgcacggcggcggtggcggcgacggctgccggttctacaggctcctcggcatgtagaacgcggacggcggctgcgacgtactagggctaggtgtagtaggcgtagtgttttttttttacaaatttgaatgaaatcgccgagtttgtaccgtgtt

SEQ ID NO: 16510 - DNA, 704 bp, Triticum aestivum
  Clone ID: PAT_TA_16510
acatcgctcgatccaccgtaggctgtcgaggcaggacgtggacggcgaggagggggaggaccggaagccggtgatcaagcccggcgtgcacgtgacgctcaaggtgcggaacaccgacggccacaccgtctaccgcaccatgcgtcggaccgagcagctgcagagcctcatggacttctactacgccagcgtgccggcggtccagcccggcacggggcggttcctctacgacggcggccggctccgcggatggcagacgcctgcggagctccagatcgaggacggcgacgaggtggacttcttcaccgagctgctgggcggcggcgggacaagcgcgctcccgaaagctgagcggaacatggcgtcgccgttggcggcggatctccggttcgtcacgctcaaggtggtggaccaggagcagcgcctggtccgccgcaccatcaggatgaacgccgagctgcagatcgtcatggatgcgtactacgacgaggcgggggacgtcgtcagaggcaccggctccttctggttcgaaaacgttcggctgcgcggcgcgcgcacgccggcgtatttcaagctgcaagacggggacgccatcgacttctttgaaacgcagcttggcggcgggatcccggtctaggcagtagtgctcatttcatattcgcattgcacttcaccaagtgatcgccgagctcgttagggaacgc

SEQ ID NO: 16511 - DNA, 587 bp, Triticum aestivum
  Clone ID: PAT_TA_16511
ttggttgggggcggcgcgggaggtctcagatcatgacccggcggccgggctctggaagacgaggacgagaaagataggaagcaggccgaggggcgagagccgaatcctgccgtcgccgaggtggcggcggaggagacggcgacgaagaccaatggggagccggagccggagcgcagggtggtgaacggcaagaggatggtgaggaagaggctgcccatgaagaaggtgcgccgcgtgctcgccatcgatcacaagccagtcgtcatcccgtctcccgagagagacctcccgccggcggtcctcgccgccatgaagctgcgccaggcccgcgtcgccgagatccacaaggtgcaggacgacatccgcgaggacctccgcaccaagggctacgtcatgggctgggtcaccgacgacgactagtagtagtaaaggtggaagatgaagcggaaattggggtttcgagtcggaagctttatccattgctgattgatattagtggtggatgccttgtaatctgaatggtggaagactcgatcgttgttggtactgatttgcatattgagtaagccttaccttctcgattcccc

SEQ ID NO: 16512 - DNA, 1111 bp, Triticum aestivum
  Clone ID: PAT_TA_16512
gcgcacgcgtgcgcgtactcgtgtgctctcaaaagccacccaagacgagtcttttctccctttctcctgccggggtgggcgcatcctgagtggcgcgctacggcaactactactactactgctgcggatcagcagcatcacccgaggaaggcggtggggctcgcggcgcacgacgaacccggcgaccgttcgcccatccgcatcccccgaaggagcactggtgactacgacgtggccataaaggtgctctactgcggcatctgccactccgacctgcacaccatcaagaacgactggaggaacgccatctaccccgtcgtccccgggcacgagattgccggggtggtgacggaggtcggcaagaacgtggcggggttcgcggccggcgacagggtgggcgtgggctgcatggtgaacacctgccgggcctgcgagagctgcgaggagggcgccgagaactactgcgccagggtcgtcctcacctacaactcccgcgacagggacggcgccgtcacccgcggcggctactccgacctggtcgtcgccgacgcgcgcttcgtcgtccgcttccccgacgccctgccgctcgacgtcgccgcgccgctgctctgcgcgggcgccaccgtgtacgcccccatgcggcgccacgggctgggcgcgcccggcagccacgtgggcgtgatcggcctcggcgggctcgggcacgtcgccgtcaagttcgccagggcgttcggggcggcgaaggtgacggtgatcagcacgtcgcccgggaagcgggaggaggcgctggagcggctgggcgcggacgcgttcgtcctcagcaccgacgcggcggagatgaaggccgccgcgggcaccatgcacggcatcgtcaacacggcgtccgccgccgcgtccctgcacccgtacctggcgctcctcaaaccccacggcaagatgatcctgctcggcatccccgataagcccctgcaagtctccgcattcgctctcatcggcggcggcaagactcttgccgggagctgcatggcgagcatcagcgagacgcaggagatgctagacttcgccgccgagcatggcgtggcggcggacgtcgaggtgatcggcgccgggg

SEQ ID NO: 16513 - DNA, 830 bp, Triticum aestivum
  Clone ID: PAT_TA_16513
agggacaagaagtcgtttttacaagactgtaattggcagcgacaaagaggccccatctcgttgcaccccagaagtagtaaacttcattcttcagcagcatttcgatgcaccgtcaatgtgggcaatctttccgctacaggatctgctcgctctgaaagacaaatacaccgcaagaccagcagcggaagaaacaatcaacgatcccactaacccgaggcattattggagattccgcctacatgtgtcactggagtccatactggaggacaaggacatccaggcgagcatcaagaacctcgtcacaagcagcgggaggtcattccctggcaagaaaacggacaaggcctagtcgacgggcaaatcgtaggaacaacaaaggaccgcgaagaacggtcagtcgtcgccgagcgggatcatgatcatgaggaatatataataggataataaggcggtgtattaccgccatgcccgttgagctgatgttgtttcggctagagaaatcgttacgcccgctcataatttttcgacgctctggagaataataactactggtatatcattctatatcaagccggcttgtgaaataaatgattgcgccccggttttttgtcgtcgagatattctccgtaaaaagtggaaaaaatgaaaaaaaatgcgaaaaaaaaaaaaaaaaatgtaaaaaacaataaaaaaaaaatataagaatcaaaaaaaaagaagaaataaaaaaaaaagggggccctccaaaagattcgaatttaagattatcgttatgagaaattaaaatctcttaaaaggggcgcctcaatttcgttatgagggtcatcttt

SEQ ID NO: 16514 - DNA, 2450 bp, Triticum aestivum
  Clone ID: PAT_TA_16514
ggatcttggtgttggagaattcccagatcttaaacttcttgttgactgggcagtcaattcgggttttcatcttgttcagctccttcctatcaatgatacttctgttaacaagatgtggtgggattcatatccatatagctcactctccgtatttgcgttgcaccccttgtacctgagagtgcaggcgctttcagatgctattccagcagatgttaaggaagagatttcgaaggcaaagaaggagttggacaaaaaggacgtcgactatgaggcagcattggccacgaaactcagaattgcccaaaaaatatttaatttagaaaaggacaaagtgctaaattcagctccgttctagcagttcttatctgaaaatatataatggttgaagccatatgctgcattttgctttcttcgggatttcttcgagacatcagatcacagccagtggggtcggttttctcagttttccaaggagaagcttgacaagctagtcgcagcagatgctttgcaccatgatattatacgcttccactactatgtccggtgtcagctatttacacaattatcagaggcagctgcctgtgccaggaagaacaaggttattctgaaaggagatttacctattggtgttgataggaacagtgtggatacttgggtataccctacattatttcgcatgaataccgctactggtgcacctccagattactttgccaaaagtggacaaaattggggttttcctacatataactgggaggagatgtcaaaggataattatgggtggtggcgagctcgtctgacacagctatcaaaattcttcacagcgtataggatagaccatattttgggtttctttaggatctgggagcttccagatcatgctgccacaggtctttgtggaaaatttagaccttcaattcctcttagtcaggaggagcttctaggtgatggtatctgggattttgatcggatgagccgcccatatattcgtcaggacatgctggaggagaagtttggatctctttggacagttgttgcagccaactttctgcacgagtatcagaaacactgctacgagttcaaagaggaatgcaacaccgagaaaaagattgttacaaagcttaataccagtcccgaaaaatcactctggctggagaaagaagacagtattcggcgtggtctgttcgatcttctacagaatatagtcctcatcagagatcccgaggactccacaaagtactatccccgctttaacctggaagatacttcaagttttagggacttggatgaacatagcaaaaatgtccttagaagattataccatgactattatttcgttcgccaagaaaatctttggcgacaaaatgcactgaagactctacctgttctattgaactgttcggatatgttggcatgcggggaagatcttggccttatccctgcttgtgttcaccctgttatgctagaactcgggttgattggattgcgtatccagagaatgcctagtgaaccaggcttggaatttgatattccgtccaagtacagctatatgacggtttgtgctccctcatgtcatgattgctccacattacgtgcttggtgggaaggagatgaagggacaagaagtcgtttttacaagactgtaattggcagcgacaaagaggccccatctcgttgcaccccagaagtagtgaacttcattcttcagcagcatttcgatgcaccgtcaatgtgggcaatctttccgctacaggatctgctcgcgctgaaagacaaatacaccgcaagaccagcagcggaggaaacaatcaacgaccccactaacccgaggcattattggagattccgcctacatgtgccactggagtccatactggaggacaaggacatccaggcgagcatcaagaacctcgtcacaagcagcgggaggtcattccctggcaagaaaacggacaaggcctagtcgtcgccgggcgggatcatgatcatgaggaatatataggataataaggtggtgtattaccaccatgcccgttgagctgatgtttgtttcagctagagaaatcgttacgcccgctcataattcctttttcgacgctctggagaataataactactggtatatcattctatatcaaagccggcttgtgaaataaatgatccgccgtcttgccttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattataaaaaaaattatgaaaaagataaaaacaagaaaaaaaagggcgccaatttaaaaacccctttcctagccgttggcaaggtttcatagatcctggtagcatctgtacacaatgctttatacaggccacggtttgaaacaagcat

SEQ ID NO: 16515 - DNA, 629 bp, Triticum aestivum
  Clone ID: PAT_TA_16515
cccgccccctcccccgccccccctctctctaccccgcctgcccaccgcgcgctctccttctccccgttgtctgagccaggacctccgttcctctttcgttgccggcctcgccactgccactgctcaccgtcgccatcgccatccccgggaggagtgccagggcatcgctcccccgtgtctagggtttcggcctccgcgtctcctccagcaccggcgaccctccccgtggctccgtcgccatcaacgctcctccgacgccatcaagagtgaggaggacgaggcccagccatctcgagccccgccccctcccctgcacgccgtctgtatacgaagacatagcaacggaggcagattccgcccgctcgactatcgagcggcgagggctgcacaacaggagaagaagcccagatgaggaaagagagcatgggcttgcacattcggatgaaagtgtcgaaccatctgtggtgtcctgagatggccgccgccgtggccgccgccgggctgcccatgctgggttcctctggggtttgttctcgtgggcgctgggtggtcgtgctcttctgcctgcagtgaataggttgttgctctcgaggattggtcgacctcgttgcttcgttgcacatgtgctt

SEQ ID NO: 16516 - DNA, 543 bp, Triticum aestivum
  Clone ID: PAT_TA_16516
gcggcgtacgacaagaagaactccgaagccatgtcgtcgtcggcgaggggcgaggaggaggaggactcgaagccggcggtggcgcccctgttcgtgacgctcaaggtggtggaccagaagcagaacctggtgcgccacaccatcaggacgaccgacaagctccaggccgtcctggacatgtactacagcaaggtccccggcgtcgagtacggcaccggcaccttccacttcgacgccgtccgcgtggtccgctggcgcacgccggcggagctcgagatggaggacggcgacgtgatcgacttctttgagcggcaggaaggcggcggtttggctttggccgcgtgatgggtgtcctcccggtggtgtacgtcggccgtcgttgccgatttccgatggatatgtgtccaatcctgttatgcatccaagtcgaacttgttcagaaattattccccctatcttctgcttcttccgtttcttcctcgtggcagtgaataaaagggcggcggcgttcgttttaaaaaaaaaaaaaaaaaaaaaaaaaaa

SEQ ID NO: 16517 - DNA, 468 bp, Triticum aestivum
  Clone ID: PAT_TA_16517
tagatctccagtccaagatgagcaggcgggtgcccgggaaggaggaggccagcaacgcgaccgtggatctggtaggtttcaactgccccagttgctcgcaacccctcaagcctccaatctatcaggacacggcagggaggcttgtatgctcttgttgcttcgacaaggttaccaagacgccgcagctgggtccgccgccgcggtacagtcgctgcttcacggcggagcgcatgctggagtcggtccggctcccatgctccaacgcctccagcggctgcgccgccgtgacgccgtaccaccgatgggccgatcatgaaagcagctgcccccactcgccccgctttgagtacgtataaacggtgacatatggatagagttgccccgtggtaattaaaataaaggaagttgatcggagcagggatgagcgtaaactcgtaggctgagggtcgtaaggataatcatcttatc

SEQ ID NO: 16518 - DNA, 533 bp, Triticum aestivum
  Clone ID: PAT_TA_16518
ccgcaacgcaccggcaccatggcgagaccacaagccagtcggcggccgcgctcgccatcctgatcctcgccgtggccaccctcgccgtcgcccaggcgccgccgccgccccaacggagcggccaggagatccacctgttccaggtgacggttcgccaggtggacggcgccgcggaagacgactacaactacaacctgctcggcaccgtgctcggcggctacgaggccgcacggggcgtcatgttcgagaccgagcccctaaggttcagcgcctacctcaccaacaaccaggcccgcagactatcaagagtcacgggggtgctcggagttcgtcagagggacgatcctgtgcccaggaccaagcactgataccgcacgtgattaacagagacgtgagcagcatccaaggaaggaagcaacgcattagctttcctttttctctttcacaataaaaaacgcagtgccgcggccttgcggtttcggtgtgcctgactgccagccagcttgcctggcttaaacctctcgcgcaaaact

SEQ ID NO: 16519 - DNA, 554 bp, Triticum aestivum
  unsure (1)..(554): unsure at all n locations
  Clone ID: PAT_TA_16519
catcatccaccttggccatggcgcgcgaggggtcgttcatgctcgttatcggcactgccggccacaactcagacgacaccttggctatgcgcgcaggaaggcctccgttccctccggagtgtcgggcgggtgcgacatcaccacggcccgccacagctctggggacttggaggcgtggagccaggagcagcacaccaggcccgcgcccatgaggagctcgacggcgcccagcttggcgaagacgcatgcgagcgcgtccaggggcatctcagaccagtccctggcggatggacccgcgtgcaccttttgtcgaacacctnccctgcgtgagtgcgatgaatggaattatagaccaggaatccggggaggagggcaccatcgagtgaaaggaaggataggggagacgtatgtcaaaaagaagtagaagaagacgaagaagaaagggatgatcgggtgcttacctcgcctgcagcgggcgttgggcggcaggggaggagacgcatctgttcagctctgctctcgcttggcgtccgttttttttagagaatttttca

SEQ ID NO: 16520 - DNA, 655 bp, Triticum aestivum
  Clone ID: PAT_TA_16520
cccaccgtcggccggcgccgccacaccccacgaccagcccgccgcctccgtcctcgcccgcggcgatgtcttcccttgtccagagcagctcgctcgagcgcctccaccacgtcgagaagcggatagtgcgggtgctggagctggcgggggcggtcactcgcaccacgctgggaaactcgcagggtccccgcggcgaggccgtcgtcgcccactgccgcgagttcatgctctacatgaaggaaattcaaactacattgcgtgaggaaataaaaagtgcttgtgaataccggccatttgagatgtgtgactacagtgcaaggattgctaacgagatttgttgcaaaaagctggagtatgtgattgagaagatggatgccatgcaactgaacattgagcccagcaccaatgaagtttagctaatttaactgggctatctagtgcttggtagtgaaatggtaatccaaccaaccttcccggggcaaccaaaacgcccgcgtcttttcctcccttccgtgctgtgcgtctcccgtgccggccctgtggcttaatgttagtgaatgaattatgttagggtataagttgcaatatcccaagaaagaagatgtattccgactactacggctgcatattcaatatattcactccttacagcaaa

SEQ ID NO: 16521 - DNA, 437 bp, Triticum aestivum
  Clone ID: PAT_TA_16521
cacgcactgtactactccactgcaagatcaaacaagcagacctgatggagaagaacgacacttccgagacgataatcaccgtggacgtcgatccggaggctctgaattgcccaagcatgtcttcgctcccctcgaacctccggtgttccagtgcgcggccggccatgtcgtgtgctcgacctgccacggcgacctcccggacaaggacaggtgcgggtcgtgctttgtcaactccggcttcagccgctgcttcatcccgacgagctacggccgctgcttggccttggagcgtgtcctgcaatccgtccgtgtcgcctgcccacacggctgcgccgccacctagatgctctaccacgagaaggcggaccaccaaaagacgtgtgccggatcatcagccgccgtggagcagccggccgtgctcctccagcaaggccccc

SEQ ID NO: 16522 - DNA, 615 bp, Triticum aestivum
  unsure (1)..(615): unsure at all n locations
  Clone ID: PAT_TA_16522
gcacgagggtagaaaacagtccacgccgccgcggcaccgagcgaccccgcgggcgtccttggaagaagacgaagcggcggcgacgacgacctaggcagaccgctcgctcgtgttggagcctggatcgcgtccggaggcatcgcccgcggccgcctcgccgaggagcgcaatgtcgtggcgcaagaaccacccccatggcttcgtggccaagccggagaccctgccggatgggtccgtcgatctcatgctctggcggtgcgtcatccccggcaagccaggcactgactgggaaggtggatatttcccgctcactctgcaatttgatgataattacccaacaaccgctcctagctgcaggttcccagcaggtttcttccatatcaatgtctatgattctggagtagtatgcctatcgatactgggtgatgcatggaaaccttcaattacagtgaagcaggttttggtaggcatccaggagttgctggatgacccaaatcctaactcagccgcacagcatcgatgctatgaactctataagaagaacatgccagagtacaggaacaaagtccgtgagcagaccaagcgctacccttcgcgcatgtagctactctagnn

SEQ ID NO: 16523 - DNA, 643 bp, Triticum aestivum
  Clone ID: PAT_TA_16523
ccggcctccgcgcttcgccgggccccggccccctggcggcggcggcccccgggcctcttcctgactgctgcgtggcgccccctcccgccttcgcccggctgctgggctccccgctgcaggggcgtgacgcgcgcgccgcggcccccgcccagagcctggccgtgcgcgccaccgccttcgaccgccgctacggggatcttcatctcctgtgcgggtgtgcacccgccccggtttgggctcagcatgcggcggggatttcctctgtcccccggcgagtgctcgccctttccgtccggctgagctccattccaagaccgatgcaggcggcggtttcactggtggctgcgggtgttactggtgaccgttcagcccgggtgccgtcgcccctccagattcgcacctcgagggacgcctcatccatctcgtctccttggtggcgtgggatgtgttctgcgctccggacgttcccttcgccctcgtggcccggtttctcttgggcgctccggctctacctgttccactcttgttcccttggctcttggggaatccgtctcaacatgtacaacactagattgcaaggggtaaacaatatttttatctcatgttgtgcaaatttggaataactgtgttgtgaataaaaaaa

SEQ ID NO: 16524 - DNA, 824 bp, Triticum aestivum
  Clone ID: PAT_TA_16524
tgccccttcgtccggcctcgtccactgcgccagtctccgggagcgcaacctgctcgccgacgtgtccacgctcgtggagcgccaccgcgcggcgggggcgcgcaagcgcgacctcctccgcctcctcgcggcgtccctccgcgccatgggccacgacgccgcgctctgcctctcccgctgggacaagtcgtcgtcccaccccgccggcgagcacgcctacgtcgacgtcctcctccccgccggctcggagcgcggcgaccgcgagcgcgtgctggtggacgtcgacttcaggtcccagttcgaggtggcacggcccaccaaggcctaccgcgccgtgctgcagcggctcccgtcggcgttcgtcggcaaggaggaccggctgcgcctgctggtggccgccgccgcagactcctcgcgcgccagcctcaagaagcgcggcctccatcttgcgccgtggcggaagcccgagtacatgcgcgccaagtggctgtccccctacgagcgcgaggcgcctcctccggcgccggacggccccgccagtgccagtgccagtgagctcgccgacaccggcgagggaggcgaagacggagccaaagcttgattaatcaaggatcggccattagttgattatttttttcgcctggggaatttgcagcgcagtccccgggcagggaccggatgcagatgtttttgctatattttcgtcctttttctctctcattttgacccttttgatgggtaacggagtactagcagtaacttccagtaagtacgtaccgggaagcaagagcaactaaataaataaaatttgtagtgtttagttc

SEQ ID NO: 16525 - DNA, 452 bp, Triticum aestivum
  Clone ID: PAT_TA_16525
tcgggggaggtcaccctacaggccgagctcggatccaccctaaacatccagccccgcgagcacccggccctcttctcccccaactgcagcgacccgtgatgccggattgaaggaggctgccccgccgccgaggttggacccaccgcatcaacccgcccagtgagcacccggctctcttttccccagcgaccgacgacttttcggaaaacggcgagtacaatagtcaggagccaagtcccattgagtttttcaaagagacccatactaacagcatgagcgagccgacgcatctagctgataatgcaatggaaaagaaaagggaaacacagtccaaagtgacaaccagtgtttgattcaatgattgtggctgaagttctcaaggaagaaaacgcccatagcaccttcctttccagcatgagttatgcatcaagatccgggagatttgggaactc

SEQ ID NO: 16526 - DNA, 617 bp, Triticum aestivum
  unsure (1)..(617): unsure at all n locations
  Clone ID: PAT_TA_16526
ctcaacttccccgatccccaatctccagtggacgattcatgcaattcgacgccaatgccctccaatttaaggcacatcagagttctagctatccatccagggttggcactcacgtttgatccatatcatcttttccgtggaaggagtcatcgatggggccatccctgcgcagacgaaacagcctgtgcgcactcctcacctcctcgccgccggcaagctcggacggcggacgcgctgcttcgctgcgggccttcctcgcgctggcgtccacggacacaccagatgcagccatctccgtcgcggccctgattccaatgggacgctctgctccatgcctcctcatgttaggcggcctcagtctctccgcgaagcccagtgagccagtctgcacgtgttgctcctctccatgccctcctcacgccgacgttctcagatgtaccacggtcatccccgccgtgcccccctgggttccagcggatgagttcgggaatgagaagcccgctggcctccccctgcctcttctcgacgtcacgatgaagcccgcaagccctactaaagaagaagtaagcctcccttccnggtgaatgggcgtcactncagnactaatancagtgttg

SEQ ID NO: 16527 - DNA, 2245 bp, Triticum aestivum
  Clone ID: PAT_TA_16527
cggacgcgtgggtggaaacgcaacgctgtctcacaggaacaggctccatataggacatgacatcgctggacggaacaatgtgtgcttcgtccggcatataagaagtcatctatccgtgccgcgccatgctctggctgataacaacatccagaacgcacagagacacagatcgggagcgagcgcgcacccgtttatcgcttgatgtatgtgcattccacctagagagcctttctcgcccccgaacctaaccaacaatggccgccgtggaggatgagacgccgagggcgtccgaagaggaggcggatgccatgatgaatgggccgcgcgcagcccatggacgttccggccgtcgacgagaagcaggacgcgcagagacgcagatcgagagcgaccgcggagcagttagtgaccgcgagggcgcacgtcaagtagaaggccttcatggtgcacgagccggacgaccagtcgccgcccgggatgaagagccacgaagggcgctgggggaggatgacggcgccaaggaggtcgaagccggacagggagcccggggacggcctccagatcgagaagcaggaggaggcgggcaccagggcgacgctgcaggtcagcgaggagaaggagaacgggaagcaggcgcggacgaagatcctcgggaacgagggcgagggctgggaggggcccgggaccggctccaaggtcgagatgcactagacggacgctatcctggtctggtccaaggtcgacacgagcatggaccggggcgagcccgtcatgctcaagctcgggcaggagcaggtgatcagggggtgggaccagggcctcaagaccatgaagaacggcgagaacgcggtcctcaccatcccgcccgacctcgccaacggcgaggcgatctccccgcccgcgatcccgcccaacgccagcctccagttcgacgtcgaggtgatgtcgagggcgagcggcaaggaggtctgcaagaccgtcggcacctacaagggttttgtggtcgagggacagaagggggagaaacccgaggacgccgaggccctgaatgccacgtaccacacggatcttcagctagtttccgggaagacggttaccctcatcggtgacgacaagaggatcttgaagaaggtgctcaaggaaggagaaggctacgagcgccccaacgatggggcagttgtcagagtggggctgatcggcaagttggacgatggcactgtgttcaggaagaaaggacatgaaggcgacgaaccattcgagttcaagacggacgaggagcaggtcatcgaagggctggacacgacgatgctcaccatgaagaaaggagaggaggcgtcagctagaataccacctgaacatgcgttcggatccaccgagaccaagatgaagcaattgatcttagctgtggttcctcccaactccaccgtcttctatgaagtggagcttgtttccttcgacaaggagaaagaatcttgggacttgaagagtaatgctgaggagaacacaagcagcttctgaaaagaaagatgaaggaaatcgtaggctgagatcgtgggcaagtagctggcagctctagatgagatatggacaatggagaaaaagcacaacaagtatgacatctccttcagcgacggatgagtagaagcaatccaaggcagtgaagatcagcatcaagctcaacaacgcagcgtgcaaactgaaactcaaggattacaaagaagcagagaaactctgcacaaaggttttggagctggagagcacaaacgtcaaggctctgtaccggagggcgcaggcgtacaccgagctcgtggatctggaactggcagaactagatatcaagaaggctctggagatcgacccggacaacagggaggtgaaggttgcgtacaaggcgttgaaggacaagctgagggagtacaacaagagggatgccaagttctacggcaacatgttcgccaaatggaggaagacggagaacgccgccgggaagcaggaagcgcagcctatggccatcgacagcaccgcgtgacgggtctacggcgtcgtggtacagccgggtctggatgcactagttttgtatcagcattgtaccgtggtttcggttgtcttgtcctctcttctgcaccttgtgcttcgtctgtgatcggctgcgtgccttgataatgtactcataatttgctggcgtacgattctagtaaaaaagagtgtctatttcgttttaaaaaaaaaaaaaaaaaaaaggccg

SEQ ID NO: 16528 - DNA, 828 bp, Triticum aestivum
  Clone ID: PAT_TA_16528
ttccgcctccaggcccccccccccccccaccagcaccggccaccgcctcctcccccaaaatcgaaacccctactccccatccccaagcagatcggtcgagagccatggaggcgcagatgagcaagttcttcgagtcggtgggctccttcttctccggcggcgacaacatcccctggtgcgaccgcgacatcatcgccggatgtgaaagagaggttgctgaggctgcaaccgaggaacagaaaaatgatagcattatgaggctatcttgggctctcgtccattccaagcagactgatgatgtgaaccgtggaattggcatgattgaagcttctcttgataaaaccaccagcccactgcagactagagaaaagttgtatttgctggctgttgggcactacagaaatggtaactatgtaaggagccggcaacttgcggaccgttgtttggagattcaaccagattggaggcaggcatcatctctgaagaaggcaatagaggataaaattgctaaagatggtgtgattggcataggaatcgccacaactgcagtaggacttatcgtcggtgggatcgcagctgctcttgcaaggaagaagtgagactgcacccgcctgttgatgaaataggatgtgtgtttggttctatcgttctaccgtttgtcctgtgttacttgagtcgaatcgccgcaactatgtgcataaaatgagtttatgataccatgccaccgtgtaatctttcggataaatcaaatcgtgatggaagtagtaccattgtctcaaaccagtgctgaataccccaataaatgaactattaggggtcttttttccc

SEQ ID NO: 16529 - DNA, 765 bp, Triticum aestivum
  unsure (1)..(765): unsure at all n locations
  Clone ID: PAT_TA_16529
ccacgcgtccggcagcacaggcgcctgtgatagaggaacacaatagagcgctgctggaggtcgtgggggcgacagggccactctcatcattgtgcatcccgcacaggcaggaggaggaggagccatcggggcaggatttgcctcgcaccccgattgtagtcccgctgggggagcaccggctaatacggccaagcgaggaggacgcggcggcggaattcggccccaaaacagtggtgaccacgctactgaagggtgtcggggccacacccgcgccatcagtcttgggactcaggccggtggcatccatgccggccaggcgcaagaagaatctgcctcccaatttcactccaaggaggagtgctaggctctgccagcaagatgatggcatgaagaaaggaccagagcagcgtgcccagacggtgctactccaacgcatgggcctgatcgagaacaaggagcagatgacccaggaggctcttgaggcgtacctccggcttttcgacaagccactggcaccccaacacattagggncggtggccgccctgcttgatccggagggacatgggttcaacgagccggcgcaactccagttcggggcattcttacttcccgagcaggcggagtcctgcggcgtctagtcgcagcgacatcaaagaaagagactcttctctggtttgtaatgtcgttaggcatagtatcttggaatgtaagggggctcaataaccccgcaaaacgcagtgcggtccgtctgtccctgcaacagc

SEQ ID NO: 16530 - DNA, 624 bp, Triticum aestivum
  Clone ID: PAT_TA_16530
ggcacgaggcagggcaatgccttggagttcccttgtacattcccccaccctggtgctgctcgtcccggccccgccggacccaccctgccctcgtggcgcccggaggcccgcctgtgcagatgccgcggcagcacccgcaaggcgcgccgcactccgccggtgtcgtgtcggttgtgcccgcctcctctcgcttcctccatgagctccttgccacgcacgctcctgccggcctgcacggccatggtcgcctccatcgcctcgcccgctttgctcggcaccccgcctgagctgtccgcaagccgggcaacccttcccctcggccgccctctgcccgccgccagtcccctctcgtcgtccccgccgcagcgcctgacgccactcgggtgctccgggggtgctggccctggcccggtgtacgtacgatcttttaggcttcttcgtatttgcatttaagtttgggttattgtcattaatcaagacgtggtagtctactttcctatttttggtgtcgcaatcgaaatatcactacagtatcaggattgaataaaggaggccgtcgcggccgccattttttttgtacactgctatgttggtatttagtaacctgcaggcctattcacctgc

SEQ ID NO: 16531 - DNA, 852 bp, Triticum aestivum
  Clone ID: PAT_TA_16531
cggcacgaggcttcattcagatcaagatgaagcatccatccatttcctacatgcagaagatatatccagatgaatggacaaatttcttggaaaggcttggtacaaatgtaaaaagtgaagacattagatactgggcttctttccgtggtcaaacactaagtcgaaccgttaggggaatgatgtattacagaaaggcattgagactacaggcttttttagacaggacaaatgaccaagagttatataaaggacccgtggggacagagcgagaacaaaataagagaaacattcaccaatcattatcaactgaattagatgccctcgcggatatgaaattttcatatgtcatctcatgtcaaaagttcggggaacagaaatctaatggtgatgcgcatgctcaagatattattgatctgatggcaaggtatccagctcttcgtgttgcctacattgaggagaaggaaattatagtagacaatatgcctcataaggtctattcctctgttttaataaaagcagaaaataacttagaccaggagatttaccgtataaagctgcctggcccacccatcattggagaagggaagcctgaaaatcaaaaccatgcaattatattcacccgtggagaggccctacaaacgattgacatgaatcaggacaattatttggaagaagcttacaaaatgagaaatgtacttcaagagtttgttagacatcctagggaccaaactccaaccatcctcgggcttagagagcatattttcacaggaagtgtttcatcacttgctggattcatgtcataccaagagacaagcttcgtcacaattggacagagattccttgctgaccccc

SEQ ID NO: 16532 - DNA, 666 bp, Triticum aestivum
  Clone ID: PAT_TA_16532
ccacgcgtccgcgaagcctcggagagcttggttaccaaccgggggcttgaaactactggataccttgcatcaagctttgccaagtatgtcccttattgcttcagacttcagttatcttcctgatgttagcatacctggcgatagagctccattggtttcttcaaagaaggatgggaaaaccttggatcatcccaactatcttgatgcacggggcgatgcagatatcttcttcccaaccgatttcttgctgttggagcagatcgaccaccactgctctggtttctcgaaggaccagatgaaccgtggtgcatttaaacctgtgaagagcaggagaacaatcatacttgattcggctgccttcatggaggagtttgggctgccactgaagacgaggaccaaagatggatacaatccacttcttgatgatttcaggaacacaaagttctatctcagtgtgcctacccacaacaagtagtagtccagcatgcctgcgtcgcttcttctgtttgccatgaggcgctgcattagacgccagtgaatacctaatatgcaactcagtaatcaatttgtcagagcaggttatttatgtgtgtttttcctgtagaacactgaaattcttaggttggtcaaattttgtttgaactgacttttggaagtcaaattctc

SEQ ID NO: 16533 - DNA, 616 bp, Triticum aestivum
  unsure (1)..(616): unsure at all n locations
  Clone ID: PAT_TA_16533
gtcccgtccgcagccaccgagaggggaaattagtccagacttttagggtttcctgagagagatatctgggagggcgccatggacgggaagctgccgccgcccaaccccaacctcccgtaccgggaggactgctggagcgagggcgagacggccgccctcgtcgacgcctgggggtcgcgatacatcgacctcaaccgcgggagcctccgccagccgcagtggcgcgaggtcgccgacgccgtcaacacccgcccgggggcctccgcgcgccgccggcccccgcgcaccgacatccagtgcaagaaccgggtcgataccctcaagaagaagtacaaggcccagcgggcgcggggcgggccctccccctggnccttcntccgccaagctcgaagtcctcgtcggccgaacctctcgggcgccgccgcaaaaagcctccccgccccgcggggnttccaatgntgcggnggggnaagttngcctttcggtccccgtngccggcctcnccggggccgccgattggggctccccctggccaaatnacggcgngggtcaaactccccggggnctgactattcaananggccncccaaantgggggtggnccgggnttcnaatn

SEQ ID NO: 16534 - DNA, 563 bp, Triticum aestivum
  Clone ID: PAT_TA_16534
gagcggccgcccgcgatctagaactagtccagacgcctcctcctcccccgccgccgccgcacgctccagagaccgcaggcatgggcgtcttcaccttcgtgtgccgcgactccggcgccgagtggtcggccaagcagcacaagggcgagctcgaggcctccgccgccaccccctacgacctgcagcgccagctcgtctccgccgcctgcgccgaggacaagtccggcggcgtccagtcctccttcaccatggtctcccccaaggctgaggagaagaaggaagaagagaaggaggagagcgaggacgaccttggcttctccctctttgattagatcttctttaccctgttgctcgccagaaatgacatggtcctattgccgcagtaattttgatgccatgcccacaggggttgtgaacctgcctagtttgattgtcaagagatgtatgtgctactttctgttcatgtgaggatttggttatgttattctgcagcattgaatatcctactatggctttagtcttgccggtttataaaaaaaaaaaaaaaaaggcggccactcgcg

SEQ ID NO: 16535 - DNA, 762 bp, Triticum aestivum
  Clone ID: PAT_TA_16535
cctacgcgtccgcccacgcctccgatcccaccaccaagctccagacgcctcctcctcctcccccgccgccgccgcactctccagagaccgcaggcatgggcgtcttcaccttcgtgtgccgcgactccggcgccgagtggtcggccaagcagcacaagggcgagctcgaggcctccgccgccaccccctacgacctgcagcgccagctcgtgtccgccgcctgcgccgaggacaagtccggtggcgtccagtcctccttcaccatggtctcccccaagtccgccatcttccaggtggtcattggtggcgcctctgctggtccgatcggtggtggtgctgctgcaggtggtgccgctgcatcaggtggagctgccgccgaggcccccaaggctgaggagaagaaggaagaggagaaggaggagagcgaggatgaccttggcttctccctcttcgattagatcttctttaccctgttgcttgccagaaatgacatggtcctattgccgcagtaattttgatgccatgcccacagggtttgtgaacctgcctagtttgattgtcaagggatgtatgtggtactttctgttcatgtgaggatttggttatgttattatgcaggaatatcctaatatggctttagtcttgccagttcagaatttttgctctgtcctgaaatgcttgagggtatcattgccttgatttgctttgcatgttaaatctagtgttcgttttattcaaaaaaaaaaaaaaaaaaggccccta

SEQ ID NO: 16536 - DNA, 1251 bp, Triticum aestivum
  unsure (1)..(1251): unsure at all n locations
  Clone ID: PAT_TA_16536
cttctcctccccttccggttcgggttctggttcggttcgggtccgagagtagctagcctagtctagggtttccgtagagaggaagggagagggagatccatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgcgggttcggcttcgtcacgttcggcagcgaggagtcgatgcgccaggccatcgaggagatgaacggcaaggagctcgacgggcgcaacatcaccgtcaacgaggcccagtcccgccgctcgggcggagggggncggcggcggcggcggctacccgtgtgcgcgtccgggtctcctcgcatcgcatcccaccaccaagctccagacgcctcctcctcctcccccgccgccgccgcacgctccagagaccgcaggcatgggcgtcttcaccttcgtgtgccgcgactccggcgccgagtggtcggccaagcagcacaagggcgagctcgaggcctccgccgccaccccctacgacctgcagcgccagctcgtctccgccgcctgcgccgaggacaagtccggcggcgtccagtcctccttcaccatggtctcccccaagtccgccatcttccaggtggtcattggtggtgcctctgctggtccgatcggtggtggtggtgctgctggtggtgccgcagcatcaggtggagctgccgccgaggcccccaaggctgaggagaagaaggaagaggagaaggaggagagcgaggatgaccttggcttctccctcttagattagatcttctttaccctgttgctggtgcatgccccggggttttgaacctgtcatttttgatgttgataaatgtttgcgaacctggcttgtatgagcgtaaggccccatgtctgcggataagaagaagatgacgccagaaatgacattgtcctattgccgcagtaattttgatgccatgcccacagggtttgtgaacctgcctagtttgattgtcaagggatgtatgtgttactttctgttcatgtgaggatttggttatgttattatgcagcatcgaatatcctaatatggctttagtcttgccagtttagaatttttgctctgtcctgaaattcttgagggtatcattgccttgatttcctacatcagtcaaaaaaaaacaaaaaggccccta

SEQ ID NO: 16537 - DNA, 1066 bp, Triticum aestivum
  Clone ID: PAT_TA_16537
cctcccggcccccctccccccccccattcctcccctcacccgtgcgtccgtcctctccagccgctccagctccaatggcgaccaccatctcctctctagcggccccacccgccctccaccgccgatgctgccggagccccgcatctgcctcgacccccgcccgcgtgtcattccgcgccgcgccgccggccggcgcggcggcgcgggcgaggcgccgggcggcggtgaaggtgctcgcctcctccgcggtgatggaggcgcccgaggagctggccacgcggaagctctacgtggggaacatccccaggaccgtcaccaacgacgagctgtcggccatgttcgccgcacacggcaccgtcgtgcgggccgaggtcatgtatgacaagtatagtggtcggagccggcgattcgggtttgtcacgatgagcacggcggaggaggtcgctgccgccattgagagcctgaatgacaccgaggttggaggtagaaaaattaaagtaaatgtgacagagagcttcttaccaaacattgatacatctgcaccggaatcggaaccttcatttgtggacagccagtacaaggtttacgttgggaacctcgcaaagaaagtgacaacggaagtgctcaagaacttcttctctgaaaaaggggaggtcctcagtgccacggtatcccgaattccgggaactccaaagtccaagggatatggttttgtcacgttttcttcagaggaagaagtggaagctgcggtttctactttcaataatgcagaattggaaggacaaaccatccgtgtgaatagagcataggcatagcagaaatttcgcattggaggcaaggggagaatatcttggagaacacctgtagacgaggggaagtttgagactagattttataacaaagttttaaaggcctttgatgtaatttcactctggccctaagcattttttttttgtataataacaacaaatggaagaattttgattgtcaagcccgttgttcatatgaagcagctgttgtttaccagcatttctaaatgattgctcatgggcagcatggtttattc

SEQ ID NO: 16538 - DNA, 708 bp, Triticum aestivum
  Clone ID: PAT_TA_16538
cgtccggcgccagccactcccccgccttggccgccgacccccatcgccagacgtcgctacctgctcgctcaccgagggctcccgtccggcgagatggctccccgccacgttccaaggggccttcgtaaccttgacactgatggagaacgtcgcagtcgatacaacagctaccttagagaggccctggagatggaccctgatatgtcctacgtcgaggttcctgaccacttggtcgctccaaagggacgcacaaagagggagatcatgaaacgggcggccattctcaaatgtggctcaactggctacgggtgcccggtcggtttctcaggatatgttacctatccagccagtgagatagaaaaacagctgctgaactcagcgggggcaggtgctgcagctgctcctccaaccgggggccggagctgcagctccaatcggaggtgctgtggtttgaactggtctgtccgggacaccacaagatgatgataccagagtcgccagatgatacctgagagtctgccagctgtaccgtcccactgcggcggtctccctctccgggcgcttggtgttcggtccccggttcgaagtagttcctctctgtaaatatgctcagcacttattcagcacttattcagggcaattgtagcactattatggtatcgggttattgatttaaatgccggggcatttgtttctgttcaaaaaaaa

SEQ ID NO: 16539 - DNA, 1292 bp, Triticum aestivum
  Clone ID: PAT_TA_16539
ttcggcacgaggcagtattgcaagtagcaatgagcgcagccactcactcaagccgtccgctctctgtccgtgtgtcacgagagaaggaatgtgctgacaattccatggtagagcccatgagccctaccggaagagtcatggaggagttgggtgtgtgcatcgtcgtcgtgatagggcttggcgtgccggtgaacctgcccgtcttccgtgccggcatcgaaacagaactgcttactcttttcccacgcttccgcagtattcaagtaatggacgagtccaccaacaatggcaagccgcgatgggtgcaaactccggtgaacatggacgaccacatcgtcgttcccaggctggatcctgaggctgtggcgtccgacccagaaaaggccgtgaggggactactgtggcgtcgctgtccctgctcccgatggacaggcgccgcccgctctgggagctccacttcctcgactttccatcctccgaggcagcctccacggtggtgctccgcctgcaccactccatcggcgacggcacctccatcacgacgctcctcatggcgtcgtcccgcagcacggccgacccggcgagggtgccagctatgccgccaccacccaagcgcacgggcgccatctaccagcggcaaccgcggcctccgctgtcttcaggtgattacctcgcactgcttgcatggttttggtcgtatgtcgtgctggcctggcacacactggtggatgtaacgatgatcgttgcaacgatactgttcttgagtgatccacgcacgctcttcacgcgtgcgcacgtccaggagtctcgcagccgcaagcgttttgttcatcggaccctcagctttgacgatgtcaagctcatcaagactgccatgaactgcactattaacgacggctgatccgtcttaccatgaatgtctttctccttattgctttcacctgcccgtgaccctcacgcgttgtgttccgctgcatctccgtcgtttcgtgccaccttctcgtccggaaacccttctgacggaggctgaatcgttgattctcacgtcattatgtaccttctatagcccgtattgtcgcaggaaaagaaactagcagaactgtgaacgtgaagtatctatatgtagtacttgcatatatttacatgataagttggcagttttctagataaccttttgacaaaaactgaaaacaaaaattataactagacataataacatggtaaatagaaaaaaatagttttacattttaaaagtctcataacagttatatcggacaattttgtctctatct

SEQ ID NO: 16540 - DNA, 1228 bp, Triticum aestivum
  Clone ID: PAT_TA_16540
tttttttttttttttaacaagaaaatcactttacaaatgacatcacatacacaaataacatacgtacacttcgactgacgtacacacaagcatatgtatatttatattagctatgcataggaatggttgtagaatgattgactagtggtggttgacggcaaagcacttctctcttatctccccctcgtgaccagtaagcacctcgacattgcccatcttgaccatagcggcagcgaacttggcccgccacgccttctccacggcggcgtggaacgcgacgatgccggcggtctgggggctagtgagcagcgtttggtcagaggtgagcggcaccttgcgcgccagcacgttcttgaagtactggttgtcgaactcccggggtgtgatcgggtccagcggcaccgttgtgaggtcgctcgggttgtccgtcgatggagggcattgtcgcctaagctccgccgcgtaggacttgtcaatggacgggtcggtccgtccgacttcgccggaaaagttgtggatacgctgcgtgaaagaggagcagtgagagcgaccgatggtgtgtgcacctgagagcgtgaccatgtcatctgcagagagtcccttgcgcttgaagctggccacgagctccgcgacctcatcagttggaggcggcacgttgttgttgagcacctcgtcggcaattgacatgcggccatcacggcggccagatgggacacggtagttgatgccgccggcaaggtatgccccgtcgcgcgccgcgaaggcgagcacgtcggcacaggagacggtgcgcgggcagctcgcctctagggctgccttggcgtcgtcgatgacctcgaagccacgcatgctagggttattcgccaccgagtccttctcggcgatgttccccggcgtcgagttgatcagcaaagagccgtcacaacccctgacgaagcagtcgtggaaatgcatgcggatgaggccaggagcgaagccggggttccgggcgacggcgcggcggacggcatcgcgcacgatgtcctcggcctgcgggcacgtgtgcttgtagaacccgaccttcagaaacttggacggcggaggcgatgcgtccgccaccgccgagatggcggccacggcgagcagcaccgccgcagcccacgcaaacattaaagtggagaacctcatggctgggagctaattctcgaagcaactaactatggatcagtttgatggccctagctctcca

SEQ ID NO: 16541 - DNA, 1247 bp, Triticum aestivum
  Clone ID: PAT_TA_16541
gcccactttttcgctcttaataagcagttgaatgaggaagctgcatccttggactggaccaaatcaagtggacatgtgctgagtggccgcaaaatatttgattcctatgaagatgaatttgatttagaaccggaagctcatgttgtcggtcacaaacttgggggaggatcgagttcactggcaagtgcccgtgtgttgccaggggtagctgcttatcagcgtctcttgagtgcatcatcaacagatatggggagttcccccagtagtgttactaaatctgtggaaatatataatgtgcaaggtacacaagctgaacctgatccggatgatgctggtcaatattttgttcaggaaaatgtgaagacagaaccagacccagatgataatgatgccatgcctgttgatgtaacaattgtgacatcaggaccagcaggttttgtagcatctacagagcagaataccataggttattctgagcctgttcttgatgatgttgccaagaaaagctctgttggttacctagaacctgatcctgatgattccgcagatgttgacatgcttaacaaggacatcaatggtgagcatgataatgaacctgatcctgatgacggcactagtgaatttgtcctagaatctggaaacaagatggaagtggagatggagccgagaactgactccacagttctgaaatctgaacctgaccctgatgactcctctagctctattcaaacccagaaggtgagcattgatgggaagcacgtggcagaacctgatccagatgctagtagctgcggagctgttatgacatctggaaataagattcaagcggagattgggcagagcagaaaccactcagttttggagtctgaacctgatcctgacgacaatgctgctaatttgaagagcgatgagctgcaaagaatagaagagccagtggcagccctatgctcgcgcctccataaggctattgaaatgctccggtcgcaagcaacaccttcagaggcagcctctgcacttcaaacactcttcaaaattatcaagaatgtgatagagaacccaaacgatattcggtatagaagactgcgtaagaccaatcctcatttccaaaggagcgtggcgaattacaaagctgcgatggaggtcctcgagttgattggcttctgcgaggatgtcgtttcagatgagattgggcgtgcagagacctatctggtactgaagaggaacgatcctgggttgctgtggcttgc

SEQ ID NO: 16542 - DNA, 2988 bp, Triticum aestivum
  unsure (1)..(2988): unsure at all n locations
  Clone ID: PAT_TA_16542
ccaccaccccgcccgacccgatccacaggctagtacctttggacgctgtcctgatatctggaaataacattcaagcggagattgggcagagccgaaaccactcagttttggagtctgaacctgaccctgacgatcatgctgctaatttaaagagcgatgagctgcaaaggatagcagagccagtggcaggccccacgcttccgtcgccccctccatcggccagattgctccgtggtgctcggctcggcgggaagcctctgcctagtgaacaaaatggatgaacagagaatagctcgaatatcggtcacttggagagtgcaggcaacttgaagttgatgcagacccaagctgtacggtgaaggaatttgggcaactgctccaggttttaactaatgttaaaccggagacgttgaagctcataggttaccgcaatctgcaaataaaggttccaacgctgatcagatccagttttcaagacccccattcaaagcttaacactgaaagaagctgctgtcagtgagggtaagcctattagaatgatgggtgtctttgaagatgaaattgaggaagtatcagacaatggcaaaagatcagatctgccgataattggatttgaagaggaagaacaacggctgaggcaacgatcttcaggcaggccccgagtttcactaaaacttccacaggggcaatacatcttctgtgattttcggacacttcacttacccggggttgagttgaatccaccaccttcggaagctctgaaaagaatgcacatacttgcatgtgaccctggcataattgcgatcatgaacaagcatagatggcgagtgggaatcatgactgaaatggcaccagtgggatatgttggtgttagtccgaaatgcattctaggcttcaataagaacatgggagaggagatatcccttcgcctacgaactgatgatttgaaaggatttcggaaatacgaaagtataaagaaaactctgctccatgaacttgcgcatatggtgcactctgagcatgatgcccactttttcgctcttaataagcagttgaacgaggaagctgcggccttggactggacaaaatcaagtggacatgtgctgagtggcctccaaggaattgaagccgatcctgatccggatgatgctggtccatattttgttcctgtcggtgacaagcctgggccaggcccaggtgctctggctgccgcccctgtggtgccagcggttgcggcttctcggcctcccgggtgtgcagcatctacagagctggggacctcccgctgttctgtgcctgttcctgtggagggtcccaaggtgcaagctgctcgtgccctacctcctccgcctgatgctggccgcgagttgtttcacggaaaatgtgaaggcggaaatggtcccaagatgacaacgattcattccctatttgatgtaacgattagtgacatctggataagcaggttttgtagcatctacatgagcagaataccataggttattctgagcctgttcctgatgatgttccgaagaagatctctgttggtagctctattcaaacccagaaggtgagcattgatgggaagcacatggcagaacctgatccagatgctagtagctgcggagctgttctgacatctggaaataagattcaagcggagattgggcagagcagaaaccactcagttttggagtctgaacctgatcctgacgacaatgctgctaatttgaagagcgatgagctgcaaagaatagaagagccagtggcagccctatgctcgcgcctccataaggctattgaaatgctccggtcgcaagcaacaccttcagaggcagcctctgcacttcaaacactctgcaaaattatcaagaaagtgatagagaagttttggagtctgaacctgaccctgacgataatgctgctgacttaaagagcgatgagctgcaaagaatagaagagccagtggcagccctctgctcgcgcctccagaaggctattgaaatgctccggtcgcaagcaacaccttcagaggcagcctctgcacttcaaacactcttcaaaattatcaagaatgtgatagagaatccaaacgatattcggtatagaagactgcgtaagaccaatcctcatttccaaaggagcgtggcgaattacaaagctgcgatggaggtcctcgagttgattggcttctgcgaggatgtcgtctcggatgagatcgggcgtgcggagacctacctggtactgaagaggaacgaccctgggttgctgtggcttgcgaagtcctcccttgaagtatccatggcttgataaaccttccagctatatacctgtatatcatgacatttcattccctttgtgctgcaaaaatggtttagtgcggtcttgtgcgatgagaatgagaacatgaaactaggtgttgcctgtcagcttctcaattgtatatcaaatatgtgattgcagagagactcgtaaaaaaaaaaaaaaaaaaaaaaaaaaaaaaaaaaaaaaaaaaaaaaaaaaaaaaaaanctcgagggggggcccggtacccaattcgccctatagggagtcgtattacaattcactggccgcgttttacaacgtcgggactgggaaaaccctggcgttacccaacttaatcgccttgcagnanatcccccttttgccagctggcgtaatancnaaaaggcccgaccgatcgccctttccaacagttggncaacctgaatggcnaatggcaaattgnaaccgtnaanantttggtaaaaatccggtaaaattttggtnaaaacagctcaatttttaaaccaataggcccaaatcgggaaaaacccntttaaatcaaaaggaattnnccccggaaaggggtnaagggttgttcccatttggnaacaagagncccctttttaaanaaccggggccttccaacgtnaaangggggaaaaaccggtttttaagggcaaaggncccctttngggaacccttnccc

SEQ ID NO: 16543 - DNA, 1066 bp, Triticum aestivum
  Clone ID: PAT_TA_16543
gcagagtggggaagaattagatcactgagagacacgggtggccggggtactgcgtctgccccgcccgccaccccggttgagattgagggggcttgaggggcccttccccaatggcctggggttgaggtagttggttgttgacctccggaggaaaggccaaggaatgcttagtcaagggcggaagaagaaacaggagaaagataggcttcggaagattgacgaaaacatgacagaggaggcagaaattggagaagagacgcctgaaagagttgagatgcccataattgtgaaagctgatgtacagggcagtgttcaagcagttacggatgccttaagaagtcttaatagcccacaggtgtttgtgaatgttgttcatgttggcgtcggccctgtaagtgaacatgacattgatctggcacaagcatgccgagcatgcatagttggtttcaacgttcgcgatccaccgagtgcgattactctaggagcaacacaagccaacataaagattttgctgcacaaggggttccaccccccccgcgtggaagggggttggctgatggtcgaggaggctccccggtctgcggagtccccgatttccgcggaggctgcggctcggcacatattccggccgtacgggcgtagcaagtcaaaagggccagacataaagattgccggctgccggataaccgatgggcgctttagcagaactggaaccatgagactgttgagaagcggagacgttgtctttgagggtccgtgttcttcgctgaagcgagagaagcaggatgctgacacgctcgacaagggtaccgactgtggattggtgatcgaggactgcgacgaataccaggttggggataccatccagtgcttggagcaggtgatcaggaagcccaagttcgtatcgacacaaagcggcgcagtccgtatagagtgctgattgagaataattgtttgtcactggcatgatcgcattgctgcgaattcagctacttttttgaactgaccgaagttttgacgatatagcgagataaaaaccaggctggcatgcttactattttggcac

SEQ ID NO: 16544 - DNA, 814 bp, Triticum aestivum
  unsure (1)..(814): unsure at all n locations
  Clone ID: PAT_TA_16544
attcggacgaggggaaagagaatagacagcggaaagttgcctccatagtggaaacaggctaggcgtgagagagttcagttttggcaaccacagcatgggaagtgttccagcagccacccccagcgtgcgcgagatctggcgcgcgcagcgcgccgacgggccggcggccgtgctcgccatcggcacggcgaacccggcgcactgcgtgccccaggacgagttcccggacttctacttccgcgccaccaacagcgaccacctcactgccctcaagggcaagttcaagagagtctttcagaagctaggcgttgagaagcgctacctccaccacacggaggagctgctgcgcgcccaccccgagttcctcgacgacgaggcggcgtccctggacgcccggctggacatcgtcgccaccgccgtcccggagctggccgcggaggcctctaagaaggccatctccgagtggggccggccggccgccgacatcacccacctcgtggtcaccacaaactccggcgcccacatcccgggcgtcgacttccgcctcatcccgcttctcgggctccgcccctccgtgcgccgcaccatgctctacctcaacggctgcttcgccggctccgccgcgctgcgcctcgccaaggacctcgccgagaacaaccgcggcgcgcgcggtccccgtggtctgcgccgagctcaccctcatgctgttcaacgggcccaagggagggcnccttcgaanaggcncatccaanaggggctcttcggaaaggcgcgggccctttntttngggnccnacccttgancccttnnaaaa

SEQ ID NO: 16545 - DNA, 1158 bp, Triticum aestivum
  Clone ID: PAT_TA_16545
tcggcacgaggccccgatcgagcttcagtcacacacctcacagccgaggcgaggcgaggcgacccagcaaccccacccatggcgcaccgcgtccaccccgcgccgctgctgccgctctccaccccacccgccccgccacccgacaacagcgacgcggccgcggagaacaccccgctgcgctccaccacagcggcggcggcgccgggcgcgtcgtacatcgtgcatgtacccaaggaccaggtgctccgggtcccgcccccggaccgcgcgcgcaggtaccgcaagctcgccgcgcggccggcgcggcgccgcatgctccgccgcgcctgctgcggcgcgtgctgcgcgctcctcctcctgctcctcctcgccgccgcgttcgtcggcgccgtctacctcgccttccgcccccgggcgccctccttctccgtcacgtccctctccgtcgccggcctcctcgacgcctcccccgcgcggctcgatgccgccgtgcgcgcggacaacggcgccaacaggaaggtcggcgtggactaccgcgccggcggcgaggtcagggtctcctactccggcgtcctcctcgccacgggccgctggccggccttctaccaaccgccgaggaacgtgacgctcatctccatgccgctcaccgggagggacggcctggccctcacggacgaccagagggcgcggctggcggagcaggccgcggcgggcgccgtgccgctgacggtggaggcgcgggtgccggtgcgggtgaggctcgggaaggtgctgcggacgtggaccgtggacgtgtgggcgcggtgccaggtcacggtggacaggatcgacggcgagaccacggccgccaaccagggtgcacggtcaagccaaccgtctggggtggtgggtgatcgccggggccagggcggcgtgaaccaagcacggaggctctttgataagatcacggaatccaattccattattactgccggtgaagtggattaattcgtgtgatctggaggatttctgtgtggggtgcatgcaaatagtacaatcaatcagcagagcattctgaccagttgtagatgcatgtatgcttcttcttgcataaaaataaactacatgtcgatgaatccctggtacaaaaaccagtcatttgtcattgtcattttacaa

SEQ ID NO: 16546 - DNA, 780 bp, Triticum aestivum
  Clone ID: PAT_TA_16546
attcggcacgaggcgcaggtttagctcaggaacatggcaaccggcaccggtgggaggccagccaccatgcgcgccgtccagtacagtggctacggtggcggcagcgctgccctcaagtatgtggagatccctgttccatcactgaaaaaaggtgaagttcttataaaagttgaagcagcaagcatcaatccagccgattgtcggatacagaagggactgctacgtccttttgtccctcaatttccatttattccagtaaccgacgtggctggagagattgtcgaggttggttctgcggttcaacagttcaaagttggcgacaaggttgtctccaagttgatattctggaaagctggtggcctcgcagagtacgtggcggcatccgagagcatcaccgtccccctccctgccggcgtgtcctctgcggatgccgcagggcttcccgtggccggcctcacggcgcttcaggccgtgaaggccatcggcaccaagttcgacggcacgggcgtcggcagcaacatcctgatcaccgctgcgtccggcggcatcggctcgtacgccgtccagctcgctaagctcgggaaccacaacgtcacggccacctgcggcgcgcgcaacctggagcttgtcgcggacatcggcgccgacgaggcgctcgactacaggaccccggaaggcgcggcactgaagaactcttccggcaagaagtacgactacatcgtcaacaccacgaacggcggcaaagtggtcggcgttcaagccgagtctcagcagccacgg

SEQ ID NO: 16547 - DNA, 1239 bp, Triticum aestivum
  Clone ID: PAT_TA_16547
attcggcacgaggctcaatagatcaaacaagctagttagccatggctcaagttcttcacagcctccatgagcatgcgtctccccaagtccttgtgctcatcgtatgccctcttgtcctcctcctcctcatcgttcggtttgccacatccacggcaaccacaaggagagcagacaagctgctcgacagactcccatcgcctccctacaagctccctctcatcggccacctccacctcgtcggctcactgccccacatttccctccgcaatctcgccaagaagcatggccccgatgtgatgcttctacgccttggcgccgtccccagcctcgttgtgtcgtccgctcgtgcagccatggcagttcttcgcacgcacgaccatgtgtttgcgtcccgggtgcagtccgccatgactgacatcctctactatggatcaactgatatgggcttctccccatatggggattactggcgccagattagaaagatcacagcaacacatcttctcagttccaagaaagttggctcctatcgtctcgcccgtgaaaacgaggtacaagacgctatggcgaggatccgcacggcagccgccaggagcactgcagtggaccttagtaagctgcttagctccttcaccactgatattgtttgccatgctgtgtcgggcaagtccttcagaggcggcggtcgaaacgagttgttccgcgagctggtagagactagctcgaagctcataggtgggttcaacctggaggactacttccccaagttggcaaggctggacgtggtaaggaggatggtgtgtgctagggcggagagaataaataagaaatgggatgacttgcttgatgagatcatcgacgaccacgccaagaacacgatgttggaccatgaaatcaaccaagacagagagacagatttcatcgatgtgttgctatccattcaacaagagtacaacctcacgagagaaaacgtcaaggccgtgttggtggacatgttcataggtgggacggacacatcattcatagtgttggattgtgcaatggctgagctaatccaaaatccagaggtgatgaccaagctccaggctgaggtgaggagcatggcagagggcaaggaaatggttacagaagaggatctaagtggcatgatctacctcaagggtgttataaaagagactctccggctacacagtcctgtgccgctcttcttgccccacctctctacggccgactgcgaca

SEQ ID NO: 16548 - DNA, 845 bp, Triticum aestivum
  unsure (1)..(845): unsure at all n locations
  Clone ID: PAT_TA_16548
tcggcacgaggccaagaatgagtgcactgctgctgctggcttcaaatggatgcttaatcagggtcttgtggcaaatcaggctgctgtggttgattacttcaaccaaagaggagtgtctgtgatatttctgttcagaaggaatctcctccgtcagatggtatcgcaactagcaaacaatcatgacagataccttaagcaattaaaaggaaaacataaggcccatgtgcacacaaaagatgaggcgaatatacttgcaaaatacaagcccaggctcaacacaacaacattaatgtggagtctgaaacaggcagatgactacactcgcaaagctcttgaaaacctaaagagcgtccgtcacattacattgtactacgaggatctcagtccaaaacagaacaatgcttgttgaggtgctggatttcctcaaagtgccagtgaggaaactagtcagccggcatgtgaagatacacacgaaaccactgtcggatcaaattgaaaactgggatgaagtctacaatgccctgaatggcaccaagtttgaaagttccttgaatgctgactaccgaacatgacattattctgtccgcacgttccttgtttagatattggctcccgtgtgttccttttatttatttcgctatttctttcttattaaaatgatagcctagggtgtgcctgacaaaagttttgacatggggaatggcggggtggccccggtggctcacaaatcacaagttctttgataggtnccactaattgtcttgtatgttcttttcagttttcttttcttttctttgaaactgatcaacaagcttntaacctcttgcgttccactgctaattatc

SEQ ID NO: 16549 - DNA, 785 bp, Triticum aestivum
  Clone ID: PAT_TA_16549
tcggcacgaggcttgtttggcaccacctctcatctgtgtggcgtttgcttacttctacggattcatcatattccagtctttaggagctgccatcaagatgttgccgcttgaacataagcccgggcactgagttttttggatggcagtgacctgcagaacctccaagatatctgccttccgtggttgcaattcttgtgggtcctacttttaatctcgcaagtgcttcaaagggaaggcctgcacagcaagggagtagtgagggaggcagagttatgggagttgtgcttctagatttctctcacaaattgatcaaacgacgagcttgtctacggtggaagcaagcaggccgcgcatcttaccgttgcagctagcccctctgtattttctggcagcttgctcccagtctgcaacttctctttgctgtgtttgttgcatgaggtttgagctgtgagcacatggggttcaacacagaatcgttgcgaggcttgtgttctgatggtctatggaagtatgcagtattttggtcaatcaaaagcgagaagcacggcatcttgacttgggaggatggctacgttgacaagatgaccaaaaacacgagagatcattacggggacccagctgatagtgacaaccagataataacacttacttggtctaacgatggccaatatcaaagctatccattttgccccatcgaggcagcattgctgcgcatgtctagtcattcgtattctcttggagaagaaattattggtaaagtggccattatgggacgacattgctgg

SEQ ID NO: 16550 - DNA, 1033 bp, Triticum aestivum
  Clone ID: PAT_TA_16550
cttccgagcttcagaggaaccacacagatggtccttcttgaactggacacgttcgatgcccatgacatgcttcttcttcgcgagagtgtacaagttcctcatgcccgcatgtcctagtctctgatgccatagccagccttctgaagcttttgcaagtaggcatacggacggttgtggtcctgtagagaaatcaacaatgtacaagtctcctctcctaaagccttcggagactttggaattgtcagcttccaagatcacaacacaacgatatttcccaaagacaacaaccatatcgagatcacaaagcatcaagacagacatgaggttgtattctaaggactcgacaagcatgactttgtccatgtgtcgatcctttgagatcgcaaccttacctagacccaatacctgacttttgcctttgtcagctaggatgatatgctcccggggcgacggggataatggagcatccatcaatagattcttgtcaccagtcatgtggtttgtacatccactatcgaggacccactcagtggctttgggttgatcatcctacagatgaattagtgcatcttacaaactcatatactccatcagtgaagaatatgacatcaattcatcagatcaatttcatcaagtaaaagaactaataacgcaatatgaggacgtgagaaatgaaagttcatttcttcatggttagcctgcgtcctttcaggcatgctcaggtctccagcaaattcttcagacgattatgtgcatctagagacctgaccctgcagaagagattagttccttttcttcaccacccacatctgaaggggtggcaaagagttcatcattctgcgagctccatacgagaaggatggcatagaagccaatccattttgtttcacataagaggggttataataagcataagagtaagcagagaaattcttcaaggatgtatggacatagtaatttgaagaataatgcacatatccataatccttagatctttcctgcgaaacagatgggttagcacgatgatgttcat

SEQ ID NO: 16551 - DNA, 1674 bp, Triticum aestivum
  Clone ID: PAT_TA_16551
tgccacgcggtgaacccgagaggctgcgcctcgacggccgttccgacagaccgggacttgcagtcccttccaatcctgctagattatctgactctttctatgagatagggaagccagtcttggaccatgagactagtaagaaggtgagctttgtgtactccgaagatatcgacagccagaacataatggccgaggtcttcgacatggagaatctcgcctcagcatactacggcaggaatctagccacctttgaatacagcagctacgcgggccaatcgaaggaggtcgtcccgaagacttgaggtgacggtgcagccttctccgcctcaggtgtcgcccgtccccaccggggacgagaagccgcgacgcaattcgcgaggggtttcagttacataactgatgcagtcgtccccctacagttagtaaaatgtcatttctatatatgtttaggcaatgttggcacaacggtcaagcttttgcggttgcgtgagcagcaagagaaaataaatgaggtacgaaagcaactaggaatgaaccctcgtctgtagcaatacagggtttcctttcggaatgcctcgatacgtgaggattccttcgagctagaaatctggaatgtgcagaaatcgagtaaaatgctgaaatcagctgtgaagtggcgggcagcatacaagccagaaatgatttcctgggaagaaattgcacttgaagcagagactggaaagatatatagggctgactacaaggacaaacttggaagaactgttcttgttctgaggccaggcttagagaacactacctcggggaaggaacaaattaagtatcttgtttactctctggagaaagcgattatgaatctgacggatgatcaggagaagatggtgtgatggatagacttccagggctggaccatgggaagcacaccgttgaaggtgacccgggagaccgtgagtgtcttgcaagactgttatcccgagagattgggacttgcaatcctatacaatcctcctagattatttgagtctttctataacattctgatgccatccttgcgccgtgaccctagcgacatggtgtgctgtgggtactcctacccccaagcgagcgagacgagaatggcagaggtctttgacatgacagctcgactcggcattcggaggaaggaatctagccacctttgatacagcagttatgcggaacaaatgaaagaggatgacagaagatgcaatctaatgatgcgagctctgacgcctcaagcgaggcttccttctacagcggaacagattccccgaagcacgaagatggagggcacggcgcgacgaagaaggcctgcgccacttaaactgctaatagttgctctatttgaaagatgtgtagtaagaatatacacaatcatctagctagaccttttgcgccagtgtttatccttttgtcggtcacattttcgggtccaagacttggaatgttctctgcccgtggtatcatagaagatcaggaagagaaagcttgggccagaacgtgtgatgcattgacatctagtatcaagtaacataaatgagaaatattacgagggctgccctgttgcaggcgcttctatacgaaataatttgatgttcagctcatgtgttccatgagcagactaaccgatgcactttactacttgagtggggggccgtt

SEQ ID NO: 16552 - DNA, 577 bp, Triticum aestivum
  Clone ID: PAT_TA_16552
agattcgatcccctcatgcatgatcggcgcgagggcagtgtcctgctagcaggaaatattccagatttcggtgccactaccacatcctctgcgacagaacaggcaaatagtgatccattatcagttgaagggagggggttattttcagaatctgtccttgaagaaactgcttggtgctagtagtaatttgaatacagatacagcatgtggctctgttgtctctagcactggtccattagctggttgtttctcaggctgtgaattaccagggtacaccctccagcaagattcttcttactcggcatgcaaggaacaagtaccaccattgaacttcccttccagcagttatacatctgaaaatgtgccagatggagcatcaaaggcaataccagtgtccctggccaatttatctatggatgacagttgcagactgcacactgcaaattccaaggtcggccaggtaacaaatcctgagggagtaaaggttataaagaaaagagctagaccaggtgagagcacgcggccaagaccgaaggaccggcagcagatacaagatcgcgtcaaggaattgcgtgag

SEQ ID NO: 16553 - DNA, 658 bp, Triticum aestivum
  Clone ID: PAT_TA_16553
cggcacccggccgccggcccccccctcctgctccgcgccccccccgcgctgccgtgcggcgtccccccccccgccggctggcgcggcggcggcgccgcgtacgcccgcgactgcctcctggcggctcccccctccagcaccgcgccccgccgccccccgcgagctgcgcgccggccgccccgggccggggcgcccgccgcgccccctgcccccgcggccgctactccttctcgtccccctgctgcgccgagcaccgcgcctctccgcgtggtcctcgcgtccggggccgccccgctggcctctccgcccgccccctcccccccgccgccacgcactctcttccccccgtgtggcggggagtcaggcaggtccaccccgcctcgtccgccgtgtcctgttggcagcttcggctgctggcgtgttctatggtcgttcctaagcctcttcgcggttcccggcgctcctcctaccggcttttctggttgttcatttgttcgtgaaggcaaggtcttgcgtgaaggtcaacctcctacatcgctgtgtcaggcactctgattgctcagagttagaaaagaggaacgcagatttttgtccgtgaactgtaagcagcaacaagatcttgcaattttctagttttgttttctagccaaaaaaaaaa

SEQ ID NO: 16554 - DNA, 642 bp, Triticum aestivum
  Clone ID: PAT_TA_16554
gcaactttacaacttcttctttttacgtagagcagtagcacacaatgtccacggcgccgccgcaagcgaaccaccagcagcagcagcagcagcgccaccggaggctgcgggtgcggcgggtgttcgacctcttcgaccacgacggcgacggcgtcatcaccgccgccgagctctcgggcgcgctggggcgcctggggctcgccctgggcgcgcaggcggacgcccccgtcgccgcccccggcgcgcccggcatgcccggcctgcggttcgcggacttcgaggcgctccacgccgagctcgccggcggaggcgaggaggacgaggaggccgagatgagggaaggcgttcgccgtgttcggacgagaacggcgacgggtacatctccgcggcggagctgcaggccgtgctggagtcggatgggggtgcccgaggcggcgtgcatggcgcgggtgcaaggcatgatcgccgcgcatgaccgggacagcgatggccgcgtcgacttccatgagttcaaggccatgatggctgccggtaatgtaaatgtaagagcttaagttataagaagaatctgattcctcgttccaagtcatgtactgctagtttactacttcctcccggctatatgtacttgccgggctttaa

SEQ ID NO: 16555 - DNA, 1128 bp, Triticum aestivum
  unsure (1)..(1128): unsure at all n locations
  Clone ID: PAT_TA_16555
cggggccgaggcgtcctaggaacatcccaaaattcccaatcgagcggagcagcagcgagagtaacctatccatccgtccgccgccgcgtccgcccacgcgcgcggtaagccagccgtcggtcggtcgccgccacaaagctccgcctcgccgggccgccgcctcgtcgccgaagagctctgcctcgccgggccaccggccgcgggcacctatgggcgaacggaaagaagcaacggtgccgagcgtggcctgtgtgggaggaggcagcggcggcagtggatcgagatcgagctcatgcaaacgcgcatctgctgtttgcaaaatcagcaagcgcagccagcaggggatctttaaaaagatgaagccaattgctgcttattttggaactccaccatctaatgaatctcaagctcatgttcatgttctctgaacctgatgcaaacattttatccactgaagcctcagatgcaaacattgtagaagatctagttcctgaacatgaagtgtataatgagggctctcatgataacactttgcaaacttctattctaggatttagttgcttcgttttgtattaaaagcggccttccagtgccttgtatcggtgtggatattccggcatcgggtgacccgtggagtgccgcatgatgggctgtggcgtccgtcacttctttgctggaactgtcgacgccaactcacattgaacctgatcctggactccggaaacaaattggagattatcctactccagaaatcagagatgcagtgaggagggagtatttgaagaaaggtccatgtcagccgtatgggcatgattttcctcgcaacactacagataaaagggtattcagagaggagtggtttgacgagtctgatgttttttgcagttgtggcagtcttgctaatcttgctctcaagttggttgaaactaaggaacatttacactttcctttggtttaccgactcatcacacttgctttgactntgccagtagcgacggcatctgttgaaagagttttctcagccatgaatatcattaagacagatttgagaaataagatatctgatgattgggtgaatgatctgatgatatgctatgtagagcgagatatatttgctggaattgttga

SEQ ID NO: 16556 - DNA, 706 bp, Triticum aestivum
  Clone ID: PAT_TA_16556
tgttgattgagatggccggcaataacaatgtgaaggagaaactgaggaagcttcctttgttgtccctgcgaagatcacccaaagattgtaccctccttgaatccagaatcttgcccaatggacaagaatcggttgaaagcgcaacacagaagctggaagcgttcaagttgcagttgagaaaaacagataatgcgactttagctgaaaatggaactgaggggacgctcaacacaagcatgccagagaaacgtaataggtggtctatagcgaagtcctggaccccctgtccgctaggaatgataccatgttcatatagttcaactgctgttctgccggtccttgatgtcattgatgatgaactgaagcatgacacagcagaacatggagattttgagcctgatggcgagatcgaaattttcgactgctatgctcaccccgagcagcatttggatggtgaaggtatcctagaaatgccaagatcgccacctgaacatgggatttctgatagcccagtcctctccgcccggcgcagggctgctggccgcgttggtggcgtgtggaaaaaggtgaccgaagaagagttgctctccataaagtcaagcatgaaaattttgttgtaatattcgctagttattctcccctcattagtaaaatatttttcttctgtgaacgatcaaatgttagctttttactgggcatgacaaaa

SEQ ID NO: 16557 - DNA, 577 bp, Triticum aestivum
  Clone ID: PAT_TA_16557
tcggtacgaggccgccgtgctggacgcacgaggagaccctcgcgctcatcgaggcgtaccgcgacaagtgggaggcgctcaagaagggcaacctgcgggcggcggactgggacgaggtcgccggcgccgtcaccgcccgctgcgggaggttccccaccgccacctacgggcgggggcgtgggtgccgccacaagatcgagaagctccgcaagcggtaccgcgccgagcgcacgcgctccatggggcgctccaaggggcccaagtggcccttcttcccgctcctccacgacctcgccggcggcggggtgcccgacgccagccccaaccccatcatcaagatcaagcccaggggaaacgccaccccggcgtccccttccccggtgtcgtccccctcgtccgaggacgccggacggagcaggagcctccacggcctcatctccaacggcgggggcggcagcgggctgcgcttcaccatccccaaggcttcgcgcaccaagccgggggtcccgcgggaggcgaggccggaccgggacaggggcgaggacgacccggaggcagaggccatggcggaggtggc

SEQ ID NO: 16558 - DNA, 788 bp, Triticum aestivum
  Clone ID: PAT_TA_16558
tcggcacgagggactattataacggggaggctgtataatgggttactacaaaagtctgttaccttttcactccttgctcaaattgccaccagagtccggagaaggcatgctatttaattcaagagacatccaccattggcaatccctgaatgaaactactaaacatgtaatacgaaacaagccggtaaaacgcgacattcccaccgtcactcctatttcattttcgcgaacttccccttctctaaccagcacgagatgtaagaacaaacaccaattaaaaatcttgttgctgctaaagaagacctacgaaacaagtgaagaagaagctggacgcgtcctacccgataaattgattaaattccgaatttcccctgccccaagctacacaaggtgtaagaacaaacaacaattaaaaatcttgttgtcgccaaaggaggacgagacgaagaaaataatcggttctatttgcaagtcatttagctcgtcagtcgacattcattcatcagataaatcacaattttcctcttccaaaagttttacaaggtgtaagaacaaacaacaattaaaaatcttgttacttaagaaggtggagaagaaggaaattgaagttgaacgcctttccgacccgtcagtcacaaacccttcacacattatatccagaatatcattttccgaacgctacacgaggtgtaagaacaaacaacaattaaaaatcttgttgtcgctgaaggaaaagagaagaaagagataatgtttggaacgaagttatcgtagctaatttctctatt

SEQ ID NO: 16559 - DNA, 519 bp, Triticum aestivum
  Clone ID: PAT_TA_16559
tcggcacgaggcaacgacctcatcctcgtccacaaccacatgctggaagccaagctcgaggagctccgccgcggcctcccccgcgcgcccttcaccgccgtctgcgcccccggcccccccctcggcctcatcacagcgcccacccaaaacgggttcgacaaggaaacggtgctggaggcgtgctaccccgtcttcatttccgggtcggcggcggtgccgtgcctggacccgtcgaggcacgtgaatttcgacggcctgcacatgacggaggcggcgtacaagctcatggcccgcgggatgctcgacggcccgttcgccgcgccgcccatcatgtccacatgcaaccacagctgctagacctatgtcttgctttggcaaatgatctatatattcagatagtgcttgttgcatctaattgtcaaagtgtcatcaatagtactcgatcacgatggtgcgcgttgcagcacctccatttttccaataaattgatactacttttttaaaaaaaaaaaaaaaaaa

SEQ ID NO: 16560 - DNA, 956 bp, Triticum aestivum
  Clone ID: PAT_TA_16560
gtgaagcacaactagtccaaatcaagataatcagtggtggactatgggccagcaaaggtgcgtcttatattatggatctccagaacctggggcgttcagctgagaaaattctagaggttaatggtgataagttcaatgttttggcatctaagtttttgtcaacttgggttggtcctggagctagaaggagggtaccggaattgaagacaaccggagagggttctgtacatcatcctttatctgctaaagaatcaatcaaagcagcggctacatactcggcccgagggtggtactctcgtgctgccttattttggaggaacataaagcaggtttcagataatgccctccaactaatggtcagatcgaactgggatgacttcctccacctcattaaggatcttcaattaccaagcatgggtcatcctccttccaacaattgtgaaagtgggtttgagaaaagaagcaaatcctttgagcccaacctatttttatgggggggggaagggggatttcctccggcctgcggttgccaaaaatacccagggggtccgaactataaacatcacaatttctgctcgaaatccttgctttgggaacaggtggcagcagcttttgataaacagcattgttggttatgatactatacttacaaacagcttagtgaattctcctggccagggtacacttctgatatggctgtgcttatgctggtcttaaaactgtcatagttcctctatgtaatgtttgctaacttagtccttgataaacgcacaggacttgcttggaagcatgtcaaatgtcacatgttaggagtcttatctttatttgttctttaagacgacccattttgatagatgggtttcccccttggcataatatgcaggttatctatataactttcagacaaaggagctttatgatcttagttatgggcatgaaccgccaacaggccctac

SEQ ID NO: 16561 - DNA, 319 bp, Triticum aestivum
  Clone ID: PAT_TA_16561
gggaaacgggagggaggatgcgtcgtcgtgtctgagagccggcgtggcgcggtcgccggcgccggggcgtgccgctgtacatggagagcccggtgctggggcctggccggctgggttgattcttttgttcttactactactttgtactctcaatgcggatgtagctctttcttctcactcctcggtagtagaatcgaccgaccaaatacatatgtagctctgttccttccttctcttcagtagaaatcaaccaaattttgctgttatgctgctatacttctctgatgtcgggcaggatgaattgcctcaattttcagtc

SEQ ID NO: 16562 - DNA, 685 bp, Triticum aestivum
  Clone ID: PAT_TA_16562
gcggcgcaccaggagatgatggccacgctgatggtgcccaagaaggaggcggcggacgaggccggcaggaacgacctcttcgtcgacctcagctacgacgacatccagagcatgtacaacggcctcgacatgatgccgcccggggacgacctgctctactcctccctcttcgcctccccccgtgtccgcgggagccagcccggcgccggcggcatgccggccccgttctaagcagagcaaagacagagaccgtcagagaccccgagatcgacagaagtggaatggacgacttcttggccgcgagcgagcgagaccgcggtgcagtgtaaatacagcataggaaacgggagggagggaggtggcgtcgtgtcgagagaagccggcgtcgtgccggggcgtgccgttgtacatggagagcccggcgccggggcctggccggctgggttgattcttttgttcttactaccttgtactctcaatgcggatgtagctctttcttctcactcctcactagtagaatcgaccgaccgaatacatatgtagctctgttctttccttctcttcagtagaaatcaaccaaattttgctgttatgctgctatacttttctcctgttgggcaggatgaaattgcctcattttcagacaaaaaaaaaaaaaaaagggcgccgtccgatctagaactag

SEQ ID NO: 16563 - DNA, 1009 bp, Triticum aestivum
  unsure (1)..(1009): unsure at all n locations
  Clone ID: PAT_TA_16563
attccacccagacagcccgacccgctcctcagctcacctcacgccgtaacctaagctaggttttcctcctccacctccaccggcatcacatcggacgcgcggcggcgtgcagccatggcgatggtggcacaggcgggcttcggcctcacccgcgtcgtcatgctcgtcggcgcgggcgtggccggctccgtcgtcctacgaaacggccgcctctcggagatcctcaccgagatacaggagtttctggagaagggggagatgggtaagtgaggtggtggtggtgcggaccacggcatcaacgacgcgctcaacgaggtgcgccaactggctatgcaggtacgcaatctaggttctccacgttcgataactgttctcagtggaggttctggacaaacaggagtatcaggattaatagtacctgcagcaactgttggagcactgggttatggttatatgtggtggaaaggcatctcctttggggacttaatgtatgtcaccaagcaaaacatggcaaacgttgtttcaagtatgactaaacatctggagcaagttcagagctctcttgctgctgctaagaagcatttgacacaacgcattgagaagttggatgacaaattggatcagcagaaggcgctttctgggcaaataaaagatgatgttactggcgcacgactgaagcttgagaatattggttcagagattaagaacatcaaagaattggtctggggactggatgagaagatggattcaatggaagccaaacagaatttttcatgcgctggtggtgatgtacctctgccaattcatagagcanagtggntgggaagctccctgaacgcctggaaggcattaaaccatcagcaaagcgatttgaaacaattggcatacagggggttgcaactagccataaaacagggaattttaagtgatttcagcaatgctgattccactgacaagataagcaggttcaactggttgaagtctgccaactaattttttttcggggttg

SEQ ID NO: 16564 - DNA, 1486 bp, Triticum aestivum
  Clone ID: PAT_TA_16564
agctcgttttccacaatctcaacagccatcggaatcaacagcagcagcagcggagcgatctcatcgaccaactctcttccaagtttcgattcaacggacatggggatgccggcggtgaggaggagggagagggacgcggaggcggagctcaacctgccgccgggcttccgcttccaccccaccgacgacgagctcgtggagcactacctgtgccgcaaggcggccggccagcgcctgcccgtgcccatcatcgccgaggtcgacctctaccgcttcgacccgtgggcgctccccgaccgcgccctcttcggcacccgcgagtggtacttcttcaccccgcgcgaccgcaagtaccccaacgggtcgcgccccaaccgcgccgccggcaacggctactggaaggccaccggcgccgacaagcccgtcgcgccccgcggagggcgcaccatggggatcaagaaggcgctggtgttttatgccgggaaggcgcctaagggggttaagaccgactggatcatgcatgagtaccgcctcgccgacgccggccgcgccgccgccagcaagaagggctcgctcaggctggacgactgggtgctctgccggctctacaacaagaagaacgagtgggagaagatgcagctccagcagcaggggggagaggagatgatggtggagcccaaggcggagaacacggcgtccgacatggtggtcacctcgcactcccactcgcagtcccagtcgcactcgcactcgtggggcgaggcgcgcacgccggagtcggagatcgtcgacaacgacccgtcgctgttccagcaggcggcggcgttccaggcccagagccccgccgccgcggcggcgcaccaggagatgatggccacgctgatggtgcccaagaaggaggcggcggacgaggccggcaggaacgacctgttcgtggacctcagctacgacgacatccagagcatgtacaacggcctcgacatgatgccgcccggggacgacctgctctactcctccctcttcgcctccccccgtgtccgggggagccagcccggcgccggcggcatgccggccccgttctaagcagagccaagacagagaccgtcagagacagagatcgacagaagcggaacggatgacttcttcgccgcgagcaagatcgctcgcggaccagtgtaaatacagcataggaaacgggagggaggatgcgtcgtcgtgtctgaaaaccggcgtggcgcggtcgccggcgccggggcgtgccgctgtacatggagagcccggtgctggggcctggccggctgggttgattcttttgttcttactactactttgtactctcaatgcggatgtagctctttcttctcactcctcggtagtagaatcgaccgaccaaatacatatgtagctctgttccttccttctcttcagtagaaatcaaccaaattttgctgttatgctgctaaaaaaaaaaaaaaaaaggccccta

SEQ ID NO: 16565 - DNA, 1556 bp, Triticum aestivum
  Clone ID: PAT_TA_16565
ggttttggccttatgcaccccaattctattacccatcgtactccacagcataacctacgccgtgatttcatcttggatctcctcctccacctccatcgccaccacacgggcggcggcgtccagggaaggccacggaggcggtggcacactccggcatcagccgcttcctcatcgtcatcggcgccggcgtggccggctccgtctacctaccaaacggccgacccaccgagccccgcaccctcacagagattgcgctggaggtggaggacaggggctagggggcaagcgggggtgcgacgcggcggccgaccgacgggctcaacgaggcgcgccacctggctacggccggcgcgctgcccggggtctgcacggtcgctcaccgcacgaggccgctggggcgcgggaagcggagcatacggactgctggtacccccccgcaccgtggggtggactgggtgttcggtacatgcgggcgcgcaggcgtgcccaggggcagccccagcgtcactcaccgacgcacaaccatcctcgcctggccctccccggactccgccgaaccgtcgggcaccacgtggccacctccccgagctgctggctaagaagccttcgacaccacccatcgagatgttggagtgacatgacagattgagctagaagacgctttgtggggcacataaaagatgatgttactgggggcacgactggaagcttgagaatattggttcagagattgaagaacaccaaagaattgggtcgggggactggatgggaaagatggattcaatggaagccaaacagaatttttcatgcgctggtgtgatgtacctctgccaattcatagagcaaagtggtgggaacctccctgaacgcctggaaggcattgaaccatcagcgaagcgatttgaaacaattggcatacaggggttgcaactagccatagaaacagggaattttagtgatttcagcaatcctgattccactgacaagataagcaggtccaactcgttaaagtctgccaactaattttcttccgggttggcgagacatgtatccagattcgttacttagtggaacattgtaaagggagattcttgctggataaaatgtaaagagtcccagcctttttgttatttgcttgcaggaagtgctgtttgttaaatttgaaaacgtgtgcgaagtagtagctactatggaatctagaccagatgttattctggcatcacttatgccgttgcatttttatgcaatactgtcgccgtaaataaatggacgacacttcggtttgcttcatgcccggaaaggatgatttgtttgttttcttttctactttgtactctcaatgtggatgtggctctttttgctcttcctcctcactgttgaatcgaacgaccaaataactaagtagctctgttcctttctttcttcactagaaaaaaccaacaaatttttgttatgctgctgctctaccttttttgtagtcgggcaggatgaactgccccatttttcagtcagtctgatctaataatccgcccgtgttttgtttgccaaaaaaaaaa

SEQ ID NO: 16566 - DNA, 840 bp, Triticum aestivum
  unsure (1)..(840): unsure at all n locations
  Clone ID: PAT_TA_16566
attcggcacgaggaacgatccaaagtctgatcagacggcgactggcgagcaccacgcaacggcgagccagacggtggtcgtcgacacgagcagcgacatcccgtgggtgcagtgcctcccgtgccccatcccgcagtgccaccttcagaaggacccattctatgacccggccaagtcgagtacattcgctccaatcccctgtggctccccagcctgcaaggagctcggcagcagctacggcaatggctgctcaggcagcacggaccagtgcaagtacactgttaactatggcgacggtagggcaacgtccgggacatatgtcactgacacgctgacgatgtcccccaccatcctagtcaaggacttccggttcggatgcagccatnngctgtgaggggctccttcagcgaccagaccgccggcgttctggcccctcggcggcggtggtgggtcgcttctggagcagacggcgggggcctacggcaacgccttctcctactgcatcccgcacccgagctcctctggctttctctcgctgggcggggccggcggaggcctcctccaagttcgcacgcacgcccctgttcaagaacaaacatgcgccgacgttctacatcgtgcacctggaggcaatcaccatggccgggaagagacttggtgtgccgccggctacctgtgccggcggcgcantgatggactctggtgcagtagtcacgcagttgccaccggcagcgtacgctgcactgcgagccgcgttcagaagcgccatggcagcatatggcccactggcggcacccgtgcgcaacctcgacacatgctacgacttcactcgcttccctg

SEQ ID NO: 16567 - DNA, 878 bp, Triticum aestivum
  Clone ID: PAT_TA_16567
cgtccggtctaaacgcggcggcgccctcctcgttgccggagcagggcgaggcggcgctcgacctgcgcctggtacccccacctccactgctgggctccgccccggggctcctcttctgcgtcccgagccctgaccagtgccatacaggccactcaaccaaaacgaggtcagatttctcaatttccactcggaaatccgaaccgtggtcatctccgtcgccgccgcctgccgcctgccgccgccatcgccatggcttccgctctacgggcccttcaccaccgcctcccccgctctctccaccactccaatcccctttccacctccgcctcacctcacgacctccgcgagctcctccgcatccaacgcatcctcggtgaccccgcagcaaccacccagcccacgcaaacgcaacaacgcccacgagccgccgccaccgcagacctgcaccgacttctccaccgcgcggccggcctcaccaccgccgaggccacctccctgctccgccgcgtccctaacacccaccgcctgggccaccttctccaagaacttcgtggcctgcgcctcccggcgggcgagatcaggaacgccctcgggtccgaccccgacgggctcctctccatggagccgggcgagccgtcccgccttgtcgagctcctagacgagctccgctgccgggcgcccatcaaggaccaggtcctctctcacggcgtgctcagcgccgcaatcgccgcgaggcggcgggtagagctcctgcacgagcgcgggctgagccggcgtgacgcgctgagggtgatctccgttgagcctcgggcaattttatatagcctggacgatgtggagaggaaggtggagttcttggtgggcaggatggggtttga

SEQ ID NO: 16568 - DNA, 358 bp, Triticum aestivum
  Clone ID: PAT_TA_16568
cgtccgaaattatcaactactaaagagaagctcagcctggctgtcacaaagggcaagtcgttgggggagggatcttgattccttaaaggagacactggctgaaaaatcaggtgagctggagaggtgcatggtggagttggaacagaggtctgatgcattgcaagaatctgagggcagacttgaggagcttaagatgttgttagatgaaaagtcaggggaacatgagaaatgtttggacgagcttagagaaacatacaacgcatgggaagctgctaaggcaagcattgagcaactaaatgatgtaaacactacacttacaataagtgatgggttccttcaacgcattggagaggttatg

SEQ ID NO: 16569 - DNA, 966 bp, Triticum aestivum
  Clone ID: PAT_TA_16569
tcggcacgaggcaccatccccgacacgccccgtccctgcgccgctccgcagacggcggccgtgctatccatcgtcgtgttgccgggccgcctccctcctgattctatcaatccctccccatggcgttctggggcgtggaggtgaagcccgggaagccgtacacccacagctacaacccttcccatggccgtctccgcatttgccaggccacattgggcagctgcgatgctgctacaaggacagtggtgcaatgcattgtgggcaacaagaaacccatcatactttgtagtttgaatcctaaattggctgagatgtgccatctcgagattgagttggaggaggtcgacgaggttctgttttcagtacttggccagagttctgtgcatctctcaggatattacctccggccaggcagtaggggcaatgcaggggatgaagactcagaatcttatggagaggatgttggagagtctgatacagaccaagactatgaagggagtgaggacagttatgaatctgacttcattgatgatggtgacaatgaagtacccgaggacagtgatgtttctgattctatggatggatggtgatgtatgctcaacccccgatcaccgcaagcaagattctgaaaagcatgctcgtaaggttaaaagacagcggcgcttaaagaagaagcaacaagttgacagctccgctgacaagattgctgattctccatcaaagcctgctgccaggcgcaaacgtggctcaatatttgatagtgccagtgaagatgaggactttttggcccagagtgaagaaaacttgcctacgcctgtttccttggctaagaaaactaatggtaaagtttcagaggaaaacaaacctgcaaatgttacgtcgaatgatgaagccaaaaaacggagtaaaagtgataagaaaagaaaaagtgatgccatcaatgaggatcctgcatctccaatggat

SEQ ID NO: 16570 - DNA, 718 bp, Triticum aestivum
  Clone ID: PAT_TA_16570
gttctctggtgaggtactacttagaagcggcgcggggcaaatgcagagtggtgaccaatatgcgcgtggagtttttttaggatcaagcgagcgaagacttgcctcaatttatgtcagagttgctcatatccccctgcccttttgcttaccttgcgttgttttggggaattaacttttttctcagttgacattctgcccaacttagatcgtctcttcatcttagcttgtctcttcaacacatccgtattaattatgtgaagttccgcatagcaaaaggtgctcaatacttcattgtttcgcctactacctataacacctataatctttcaatagctcattgtcttgtctgtacttgttaacatttatatacgtgaatacacatacattttttcggttgaggaggctatgttgatgcctatttgtttgagagactattcgtgagagtgatgagagtgttagtgcagagaatattactaatcgctatttggggggtactgcgttctgccctttcgctagtatgttcccctcttgctctccctccgttccggtcttttggcttcttcgggcattccattgaggactacataagaagcaaaatgagtgaatctacactctaaaactccctctgttcctaaatataagtttttttagagattccagtacggaatacataaggtgcaaaatgagtgcatctacactctaaaatacatctatatac

SEQ ID NO: 16571 - DNA, 863 bp, Triticum aestivum
  unsure (1)..(863): unsure at all n locations
  Clone ID: PAT_TA_16571
tcaccctttgacattagtgagttttataganttgttcagccgcttgtgtagagcagattttgncatctgctagcaccggtcacagttgacatcaccgccttgaggcgtgangtagcncgccgccacgccgttgctttgtcncgtcgacgcatcggcgtgttgacgagatcatgtccagcgtgttgcggcagtccgcgaggagccgcagtagtgatcagtagcggttcatgggtgatcttccccgccttgcacggcctcctggacgactcgccttggatggcgctgccgaactcctcgatcgtgcggcgcagggtggagccctcccccccggccacggctgagacctcggcggcgaagagctcgcgcgcgtctccggtgaagagggcctcgagctccggcgcgacgtcggcgagcgcctcgtacatgccgagcgtgcggtagagcttctcggtggcgcgcgcagacatggcgacggcgtccgcgaagccgagcagctgcaggacgcagcccctggagacgtcggcgaagcactcgtggccgagctcctcgtcggacgcgaagacctcgtcgcagagccgccgctcgccggcgaggagggtcctgaccacggcccggatggcatggttccaccgccgcatcttctggtctagcaccgcccattccatcctcaacacctcctcgatggccacgggctcggcggcgcccagctggtgcgccacggcctccgcgagggcgtcgcggcgggcggtgacgtacacctgcgcgagctccgggccatagccggcgcgcagcatgcggtccgcgacgccgcggacggaggcggtcgcgcgcggggagagccgtggcgacgcgtcgggcggcga

SEQ ID NO: 16572 - DNA, 753 bp, Triticum aestivum
  Clone ID: PAT_TA_16572
accacacccccccgcgagaccccttgccttgaaatggccactcctcttccccccacccgccctaacccgagtttcctgccctggccaaacggcctcaacctgggtatcttactccacccagccccccggcccaaaggcaactaaaaagcctatcgtaccaccaaaacctgctagaaccgagcgcctatcaggacggggacttaccagcccatcgtggagggcgccggtttcggagcaacggtcgtacttactgggccacggcgtacgccccagggctcaacacccaagtcgtcggctatcaccaagcctttcacgtcacggcttattcgcgcagtgttcccaaccccgagtcccttcaccttccgtggctcgtgaggcgcttcacgggagcggcccatcagctgctgggggggcataactcactgcgggaaggggccctagcagatacaacgggcccaatcactgtcgcgcgtgggaagattcacgacattgatctccaacagaatcctgccacgcagagtatccctgaactgattatccgcgcatccaacgcgcaccctataacaatatttgtccggggctcatgagtagtacaactgatatgtgagaactctacctaagagacattaataataacaataaaaatagtgagcatattgatgtctatcagtgttgcgagtgtgaagattcccctgttttattttatataaaataatgcatggattacagtctatgagctgattatccatgttt

SEQ ID NO: 16573 - DNA, 639 bp, Triticum aestivum
  unsure (1)..(639): unsure at all n locations
  Clone ID: PAT_TA_16573
ntttttttntgttaaaccaatgtttataaaatatagagaactaatacaagcatgttcttcttgagtcactccactcatcgttgcgcttgtcgagacagtttcataatgtttgcaatgagctcacatcttattctattgcataaagggtacaagcatacactgcaatactgacaccattgacatgtgctgaaagtgcaggcaataggcgaacatgcaagcttcctacatcactccaacggcgtagctttggacaacacgcgtggagtagctctgagtttcaggtcattccttctgtgtagtgtaagcccaaatttctcggacatgtcaaacgaagcgaggctagccccgtcaagaagcttccagtcgaagtgatacagaatgtttgttaacaccatctccacgagcgatgtgccaaactgagtcccggggcattgccgtcgcccagccccgaagggaatgaattcgaggtatgttccattgtaattcactgtgttgttctcaaacctctctggcttaaactctgcaggactgctccagtattcaggatcttgacaaattgcgacgacattaatgtaaacattggtgcctttaggtatgtcataacccattactgtacaatcctctctagccgcgcgtgga

SEQ ID NO: 16574 - DNA, 1712 bp, Triticum aestivum
  Clone ID: PAT_TA_16574
ctcctccacgcctcccgccggcctccctgcctcgcccctccgacctccccgaccttctactgcggagccgtgacggaggagagtcacccatggagctcgccggcgacgaccttactcgtgctcccccaccgccccgccgccggctgatgctcccgcaccacgccccttctacgctctcgtcgcttcgaactggtggtaccgccagtactcgtggggcgccttgaccgagcgccagattctgagttgtcagtaatgcatgcgtggcctaggagtcaagcccacatcaaagtcagacatttactcccataggggcaccaatggaaattcaaatttttgtgctacaaatccagtagtgctgctaatgtaaacacgggcagcggatatgcttgtcgattccttcgggaggttttacaattacttgaggatcttcttgactgtgcgatgtaacctgagatgcaaatactgcatgcctgccgagggagtggagctcacgacaaagtcagagcttctgtaacatgacgagataatccgaatagccaatctttttgttacttctggtgtggacaagatcaggttaactgggctggagaaccaaccgttagaaaagtccttgaaggatatttgcttgtgatctttcctggcctcaacggggctgaaaactagtgcgatgaccacaaatggcatccttctttccagaattgcccacgcacaagcctattaatgttcgatttattgtgtttatgccttttgatggcaatgtttggaatgccaagtagctggtcccttatgcagagatactagatactgtaagtccatagtatcaatagatactgccatacaactttgatatgaccccgtccagattaactgtgttaacatgcgtgggaacgaatgatgatgaaatctgcgattttgttgaattgactagacacaaacctattaatgttcgatttattgagtttatgccatttgatggtaatgtttggaatgtcaagaagctggtcccttatgcagagatactggataaagtgcgtcaacgtttcaaaggtgtagagagacttcaagatcatccttcagacaccgcaaagaatttcaagattgatgggcatgttgggaacaatttcatttattacatcaatgtacagagcatttttgtgctggttgccaatagatcgccattacagcctgaaggcaactttaaattgtgcttattttgtgccctcagaggtgagcttgagagagcctattcatcctggctatggatgatgctgggactgaaggaaataattagtgcgtgcggttgaaaaggaaaaaagctaaacatgccgggatgtttgatattgcgaagacagcaaatagacctatgatacatatcggtggctgaggatcaacggctgagttccttcttccctgcgtgacagctaagataaattgttagctggctgttgttttctgacaaaggttgcacagtttagctccagaaaggggcaactcaaaggcaatatagttgttaaaatatagtactatacttgtgaaagagcatttcagaacctcacactgttcagacttcacatgtttgtacttttcactgtatacgacaaaacaaactgttaatgttgtatattgtatcctctcccgtgccagtggtccccagtcggacacccggcctggtttaatctattactactgtgagttcctgcttaaaaaaaaaa

SEQ ID NO: 16575 - DNA, 702 bp, Triticum aestivum
  unsure (1)..(702): unsure at all n locations
  Clone ID: PAT_TA_16575
tcggcacgccgagcgagcaatggcaaaggggttcctctcttcttcctcctcgcgcgctcgtcgccgtgtagcttgggtgctgctttgcctttgcatgctcctatgcacagtgcacggcggatcatcatctcgcaaggtctacatagtttacctaggcgacgtgaagcatgggcaccccgaccacgtcgtggcttcgcaccatgacatgctcaccactcttctcggaagcaaggaagaatctttggcctccgtggtgtacaactacaagcacggcttctcaggcttcgccgccatgcttacaccggagcaagcagagcaacttgcagagtttccggaggtaatcagcgtcgaaccaagcagaaggcacaaggcgagcaccacgccggagctgggactttcttgggctcaactaccagatgtctggcagtgcgcttccccacgggaccaactacggagaggatgtgatcatcggggtgattgacaccgggatctggccggagtcgcgaagctttagcgatgaagggtacccaccgataccatcaaggtnggaaagggatgtgccaactcgggccggactgggacaagaacaactgcagccgcaagatcatcggcgcacggttctacgacactggagtttctgaggaggccctcaagacggactcgctctcgcctcgtgactatagcggccacggcacgcattgt

SEQ ID NO: 16576 - DNA, 1510 bp, Triticum aestivum
  unsure (1)..(1510): unsure at all n locations
  Clone ID: PAT_TA_16576
accggtccggaatttccgggtcgacccacgcgtccgcgttttctaacatggtatcagaccaggaccaaaccctagtccctcttccagccgccacccatgaaatcgccgccggtgaggtgattcaggcggatctatctggtgaggagacatccacatcgctgccccatcccatcttcgtcatcaacctgtaggagctgctctccagcagctcctctgtgtgtcttcacagctactctgtgagaatacttcccctgctctccagcagccatctccagcaagctcttggtgccttccctgctctacagcaagctccaggcgttccccctcctatctagcaagatccagcaagctcctccttctatccagtgagatccagctcgccgcggccagcctagtgggttgctgctcctgtttgtggctgtctgctgctcatctcttgtcgctgcctgcagctgctatcaaattgggtgtttccagctgctggccgctcaccactatggcaagaaatgatttcggatttggttctttgatcatagatatcaagcttgatggttcaaactacagggaatgggcattttctgcccggactgtcttgaggacggctggttttgtttctcatacagatgatccacctagtccaaatgatgatgcagcaaggaagtcttggcaaaagatcgatgatcgtgtgatgggagttttaattctgggtgttgaaccctcactctgaatgagtcttgagcatcacacttcagctaaagagatatggaagtactttgagtagcgctaccttcagcccagcagtgcacttcatttctccttgttgcagaatttacacaacactcggcagccagaagacatgtccatagaagagtactatggagctttcactcgcatcactgggcagctaggttccatggttccaaagggtaattctggttgtcagtcatgtgcagcgaaggaaaagtacgaccatcagactctcatgtttcagtttgtgatgggtctcaagccaaactttgagaacattcgcactcaattgcttggtcgtacgactcctcccaccttgacagaggcacttgctagcttgatcgccgaggagactcgtctccgttctcttgggactacttctgcgcagactctacacactagtgttctggcttttcctcagcggccaggtgcctccaaggccacaccttcagctgtcatctgctcgttctgcaagaagacaggacaccatagagatggttgtttcaagcttcatccagagctgttagctgagtttcaggctagacgggccctcaatcagcagcgtcgtgcancccangctccttatcaacagcaagcgagggtgcttctgatcngtctctctnancccgccgttgctgcaaccaaccttggttcnggctcnggagcttcttcaagtgactcnattgtcnaacttgngcctgcaacaatncgggaaggncccngtaaaatgcnaangccgnaaanaagnggcatgganggcacc

SEQ ID NO: 16577 - DNA, 998 bp, Triticum aestivum
  unsure (1)..(998): unsure at all n locations
  Clone ID: PAT_TA_16577
tcggcacgagggggaggtcaaggttattcacgaagccgtcatggatctcatcaggagccgcaaaaaggagcgcttcctggtcaacgccggcgacgagaggaacgacctgctgtcgcggatgatcgattgcggctacgccgacgaggatatccgggacatggtgatcagcttcatcatggccggccgcgacacgacgtcgtcggcgctgacctggttcttctggctgctcatgcgccaccgcgacgtggagcgagacgtgctggaggagatcacgagcatgagacgagacagcagcaacggcacctacgccggcgaaggcttcgaccttgacgacttccgcaggatgcgggtgctccacgcggcgctgagcgagaccatgcggctgtacccgccggtggcgtgggactcgaagcacgcggcggcggcagacgtgctgccggacggcacccgtgtctggcccggcgaccgggtcacctactttcagtacgggatggggaaggatggaggccatctggggctccgacgccggcgagttcagcctggagaggtggctcgcactgccggcggacggcaacgcggcgtctggcggcgtgtctcccttcaagtacccggtgttccagggcggcccgcggacgtgcctggngcagggagatggccttcgtgcagatgaagttcgtcgccggcgccatactccgccggttcgacctccgccccgtcgacgagggccgcacngccggcgttcctgccgctgctcacttcccatatgnacggtgggctcaaggtgacggtgangaagaggaaggtggagaccanagcngagaaccgatcatttttcttntagctagtngtaatggtaanaccctcgtgtaaaaacaataanttttcatntacanccatttgacatggccataatnntaggggntctatgaatctntnncaagcgnaatgagtcatttcccacgaananaaagagtgntcnaanaaanaaanggnccaag

SEQ ID NO: 16578 - DNA, 643 bp, Triticum aestivum
  Clone ID: PAT_TA_16578
cgtccgctccaagcatcgccgatcggctccgtcccaccacaaacagcattgcgcacgcacgcacccgaatcctcattggcacagctaaaccctaaaccctcccgtgatggcactctccgccgcgttcaggctgtcgcgcgcggtgcgggccgccgccgtggcccgccgcctggcagccggcagccgcgagcccctcccgcgcgcacttgcgtcgctagccgggggaacccccttccccaccgccgccaaggtcagcaggccctcgtggctcgctcctcccatggccaggctccccacgggggggcgggggtggcctcctggtgccgcctcgccggcttttccactccacgccgccggctcggtacagcgcctcatcctcgtctcagataagtccagatcaattcactgagatggcttgggagggggttgccggtgcagttgaggcagcgagattgtctaaacaacagattgtggaatctgagcacctgatgaaagctcttttggagcagaaggatgggttagcacgcagaatattttcaaaagctgggatagacaacacatcggtcctgcgagctactgatgactttattgctaaacaacccaaggttagtggtgatacaagtgggccagttgtagggcaaag

SEQ ID NO: 16579 - DNA, 596 bp, Triticum aestivum
  Clone ID: PAT_TA_16579
ttcggcacgaggccgtccgcgcgcttctcgccgttattctcccgtggtaaccgacgagcgccaccaccacctccgcttccgccgcacctcgacaagctccacccaggctagggtttgatctccggtcccttcttcggagcaatggagggcgcagcaccggccccagcggcggcggcggcggaggtgaaaaacccgaggtgcttcatggacatcaccatcggcggcgagatggaggggaggatcgtgatagagctgtacgcgtccgtggtcccgcggacggcggagaatttccgcgcgctctgcaccggcgagaagggcgtcggcgcctccggcaagccgctccactataagggatcatacttccatcgcattatcaaaggttttatggtacaaggtggagattttactgctggtgatggaacaggaggggagtcgatttatggatcgaaatttgaggatgagaattttattttaaagcatgagaggaagggaatattatctatggccaattctggccccaacacaaatggatctcaatttttcatcactaccacccgaacacctcatttagatgggaaacatgtagtttttgcgag

SEQ ID NO: 16580 - DNA, 1090 bp, Triticum aestivum
  Clone ID: PAT_TA_16580
cctccctctgttatccattccgccactgttcactcccgagccactccgcagccctgctccaatggcgctgtgccggacggcgcccgccaactcctcctgcttccacccccgcgctgtcgccagctcgccctcctctctcagcgtgggcaccaaggtcttcgtcgggttgaaggcccagaccaggctcggctctctagggttttggtcgtcgtgcccgaatgtcaacgcccggttctacaccgccgtcaaccggagggtctctctagggttgtcaaacaagagggctaccagggcacgtatttccatgatgcctgtcggcaccccacgggtaccgtacagaacacctggtgaaggaacctggcagtggcttgacatatggaatgctttatatccgtgaacggattatcttcattggggacactattgatgaagaattcagtaaccaagtactgggcaagcatgctgtatcttgacagtgttgatgacacaaagaagattcttctatacatcaatggtccaggaggagatcttacaccatgcatggcgttatatgataccatgctaagcctaaagagtccaattggtactcattgcctgggctttgcattcaacttggcaggattcattcttgcagctggtcaaaagggttcacgtacgggtatgcctctttgccgtgtttcacttcagtcacctgctggagcagctcgaggccaggctgatgatatagaaaacgagtcaaacgaacttaatcgaatcaagaactatctttacggcaagctagcagagcacacgggccattctgttgaaaaggttcatgaggacttgtccaggtcgaagcgcttcgacgccgaaggagccctcgaatacgggatcatcgaccgtatcgtcaggccttcccggatcaagaaagagggcggctcgaccaccggtcagaagaaggagctgcggaatctgggactcggctaatcgtagatgttagcgcaccagagttagccctagactgccacagtttttgaatttttccacgtcttcgaaatcttgacgcttccttgcattggtccatgtggatgtacctgcccgggcggccgct

SEQ ID NO: 16581 - DNA, 1286 bp, Triticum aestivum
  unsure (1)..(1286): unsure at all n locations
  Clone ID: PAT_TA_16581
gattcggcacgagccaccctcttcctccctccgttatccgttccgccactgttcactcccgagccactccgcagccctgctccaatggcgctgtgccggacggcgcccgccaactcctcctgcttccacccccgcgccgtcgccagctcgccgtcctctctcagcgtgggcaccaaggtcttcgtcgggttgaaggcccagaccaggctcggctcgtccgagtcgtcgtgcccgaatgtcaacgccccggttctacaccgccgtcaaccggagggtctccctggggttgtcaaacaagagggctaccagggcacgtatttcaatgatgcctgtcggcacaccacgggtaccttacagaacacctggtgaaggaacctggcagtggcttgacatatggaatgctttatatcgtgagcggattatcttcattggggacactattgatgaagaattcagtaaccaagtactagcaagcatgctgtaccttgacagtgttgatgacacaaagaagattcttctatacatcaatggtccaggaggagatcttacaccatgcatggcgttatatgataccatgctaagcctaaagagtccaattggtactcattgcttgggctttgcattcaacttggcaggattcattcttgcagctggtcaaaagggttcgcgtactggtatgcctctttgccgtgtttcacttcagtcacctgctggagcagctcgaggccaggctgatgatatagaaaatgaatcaaacgaacttaatcggatcaagaactatctttatggcaagctagcagagcacacgggtcattctgttgaaaaggttcatgaggacctatccaggtcgaagcgcttcgacgcagaaggagccctcgagtacgggatcattgaccgtatcgtcaggccttcccggatcaagaaagagggcggctcggaccaccggtcagaagaaggagctgcggaaatctggggactcggctaatcttagatgtcagcacaccagagttagccgtagactgccacagttttttccacgtctagtcctgcttcgaaatctcgacgcttcctttcatggttcatgcggatgtacgagatttagtttgttgtctccggtttccccagacttttaagtcagcgcgatagcaggaagaggtgataggcggtggtgatattcgtcgttttttcatgcacaccgagaaacaccgtgcatagttgatgattttgcgccacattaatgttcatgttgagtcagggtccgcaagatgctgtcnatatttatcttt

SEQ ID NO: 16582 - DNA, 1215 bp, Triticum aestivum
  Clone ID: PAT_TA_16582
ctcttcctccctccgttatccgttccgccactgttcactcccgagccactccgcagccctgctccaatggcgctgtgccggacggcgcccgccaactcctcctgcttccacccccgcgccgtcgccagctcgccctcctctctcagcgtcggcaccaaggtcttcgtcgggttgaaggcccagaccaggctcggctcgtccgagtcgtcgtgcccgaatgtcaacgcccggttctacaccgccgtcaaccggagggtctccctggggttgtcaaacaaaagggctaccagggcacgtatttcaatgatgcctgtcggcacaccacgggtaccttacagaacacctggtgaaggaacctggcagtggcttgacatatggaatgctttatatcgtgaacggattatcttcatcggggacactattgatgaagaattcagtaaccaagtactggcaagcatgctgtatcttgacagtgtcgatgacacaaaaaagattcttctatacatcaatggtccaggaggagatcttacaccatgcatggcgttatatgataccatgctaagcctaaagagtccaattggtactcattgcctgggctttgcattcaacttggcaggattcattcttgcagctggtcaaaagggttcacgtacgggtatgcctctttgccgtgtttcacttcagtcacctgctggagcagctcgaggccaggctgatgatatagaaaatgaatcaaacgaacttaatcggatcaagaactatctttatggcaagctagcagaacacacgggccattctgttgaaaaggttcatgaggacctatcgaggtcgaagcgctttgacgccgaaggagccctcgaatacgggatcatcgaccgtatcgtcaggccttcccggatcaagaaagagggcggctcgaccaccggtcagaagaaggagctgcggaatctgggactcggctaatctttagatgtcagcgcaccagagttagccgtagaccgccacagtttttccacgtctagtcctgcttcgaaatctcgacgcttcctttcatcggttcatgcggatgtacgagatttagcttgtctctccggtatccccagacttttaagacagagcgatagcacactgagaaacgccgcgcacgtttgatgatttcgcgcgacattaatgttcttgttgagtcagtggtccggcaagacgctgtctcctcct

SEQ ID NO: 16583 - DNA, 798 bp, Triticum aestivum
  Clone ID: PAT_TA_16583
gaattcactagtgattagcgtggtcgcggccgaggttaggaataatgcccggtgtagccactggggtaaacacgcagcagactaacagtaagcactaggcccatgtatttagatggcatcacaaataacagatagataacataccatctcagatcctgacaagtccagcaaaatctcaaacactactaaattttcatctgatacaccaataacagtgatgagtgattcacacaatatttcacgattttggggcaaagatacaacgctgaccaaaagctcaacagtctgcccaccaaagtgatctaagcagcagcaacctccttcttaagcttcgctagctcctgcctgatagctcctcccctcttgatcttggcgagcatgaccttgaacctgtcgaagtcattgagcgatgccctcctcttctggacaaccagcttcttgccccatgagctgttttcccacttggtcttcacatcagcttcctccattgctttgatcaaagttgccttcttagggatccgcttgatgtcaatcttgatgtcggtcagagagagccgcttgaagttcatctggcagcggaccatgtccggagcatcaacaagtgccctgttctggtcaacaacgtcgacgatgacgacgaggcggccgtagtccttgccatagttcaccagggccacccgcccgatctccacgaacctcttgaacggcattttgcggctgcgcgggcggcggcggcggcggcggcggcgagaggtgggagcgagcgagacggggaggcggagggcggctagacagcca

SEQ ID NO: 16584 - DNA, 825 bp, Triticum aestivum
  Clone ID: PAT_TA_16584
tttttttttttttttttttttttttttttttttttttttttttttttttttttttttttttttgggggtttttttttttttttttttttttttttttttttttttttttttttttttttttttttttttttttttttttttcacaaataacagatagataacataccatctcggatcctgacaagtccagcaaaatctcaaacactactaaattttcatctgatacaccaataacagtgatgagtgattcgcacaatatttcacgattttggggcaaagatacaactctgaccaaaagctcaacagtctgcccgccaaagtgatctaagcagcagcaacctccttcttaagcttcgctagctcctgcctgatagctcctcccctcttgatcttggcaagcatgaccttgaacctgtcgaagtcattgagcgcagccctcttcttctggacaatcagcttcttgccccatgagctgttttcccacttggtcttcacatcagcttcctccatagctttgatcaaagttgccttcttagggatccgcttgatgtcaatcttgatgtcggtcagagagagccgcttgaagttcatctggcagcggaccatgtccggagcatcaacaagtgccctgttctggtcaacaacgtcgacgatgacgacgagacggccgtagtccttgccgtagttcaccagggcgacccgcccgatctccacaaacctcttgaacggcattttgcggctgcgagggcggcggcggcggcggcgagaggcgggaacgagcgagacggggaggcggagggccccacgcgtccgcccacgcgtccg

SEQ ID NO: 16585 - DNA, 862 bp, Triticum aestivum
  Clone ID: PAT_TA_16585
ttgtatttggaacgacttcgggccaataacatgatcgattggaacaaagctgttccaggaataatgcccggtggagccactgggggtccatgattttggacagctggaggtaaacaggcagcatactaacagtaagcacaaggcccatgaatttagatggcatcacaaatagcagatagataacatactatctcagatcctgacaagtccagcaaaatctcaaacactactaaattttcatcggatacaccaataacagtgctgagtgattcacacaatatttcacgattttggggcgaagatacaacgctgaccaaaggctcaacagtctgcccgccaaagtgatctaagcagcagcaacctccttcttaagcttagctagctcctgcctgatagctcctcccctcttgatcttggcgagcatgaccttgaacctgtcaaagtcattgagcgatgccctcctcttctggacaaccaacttcttgccccatgagctgttctcccacttggtcttcacatcagcttcctccatagctttgatcaaagttgccttcttagggatccgcttgatgtcaatcttgatgtcggtcagagagagccgcttgaagttcatctggcagcggaccatgtccggagcatcaacaagtgccctgttctggtcgacgacgtcgacgatgacgacaaggcggccgtagtccttgccgtagttcaccagggccacccgcccgatctccacgaacctcttgaacggcattttgcggctgcgcgggcggcggcggcggcggcggcggcggcgagaggcgggagcgagcgagacggggaggcggagggcggctagacaggggagcccaacccggccggc

SEQ ID NO: 16586 - DNA, 684 bp, Triticum aestivum
  Clone ID: PAT_TA_16586
gtaaaaacagagaaccgggcaacatatcacatatgaataaggcaagaggcacatctgtagcaaactagcttgggtattcaataacagccatgacaaaatatgaaatagttcgctgaaaacagttgtactaattctggctttaagaacactggaacatagagcagatccaacttggaacaaaaaactcaacatgccatccactaggatattctaagcagcaacctccttgagcttggcaagctcttgcctgatagcaccacccctcttaatcttagccaacatgaccttgaacctgtcaaagtcattcagcgatgctcttctcttctggacaacaagcttcttaccccatgagctgttctcccatttggttttcacatctgcttcctccatggccttgatcaaagttgccttcttagggatacgcttgatgtcaatcttgatgtcggtcagcgaaagacgcttgaagttcatctggcacctgaccatatcaggagcatccacaagtgcccggttctggtcgacgacgtcgacgatgacgacgaggcggcccgtagtccttgcccgtagttcaccagggccacgcgcccgatctcgacgaacctcttgaacggcatctttgcggcggcggcgtggggcgagacggcgaggcgaggagaccctgcagcccggggtccactagtaacg

SEQ ID NO: 16587 - DNA, 786 bp, Triticum aestivum
  Clone ID: PAT_TA_16587
attaaaagatatgcttaccctactcaattcttaaaaaataaccacaagcgagtcaaaagtaaaaacagagaaccaggcaacatatcacaaatgaattaaggcaagaggcacatctgtagcaaactagcttgggtattcaataacagccatgacaaaatatgaagtagttctccgaaaacagttgtactaattctggctttaagaacactggaacatagagcagatccaacttggaacaaaaaactcaacatgccatccactaagataatctaagcagcaacctccttcttgagcttggcaagctcttgcctgatcgcaccacccctcttaatcttagccaacatgaccttgaacctgtcaaagtcattcagcgatgctcttctcttctggacaacaagcttcttaccccatgagctgttctcccatttggttttcacatctgcttcctccatggccttgatcaaagttgccttcttagggatacgcttgatgtcaatcttgatgtcggtcagcgaaagacgcttgaagttcatctggcacctgaccatatcaggagcatccacaagtgcccggttctggtcgacgacgtcgacgatgacgacgaggcggccgtagtccttgccgtagttcaccagggccacgcgcccgatctcgacgaacctcttgaacggcatctttgcgtcggcggcgtggggcgagacggcgaggcgaggagacgggtgggcgcccgggaattcgatatcaagcttatcgataccgtcgactccgagggggggcccggtaccc

SEQ ID NO: 16588 - DNA, 730 bp, Triticum aestivum
  Clone ID: PAT_TA_16588
cccactagggtttatctcctctcgccgcagcctccatcgaagccaagagaggagcagggcgaaaggaggccgtcggcgatgtcggagaagaagcgcgcccccggcccgcgcaaggacgaggtggtgacccgcgagtacactgtcaacctccacaagcgcctccatggatgcaccttcaagaagaaggcaccaaatgccatcaaggagatcaggaagtttgcacagaaggccatgggaaccaacgatgtccgcattgacgtgaagctcaacaagcacatctggagcagcggcatcaggagtgtcccgaggagagtccgtgtcaggattgcccgcaagaggaacgacgaggaggacgctaaggaggagctgtactctctggtcacagttgctgaagtcccccaggaaggtcttaaaggtttgggtaccaaggttgtggaggatgaggactaaaccccctgtctgttgtttcaatcagttagaatttaatacatatctgctgagagcatattgggaagtcttgctttagcttattgttatctactgttcatgatgttccatgacttcttgatagaagatttgagacgttggatattttgttcaagtgcttgaagttttgacttgttgtttgactctgggcgtccgtcattcccttgtgattggcctgtttttcacgtctcaaaggtaatatcaatacaaaacaggccaatcacaacccacgcgtccgcggacg

SEQ ID NO: 16589 - DNA, 712 bp, Triticum aestivum
  Clone ID: PAT_TA_16589
aacaacaagtcaaaacttcaagcacttgaacaaaatatccaacgtctcaaatcttctatcaagaagtcatgggaacatcatgaacagtagataacaataagctaaagcaagccttcccaatatgctctcagcagatatgtattaagttctaactgatcgatacgacagacagggggtttagtcctcaacctccacaagcgcctccatggatgcaccttcaagaagaaggcaccaaatgccatcaaggagatcaggaagtttgcacagaaggccatgggaaccaacgatgtccgcattgacgtgaagctcaacaagcacatctggagcagcggcatcaggagtgtccctaggagagtccgtgtcaggattgcccgcaagaggaacgacgaggaggatgctaaggaggagctgtactctctggtcacagttgctgtagtcccccaggaaggtcttaaaggtttgggtaccaaggttgtggaggatgaggactaaaccccctgtctgtcgtatcgatcagttagaacttaatacatatctgctgagagcatattgggaagtcttgctttagcttattgttatctactgttcatgatgttccatgacttcttgatagaagatttgagacgttggatattttgttcaagtgcttgaagttttgacttgttgtttgactctggtcgttccgtcattccttgtgatgatattaccattg

SEQ ID NO: 16590 - DNA, 985 bp, Triticum aestivum
  Clone ID: PAT_TA_16590
tgttattttgaaattcaagaattttatgatttgttgggaggccatatgttatttatttgtacttcaaaagtgttttttctgcagcacgaggcagtcgtgtgttgggagaacagtagtatgcatattgcagtctcaagcatctgaacaaatacaaagttgagcactagggtttatctcctctcgccgcagcctccaccgaagccaagagaggagcagggcgaaaggaggccgtcggagatgtcggagaagaagcgcgcccccggcccgcgcaaggacgaggtggtgacacgcgagtacaccgtcaacctccacaagcgcctccatggatgcaccttcaagaagaaggcaccaaatgccatcaaggagatcaggaagtttgcacagaaggccatgggaaccaacgatgtccgcattgacgtgaagctcaacaagcacatctggagcagtggcatcaggagtgtcccgaggagagtccgtgtcaggattgcccgcaagaggaatgacgaggaggacgctaaggaggagctgtactctctggtcacagttgctgaagttccccaggaaggtcttaaaggtttgggtaccaaggttgtggaggatgaggactaaaccccctgtctgtcgtatcgatcagttagaacttaatacatatctgctgagagcatattgggaagtcttgctttagcttattgttatctactgttcatgatgttccatgacttcttgatagaagatttgagacgttggatattttgttcaagtgcttgaagttttgacttgttgtttgactctggtcgttcgtcattccttgtgatgatattaccttcgaggctggtgaactccttgctaggaactttataggtttgagactcctggcaatgagttatatgcgcctggtaaacatcgtgtagttcttggaatggtcctgcaaagccccatcgtgtaggtttgagactcgatcatgcaggaaatttgtgtttggaat

SEQ ID NO: 16591 - DNA, 692 bp, Triticum aestivum
  Clone ID: PAT_TA_16591
aaaagcagagaaccgggcaacatatcacatatgaacgaaggcaagaggcacatctgtagcaaactagcttgggtattcaataacaaccatgacaaaatatgaaatagttcgctgaaaacagttgtactaattctggctttaagaacactggaacatagagcagatccaacttggaacaaaaaactcaacatgtcatccactaggatattctaagcagcaacctccttcttgagcttggcaagctcttgcctgatagcaccacccctcttaatcttagccaacatgaccttgaacctgtcaaagtcattcagcgatgctcttctcttctggacaacaagcttcttaccccatgagctgttctcccatttggttttcacatcagcttcctccatggccttgatcaaagtggccttcttagggatacgcttgatgtcaatcttgatgtcggtcagcgaaagacgcttgaagttcatctggcacctgaccatatcaggagcatccacaagtgcccggttctggtcgacaacgtcgacgatgacgacgaggcggccgtagtccttgccgtagttcaccagggccacgcgcccgatctcgacgaacctcttgaacggcatctttgcagcggctgcggcggtggcgtggggcgagacggcgaggcgaggagacgggtgggcgggcagaaaggcaagagg

SEQ ID NO: 16592 - DNA, 1223 bp, Triticum aestivum
  Clone ID: PAT_TA_16592
gcacgaggatcgctttgttacttgttcacctccacctactcctgtgcggccatggcgccgccgccgtcgcagcaacggcgacgccgccgcctctcccggttctgcccgtcccttcctacgcgcagctccagtggcagctctccgagatggctctcttcatccacttcgggcccaacaccttcacggactccgagtggggctccggccacgccgaccccgccgtgttcgcgccctccgagctcgacgccggccagtgggcgcgcgtcgcggcagagggagggttcggccgcgtggtgctcacggccaagcaccacgacgggttctgcctctggccgtcggcgctgacggactactcggtggccgcctcgccgtggcggggtggggcgggggacgtcgtcggcgagctctcggccgccgcgcgcgcggaggggatcgggctggggctgtacctgtcgccgtgggaccggcacgagccggtgtacggcgacaccgtcgcatacaatgagcactacatgggccaaatgacggaattgctcaccaggtatggagatgtggaggaagtttggcttgatggtgcaaagggtgacgacacatacatggattacatgtttgatgcctggtttgcgcttatccatcagctccagcaaagggtggttatcttctcagatgctggaccagatactagatgggtaggcgacgaggcgggaattgcgggccgtacctgctggtctcctttcaacaagaccgtcgtgacaattgggcacatcattcctgaatactcacaaagtggggatcaatttggtgaagaatgggttcctgcagaatgtgatgtttccatcaggccagggtggttctggcatgcctcagagaaaccaaaaagtgctgtaaccctgcttgacatatactacaaatcagttggtagaaattgtctcctcatattgaatgttcctcccaattcatccgggcttatttccgatgaagatatgcaagtccttcaggaattcaccgagatccgacggacaattttctctcacaactttgctgccaacggaactgtcacagcaagcagtgtacggtggtgggttgaacaacttgcagtttgcaccctccagtgtgctccgagatagcatatactcctactgggcaccacaggaagggcagacaagctgggaaatgctcttcgacctcgggcgatccacttccttcaacttgctccagctcca

SEQ ID NO: 16593 - DNA, 446 bp, Triticum aestivum
  Clone ID: PAT_TA_16593
ttcggcacgaggggggccggccaccgcgcgcgccgcgaggccggcatggcgctgtaccacgtctcggtcgccgggatgaaccggtccaagatcgcgcgcacgccgggggtggtgcggacgctgctggccacggcggaggcgcgggaccgcgggaacgaagcctacgccgacgccgcggcgctgcggaagctcgccgtgatgatcctggcgaacctcgccgggtgcccggaagggagggccgccctgatggacggcggcgcggtggccgccatcgtggggctcatgcgcagcggctcggccgcgccgggcagcgcggaggaggagtactgcatatcggcattgtacgggatgagccggggcagcctgagggtccgcgggctcgcgcgcgcggccggcgtcgaggcggcgctgatgccggttggccgagagcgacggcggggacgggc

SEQ ID NO: 16594 - DNA, 683 bp, Triticum aestivum
  unsure (1)..(683): unsure at all n locations
  Clone ID: PAT_TA_16594
tcggcacgaggcaagattgtagttgccatttctcgtcgcaagcagactgctgagctatgtcgctctcttggtttgactgagagaataccaggtgttattaacgagttgattaagaaacacaggcaaattgatgcagttcaattcatacaagcctttgggctgtcagaggcttttcctcctgctcctctcttgaaggcatatgtagatgagataaaaggctcacttaacaataagggggatgccggtgcaactccttcagtggatgacttgaagaaccgcgagctagttgcattgagggccataatcaagtgcatcgaggagtacaagctccagaaggagtgtccacttgggcctctccagaaacgcatcaacgagctgaaaccaaagggcgcgaaaaggccatcgggttctgctaaccgcaactacgcgaagaagcagcgggtctctggcagtggcacttcagctcctcggaggcccaccggtgcagcagctccccgcaggcccgcaagctccaagtcggcacatggcagcagcgcgcccctccgccgccggtgcccgcctaccccgacaggtacggggtccgcccgcccgaccggtaccactaacgccgccgccctccttgccgcaagcgttatgacgccggccacctaatgccgcctaacggggggnnggtggccaaacaa

SEQ ID NO: 16595 - DNA, 616 bp, Triticum aestivum
  unsure (1)..(616): unsure at all n locations
  Clone ID: PAT_TA_16595
cgtccgcggacgcgtggggtcagtcctatcctgcaaagctatggcattgcagccattgcccccttttctcaccgccttgcatttgatgatttgcccgtggacattcaacgcctgcgctgtaaagttaactttgaagctctgatttttgtgccttacattatctcattggggaggacccttgagaagcgcttgagatctccagtccaggggcattccactgaatttgcccaacaagtcatagaagaaaacacagatcaggatgggaagtacgcagttttacatcttcgcttcgataaggatatggctgcacattctgcctgtgactttggcggtggtagagctgaaaaattagctctggctaagtacaggcaagttatctggcaagggagggtattaaattcacagttaagtgatgaggagcttcgaaacacaggacgctgccgttgactcagaanaaatgggttgatacagtagcncntggtttgaagcacaccnattatcttcctccacangnatatggagggaactagatcctagccgcgcaanttccgctgatngaaanaaanganctgcatcgnaataactgcaatgtnaaggaaggttcgtcaaaacctgn

SEQ ID NO: 16596 - DNA, 1353 bp, Triticum aestivum
  Clone ID: PAT_TA_16596
gcccggggccgtcctcgatcccaccatgtttgccacttccgccctggggtctccggcgacctccgccgccgcggcccctctgcccgacctctccatcccctatgatctagccacgcgcggcccgtaccagatctcgatcccaccatgtctgccacttccgccctggggtctccggcgacctccgccgccgcggcccctctgcccgacctctccatcccctatgatctagccacgcgtggacagtggcaagcgctgctcgcgaacctcgctcacccctcccacgcccatcacccgcaccacggtctcctcttatctgcgctctcggcgctctccctcgccaagctccgccgctaccccgacggcgccgccctactggcctcacttcaccccgatcccggctgcccgccgcccccctttcttcttcgcctcctgcacgctctcctcccgctcttcttccccgaccgccccctcgctctcgaccggtctctacacgcttctctcatcggtccgcgcccgccccgactcccagcatccggagtggcgccgtcgtgaccgcccttgtcgcgtccgtcctcgcctccgatcacctcgcccaccgcgagttcgacgtcgcccttgccctcgtcgctgaactcgtcgcccgcgagccggacaacccggtcctgctctcccgcctcgcctatgcccacctccagatcggcaacctcgctgccgcctccgcggtcttccaacacgttgaatccgtcgcggccggcgactcctctcacgacagcctcctgtctcgcaaccgcgcgctcgagtgcatcgtggctaaggactatgccgcagcggtgcgggagtacgagctctgtattgaagctgacccggctgacgccatcgccgtgaacaacaaggcgctatgcctaatgtactcgcgggacctcggcgatgccatcaaggtgcttgagggcgcgctggagactatgcccacggcggcgctcaatgagacagtggtggtcaatttgtgtagcatgtacgagcttgccttcgtcaaccatggtgaggtcaagcgaacccttgccgattggataacgagggtggcaccagacgacttcgacaagtcctgcacacgcatgtaggaggtactggaattcagcattgaattattcacctgctgctaggatgtgctctagcagagagattgtgtatttgtgttgctatagttgctccacacactggagtttgattgttcatgtttccatgacatttatcatctaatgataactgaaagttacgtggttgcaaaaaaaaaaaaaaaaagcacgagggcggtgcttaacaaacaatggggaatttctagcattatgttgtgct

SEQ ID NO: 16597 - DNA, 911 bp, Triticum aestivum
  Clone ID: PAT_TA_16597
gccgagatgcaaggcggtcacgtcggctgggacagcggacgcgcgcgcgggaggaggagttcgcggacccgccttccatcgtgcgggccagcaaccgccgccgccgccagcagcaggcacagccgaagatcccctcgtggggccggcgccggccggcacgcccgcggcccatgacgatagcagcgagggcctcgccattccggacaccccgctcgccttccccaaggacgccgagcacgacgaggcagaggtggcggaggacgaggccaaggccagcgtgcagcacaaggttgacgtcgacccccccccctgctcctgcgccccgcctgccgctgggccgccgccggccgcttcctcctccccgtccgcgctgtcccggagccagctgtgccgccgttcctgggcgcctccacctcccgctcgtgggagcctatgaacagaagacatccgaggggacgccgaagacgagcgagggcggccacctgaggcgctaggagaggtggcagtgggcagcggcggcggcaccatcgagaagggcgcgaaggacctcggtggaagcgatacctatcggtcatcagagccgccaaccggctgcccggctatgcgccacatccacatctcctgtagttgatgtcgccgctcctcctctgaagtgtctctgtggcagcggtgttcccacccccacgcccatagttgcttctcccgatctgttgtccctctcggcatggacggcaacagtggctgcagttcctctccggcgagcttgtgctcttctctttgcatcacctgcaagatcgctagatggtctctggtttgtgggtggcaggcggtgatctttacctgggtatatgtgagtatgtgacacatcgttcaaacgcgaattgcagaatgatgccttgaccaatttagtg

SEQ ID NO: 16598 - DNA, 788 bp, Triticum aestivum
  Clone ID: PAT_TA_16598
gaggggtgcgagccccggggggcccggccgcgccggcgacgatcgatcgatcgaggctgcggtggcggtggcggtggaggacgagaacactaggaaggtgttcgtcgtggtgccggcggagcgcagggcggggcggtcgacgctgtcgtgggctctcggccatctctgcggcggagccacagccaccacggtcgtcgtcacgcacgtgcacgtcccgccgcagatgatccccgtcatgggagccaagttccatgccagcaagctgagctcggagcaggtgagctccttcagacggatggagcccgacaaggcggccaagatgctggaccactacgtccatctggcccggaacaccggggggtggtgtgcggagctggtgatcgggttccttccgctccccccccccctcgtcgcccgcattgcctcgggcggcagcgccccgccggtggtcccggctgccgcgcaccggcaggaccccacatatctggcctgccccgtctgcgggcccgcagcctcgttcctgcagcgagctggccccgcgtgcgacatctcgtccctctgcctcgtgcacctgatctgctcccgggattcgtcagtacccggtgcatccccgcctgtcactgcaccgttgctccctaatcctggccatgaagtccttcgtttgtcaactcaccaggaagagcatgatgatgacagtgaggttgaattggggttccatgacgagctgagagaggcatgcagagcagccgaggacctgatgaacagagctctgagcgaatcccacaggc

SEQ ID NO: 16599 - DNA, 636 bp, Triticum aestivum
  Clone ID: PAT_TA_16599
gaggcgcttgtgtgtgttgcgccctcgccctgccccctgctgcccccctctgtcgccatggccgccgcactctccccccacctcgccgcgaccctgccgtctctccgctcccctgcccgccggccttctcccgcagcctctctactcccgccccggggcgcccgcatcgccctccgtcgctcctccaggcatccttaccctttgtcaagaaattctgggtggtttgagaatgcaacaaagaagaaggccctgtttgcatcagattcagactctcctaacaccgaggtttcaaaacagagcagcactggtgacgccagcgcttctccggatggcccgccagtcctcaccattttggccggtatcgtcgtgttctttctgctcttgtgggtaatcggatcgatcttcacctggattgttggtctcgtcttcggggctgcgaaatcttagatgttcatcaaccttaggatagttctgcaccttttcagttgtatatacacttgtctcagactgatgcttgatgatagccctggatcattgcatcctccgctgtcatttccagccgaaatttcttgaataattgtaccacatgttcctagccaaatgtcgtggttcaccgtgtttaaaactgttatttct

SEQ ID NO: 16600 - DNA, 459 bp, Triticum aestivum
  unsure (1)..(459): unsure at all n locations
  Clone ID: PAT_TA_16600
ttttttttttattttggaagcagctgacttncgaggatttatgaatttgatattgcaactttggattgcctggatctcacgatgaaattttggccggttgatcggctcgccaatcatgttatcctttattactgatgaatcactctgtttctttaaaaagaaaatactggtgaatcattcatcgggcgagcagaaaagccaagcaacctcaacagcgcccgacgaagtcggccacgacggcgagctccttgacggcattgtcgcagccggacttaaacaagaagtagacatgctcctcgcccttggtctcgtggaactcgaccactccgtcccacccgcacgccttgatcccctccgcgtacgcgcgcgccctgttcacgaaccagcagagctccgccgtggcgaccagcacgtggccgcacccgagctggctccactccccgggtgacgtcgctgggt

SEQ ID NO: 16601 - DNA, 934 bp, Triticum aestivum
  unsure (1)..(934): unsure at all n locations
  Clone ID: PAT_TA_16601
cgcctgcgaggccgtcggcttgccccggttcggcggctgcggcgcccagcgcaagcctgacacgtgccacccctcccagtactcgcagctcttcaagtcggcgtgccccaagtcctacagctacgcctacgacgacgccacctccaccttcacctgcaaccacaccgattacaccattaccttctgcccgcagtcctatccctcccgttccaatccttacagtggcaaaccgaacaagcacgcattgcggaggccgagccatgagcagcttgaggacgacgtgtggctggcatctttgaaccgtgccagcggcgccgctgcgtgctccgcggccgcagggtcgccggccgcccgggcccatgccgccctggctgtgcctgccgccgccctgcgggccccgccccggggcggtcgtccccgcttcggcggcgtatctccatccctaggagtgatctgcagagttttttgtaggatcaaaagaggatcagagcacgagaggaagagacgtggatggcctcttcgtggggccgtcgtgcttgttcatgttcttcatgccgcgccccctggtgggcaatgctcgtggcgcgtcttctggtttgtcattgtgctttatcccctttttggaatccttgttcctcggggccttttcgtcttcgtgcgctcctggtttgtcggccttccggaccagtgcagcacagtcaagtatcgtcactaggagatcgcaagctttgaagtgggaaggctgtaagatctgaatatactattgctctgccttttgagctcctccttgttgtatccgaatgccttctacaaagaaaaaaaaaanaaaaaaaancaggggggccgtacaatccccnaaagatctttaccccctaangcgtctttnantccnacgngaaanctggtaccactanccctgaaaaccctncattgg

SEQ ID NO: 16602 - DNA, 692 bp, Triticum aestivum
  Clone ID: PAT_TA_16602
aggagccatggcttggcactgggggtgagctttctcctcctcctcagcgtcgccggcatcgcgcagagcgacagagagaagaacaagaccaccgtggtgagccatctgcctggcttcgatggcccccttcccttctccctggaaacaggctatgtggaagtggacgaccgcaatggcgtccgcctcttctactacttcgttcagtcggaggccaatccggcggaggatcccgtcttgctctggctcaccggcggcccggggtgctccgccttctccggccttgtctacgaaatcggtcctctcagctttcagcctgattcctacaccggtggtgtgccggagctggtgtacagaccggattcttggaccaaggttgccaatgtaatctttctggattcccctgttggagctggcttttcatactctgcaacagaccaagggtacaagtcctgcgacaccaaagccgttgaccaaattgccatcttccttaccaagtggtatgaggagcatccacagttcttatcgaatccacttttcattgccggagattcgtattctggtttaattgcgccaccgctgacctttcaaattgctaagggtatagaaatgggtgacaagccactgcttaatctgaagggttatatcataggcaacccattaacggatcgcaagttcgatttgccagccagagt

SEQ ID NO: 16603 - DNA, 1552 bp, Triticum aestivum
  unsure (1)..(1552): unsure at all n locations
  Clone ID: PAT_TA_16603
tcggcacgagggacggttgtgccctcgtcgtcacggcgacgacgtctagccccttcgccccgcctccacgggccgggcccctatatagccagccggcttcctctccgccattgctgtccccctcattgacctcacacctcacctcctcctcctcctcttcccactcctactcgaacctcgcatccagaacgaccatctgacccggtccgctgaggggaatggctgcggcggcggagggcgtggaggcgttcctggcgacgtgcgcggcgtcgggggacgcggcgtacggcgccgccaaggccgtgctggagcggctggacgcgccggccacgcgcgccgaggccaggcggctcctgggcgccgtgcgacggcgcttcgccgccggcggccccgcggccggcctcgagtgcttccgcacctaccacttccgcatccacgacgtcgtgctcgacccccgcctccaggggttccaacaaagaaagaagctaacaatgatggagatacccagcatttttattccagaagattggtcattcactttctatgagggtctcaatcggcacccagattccatcttcagggataagacagtggcagagctgggatgcggcaatggttggatatccattgcacttgcggagaagtggtgcccttcgaaggtctatggtctggatataaacccaagagctatcaagattgcatggataaacctttacttgaatgcactagacgatgatggtctcccaatctacgacgcagaggggaaaacattgcttgacagagttgaattctatgaatctgatcttctttcttactgtagagataacaagatagaacttgatcgcattgtgggatgcataccacagattcttaaccccaatccagaggcgatgtcaaagattgtaactgaaaattcaagtgaggagttcttgtactcattgagcaactactgtgctcttcagggctttgttgaggaccaatttggcctcgggttgattgctcgtgctgttgaagaagggatatctgtgataaagcctagtggtcttatggtattcaacatgggaggccggccaggacaaggtgtctgtgagcgcctatttctacgccgtggatttcgcatcaataagctctggcaaacaaaaattatgcaggctgccgacacagacatctctgctttagtcgaaattgagaaaaatagccgacatcgtttcgagttctttatggatcttgttggggatcagcctgtgtgtgcacgcacagcatgggcatacatgaaatctggtggccgcatttcacatgctttgtcctgttgtatagctttcaacttcgcccagcccaaccagttaaagaaaatatttgagttnctttaagacngatccatgaantcagcactcccttaattngcctttgatancaatcctttcctaataaaaaatcctttcctggnaaaacctgctgttncntgcaagaaaanagntctaacctgntagcccccnnccggtttttaaacttccggaactngttccccgnttatgaananttccacacaccc

SEQ ID NO: 16604 - DNA, 762 bp, Triticum aestivum
  Clone ID: PAT_TA_16604
attcggacgaggcttgtacccgaagtagatgccatgacagtccatgcgacatgcgagcagccttgaacttctcaggcctaaactcctcggcattctcccaatattaggggtaacacccgacagcccaggattttatgctcacccttgtcttagctggcatcacgtacccattgatctcccgtgcctcagtactctctcgagggaccaggatgggagttggtgggtatggcctgaatgtctccttgatcaccaagccgaggtaattgatgcagctgccgctcacccggacatcagtctcggagatgaattccttgccgcggaatgccgccctagtctctccttgctgcttccccaccggcatcaggaggaacctccagagcattcctgacaccatcgatggtatcctggaggagatcatcgaccacagagagcaaatcctcaagagtggccggtcaaccgcgtctaagaagaacttggtgaaagatctcctcggcctccaccgcccgctcgactgtccctgccccatctcctgctcccccggctgcgccgtttgcctccccctcgactcttgcgccgcctgccgctgctactactgctgctgctgcccctactgctactactgatcaaagttttaaatagcgcgctaagcctcttagcgacggacctctttcaaatgctatagcgtgctatagcggtgctatagcgggctatttaaaatgtttgctcatgtgtttggacaaaaaaaaaaaaaaaaaaaaaaaa

SEQ ID NO: 16605 - DNA, 603 bp, Triticum aestivum
  Clone ID: PAT_TA_16605
ctcgtgcccggctcggcgccacaaacatcaggaaggaagcgaagagcccaacaatcgaggatggtaaagaagaactcctctgcgacctcggcccggctgatgctcaccctccttgttctcctggctttcgttggcggcatcctcgcacggggtggaccgtccacctgcagcaaccccgcggctcagcgaaactgcccgtcgatccctggtggcggctcataagcacgacctatggaccatttctacgcatgaacgaagcacgggatttagtaggccggccctcgcgttcgccggcgccgatttcgatgttgaacccaataataattgtatgttcttcttggcgcgccgttgggtgtggggttgtgcctccccacgttgtttgtggtgtggcctgggtgggcctggggttgtactacaaggtggcgccgagttctcctgcccgggctggactttgattattggatctgatggccaaaaataaataaaaattaagagccatctatgagtatatatcggtgtatttttttaacagtatttaactatatgccggtgacccggtgtgtgtttcagtaaggaaaaaaaaaaaaaaaaaaaaaaaaaaaa

SEQ ID NO: 16606 - DNA, 1081 bp, Triticum aestivum
  Clone ID: PAT_TA_16606
aatctaacggctcgctcacagtgtggttccggtaaggaagatttgctcctcctcctctccctctctccggtctccacgccgccgccgcccgctcctacggggagccgatcccgcgcctgagcgcagcagccatggcgattgcttctctcatcgcctccaggttcgccaggtccggccacgggcacgccctccccgccgccgccgcggccatctctcaggcgcccagggcccagcacgccgcatctccgctgctctccggcttcggaccactcactcgcgccttcagctcaaggcctctatggaagggagcgttcgtcgacgcgttcctgcaaaggataaagaacaagagggagaacctcaacggcaagaagatctggtctcgcaggtcttccatcctgccggagttcgtcggttccaccgtgctcatttacaacggcaagactcacgtccgctgcaagatcaccgaggggaaggtcggccataagcttggggagtttgctttcacgcgcagacggaggccccatcgggccattttggcgaagggcgggcaaggaaaggggaagaagaagtacgaaatgggaatgtgcgtgcgtcaaaggtggtttcatggacggtgggatgagggcctcgttgaagcacatttacttgaatcaccttaattttcgggactgcgtttgttttcttacaagaattattatcgcagaaagaatgtttagctcctcttacttgaagattttccagtggactctgtttgtttactctgctagtgtttccagcataactctagagtactacttctattcactcaaggcattgctctttagctcgtcttacttgaagattttccatggactctgtttgtttactctgctagtggttccagcataactctagagtactacttctattcactcaaggcattgctcttatatttttttgggccttactgaggtctgatgccacaacctgccaagtgtctttacacctggttctatgagtgagtgattgtaagttttgcttcaaaggttgttttcagccaaatagcgatgtgtatcttgctacagttcccttgcaataggag

SEQ ID NO: 16607 - DNA, 1514 bp, Triticum aestivum
  Clone ID: PAT_TA_16607
ccgtccgactcgatcggcagtcgccaccgtacacgtgagatcgagaacttgatcatcgaccgcgacatcgccatgggcggcctctccatggaccaggccttcgtgcaggcgcccgagcatcgcaccaaggcgaacctcgccgacgcggacggcatcccggtcatcgacctctcccctctcgcggccggcgacaaggccggcgtggacgccctcgccgccgaggtgggcagggcgagccaggactgggggttcttcgtggtggtgcgccacggcgtgctggcggagacggtggcgcgggcgctggaggcgcagagggccttcttcgcgctgccggcggaccggaaggcggccgtgcggagggacgaggcggcaccgctggggtactacgagtcggagcacaccaagaacgtcagggactggaaggaggtgttcgacctcgtcccccgcgagccgccgccgcctgccgcggttgccgacggcgagctcgtgttcgagaacaagtggcccgaggacctcccgcggttcagagaggcgctcgaggagtacgcggaagcgatggaggagctggcgttcaagctgctggagctgatcgcccggagcctgggcctgcgaccggaccgcctgcgctgcttcttcaaggaccagaccaccttcatccggctgaaccactatccgccctccccgagccccgacctcgccctcggcgtcggccgccacaaggacgccggcgcgctcaccatcctctaccaggacgacgtcggcgggctggacgtccggcgccggtccgacggcgagtgggtgcgcgtcaggcccgtcccggactcgtacgtcatcaacgtcggcgacatcatccaggtgtggagcaacgacaggtacgagagcgcggagcacagggtgtcggtgaactcgcagaaggagaggttctccatgccctacttcttcaaccccggggagcgacgccatggtcgagccgctggaggagatggtgagcgacgagagccggccaggtacgacgcctacaactggggcaacttcttcagcaccaggaagaacagcaacttcaggaagctcgacgtcgaaaacgtccagatcgcacacttcagaaaggaccgatcttgaatgaaggatccatcgtgaattcatgatcctaccgctctcctcggtgatcctaatgctacaagcatctccccgtttgtagtaatataaataagtaattgtgtcggttcaaaaaataaataagtaattgtccgtattaataatcactctctccgtcccataatataaaagcgtttttgacactagtataataccaaaaacgctcttatattatgggacagaggaagtacttcccctgtttcaaaataagtgatgatgtggttttaattcaaatttgaacggaggcaactaaaaaggatattttaggaccgagggagtactggatatatatgtgtgtgtatttccaatgtgatttggcgcatttgagcagatcaaaaaaaaaaaagaaaaaaaaaaaa

SEQ ID NO: 16608 - DNA, 731 bp, Triticum aestivum
  Clone ID: PAT_TA_16608
atttccttgccctcaccagcacatcaaccttctcatccccgatcaattcgttctcatctctgctcctctcgaatcattatccactgcctacaaccagcactgcgccttggaacgacagcagcaacagcaaccatgctcagcagctccaagatccatggaataatctcttcatgccaaccaatggtgaacttgctaatgatgaggagaggcacaagactttggaaggccaggcgctgtttccagctacaaccaccggagaaggagaagagggcgatgggagcagcgccgccggccacagcgacagcgacaccgcgaggcaggggggcagcctggctggtgtgccctgccgctgggggtgctccgcgccgcctcctggggccagggggggccagcacttccgccgctacgccctgcggccgcgtcctgcctccgcctccaccacctccctcggaaacaacatcctggacttctcaaacaacggttcgccacgtgagtgcacgagcacagcatctggagcagctttcaagaaggctaggacccaagaaccctccccggctcaatctactgttaaggtgagaaaggagaagctaggggatagaataactgcccttcaccagctcgtctccccatttgggaagactgacactgcgtctgtactccttgaagccattgggtacatcagattcctacacggtcaaattgaggtgcaacaaaaagaaaagagcagcata

SEQ ID NO: 16609 - DNA, 642 bp, Triticum aestivum
  unsure (1)..(642): unsure at all n locations
  Clone ID: PAT_TA_16609
gagngnttgannccnttnntttnattccgtnagctcgaaattaaccctcactaaagggaacaaaagctggagctccaccgcggtggcggccgctctagaactagtggatcccccgggctgcaggaattcggcaccagaactcccgaaaatcccacacaaaagaagcgaaaattaaaacgacatgacccccctcaagaactcgcgctccgccctctcccgtctcctccgccacgtccgcgccgccggccggccgcagcccccgcccccgccctcgccggtgttgggggaaacggcctttcggcactaccacgccgccccgcagcgcccagggttcattcaatccttcagccgaagacccctccgccacgagcccgccgccctcttccggccgccgccggcgcaggcgcaggtgccgccaccccggcactacttcacctcctctcgccgcccggaggtcatccacttcacgcgccgccgcggcggcgcgcggtggtaccacgataggcggaaggtcgccgcggtggtcctcctcaccggcggcggggccatcgtcgtctacttcggcaacctcgagaccgtgccctacaccaatcgcacccacttcgtcctcgtctcgccccagctcgagcgccaagctcggcg

SEQ ID NO: 16610 - DNA, 1490 bp, Triticum aestivum
  Clone ID: PAT_TA_16610
cgtccggcacaagaaaatgctcagagggagtgggagaagaaattcaatgggagccgagattcaacttcggatgatgttgaccgagataataagttaaatcagcaatgaaaaagtttggggacagagaggcagagctgctcagattgtgaatagagaactagttggtgaagagacacgatcaagggataaaaaagatctctctggaatcaacagtgcatcggagtgtttgttgaacgaatcttcctttggcttgtccacaaatgctcgaaatgtaagtgctattgggaagtgtgaaggatctgataatgatttcgagcgggctactgcagtagttgcttcagttgttgatgaattgcatgctaggaaggatgagctagtacataaaagttatactgaaattattgaagggagtgggaataatcttggaagatcagcttcttcaccacaaaaaggctatcatagcagcccaaatgcagtacataataaaggtcaaggagatgggaattcagacagtggttcaagctaccatgggaatgctcgctcttatgagcactatgtaaccacaccatcacttggaagtcctttaagtgatacccctaaaagcaaagtgtctgaatggagctcgtcatgctttcataaccataccgataaccagattgacatgcagccaccctcaagtgatgatgtgggaggtgttctagaggcacttcaacgtgccaagatgtccctcagggaaaagctgggcagggcaagtccacccaggcaagacatgttggcacttccagcaccagaggatcactacacagatgatgatttgcaagtcgacgacacagaacttccactttgcatgtcacaacggcttagccaggaaatattgacactgccagcatcagaagactaccttagcaggatcagtttaccaggtgatgatgcaaaggtaccagttggccctgctggcttgttccggttgccaacagacccgtttccccaaaacgaggtgtgttccactgatggctatggctcaaggttcagtttgacgtcaagccggcaggccgtcttttcaagaaaccctgctagtcatatcgtgttaacttcatcccgcccccaagtatggttctgggtttctcaccgaatccgatattacgatcttcataattcaatgtagtcaatgcctacaacaggggatgcttctttcatcccaagaaatcctaaggtctagcgatgattcaaaaaggggaatgtcctctggtgatgcaggcatgctttcccagtatggtagtgcttatgattagtagctggagtgtactagtacctatgcatggttagaatcccaatatagcctttgagctagatgctatctgttgcgtcggttcttcgtatggtttgataatgatgtgtgtcatgttgtattactatccaagaataaatcttgtttgtaagcagtgtaggctttctctcttatgccctcatgaggcattacaaattgctac

SEQ ID NO: 16611 - DNA, 796 bp, Triticum aestivum
  Clone ID: PAT_TA_16611
attcggcacgagcgggtcatcaagccctcggagaagttccgcttctccttcgactgggagaacaccgaggacaccagccgcgacatgaacatgctctaccaggcgccgcacgaggcccgcctgctctacggccgcggcttcctcgccggcatcgaccggcgcgagcagaagaaggcggccgccgtgtttgagaaggagacccgtgccgagcagcgccgcaagttcggcgtggaggaccggcctgaggatgatgtggctgataagaagaaggctgccgccgcggagatgtatgatgccttcgacatgcgggtggacaggcactggtctgagaagggcatcgaggagatgacggagcgggattggcgtattttccgggaggacttcaatatctcctacaaggggtctcgcataccccggccgatgcgcaactggcctgagagcaagcttgggactgagctgcttcgtgctattgagaagggtgggtacaagaaaccgtcaccgatccagatggctgccattccacttggtctccagcagcgtgatgtcattggtattgcagagacaggttcgggcaagactgccgcttttgtgcttcctatgctgtcatacattactcgcctgccgcctataagcgaggacaatgaggccgagggtccttatgctgttgtcatggcacctactcgtgagcttgctcaacagattgaggaagagacggtgaagtttgcaacctatctaggcattaaagtcgtttcccattggttggtggtcagtcgattgaggagcaaggtttcaagat

SEQ ID NO: 16612 - DNA, 857 bp, Triticum aestivum
  Clone ID: PAT_TA_16612
cactgggagcctcttcatcttcttcaaccatgagaatggaaggaacgggatcatcgacctcttcttccaggacaggtacctcaatgctatccagaccaacgctccccatcttctgaggtaccttgctgctgcagttgttgtgaacaagaggagaaggaacatgcttaaggaactcatcaaggtcatccagcaggagcagaacagctacaaggatcccatcattgaattcctggagtgcctgtatgtcaagtatgattttgatggcgctcaacagaagcttgtcgagtgcgagcaggttatactgaatgatcctttcctgggaaagcgcgtcgaagagaggaatggcattgctgttcctctgagagacgagttccttgagaatgctcgcctgttcatctttgagacctactgccgtatacatcgctgcatagatattggtgtgcttgcggagaagctgaacatgacctatgatgaagccgagttgtggataatgaacatggtcaagagttccaagctagatgccaagattgattctgtgacgggaactctcatcatgacgaccaattgtgttgatgtccatgagcagattattgagagcatgaagaacctcaacgccaggacctacatgctggcaaagagtgttgtggatccagggcatgcagcagcacagcaggctgctcggtgagaccaacagatgatctgcagctttgaggcggtaaaaattactttgggaacttcgttgttaggcagtgacttcgttgctagtatttgaatcacattgctacagcttatgctgatgttttaaatgctttgtactccttttactcaagtttatcgtcctatgaatttaatactgc

SEQ ID NO: 16613 - DNA, 1739 bp, Triticum aestivum
  Clone ID: PAT_TA_16613
aggaattcggcacgcgtccgcccttccctccctccctccccccgccgccgccacccacaaccctagaaaccctagctctcatcccctcgcccgagacagccatggcggagcacgacctgacggcgagcgtggcggcgtggatggacccccacctggtgctcccggtgctggagttcctccaggagcgcggggtctacgccgacgaggagatcctgcggggcaagatccgcctcctcggcggcaccaacatggtcgactacgccatggacatccacaagtcgctccacggcaccgacgacgtccccgccgacatggtcgcccgccgctccgaggtcgtcgagaggctccgggccctccaggaggccgtcgcgcccatagtcgccttcctctccagcccgcagctcgtgcaggagctccacgccgacaagcagtacaacctccacatgctccaggagcgccaccagatcggcccggaccagatcgaggccctctaccagtacgccaagttccagtacgagtgcgggatgtactcggacgccgccgatttcctgtcccagtaccgcgctctgtgcaccaacagcgagaggagcctgagcgccctgtgggggaagctggcggcggagatactgatgcagaactgggatgtcgcgcaggaggagctcaacaggctcaaggagatgattgattccagcagcttcacctcgtcgcctgtgaaccagctccacagcaggatatggctgatgcactggagcctcttcatcttcttcaaccatgagaatggaaggaacgggatcatcgacctcttcttccaggacaggtacctcaatgctatccagaccaacgctccccatcttctgaggaccttgctgctgcagttgttgttcaacaagaggagaaggaacatgcttaaggaactcatcaaggtcatccagcaggagcagaacagctacaaggatcccattcattgagttcctggagtgcctgtatgtcaagtatgattttgaatggcgctcagcagaagctggtcgatgcgagcaggttatactgaatgatcctttcctggggaagcgcgttcgagagaaggagaggcatcgctgttcctctgagtagaggagttccgttgaaaatgctcgcttgttcctttttgagcctttgctacctacatccatcgatgcatctgattttggtttgggtggcggtggaagggagaacataacctacctaggaagaagacttgttgatgataaagaatatggacgaagaccacgatacttgatgcgatggatgaattgacggcaagtctcctcatgatgaccaaatcgtgttgatgtctatgagcagattatagagagcataaggaacctcaaagccacgggctacatgtgatgaaaaagcggcgtgggtcgaggccatgcagcagcacagcagagtgctccgggtgaccaacagctgatctgcagctttaaggcggtaaaaattacttttggtactttgttgttaggctgtgacttcgttgctagtatttgaatcatattgctacagcttatgcttatgttgtaaatgctttgtactcgttttacttaagtttaagtttatcgtaatataatactgaaaaagacaattaacgtaaacgcatttcctggctgcggtgccgctgcttctgtctttctcggcctgtctgcaattgtctttgagctccctgttgtctgtctagcttagcttcctgttaaacatttttg

SEQ ID NO: 16614 - DNA, 814 bp, Triticum aestivum
  Clone ID: PAT_TA_16614
agtggagttgagctgaacagtgacgatgttcgagcctacatacaggctcagcaggttgcagcacattttcgtcgttccatcttcggggctggatccggccacatcaatgaaaccatgtctgcagaagctagtcccggtttcagcgtccgtgatgctgttggagttgagctgaacagtgacgatgttcgagcctacatacaggctcagcaggttgcagcacattttcgtttttccatcttcggggctggatccggccacatcaatgaaaccatgtctgcagaagctagtcccgagttcagcgtccgtgatgatgttggagttgagctgaacgatgacgatgttcgagcctacatacaggctcagcaggctgcagcgcattctcgtcgttccaccttcggggctggatccggccacatcactgaaaccatgtctgcggaagctagcagccctggaggaggcgatggtcgacttggagttgagtggaacgatgagacgctgacggcgctgccgccccgcgctccagctatgagagaacacgacggctctcaagattttctcgtcgatgaagcgggtggccgctttctcgctattcacattcaccctccgcagcagggcgatcaaggtttagtgggagccgcacgaggaacacaagatggtcccggtgatcttgctcggcacgctctgccgtcggtaattggaggtcttgtgccgctatgcttcaacttattattagatgatagtatcctcaaggcggacagttctcccggatatatcaaggctgccgctgccgctggggctggggcttgtgactgca

SEQ ID NO: 16615 - DNA, 634 bp, Triticum aestivum
  Clone ID: PAT_TA_16615
actttgacttcaacgcaagagagttagcacatgccctgcggttcctggcatctgtatgtcacaaatttcatagcttttggtgacattctcgattgcataagaaattccttgaactttctggtggtgtcaatagatatttgaactcgagagcttctaaagcatctcaaacaatgctgtcatgccctcaaatgttatcagtgtgccatctgaagaaactatttccttccgtaatgtggatattgtgaccccatcgcaaaagctattggctagccaattgtcttgtgatgtgtctcaaggaaattcccctcgtggcgctggtccaaacggcagtggcaagagttccatttttagggtgctccaaagtttgtggcctgtagcttctggaaggctcaccgtgccatctgaagggatatttcacgttcctcagcgcccatatacttgccttggaaccttgagggatcagatcatatatcctctctcacgtgaggaggcagagttgaagatggccaaaacgggtgacaggtctacgtcgctggacgatcacctgaggacaattctggagaatgttcgcttggtctatcttctcgaaagagaaggttgggatgctactcccaactgggaagacattttgtcc

SEQ ID NO: 16616 - DNA, 937 bp, Triticum aestivum
  unsure (1)..(937): unsure at all n locations
  Clone ID: PAT_TA_16616
gctgccttgccaccaagacttgacctgcnaaagaaaatgtcagcgtttacgtgcctgtgnacgccacgcttgtaagcgacgttgttgtgttggggattgcccaccctgcgcagagacttgtgataggaggctcagatgtggaaaccataagtgtctctctccatgccacagaggcgcttgttcaccttgtcctttgatgaagaccatctcatgtttctgtgggaaaacatactttgaggttcccttgtgggaccgagaagaatcaaaaacctcccaaatgctcaaaaagatgcaatatagatcgtctttgcagacacaagcttgaatgccggccccataaatgccactatggagcctgtccaccttgcaaactgatctgcggggaacaactttcttgtggccacaagtgtaaagaaaggtgtcatggctctattcctccaccgagccccgagttcacagttaaaccaatgaaaaagaaaatggaaaagcatatagaatgtacgcctggaactccatgcccaccatgccaagaagtagtcttggtgccatgttttggagagcatctaggccaagaacgtgcaataccttgctccaaaagcaggcaatttccctgtcagaatttatgtggaaaccttctccactgtggtaaccattactgcacaaaggattgccatgtgttagagattccatcggatcaacgtaaggctgataccatattatctctcagtagaaagaacactcttgccgagccttgcgaaagatgcaatcttccttgtcaaagggccagggatcctccttgttcacatccttgccctttgcggtgtcatctaagcgattcgctcccgtgcgtcgtcccggttattccggcccgccattgtggtgctatgacacatgctttcgagtgtgtgtactataacaacttnnntgcnnngcannn

SEQ ID NO: 16617 - DNA, 883 bp, Triticum aestivum
  Clone ID: PAT_TA_16617
cgtccgccctcagctgctctcctctcctctcacctaccctccagatcgggtcgtaactcgtaacagggatcagggtggccatggctccggtgaagctgtacggcatgaccatgtcgtggaacgtgacgaggtgcgtggcggccctggaggaggccggcgtcgagtacgacgtcgtgcccatcgacttcggcgccggcgagcacaagacccccgaccacctcgccaggaacccctttggtcagatgccggttttgcaggatggcgacttctacgtctgggaatcgcgtgctatttgcaagtacacatgccgcaagaacaaaccggagctgttgaagcagggcaacctcaaggaatcggcaatggtagatgtgtggctcgaggtggaggcccatcagtacaccgccgcactggagcccgttatccttgagtgcctcatccgtcctatgttcgggcgagccactgaccagaaaattgttgaggataaccttgtgaaactgaagaaggtgctggaggtgtacgaggcgcgactgagcaagtgcaagtacctggctggagacttcctcagcctagcggaccttaaccatgtgtctgctaccgcatgcctggcgactacaccctatgcttctttgttcgacgcgtatctgcatgtgaaagcctggtggtctggcctgatggcgaggccgtccgtccagaagatcactgcactaaagaagccgtattttcagaatagtgtctagcacagttttcgccgcggcccacgaaataagccgggctgtctcccgacgtttgtcgtgtccaggcgcgcgttgttgtaataattagacaacaccccacgcgttgctgtgagactttttagcaataaactgtgaaatgatttattgct

SEQ ID NO: 16618 - DNA, 594 bp, Triticum aestivum
  unsure (1)..(594): unsure at all n locations
  Clone ID: PAT_TA_16618
gcgtcgccgcaaggtnaccaaagttgccaggcttctcgcggccaagacttgcaacgtcatggctttgcttgacggcgggatgctcacgaggcaacgtccggggtaaaggcagagccccctgcaataattgtagcaactgttgcaagcttgtgccagatggttgagaagcgtgctttcagtcttgggtcgatcaaaatactagttatcgatgaggttgatttcatttttggatcatcaaagcaagtgaactcccttcgcaagatactgaattcttacacagcagcttccagccgtcagaccatattcgctagcgcatccatacctcagcacaatcgctttgtgcatgactgcgtacaacataaatggactaagagcgatgtggttcatgttcatgtcaaccctgtccagcccatgcctttacacctacatcacacatatgtgatctgcagcaagaaggaacggttgcatgttttgctatccttgcttgagagggatgcaccaaagtcggtgattatatttgtcgctcaacagtctgagaaatcaaaaagggctggaaatcctccgtcgtctacacttgttgtcgagttcctgaga

SEQ ID NO: 16619 - DNA, 3270 bp, Triticum aestivum
  Clone ID: PAT_TA_16619
gaattcggcacgcgcttccttctcgccgcagagctcccaaatcccgcacccgaggaggcgactctcccgcgcgcgagagagcgggtcacgagtcctgcagcgacggcggctgcggtcaccggccgcagagccagcgggcgacatgacggacggccacctcttcaacaacatctccctcggcggccgcgtcggcaacaaccctggtcagtttaggctatattcgggagggcttgcatggaagaagctaggtggaggaaagacaattgaggttgataaagctgatataatttctgtgacgtggatgaaaatccccagatcttatcagcttagtgttgggaccaaagaggggattcggtacgtgttcaaaggcttccgtgaacaggatgttagtaaccttactaacttcatacaaaagaacacgggaaccacaccagaggagaagcagctctctgttagtggccataattggggcgcggttgacatcaatggcaatatgcttagctttaatgttggctcaaaggaagcatttgaagtctctctatcagatgtatcacaaactcagttgcaaggaaaaacagatgttgttcttgagttccatgttgatgatactacaggggctaatgagaaagattcgctgatggatttaagttttcatgtaccaacttcaaatactcaattccttggtgatgaggaacgtccctcggctcatattttttggcagaaaatcttggctatagctgacgttggctcatcagaagaggctgttgtctcattggagggaattgccattcttaccccaagaggtcgatacactgttgagcttcatatgtcattcttgcgactccaaggacaagctaatgatttcaaaatccagtatagcagtattcttcggctctttgttttgccaaagtcaaacaaccctcatacatttgtggtcatcacacttgatccgccaattcgcaaaggacaaacattatatccccacattgttattcagtttgtgacagagaatgtagttgagaaggagctgtcattaagtgaggaggttttggctgaaaagtacaaggacaggctgcagagttcttacaatggtctagaacatgaggtattctccaaaattcttcgtggcctgtctggtgctaaagtgacgaggccaagcacattccgcagttgtcaagatggatatgccgtgaaatcatcacttaaagctgaagatggattgctgtatcctcttgaaaaaggctttttctttttgccaaagcccccgacgctcattctgcatgaggagattgagtatgttgaatttgagcgccatggtgctggtggtgctagtatgtcatctcactattttgatctcctggtcaagctaaagaatgaccaagaacatctcttcagaaatatacaaaggaatgaataccataacctcttcaacttcgtcagtggtaagaatttgaaaatcctgaatcttggagaagatggccaagatagaactggtgccgttgcggctgctcttcagagcactgatgatgaccctgttgatccacatctggagcgaattaaaaatcaggccggtgatgaagaaagtgatgaagaggacgaagattttgtggcggacaaggacgacagcggatcccctagtgatgattctgaagagggttctgatgccagcataagcgatggagaaaaggagaaatcttccaaaaaggaagctagtagctcaaagccacctgcgaagaggaaaccaaagaatgtggacgtggaaggttcagagaagagaaagccgaagaagaagcagaagaaagatcccaatgcccctaaaagagcaatagcaccattcatgtatttctcaaaggctgagcgagctaatttgaagaacatcaaccccgaactcagcaccactgatattgcaaagaagcttggagagaagtggcaaaagatgtcagctgaggagaagcagccatacgttgagcagtcccaagtggataagaaacgctatgcagaggagtctgctgcctaccgcggcgctggtgcggctcctgtagacgtggactctgcagatggatcgtccgattgaattggaagattggccgatgtcgaaaggagcatactttcgagtcatggtacaagtaggcatccgatctatcttgctgtagtgactgttgaggtgtgatccctacgtttctgagttaacaaacaacagttaggatatgtaggttccaaggtgatgtttactttgctaagagctgtcagcacatgtgacaggtgttttattcgcaccctgcttgtgcaaccttttttctgcaaaatactcaaataatcaccggaaaaaaacaaccctagccttcctctctgtttcgccgtccccatctttctccccgtcttcctctccttcgcccgtcgccgacttcttgctgcctctcccgccgtcgaacctcagatccagtcagcttctagggttcgatctttggtgtggacgatgcatctcggttcttcgcctggttgattgcgatggatgaggattagggttagggttggcccttggtcttcgtttgcggcgtcgtccttgtcttctgtttacaagtgattgggtctgctgtggttgattcgtgcgagggtgcctgtcgacggtcctggagcaggatgtttgctgtgagttgttcgtacgtgcacctgttggatgccgtcgcctctcgatgccgtttgccgtttcactcatacctgtgagagtttatggaagatggtgatttgcttggtggagttgagatcgaggtttctattcctgggagtggtgcaccgacggacaggagatttttctggtcccattccagtgtgagactgtccatttatgaaaatgctgctttccaggcgatttgttttctgcagggtgtgtatgggtttgttgtgatggattacaactataagagtatgtctacttatcgagagcttgctcgctctgcaatggttttggctgcgtcgttggtccggaccatgcacactgatgcccatgctgatgtgtctgccgttgtgggtgacgtcgatgttgctgcgcagtggcagatgctgcatactgccttggtcgcaatggcatgtgctttatagtgctggtgtagggcttatttggttttgtttttcagtggtttgttttttccttgtcccgggtgttgtgtatttgagtcatgctgtatgtgcagctgaaatgttgtactatttaaatataatgctcatttgtactcacggcattcaataaagttgttgtaaaaaaaaaaaaaa

SEQ ID NO: 16620 - DNA, 1040 bp, Triticum aestivum
  Clone ID: PAT_TA_16620
gacttccagcagggcgtgaactttgcgtacggcaggtcgacggctcttggcccggagttcttcgagagcaaagggttcacgctgttcatgcccgtctcgctcgaaaaccagaccgagtggttcaggaatgttctacagctagccggctcagtagaagagcagaggaagctgatggccacgtcgctggtgatgatgggagagatgggaatccacgactatctcatcttcatcaccggaaagctcaccgaggccgagatccggaccttcgtgccccacatcgtcggcgccatccgttcagtcatcaccgaggtgatcgatgcgggagcgaaaacggtggtggtccgggggatgataccgctgggctgccagccgctcatgctcgccctcttcgagggcaccggcgctgactacaaccgggcgaccggctgcctgacgcggctcaacgacctcgcccggatgcacaaccacgcgctcatgcgcatggtcctcgacctccggcgcgcctaccgcggcaccggcgcggccatcctctacgcggaccagttcgaccccgtcaccgccctcgtctccgcgcccggcaagtacgggttcggggacaagcccctggcggcgtgctgcggagggagcggcacctacaacttcgaccccaccttcgccaccctctgcggcatgcccggggcgaacaagtgcgccgacccgtccaagtacgtctcgtgggacgggatacacttgaccgacgccgccaaccggcatgtcgccggaaatgtgctcaggtccatcgtattgcggcaaacgccatatatggcacacctctcctccagctagctatgttggcactgcccctgtcagtgctcctgcgcggcctagtattgtgtatcttgtacgcatttcccttcgaaatgaacgtagcgcgcttcgatgcgtccggtgctacatactcagtttgagaatatctctgaggaagtccaaattattcttttcaaactggccaggtacaagtcgagtgaaaaactgaaaacatatattgggtcaaaaaaaaa

SEQ ID NO: 16621 - DNA, 1387 bp, Triticum aestivum
  Clone ID: PAT_TA_16621
cgcagtctcccgtatcacagacgcccgccaaggagccgcgcccgcggcgcttccgttaacctggactccctcggatcccgtgccgtccggccatccgcccttggacacttcacttcttaggcaaggcccaaccctcacacttcagcccaccagctttgtgaacgtctacgtccactacacacgcgtcaagggccaggcctccttccccgccgaggccccgtcgccgggcaaggcgcaggcctcctgctccgccgaaggctcctcgccccccgcggagccaccgagagtcttcgggtgcgtgatcggggtgcagcccggcgggacggcctatatcttcatcagcttcgagctcgtcctcgaccccttcaccggcacgctcgaggggctcctcatggtgtggaagctggatctctttaatggaggtgttccctgagttctatgtgttgggctggtactctactggcaagcgactgtgcaggatactgacattcctaatccacaaggctctgatggacattaatgacagccctgtttgtcttctcttcaattccgcaatcaaccactcccagttggacctacctgtggctgctcatgagagtgagttgcatgttatcgatgggggcccccagctcatctttgtcaaatcaaattacacaattgagaccgtagaagcagagaggatatctgtagatcatgttgcccatctgaaaccatctgatggtggctctgcagcaactcaattggctgctcatcttacaggaatacacagtgccatcaagatgctcaatagcagggtccgtgttatccagcaataccttggtgccatgcaaaagggtgatattccactggataattcacttccttaggcaagtctcaagcctcgtaagaagactaccagctatggaatcggagaaattccaagatgacttcttgacggaatacaatgataccctcctcatgacttaccttgcaatgttcacgaactgttcaagcacaatgaacgagttggtcgagaagtttaacaccacctatgagagatcccctgccaggagaggaggccgaggcgctttcatgtagatgggtcctgctgccgctgaggttttgatgctggttatccgtgctgagattttgaaaatagttatcatatctagacgcaatttttgcgtgctatcagttaggtgctctatgttcccgcagtatccgagacttttcaatcttcttatcccctctgggttggatcagtgacaagacgtgcctgggatgattgattatcctcttgtcccgaagttgacatgtaaagttcggcttaatagatgttgctcaagttaactcgtatctcggtcttgtcctgccttctttaaattggttatatgcttgcagaatcttg

SEQ ID NO: 16622 - DNA, 1118 bp, Triticum aestivum
  Clone ID: PAT_TA_16622
ggggctcgggcgcccccccggtcgcccccacgtccctcctctcccgcacccgcgcgcccgccctcccccgcaccccctccgccggctggagccccggcggcgacgccgtcttcggcgcgctcggcgagctcggggcggccctcgcgtgcggggcccgcctctccgccctcctcctctcccccctcggccacagcctcgccatctgcaccttcaaccaggccaccttcctcgtcaacgccctctcccacctcttcgccctccccgacggcggcccccccctgccggtcaacaaggagtatgtcctggaggtcctcgaagagggggttcctgctcaacttcgtcgggaacaggctcttcttcggcggcgttccgctcctgctgtggatcttcgggcccggtgctggcgtgcctctgctccatggtcatgatcccggtactgtacaacatcgacatagtgtacatcgaaagaggaaagggtggcgaggtcagtgacaaagtggagctgaccgatgccgacagcgacgacggcatgcaagtctgatcggcctttggctcgctcgttggtgacacgaccgacgagattcacatgcaccaagaaacgctcgatggctctatgttaattccacatccaaaaaaccctcgtgctcgccttcgtccgcgacgcccgggtcggggggtccctgcccaactccgtcgcggacaggctcttcttcggcggcgttccgtttctgctgtggattttcgggccggtgctggcgtgcctctgctccatgggtcatgatcccgggtactgtacaacatcgacatggtgtacatcgaagagaggaaagggtgggcgaggtcagtgacaaaatggagacgaccgatgccgacagtgacgacggcatgcaagtctgatcgacctttcattcgatcgttggtgacacgatcgacgatatgggcgcagcaacaacgatcaacggatgttaattaatttcgtattcaaaaatccatgcgcgcgcctttgttggacatgggaattgttgttcatttcccaaacaattctggctaaactcgacaaaattagttcaaagaggcctgatctcatcatgtagacagcatcagcaggaatattatgc

SEQ ID NO: 16623 - DNA, 953 bp, Triticum aestivum
  Clone ID: PAT_TA_16623
gtggtatttcttgatgatgacattgttgttcagaaggacctgtcagatttgtttacaatcaacctcaatgggaacgttatgggggcagttgagacttgcatggagacgttccacagatttcataagtatctcaatcattctcatcctctgattcgtgctcattttgatcccgatgcttgtggctgggcgtttggtatgaatgtgcttgatcttgttgaatggaggaacaagaatgtcacaggtatatatcattattggcaggagcgcaatgctgatcataccctgtggaagcttggatctttaccacctgggcttcttgctttctagggctgggttgaaccacgggacccaaaagggcaatgtcttggggctgggcgccacaactggtggtccccgtactatttgggggggggcagttttgccctacaatggggatttgaagccatggctgaaaattgggatggagaagtacaagggcttctgggacaactatgtggattattcacaccctctgcttcaacggtgcttcatgcgctgagtaatgtgtctcaatattagaactttttgtgcccttctgatggacatgcttcaaatgcatagcttgacaaggcacacacggacattcttgtgaatttcgataggcttcgttcacaagttacaccctcagattaaacatggacagttgtttatgctggcatgtgtagtcgataaggtacatcgactacaggtatgaccggccatacaggtaatagcagaagagctaagattggcattcagtaggctgctacttgaacagcatctagtacatggcttcataacttgcaaccaccaatgtaattttttccattttgattttttggtgagactggaggaagggcataattgtagaattgatttaaattattgaggtgctacaacaagttttgagatacatatttattggataaaaaaaa

SEQ ID NO: 16624 - DNA, 1898 bp, Triticum aestivum
  Clone ID: PAT_TA_16624
ggttgaggttgatagcacagttagtttggaggctttctcaagaatagcacctgccattccaacaatcgctgatgtagtaacttcttcaaatctctttgatgtgctttcatcaacaagtggaggccgtcttccatttcctgtatatgataagtatcttgcaggattggacagagcatttaagaaaatgaagacacagtctgagtcatcgcttctatcgggcttccgatcacagagaggagaaagggttctagaagtcgatggaacattgacaactcaaccagtacttgagcatgttgggatttcaacatggccaggaagattgacactgacggatcatgccctttactttgaagctgtaaaggttgtgacatttgataagcccaaatcttatgaacttgcagaagatgcaaagcagattgttaaacctgagctaactggcccatggggttcacggctgtttgacaaagccgttatgtataaatcaacagccttaactgaaccagtgatcatagaatttccagagctggccgggcactctcgccgtgattactggttggcaattatatctgaagttctttatgttcacaggtttgttaggaagttcaacataagtggagtcgataaagaggaaataattctgaaggcctcgcttggtactcttgcggttgcaagccatcgaagaattagcttttccagcttccaatcgatacgaatctcttttgttgttcaatctttgtgacaaacttcctggaggagatgtaatacttgaaacactagccagtactatatcatcaagaagttcagctcatgccaatcaaccaggcatgagcattggaatgcgttccatgtctgccttcgctgtcctgtcaaacctgggcatggtatcaccaggtaataatagtgagagactctttgttggtgagatagtcgttggggaaatgagttccttgcagaaggcagttactgagtcaatgaacaattacaagaaggttgaactggcccaagccacagttgatggagtcaaagttgatgggcttgatacaaacctggtagtgatgaaggaattgttatcaccggtaagtgacctttggaggtttttggtgtcgttggcattgtgggacgagccttttaagtcattcatcttttgcttgttatcttcttctattatcataaggggatgggtagtctattttcttgttatggtcatactgttatcagcaacggtcatgctgctgacaagactaactagtcaaggaaagccaatgactgaggtcaaggtgacatctccaccttcaatgaacactatggagcagctcttagctgttcaaaatgctatttccaaagttgaagagcttgtccaggatgcaaatattgttcttctgaagataagagctctactgctggcttttccatctcaggccacagacaaagctatccttgcgctgttattgatggctcttgtccttgccttgctgcccacaagattgcttatcctggcgatgtttctggaggtgttcaccaaccactctccgctaaggagagcaagcacagagagatgcaccagaaggttgagagagtggtggttcagcatacctgcagcgccagtagtggtggagaaggataacaaagaagataagaagacaaaatgaatttgtgtgtataaattgtgattccgtgtctagtttggctgatgtggtgatggatcacaagcgcaccgctgtgtacaatgtctgaggatatgataaatgaactgcagttagtatttcaataagaatgttagctccttttccctcctttctgtgctctaccctgatatctcaaaactagtctatttcatgggaatgtattatgcatgtgcatgtgtttgagttgcctcgagactagacctgcccgggcgg

SEQ ID NO: 16625 - DNA, 753 bp, Triticum aestivum
  Clone ID: PAT_TA_16625
tttttttttttttttttgaatgtaacgagaaaagtgtaagtggagccgttttgttagccgtcgtgttacattgttgctacacaagagttatattcagctagggcttgaacatgggtggcctcctcactttggtagcctgctcgaaagaataggccatctcgatcaacctcggctcatacccctgcagccccccgaagcatatcccgatagcgtggtcgcggccgaggtaccccgccggcacaacgataccagggtggccgctaatggcgagaaggctagaaatatcgctgttaggcgcaacgatcgcgtctaattggtgctccatcattagcttctccagcccattcgtgttcagctccttcaggcgacggattgcggccctctctacgggcccaatgccgtttgtgctttgggcagcgataagatcaggctgcccgaaatctttcagcctctcctccacacctgcccgggcggccgctcgaatgatgtctgctagcgaatggaccggggagtagaccaagtctgccaaatacgcgtttatgctcagtttgaactctgcctgcatcgcaatcccctccttggaataaatctcaacgaatagagcggtcaaattggcagcgacgtccagcttctcgatcaccactgctccaagtttcctcattgtggcgaggtgctgcttgtacgtattcaactgcgtctggtcatatccttggaagaagccattggggacgccgatcctcttgccttttagcc

SEQ ID NO: 16626 - DNA, 730 bp, Triticum aestivum
  Clone ID: PAT_TA_16626
ttcggcacgagggccataaccatcaccgattggagcgtatttgttgactgcgacgagcaacatcgacgggggtgaggggccgatgaccgtcaccgccagccactcgttcgctcctcctcctcctcctccaagcggcgatcgagtttgatgattccaggtgcgggcatcaggatctctgctattggatccaggttcgggagattaaagtattaaactcagtctctaacctcccgaacgggactcagactctgttattgaatcctgttggatcttgttcggggatgagactgacgttcgaatttgatcctggccgacgggattgagacgcacgttctctaaccaccagcagggtccgctcgttcgatcctgtcgtcggccatactccaagcggcctgggcatcgagctcggcttcgacacccgcaccatccagaaccagatacattattgcgaagacatcagcaccacacacacccccatcaaatccgtccaagctcatcctgtctcctctcagatctcggtggctgctccattctcggtgcctgattaagcacaaggtattgttgttcatcccttactggattgccagtgtttggcgtggtgctgtgcccgagtttttggtttgctcggggctcgcatcccgtgctttgttgtcgccatctaatcttatgaatcttacaaagtagttaagcattatgtcgtttcttttgcatctgcacatgcagattttta

SEQ ID NO: 16627 - DNA, 1245 bp, Triticum aestivum
  Clone ID: PAT_TA_16627
ccacgcgtccggaggaatagtgaacccgtgccgatgtcggcgcgaggaaaagccctactccacccaacctcccctctctccgtctccaccggctcgccgccgctgccgccatgacctccagccggctgcccaccctttccctccgatccgcgtcctcctagcccatccgcttcccccacctccggtcgacgaaagatcacaccccgcgccatggaaatcccgcgccctgttctccttggtctggggcagctcatggagcacctcctcggcgatccagcagcctccgccctccttcaacaaatcgaatccaccagaaaatgagagggaagcaccggccgtatcggcgaatccttagcctctcctctgaatgcttctgttttagttagtatctgtatgctgacatgtcgttcttaattgacagcttttgcttcatactccacttactttaccaagtttgttgtttgtcctaatgacagattgatcgggggatggaggtgttgattcgattgcttttacgccagctaagggcaaaatccctccctccaagcgagacacgtctctgtagttctagttcagttgatttcatctgcggcacaggtcagcatgcagaacaacgcgacagaggttcctgcccaaggccatggccttgggcaggtgagcaacaacgacatcaggctgtccggctccgtcattgggggcactttcgtcgttgtcgttgttttggtgggcggcgctattcttctgcaccgattcttcaggttctacaagctggagaaagcactgcgagcgctgaagatccccccctccaggttccaaccggagggggcaatcaactcagtgtgcaccatctgcattgcagatttccgcccccgcgcgcgcgtggcagtgctccccacgtgcgggcacgtcttccaccgccactgcctccgggaggtggtggcggggcagagcccacgctgcccgctctgttgggcagctctgctgtgaaggtttgatgaaggaggaggatcgacaggtgatgaggaagggggcgctgatgctcaaagacaatgccagcaacacgatgcgcacctgcgcagcgatccaggatgacaacagcggctgatgaagttggcagctgggtcattaaagcatggcagcgtttccccttttcgttgcttgtctgataactttgacccctgcgtgggtagacttcctgtgtcttgtttggttggcacctgttttgagctgatagttcccttggat

SEQ ID NO: 16628 - DNA, 1005 bp, Triticum aestivum
  Clone ID: PAT_TA_16628
gcagattcaagatctggagttttgctctgctccaagcaaagccatggcctccgaacagatggtgcatatgagtcaaggacaaggggaaactagctatgctcgcaactccagttttcagaaggctgagcagaacaggatgaagtccctcatagaagcggtcatcgcggactggcgcggcggcagcagcaccttcttgcctggcaagatggtgatcgcggacttgggatgctcctctggcccaaacgcgctggcactggtatcggtcgctgtcgaggcgatccatggctactgtcttcagttccagcagccaccaccggaactgtgtgtgttcctcaacgacctgcctgacaatgacttcaacacggtggtgaagagccttgtcacgctccgtcgaagcaacgaccccgttgtcctgacgggtgttgcacccgggtcgttttacgagagcctcttcactagtagctccgtgcatcttgtgtgctcgtccagtagcctgcactggctctcaaagcctcctgaagttctaacgaagaaccagatcccggcttactacatcgatgagcatgctaggcgtgacaacctccctatggtccttgcggcatatgcacaacagtttaggaatgacttccgacatttcctggagctgagagccaaagaattagtcccgggaggacagatggttgtttccattatagggaggcattctgatggcttcgcccccttccacatctggggcatccttgctcaggttctaagccttatggcctcagagggtgtaatcgacaaggcgaagtttgattctttctacgtgccagtctatgggccttcgaaggaagatttaagggaggtcatccaagatgaggggtccttttccatcaaggagtttctggtgcatgactttttaagcggcctggacagcgcgctcgtcaccccaagctggatcgccaaccagataagggccgtgtatgagcagatagtggtgcagcattttggagatgtcatgga

SEQ ID NO: 16629 - DNA, 765 bp, Triticum aestivum
  Clone ID: PAT_TA_16629
gattcggacgaggccgggcatccccaagagccactccttcctccgcggcgccgcggaccctgctgcctccccgtccgcgccgctcccgctcccgccgccgatccgtgcgccgccctcccgacgccgcgccaaccgatcggcgccgggcgctcccggcgccgccgccgccgaccccttcgccgccgcgctggcagagtgcaccagggagcgcaccaacgccatcgacatcgacgcgctgtttcctcctaagccggcgtcggccgtccgcgccgggccgcggcggtggtccatcgccactggcggggtggtaggattactggacctgtacggctgcaagaacgccatgggcgtcgccgagggcgccttcgtcgtacgccggccggtggtggccgtcgggcgggcgggccagggccgtgctggccggcccggcaagagataagggcccttccgaattctgagatccatcaactgtgtgggctcaaccaggtacataaataatggatgtgtgcagcgagcgagtggtgggaaaatatcgaaaagaaatctcaccttttcttttcgtttctttttattttcttttggttgtactttgatggtattctcaattctacttagtggatgtgattcatacatataattgagaaaaagtgatatatcaaccgatatatcttatatggctctttgtatatatatgtaaataatgcatgtgtcttactaccatgtttaaatagtcaagcttttgccaaattttcgaaaaaaaaaaaa

SEQ ID NO: 16630 - DNA, 990 bp, Triticum aestivum
  unsure (1)..(990): unsure at all n locations
  Clone ID: PAT_TA_16630
tcggcacgaggcaggaacacattgccccaaagcccccaacggattagagatggtggctgccatagttgccgtggttgtggcggttgtgtgcttgcggctgccggcggtggctcgcgggcagctccaggtgggcttctacaacacgagctgccccaacgcggagtcgctggtccagcaggccgtcgccagcgccttcgccaacgactccggcatcgccgccggcctcatccgcctccatttccatgactgctttgtccggggatgtgacgcctccgtgctgctcgtgtccgccaacggcacggctgagcgcgacgcggccccgaacaagccgagcctccggggcttcgaggtgatcgacgccgccaaggccgccgtggagaagagctgcgcgcgcaccgtctcctgcgccgacatcgtggccttcgccgcccgcgacagcatcaacctcaccgggcaggccgcgtaccaggtcccctcgggccggcgcgacggcaacttctccctcgatcaggacgcgctcaacaacctgcctccgcccacgttcacggcgcagcagctcgtcgaccgcttcgccaacaagaccctcaccgctcgaggagatggtcatcctctccggcgcccacaccgtgggtcgctccttctgcagctccttcctcgcccgcatctggaacaacaccaccgccaccgtggacacggggctgagcccagcgtacgcggcgctgctgcaggcgctgtgcccgtcgagtccgaacgcggccacgacgacggcggtcgattcgacaacgcccgcggtgctggacaacaactactacaagctcctgtcgctcaacctcggctcttcttctccgacaacagctgcggaccaacgccacgctcaacacgtccgtgaaancttcgcngngaaacgaaacctctggaacagaattcgtcncggcatggtgaaatggggaaatcnagtgctcacggaccaggggagatntcggntaaatn

SEQ ID NO: 16631 - DNA, 970 bp, Triticum aestivum
  unsure (1)..(970): unsure at all n locations
  Clone ID: PAT_TA_16631
tcgacccacgcgtccgattttgtgaattgatttcgtccgcatgtcaaaatagtcaaaattgcccacgaaagaggaaaaggggaaggggggagcaggaggaacgctccggcccaccgccccagagccagaaatccaccaaccggagaagagaatctctccctcccctcgcgctccagcgcccgcgtcgtcgtccccctcctcgtccccttccccgctccagcggattcgaatccgctcggggccggccggatcccgctcgccccatggcggagggcttcgggcgctgggagtcggatccgctcttccccgcggccgagtgcgtgcaggactccgccgacaggatggacggtgtctaccgcttgcttttgcatgaaaagaaagttatacaagatgacacttcagatgcaaaacttcatgcaccgatacagtatgagagagatgtggctactgctctcggaactaccaagtggcagttagagcaatttgagagggaggtgaatgcagctgcattctctgataagtcaacttcaagggaaaatgcaatcttaaagttcaggcaattcattagagctatagctgagcaaatttctgaggtggaagaaagcttgaagactcttaggacagatttcagtagaactccgaaatctccatactcctcaagtgaacaggatggagatgggctggcatctttcctttctggtggcaacagtcatagtcatgcatactactccactgatacaaatgaaattactgaacttaagctcgacagtgcacctatgatgaatggttatcattctgcccaagaacatacaacacgtgaactcagatattcaggaaatgatgtcgaaggagcatccagattgcaatgttcacgtggagaaagtgcatctgaagtagatcataacggtagcactttgtgtagtttggatgctgatgattcgctaggtacctgcccgggcgnnngctcgaa

SEQ ID NO: 16632 - DNA, 977 bp, Triticum aestivum
  Clone ID: PAT_TA_16632
ccctcagttcatcgcaagacgccactgatcggcaagctagctacctaggtgctgagctgaaccgggggggcggggatggaggacacggcggcgacgctggcaacggagctggaccggctgctggccatggcgagggagctggaggcgcgcgtcgacggcgccccgggcgccgcgagggagctctgcgccgcgctggccgagtccgtcgaccgggccatgcgcctcgccgggagctgcccgcgcggcggcggcggcgggggcaatgccggcaacgtcagggcgagcgtgagcgggcaggtcaagggcggcaggaaggcgggggcgaacaaggtgcggacgcaggtgcgggtggcgtcggtgacggacgcggggccgctcaacgacgggctcagctggcgcaagtacggccagaaggacatcctgggcgccgcgtatcccagggcatacttccggtgcaggcaccggcacacgcagggctgccaggccaccaagcaggtccagcgcgcccacgccgacccgctgctcttcgacgtcgtgtacctcggcgcgcacacctgcgcccaggccgccgcggtcctcgccggcccggagcagcagcctcctgctgccttcgccctggagcaccagcagcaggagcctgccgccggaagggattcagtggccggtagagcccgtgacgccgccccccttcctttcctcgccggccggttgatacacgccgggaagcccctggtgcgagcttgccggcagctacggctacgctgccggcggggggctcggggctgacatggagtatgcgtacgaccagttcgacgaaatgttcttgaatctgcccgaggttttccaaccggatggtccgaacctgtaggtgctgcggccagtatcgtactgtattcgcactagcatttagattcagactcctgtgatcggcatccaacgggaagtagtcagtcgaactggttcctaccaggttactc

SEQ ID NO: 16633 - DNA, 1085 bp, Triticum aestivum
  Clone ID: PAT_TA_16633
cgggaggggccggcatcgcggaactaacccgaccgcccgcagacgccggctgtgtcgtatgaacgccggcacgctgaccgctgacggctgagcgagcgggaggagatggaggagaggtgcgccctggccacggagctggcgcaggtgctcgacacggtgaggcagctggaggcgcacatgggcgtgaagggcggcgctgacagaggggagacctgccgggcgctggtgtcgagcatgcgctcctccgtcgacaggtccatccacatcgccatgtcgtcgtgctgcgtggtcctcggagcgccggagtcgccgccgtgctgcaggaggcagcccccgcagcggcgggtctgaccaggctgccgactccccttgccgcggcgctcatgcagctgggcagtccaagaagaggaaaacacagcccaagtggagcacgcaggtgagggtgaactccgtagaggacgtcggccccctcgacgacggcttcagctggaggaagtacggtcagaaggacatcctcggcgccaagtacccaagggcctacttccggtgcacccaccggcacacgcagggctgctacgccagcaagcaggtgcagcgtgctcacggcgacccgctgctcttcgacgtcgtgtaccacgggaaccacacgtgcgcgcagggcaagcacagcaacagccagaggccgcagcccgcagcaagcggagagcaccggcagccgcagcctgcaggcggacaggaacggatctccgttggacaggagaccgagggcggcgtggcgcctgcgttctcgttcccctccaaacaagcaggcgccgacacgggcagcgacttccaggccggctgtgccaccactgcatcccccttcatgtcgccggcgacgtcagagtgcaaggcctccacgacggaatccccgatgggggacatggacttcatgctccagctggccgacgccgatttcttggacaactcgcgctatctctaagtctccgcaggactactaggcaacgaattatgagttcaggatgctagctccgagcttgtaagattctaagctgatgaatgcacatgccacttgttcgagcttt

SEQ ID NO: 16634 - DNA, 590 bp, Triticum aestivum
  unsure (1)..(590): unsure at all n locations
  Clone ID: PAT_TA_16634
gcgaggccccaacgctcccccgcgctggtcgcaatgctctgccggctcctctccctgctgctcctggccgcccttctcgccgccgcggctgggcacggggattcctccgcgtcctcatgccccttccacggcggccacgacgagaagccccacgaacaccatgaccacgggcacagctgtgggggcgccctcgatgattccaatcacgagcaccaccaccaccacagccaccatcaccgcgacgagatccagcggctgcttcccgaggaactggccgaggaggcggatctcgagctcgagggcttcgaccacgaccaccatcaccaccatgatcaccaccacgaccacatccacggcgatttccacccagagtcaacatccatgggcgtgtggctgagagcgatggggtgctcgctgctggttagcatggcgtcgctcgtctgcctcatcctcctcccagtaatcttgtttcaggggaaaccgttcgaaggccgttgtgggacgcacnttgcagtgtttggggcaggcgcaatgcttgcagattcattccttcatcaactgcctcatgcttttgtggtttactgtagctt

SEQ ID NO: 16635 - DNA, 632 bp, Triticum aestivum
  unsure (1)..(632): unsure at all n locations
  Clone ID: PAT_TA_16635
cattcttcctacctcacccgcaccactcctcctcagccccgatagctaaggcaccgccgctcgccggagctcccctcaagctcccaagccagggccgccggccctctgcatcgccgccggatttccggcgcctccccaaccctccaccgcgaacagatctgcatcccgtgcgccatcgccagcccaagcggcggcgccctgccgcgaggaccagagggcgactccgcacccacctgagcaaagctgctgctggccggcggtgaggctgacccgcacatatcccgtgcgccttcgctggcccatgtccggggaggcgagcttcgcgtcggcccaagcagcggcccccagcgtgaggcccggcgggcgaggatgccccgacctgagcaaagctgttgctggccggcggtgaggctgatccattctggcccccgcctcctcccctccgccgcccgccccgtccccccgggccccgcgggctcccgccgcgtcctcctttcgctctctcccgccgccctacttggctggcccgcccgccaccccgcccccctcccggtgggcgatcgccgcctcccctcctttttgctgagttcccanggggccagggccanaaaagggtccggnttgaaccaann

SEQ ID NO: 16636 - DNA, 411 bp, Triticum aestivum
  Clone ID: PAT_TA_16636
cgtccgcccacgcgtccggaaaaacagagaggggatggctctccagggttcgcccgccgccaccgtcgctggcccgttgccggcagggcatgtggatccagtctccgccgcccccgggcatacaccgaccgcatcagatccgtcacgccgccgttccttagcacctgctgcccctgctctcagctcgcccctgtgctccacctgcgtcagcgccggagcttcagctgcaccacgacggagcttcaaccgcaccacgccggaggccccccttgccccctgactccacctcctcctgcccgactgcaccagccctgccccatctcctacctttgagaaggtatctgttcatcagtcccaaaaaagtattttttgcttgatgctttaaattatgttcttatgtattgaactgcc

SEQ ID NO: 16637 - DNA, 876 bp, Triticum aestivum
  unsure (1)..(876): unsure at all n locations
  Clone ID: PAT_TA_16637
gaatatcctgatgtggatgaaatgaanaagatattattgtttagctattatgatctaccttcccatttgaagccgggtttgttatatctgagatatctttccacgaagatcataagattatgacggatgagcttagatggaggtggatagcagaaggatttatttgcagtgaaaaacaggaaactagtttatatgangctccgtgattgctattttaatgagcttataaatagaaacatggtccagccagtggacatcgacgaagatggaagggcagaagcttgccacgttgcatgacatggtgcttgacatcatatgttccttgtcaagtgaagaaaactttgtcaccatattggatggtactaagcagaaaactgcctaacccgcataggaaggttcgcagattatccatccataagagcaacacagatgtactggctaccaccagcatagcacaaccgaggtctgttactgtttttggaaatgatattgttcaacaaatgccgcctatttcaagttctaagggtctgcgtgtgctggctttagaaggttgtactatttcagatattggcctcctggtctatctgcgtcccctgccgtacctaggccttagagccgcttgggtggacgggttcctggttcggataggaaagctgcattttctgcaaacactggacttgagaggaactaaaaatatacgtgaattgccatcaagcattgtttggttaagaaatctgatgtgcctatatatcgatgaggccatgaacatgccatgtgggattgctaacctgacgtccctagaagtgctaaaggaactgcgtttggttgatgataatctagtcattgtgaaagagatgttccatctaatcaagttga

SEQ ID NO: 16638 - DNA, 631 bp, Triticum aestivum
  unsure (1)..(631): unsure at all n locations
  Clone ID: PAT_TA_16638
gagcctggccgcgggaggagcagggcgctcgcgcccccttccccccgcgagctcccggtggccggccgggcggtccccggccctcccccgccgccctcaaccgcggccacgccagaggtactcgcccttcttctcgcgctccacacatgactcgccgttatatgcagcgatggcgacgttgcgatatgattacgagttctagaattattttatgtggcaacgatcgagctgattgatgtggttgacgccacgattcagtgcaagttgacgccgattgcatgcatgctacacaaagaaaaatagctgtgtaataaatagtacctcgccgggcagccgctcgaatggcgacgttgcgatatgattacgagttctagaattattttatgtggcaacgatcgagctgattgatgtggttgacgccacgattcagtgcaagttgacgccgattgcatgcatgctacacaaagaaaaatagctgtgtaataaatagtactattttgcaaccacgctaatatatgtggcgatgacaaacttttgctgaggaaagtacacaaaaaaaaaaaaaaaaaaaaaattcccnaaaggatctatancccccaaggcgtctttaaactctanggaaaccngntac

SEQ ID NO: 16639 - DNA, 984 bp, Triticum aestivum
  unsure (1)..(984): unsure at all n locations
  Clone ID: PAT_TA_16639
cggacgcgtgggcttccccttcacctacacaaaaccaaaccatggagataaaccccccgaattgaattccacggtaggtagaatccagctagcggccatggcaatcgcattggcagccttcctcctgataccgctcttctccctcggcgcagtcttcgtcctccgtgcgtggcgactcgacaagaaggcgccggcgcagcgcacgccgaggacgcggccgtacccgctgctcggccacctgccgcagttcctggcgaaccggcaccgcgtactggactggctcaccgaggtgctcgcgctccagcccacctgcacgctcgtgttccgccggcccggcggcgtccgcggcgtcatcacggcgaacccgaccaacctggagcacatcatgcgcgccagcttcgacaactaccccaagggcccgcgtttcgcgtcgctgctccacgacttcctcggccggggcatcttcaacgccgacggcgagccgtggcgcgcgcagcggaaggcggccagctacgagttcaacacgcgctcgctgcgtctcttcgtggcgcgaagcgtgcacagcgagctccatggcaggctcctcccgctgctgcgccgtgccgccggctccggcggccacctcgacctacaggacacgctcgagcggtacgcgtttgacaatatctgccgcgtcgccttcgaccacgacccccgccagctccccgacggcgacgcttgcccggaggtcgagagcaccgggaccgcgagcagcaggttcgccgacgcgttccgggacgctgccaatctcagcgcgggcaggttccggtacgccatcccaggattctggaagataaagaaggccctcaacctgngttccgagtggcggctgcgcgagtccatcgccatagtgcatggcttcgctgatggcatcatccggtcgcggcgggaggagatgaacatgggatgcgagaagcacgacctcctgtcggggttcatggggag

SEQ ID NO: 16640 - DNA, 801 bp, Triticum aestivum
  unsure (1)..(801): unsure at all n locations
  Clone ID: PAT_TA_16640
cttaccctctcaactccagcaaaactcctccagtccagactacacccggttggaattaggccccactgagcgcccccagccatgagttgcgggagatctgaaaacactaccagaaaatgcaggacgcgttcaacacctggtgaaacgatgtatctacatactgcagatgctaaaaagatcacccactaccaagctaatctaccaacaacaatggatcgcgatatcggcgcctaccctgtgaagcaccactttccgtctcctatagtttcttggatagaagacctttctagctttggcgatgttccttttagtcatgatactgaatacgtggatgatcaatcaacaccttcatttgggcagtcttttgcatctagcaatttgcatgacatgcaaatatcagtgagattgacagacgaattcatggaacttgcaaaggagaatacaagcaataatctagaggcctgtggaattcttggtgcttcatttagggatggaacttattatgtgacaacattgatcattccaaagcaagaaggaactgctcactcatgtcaagcttctaacgaggaggagatacacgccgtattatcagagcagtcactttaccctgcagggtggatacatactcacccttcacaaacatgctttctatcgtcgatcgatttgcacactcaattctcttatcaggtcatgctaccagaagctgttgccattgttgctgctcccaccgatcctactaggagctatggtatattcaggttgacagatccaggaggcatggatgtgctcaggnagtgcagt

SEQ ID NO: 16641 - DNA, 1369 bp, Triticum aestivum
  Clone ID: PAT_TA_16641
gctgccccttccttcatttctgttcagggcaagtgaaccggtaccttttgcgggagcgagataattgagaggattacggaccgtctctggcttgttaacaagggagagagcatgcaattgtgagagtcgagatcagaattgcggcaagtttctaagagtcaatacggtgaccatccaaacagccgtattggagtctagacaacaccaattcacgattccagggtcgaatacagacatccaaacgcagcagtagtctatctcagaattgctggccttgtgtggttggaattaggccccactgagcgcccccagccatgagttgcgggagatctgaaaacactaccagaaaatgcaggacgcgttcaacacctggggaaacgatgtatctacatactgcagatgctaaaaagatcacccactaccaagctaatctaccaacaacaatggatcgcgatatcggtgcctaccctgtgaagcaccactttccgtgtcctatagtttcttggatagaagacctttctagctttggcgctgttccttttagccatgaaactgaatacgtggatgatcaagcaacaccttcatttgggcagtcttttacatctatcaacttgcatgtcatgcaaataccagtgcgattgacagacgaattcatggagcttgcaaaggagaatacaagcaagaatctagagactgtggaatcttgggctcatttagggatggactactatgtgcaacattgatatcaaagcaagaagaacgccaccatgtcaagctcatcacgagaggtcaagcctatacgtactatactagccgtagcttggtaatgccccctccagacatcttcacctcccactcgcagcctggctaacaatatcgtagaataaagtctgaattgctgctcccaccgatcctactaggagctatggtatattcaggttgacagatccaggaggcatggatgtgctcagggagtgcagtgagagtgggttccatactcaccgagagacgacagatggcggtccaatatatgaaacctgcaccaacgtgcatttcaaacctaatttgcggtttgagattgtcgatctgcgttctggtgcgtgaccaatccggcataccctctggcatactggaatatgtaagtatgtgatgtgacgcatgtgccatagatgatgatagatcttaccggtgactgttggtcagcttgatgggcgtgttaaaaaatggtgttaccaacctatgatgtcaactattccctccgtcccggagtaactcttaactggtctgttgtaatgtggtgtgcctgaaaaaacagacacgctcgtctaatgtattttatgtactaccccctccattcggaaaaaaaaaa

SEQ ID NO: 16642 - DNA, 622 bp, Triticum aestivum
  unsure (1)..(622): unsure at all n locations
  Clone ID: PAT_TA_16642
atggatcctgtcgttggtgatcatcggcatcaatacttatttcttttgtactagcttcgtcagttggcttgtatatagtgacctaccaagatttgctaaagcaataattagcaccctcgtcttccctttcatggcggcctatattgtagcggtcatttgcggggctttcagaaaagttagtactaatgccgtactcccctccagttcagtttcttgtgagattgaagtggcagaggtgccaagacaagacaacaaggatgaagtttgggctctacattgctagattgaaagattggatccagaccttgttttggagacggtaatatcttgattcctccaagaatgaagccgttttcggggcaattagtgcgatccaaaaagtcccttggaacccttcgatgaacaaagcatcaactagttcatgtatagcatatcagcactcaatggatggcatatatagtgggatctcttcggccggtctgttcgtttctcgcttgctcgtcatgcgcgcccatataggctcctgggatggcgtctgtcttgtgggaactgaaagataatggcctcaaaatntaatggggaaanaanaaaaaaaaagggggcggacaatcccnaagggcca

SEQ ID NO: 16643 - DNA, 704 bp, Triticum aestivum
  Clone ID: PAT_TA_16643
tcgcggccgcgtcgacttttttttttttttttttttttttttttttttttttttttgaactggaacttgatgtccacgatacatgatcgattcatcttacacatattatttcgtgtgccatggcttgggagcacccgaagcaatggacccatggtagccgttgaacttctagaaaaaaattcaacagttcttgcaatcttgtaacttgactgacccaactagaaaaagacttgactgacccgggatgttgatcgccacaaacagctatagcacacccgccacgtacacagagcactaccgttgtaggagtatcacagtatacggtgtactctctcattggcttagcaggtcgatgaacttcttgaaattcttctccgacgagccgccctcgccgatgcactcggacgccgcgtccttgagccaggacgccctcttcctgatgcccgcgtcgccgatgacactttccaccttgccccgcacctcctccttggccacgatgccgtcgtcgccggggcacacggcgaggccggtcctccacacgtcggtgacgtagctccggtccaggaactgctcgcagaagtagggccagcacaggaccggcacgccgttcctcgccgcctccatcgtcgagttccacccgcagtgcgacacgaagcagcccaccgcgcggtgccccaggacctgctgctgggagcaccagctga

SEQ ID NO: 16644 - DNA, 633 bp, Triticum aestivum
  unsure (1)..(633): unsure at all n locations
  Clone ID: PAT_TA_16644
ngagccgagcactcaataaaaaaggagaggaggagacgaggaagaagaagctagagagtcgcgcagctagagagcacagaaaggcgcgagcttttcttgctttcggcgccatggcgaggtggacggcgcagcggtgcgggctgctgctggtggcggcgctcctcgcggtggccgccgtggcggacgacagcggcgagaagtgcacgggcgggtgcgggaacccgtgcggcatcccgtgcacctactccagcccgccgccgccggagccggcgctgcccccgcccgtctactacccgccgccggcgcccgtctactcgccgccgccgcccgaggccgtctacccgccgcccacgcccaccgccgactgcccgccgccccccaccgagggctacacgcccgcgccctacacgcccacgccgtccacaccgtccggcgggtacaccccgacgacgccctccggcgggtacaatccgactccgtcgggtggcgggtacaaccccacgccgtccgggtggttcacgccgcccaacttgccgtcgtacctgaccccgccggggccgctctacccgcaggaccctgggttccggcccaacgncnnnccgngcgnntccacgtcatggcgcgnnnnnnnnn

SEQ ID NO: 16645 - DNA, 888 bp, Triticum aestivum
  unsure (1)..(888): unsure at all n locations
  Clone ID: PAT_TA_16645
acaaccgcagccagcgtgggcgaggagctcaactactacgtngtcgtggaaactacctcgctggagccgagccccgtctgccaaggtcacagggtgagcccatcgnncagcggcagnggcaaccttaccggcggcgcctgggtgccgttgagccatcctaatggtccgtgctccgaggcaggtaacagtggcgcgccttggtcattcgccggcacgacgctccagtgggaccaagcaccgcgtccggttacatccagagggaagctcttccggcgantgagcccgccggcgacgacgacgaaaccgcccctttcagcaaccccaggcatccggggtcactagcgagcccgccgcaaagtttgctctgccagctggaaatcaggggaagtccgaggtcactccgacggccacggtcggcgggggcagtctgcccggagtgacccaacacatggtgatcgacacggccagcgacgtgccgtgggtgcagtgcgcgccctgcccaaagccgcagtgccaccctcagacggacgccacgtacgacccaagcaagtccaccacctatgctcccttcccttgcagctcgcccgtctgccgccagctcggcccgtacgccaacggctgcaccggcgccggcaacaccggccagtgccagtaccgcgtccagtaccccgacggatcatccacctccggcacctacatctccgacgtgctaacaatcacccccacccccgccggcatggtcagcggcttccgcttcgggtgcagccacgccctgcagcgacccgacctcttcagcaacaccaccgcncgggatcatgtcgctcggccggggcgcgcagtcgctctcgtcgcagaccaagggtacctacggccacgtcttctcctact

SEQ ID NO: 16646 - DNA, 859 bp, Triticum aestivum
  unsure (1)..(859): unsure at all n locations
  Clone ID: PAT_TA_16646
ttaccaattcctccattatcaaaagagattcctatgaatccaatgaacaaagtgaaaagtagtaatataagaagaggaaataacatagtatttcccgtttcatgcggataggcaaaagtgtttttagccccaaaagacgtantaaaggatcctatccgctcgcgggtattaccttgaatttttgngtatagttttgtgaaaaaaaagaaactccactcttcgttgttgataaaacgaaatccctattctctccttgtggttagcgtggtcgcggccgaggtattgaatacaaggaactctctttagtgctactgtaattttgaaaatgaacacgcaaatacccatcaaatgtaagtaaatatatccgaaacatataaaaggcagttaatcctgcagtaaaggaggctattattccaaaaaagggcgaatacaaccaactattactaaggatttcatctttggaccagaagcaagcaagaggtggaataccacaaagagaaagtgtaccccataaaaaagtagttcttgtgattggaatgtattttcttaaaccgcccataagaaccatattttgacttttatctggtgaatatccaacaagaggttccattgaatgaataacggatccggatcccaagaacaataaagcttttgaataagcatgagtgatcaaatggaataaagcagctttgataagaacctatacctaagagctaacatcatataacccaattgagacattgtagaataggctaagcttcttttaatatctctctgagcaagagctaaagtagctcctaagaatagtgttattgtacctactaaagaaataaaactcattatcaaaggtaaagatatg

SEQ ID NO: 16647 - DNA, 910 bp, Triticum aestivum
  Clone ID: PAT_TA_16647
gcacgagggtgggtaacccaattgaacctgccatcccagctgtggaatctactgatgtgatggatacaacgctttctcctcaggtatctgttgagccagataataatacctataacagtaatactgaaggttctgtggttaactcaagcacaaagcgagatttgttgtcttcttggattgaatccattgcgtcagaagctaaaaaggatcatcaaccatgcaaatctactttaccttctattagtttgccagtcttagcaccaaaggaggatagcaggagagcaggattggactcggctggaaaccctgtggggaagtctcctcagatgaatggtacaagctctatgcctcccaaggtagctcctaaacaggcgaatttgcccagttcatcccgagagcctcctcgtgtaagttcaaatccaaggcacaagacatggcatcgtggtgacctgacatcttctacatctttgcccagttcacagccttcaggattaccacctaaacaaccaccaaggaggaatgacaaaactcaaaactcttatatacgcaagggtaacgcccttattagaaatccagcaacaggaaaactttctcattcttctagcctggatactcagaataagttgaataagcctgtgatgaggagaagcatgaactttgtcaggaaagttgattcaaatgattctgcagcacgtttgagctttacagttgaaagacctaagactcctcctttaccacttcatgccaaatccatcaattcaaccacaaaccttccagagcagttgtctaaaactttgcccaagcagcatgttcctgaaactgagaaagaagattcggctaggcaattagactcaggtgttgataccccaagcattaaaagtgcacaaacacctgaaccctcagatgctag

SEQ ID NO: 16648 - DNA, 924 bp, Triticum aestivum
  Clone ID: PAT_TA_16648
cagcgtcaccgccgcctccgccgccttccccccggccgtctcccgcccccgcgcgctctgcgtccaggtccccggcgtcgtcccccccgtcttccccgccggcccccccctgctcttcggcgacccgggccagctcggcgcccggcccctctgccgcccccgccccgccgccagcctgtaccccgtctcgttcgtcttcccgcggcccctctccctcctccacgcgcactacttcaagaccccgggcgtctccaccaccgacttcccggcccacccgccggtgcagttcgactacacggcgcacaacgtcacccagaccctgtggcagccggtccccgcgaccaacctgtaccagctcaggttcggctccgtggtgcagctcgtccttcgggacgcaaccatcgtcccgcgacaaacccacccgttccgcctccattgctaacctggcctcgtcctagctgagggcttgggcaacttcgacgccgagaaggactccgcgaagttcaacctcgaccacccaccgcagcggaacaccgtggcggtgcccgtgaacggctgggcggtcatccggttccgcgccgacaagcccgggggtgtggctcatgcattgccatctcgatgtgcacatcacctggggcctggcaatggcgtttctggtcgaggacgggtatggcgagctacagtcactggaggcgcctccagttgatcttccaatgtgctaatgaccggcaaagatacaaacaccagggatattgaaggctgcccacacgttctattctcagttcctgccatttggggggtatttgtgatctttattttgtacttctactaggggttttgattttccaccatgatttgtaacattcccctgtaaatttgcgtattttcagtgattcaaaaaaaaaaaaaaaaaaaaaaaaaaaa

SEQ ID NO: 16649 - DNA, 684 bp, Triticum aestivum
  Clone ID: PAT_TA_16649
ttcgagcggccgcccgggcaggtaccgtcatgctcgcccgccccgccgagcacttctctgccacccgcgacatggccggcttcaagcgctatgttgtctacttgttcgacgccatgtgtgccaggatccctagagggcaggagaagtttctgtgcgtcgtggatctaaaggggtgggggtaccccggccgcgacctccgcgcctacatcgcggccatcgagatcctgcagagctactacccggagaggctgggcaaggcgctgatgatccatgtgccctacctgttcatgaaggcgtggaaggtggttcagcccttcatcgacgccaacaccagggacaagttcgtgttcgtggacgacaagagcttggaggagacgctgcggcgggagatggaggacggccagctcccggagatgtacggcgggaagatgcccattgttcccctcgagtagagtgaggaggagcacggaggaggaatcgatgtacctgaaacaaattaaccacgcgcgatgtggatgtaaccaggggagtgagacgagcgcagcttgctctcactctcttgcagcgttgtgactgcttcgtacgtgtggccagcccagccggtgctaaagtcgacggatcgataatacggaagaactctatggtacttagtggtaggtatatcggattatgtctggtcacgtg

SEQ ID NO: 16650 - DNA, 501 bp, Triticum aestivum
  unsure (1)..(501): unsure at all n locations
  Clone ID: PAT_TA_16650
ctagtctcgacgtccgcggacgcgtgggtttttttttttttttttaaagagaacaggcaagcgccattgggttattttctgtacaaaagtacgctgataaaaataatcaaaccctgatcatctcatgcagaatgagtaaatggacaatctctggtaacatcacaagatttcttaactttggcatgaacaaaccttcaacaccgagtaccatataatccaatcacgaaaaaaaaagcatagctgggtaagccctaatgaatgagctagcctggacaagatgttgcaatgacggacccctcgcataatgggccctgctctgtaaggaaagtacagcccctttcttgatgaaatgacgttgtttcgtcgattccatggctttaatgcccaatcactattctgggatcttgtancagacatgctgctgctacgtcccactcctgtcagtnangcngattaccagagtgncccaagttctggtcattgntcancnagtgattncgg

SEQ ID NO: 16651 - DNA, 382 bp, Triticum aestivum
  Clone ID: PAT_TA_16651
cgtccgcggacgcgtgggcggacgcgtgggcggacgcgtggcgtcagacctcatactagatcaatcgaatcgatggggatctaggtagctaattcttgatcttcctggtttgcttatctgcaatttcatggcgcacaagatccagggcatcatggtgtgaagaaaacaactaattaatcaagaaagctttgctagctagccaccaagaagaagaagagcagatcaagaaaggagcagagatcagttaggttaggtgcagatggccaacaggtggtgggacgaaggccggttgacggaggcgccgcctgcatcaggcctcgccagcaaccagaaccagaaccagaaccagcagcagcagcagctggaggacgccatggcggcg

SEQ ID NO: 16652 - DNA, 1853 bp, Triticum aestivum
  unsure (1)..(1853): unsure at all n locations
  Clone ID: PAT_TA_16652
tatcgactcccgctccacctcgatgctcctctcctcggaacccttgcgtctctgtcccccttcccaactactcctccacctcgatcgagagaagctcggatccccggcggagaggagaggagaggagcccactttagctctcggttgcgccgcggctatggggagcctgcgaggcggaagcggcggagagggaaggaacgaggacggagggaaagtagggctaccggcgttggaggtggcgctcgcgttcccgcaggccacgccagcgtccctgttcccgcccgccgtgtcggactactaccagcttgatgatttgctgaccagtgaagagaaggcgcttaggaagaaagtccgtgctatttcagagaaagaaatcgcacccattatgaccgaatactgggagaaggcagaattcccatttcatgccattccgaaacttgcaactcttggcttagctggaagtacaacgaagggatatgggtgcccaggactctcgcttacagcgagtgccgtttctatagcagaagttgcacgggttgatgcaagctgctccacatttattctagtgcactcctctttggcaatgtccacaattgccctttgtggatcagaggctcaaaagcagaagtacctaccatcgttagctcagtttaaaactgttggttgctgggctttaacagagccagattatggaagtgatgcaagctccttgaaaacttcagcaatcaaggtacctggcggttggcaattagatggccaaaagcgctggataggtaacagcacgtttgcagatgtgcttgtaattttggctaggaatgcagacacaaagcaactaaacggattcattgtgaagaagggagcgcctggtttgagagccacaaaaattcaaaacaaaattggacttagaatggttcagaatggcgatatccttctgaataaagtatttgtcccagaagaagacagattaacaggcatcaattcatttcaggatataagcaaggtcctagcaatgtcacgtattatggtggcttggcagccaattggcatatcgatgggcgtctacgacatgtgccatcggtatttgaaagaaaggaagcagtttggagctcccctggcagcctttcagctcaaccaagaaaagcttgttcggatgcttggtaacatccaggccatgctccttgtcggctggcgcttgtgcaagctctatgagtcaggcaaaatgacaccaggccatgctagtttgggcaaggcatggacgtccagcaagtcaagggaggtagtttctctgggccgagagctattgggcggcaatggaattttggctgattttctagtagcaaaggcgttctgcgatctggaaccgatttactcatatgagggcacctacgacatcaacagccttgtgaccggaagagaaatcaccgggatcgcgagcttcaaacctgctgcggtagcgaaatctcggctgtaattcttcttctgcctccagctatgatgaacagcaaagtatgacccccaccttgtattctggtgggtacgagtaagatcggaataagtgcaaccgaatgatcaaatgtaatctgtaaagcgaaagaataaagtcggagctggatttgtatctatgtaatggtacagcatatggagtctaacctctcatgaccagtgtttgtgctgtggggggtcgtaccagcttctacataatggaattgtgcagtttaggagaaaaaaaaaaaaaaaaaaatattacccctgatacgcgcccgtgnagcttgctttaaggnccgatcatgtanttgtatggatgntacattacgcctccccccnccntttaccgaaaggaaggggttnanacc

SEQ ID NO: 16653 - DNA, 747 bp, Triticum aestivum
  Clone ID: PAT_TA_16653
attcggacgaggcggaccaccagctcctgcctgatcttcctcctggcgctcctcctccccctcgccgcggtcgccgtgccgcgcagacaccgctttccgtcgctccagctcgccccggtcaacgcctcggagccacccaccaccttcttcgaggtggaccgcccgatccagccgccgcgcggcagcgtcgggccctgctccgcgctgctcctctccgactccttcggctacacctacggccgtcctccggccaccgccgcctacgtgccgcccgggtgcctcgccgccgcgcgcgcccggggcgggtcgctcgcgctcgcggtgctcgagtggagcgccgactgccgcggccgccagttcgaccgcatcttcggcgtctggctctccggcgccgagctcctccgcagctgcaccgccgagccgcgccccgacggcatctctctggtcggtctcccgcgacgtcacgaggtacgccgcccttctctccgagcctggcgaggtcgcggtgtaccttggcaacatcgtcgacagcacgtacaccggcgtctaccacgccaacctcaccctccatctttacttccaccccacaacgccgtcaccgccgccgccgccgccgcacgccgacttgatcctgcccatctcgaggagcctgcctctgaacgacgggcagtggttcgccatccagaattccgccgatgtgcagtcgaggaagctcgccattccgtcgaacacctacagggcggtcct

SEQ ID NO: 16654 - DNA, 484 bp, Triticum aestivum
  unsure (1)..(484): unsure at all n locations
  Clone ID: PAT_TA_16654
gcacgagcgccagacgcgcgagaacctccgatcgaagcaataatcgagccgagttaggatccataacccatcgtccatggagaccgccaccgccacccaggaccaaggcctcacccgccgcgccgtcgggggcgtggacgccgcgccggcgcggatgcccggttccggcgcccgcgccaccagccgggacccgaagaggaagctgggccgcgccaagcggggcctccggtcgctcgcggccgccgtcacggtctcggccgcgctcaccgcggccgccttctacgcctccggcgccggctcgtcctcggggacggccaaggcgccgtcggccgcaatggtggccatcgcgcgggcanggtcggtggcggcggaggccgtgatggcgctggcggcgtggatggtgtgggcggagggcgggcnnnacgggcgnnncgcngcgacgctggcgccgttcgcggcgcnnntcctnnnnncngnnnnntgn

SEQ ID NO: 16655 - DNA, 781 bp, Triticum aestivum
  Clone ID: PAT_TA_16655
gcccggggcgcgcgtcggggcggcgagggagcgggagaacacgctgctctcattcggccgcgccgccgagcacgccgccgtcgccttcgtcgagttcgacgtccaggttacaaaagatggctgcccagttatcttccacgatgcggctcgccgcacccaaaaaactgaggttttgtatgaaaggcgcgtgaccgatcttcttctggacgaattcctttcatatggggtacaaaaagagccgcacaaggtctccaagcccctacttagacggatggaagatggcagagtccttgcttggagcaccgaagaagatgattatctctgcacattgcaggaagtcttcgaacatgtcagtccccatctgggatttaacatcgaactaaagtttgatgacaacattatctatccgggcgtcaaccttaaccgtgctcctcaagctgtactgcaagttgtttttcagtatgctggcaacagaccaccctttttctcaacattccaacctgatgccgcacggttaacacgtgccctccgtagtctgtaccctctactgttcggggcagaccggcgcactgccgaacacgatgataggagaaggaactcactcgacaatgctatccaagtgtgccaagagtatgagcttgcatggggttgtgtcagaagtcagaggagttctaaaaaatccctctgcgatcctaaaagcacaagaatccaaccttgctattctcacctatgggcagctcaataatgtgcgggaggctgtttacatccagtatctaatggg

SEQ ID NO: 16656 - DNA, 591 bp, Triticum aestivum
  unsure (1)..(591): unsure at all n locations
  Clone ID: PAT_TA_16656
cgagctcgctcccctctgccgtctccaaactctccaccacccaaaccaaatcctcgccaatggcgccactactcttccaaacccaccgtccggcgcaaaccttcgccccgagcccgcgcggcaaccgccgccccgctcccgccgcgccccacgccgtcggcttcctccgcgccctcttccctgcccggccgccgccggccaaggccgagctcctccgcctcatcgccgaccagggccgcggcctcgaaacccagtccgacccgtcccgcctcgcggacatcgtctcctgcatagacgccctcgctgcctccgccccggacgccgacaccgtgtcggacgccgccaagctctccggcacctggcgcctcctgtggacgaccgagcaggagcagctcttcatcgtgcgcaacgcccccttccgcccgccgcggcgcggcgacgtgctccacttcatcgggagctcacatggatgacttcacaacctcagcttctctgaaggccatgacaccaacaccctcaacaattcgataaagtcatgtaagggggaantggagtcttcgcattggaagtgttntatgtcattgacataat

SEQ ID NO: 16657 - DNA, 493 bp, Triticum aestivum
  Clone ID: PAT_TA_16657
attcgcccctgccttccatccatccccgcttcaattctgctgtcgctcgctccctacaccgcccccatcccagtcggtcgtcacaaaaagtccaggccgatcgccaaggggccatggccggcgctgcatccgaggcgaataagggcgagatgcactccgtacctgttggcctcgaggcgaataaggaagggatgcagcccgtggccggcggtgccagcgttgatgaggacaacgcctggatgcagttcatctccgacggcgcctggtacaccagcgccgtcgcgcgagaggataactcatggatgcagtttacctctgacgtcgcctgggtgcaccagagtcgccgtggacaaggatggttccttcctgcagttcatcttcgacgacagcttggtaccgcagcgccggcgacggacagggaacgacagagaaaagtaaagaatagaatcaaaggactcccattcctccgtgtataggttgatccttaagtcat

SEQ ID NO: 16658 - DNA, 747 bp, Triticum aestivum
  Clone ID: PAT_TA_16658
attcggacgaggctccacactgcagtccatgaagcctcgttagtttatccgatccagtagccttccctccccgtgccatagcttcttgcaagctctccttcctcctcctcctcttctgcattcgcttgtgtttccgctccggtcgcttgtctgtccgccgcctggacccctggtcgatatccctctcctctggcttcggccgcctgtgtgcccttgctgcgggcggttagtgccggtgggtggcgcgggtggtgtttcgcgtggtttggcttggtttggtttggagggcgatgatggaaacaaacgagggctcgctcgccgaacctaacatggctcactatgccttgatgatcagaaatcgtgatgtggactgagttctccgtccacgcacgcattttctccttctttctcctgagaacacttcagaaactctgttttgtcggcacttcctatacctctctgtgatgtcgttcttacggagaattggaccacaatccataagttttccgtttcagaaatttgcagggactgcatggggtggataaaaaactatcgaaaaaactactcctcggcttttattccgcctgcttttgtttgtgaaaataaatctgcttgaacagatccctgcgattcatggcgatgcggtcaattctgaagaaaaaaaagatgctaattgtgatcctcaaaaaatatctttatgtgatcaaagatactcaaccttttttccatgcaggtttcttctggtct

SEQ ID NO: 16659 - DNA, 777 bp, Triticum aestivum
  Clone ID: PAT_TA_16659
gcttgcacatcgcatcacgtcaccggagccagctacgggcgcgtgggacagcatggaggggggcggcgaggggaagggccgggcggcgccggcggcggggggagggttcggcgggtacgagtcggccggggaccgcaagtggtggccctggctcgtgcccaccgtcatcgtcgcctgcgtcgccgtcttcgtcgtcgagatgtgggtcaacgactgccccaggcacggcagtgcgctcggcggcggctgcgtcgcgggcttcctccgccgcttctccttccagccgctccgcgagaacccgctcctcgggccctcctccaccactttggggaaaatgggagctcttgactggaacaaagttgtccatcagcaccaagggtggcgtctcattagccgtccgcggacgcgtgggcggccaagtgggttggttgtgaacatgctaagtctgctgtttattgggattcgtcttgagcagcaatttgggttcgttcgcattggcgctatctatctactgtctggtttcggcggcagcgtaatgtccgcacttttcctacggaataactacatctctgttggtgcatctggagctttatttgggctgcttggatctatgctttctgagctgcttatgaactggacaatttattccaacaaggttgcagccataataactcttctgtttataattgcgatcaacgtggcgatcgggatactaccgcatgctgataacttggttaaatgggtggattctggccggggttcctttgggggttggtt

SEQ ID NO: 16660 - DNA, 1199 bp, Triticum aestivum
  unsure (1)..(1199): unsure at all n locations
  Clone ID: PAT_TA_16660
ccgccccgccccgccgctcctccggccctcctccttcctgccccatccttccatcctcggcttgcacatcgcatcacgtcaccggagccagctacgggcgcgtgggacagcatggaggggggcggcgaggggaagggccgggcggcgccggcggcggggggagggttcggcgggtacgagtcggccggggaccgcaagtggtggccctggctcgtgcccaccgtcatcgtcgcctgcggggtttgttcggttgtgcggatgtgggttaacgtctggtttcggtggcagcgtgatgtctgcactcttcctatgaagtgcttacatctctgttggtgcatctggagctttatttgggctgcttggcatctatgctttctgagctacttatgaactgggactatttactccaacaaggttgcagccataataacccttctgtttataatcgcgatcaacgtggcaatcgggatactaccgcatgctgataactttgctcacattggtggattcctgaccgggttccttttggggttcgttctgctggcaaggccacaattcggttggttggaacgcagcgagctgccccataccaatcagccccccaagtacaaaccataccaatatgtcctgtgggttgtggcactcgtcttgctgcttgtcgggttcacgctttcgttggtgatgctcttcaagggcaagaacgggaatgacggctgccactggtgccactacctgaactgtgtgccgtacgtcggaggtggaagtgcgatacctaggcggttccttctttcggttttcggacgtaaaacccgtagtgttgtgaggacctttttcatgcctgtatgtttgtagatagacacttcttttttaatgaactctgtgagttttgtcacgccacttctctgtcagtgtgtaaatcgagcagtctgcaagtgattccatgcgtgtttttgtgtaagacggcttatccttttgacactacctgaaaaaaaaaaaaacgtcgaggtggaagtgcgatacctaggcggtcccttctttcggttttcgacgaaaacgtgtagtgttgggaggaccatttttcatgcttgtatgtttgtagataggaactgtggtctgttaattaagtttgttcgttagtgaattctgtaaatttgtttgccaggccctgtaagtttgttactcgagcaccccagnatttc

SEQ ID NO: 16661 - DNA, 1614 bp, Triticum aestivum
  Clone ID: PAT_TA_16661
cgtccggaaaaacaagagggtacggcgagaacggcggcggcgccacacttgccggcgatgtacgcggaaacggagcccggggccgccgcggagcgcacggcgttccggcgggccgagaagcagtacaagctctacaagccgcccagtcgcaagggcaggtcgaaatccaggggcaagccagccgttggtggcggcggcggggacctgtccgcggtggtcgacttccacgcgctgcttgctgccgggggagaaggcgagctgcccgccgggatccggaggtgcgaccgcgcccggcttccacctgcccgtgttctgcttcctcgaccggccgggattctatttcatccctggtgctctatctaccgaggaacagtgctattggatcagggaaagcttgaaaacattcccccagcctcctaatagaaccaacttgactgctacatacggtccaatttctgacttgctcattgctgctaaaaaccagaagattttggttgaagtggaaagttccagtggcaaaccaagagatgagcagaataatgttggggaaaatgcacatccgggtaaattcaaatttgtggatgactcagagatccaaaaggaggaaagacctaagtcgaccatggcagctgctcttgtgcgcaagctccggtggagcacccttggcttgcaatttgattggtcaaaacgtaactatgatgtatcgcttccacataacaagattccagatgaccttgctactctagcaaaaaagatggccgttccagcaatgccttctggagaagaattcaccgcagaagcagccatcgtgaactattatggtccaagcgacatgcttggtggccatgttgatgacatggaagcagattggacaaaacctattgtgagcataagtttgggttgcaagtgtatttttctgcttggagggaagacaagggatgaagctccaacgccaatgttcctgcgaagtggtgatattgtactgatggctggggaagcacgagagcgcttccatggtgtcccacggatcttcacagagggtgaccagcaagatatctctgggctggtatcagaactatctgatgatgatgaccgctgcacgtgggactacattcataattcaaggataaatatcaacataagacaagtgtactgaagctactttagttattactgaaagtttgctctcctgccgcctcccgggcgaccacactagatgtgcaatttgtttgtattaactgcgtctggagtttgtttctgaaatgttgctggaagatggggtaacttattgaccgggggaagcgttcatcttccttcaaagggtaggcctcccatggacagggcatttttgatagtttcgtaccctcagcgagaccccagttatcattaaaagaatcctgctaatgcgacagattgtaaatcacttaatggcttaatgcctgatgtatgagaagttgttcatcttgtgtactcttttccagaaaatttacttgccaagatctccgtctgttgattctttgaacaaaaacgtaccttctgctgtgcagatggacaagctaaaatggtcagatgtgttcatatttttcagcctgtaatacattgaatacagtgtcc

SEQ ID NO: 16662 - DNA, 784 bp, Triticum aestivum
  Clone ID: PAT_TA_16662
ttgacactgttaattaacaggaaaaaaagtgtagcacacgcgcagaataaaagagtgaacggcggcgaccgactccggcgcgccgacgcgccaccaccacccgttgactccggcgatgccgccccttttcctcctcctcctccccgtcctcctcctcgtgcacccccccttcccgcaaggccgccgccgccgctgccgaggacatctgcatcgtcggcagcggcatctcgggcgcctccacggccttcttcctcaccaactacaccgcccccgacccggccccgcagctccgcgtcttcgagcgccgcgacagggtcggcggccgcctcgccaccgtcaccgtcgccggcgaagtcttcgaggccggcggctccatcatccacccgcgcaacctccacgtgcgccgcttcgccgacctcctcggcctcgccgccaagaccggcggcgacaacgacgaggactggctcgggatctgggacggcgcccgcttcgtcttcaagactctccgcccccccccgccggggagctcctggctgcgccgcaagctccacggcctcgccaactcgctcctgctgctcaggcgatatggtctctcgctgctcaggatggacagcttcgtgcaggaaatgttgcaaaagtttatgctttactacaacggattcgagtcccggcctgtgttcgacaacgttgaggagatgctcaaatggtcaggcctctatgggctcactcgcaggaccctagaggacgagctcattgatgctgggctgaatactcaaactatatc

SEQ ID NO: 16663 - DNA, 679 bp, Triticum aestivum
  Clone ID: PAT_TA_16663
gcacgaggctcgtttaaagctcaacctccgcccggggcgcatcacaccagatgcggtggtggctgcaccgcctcgcggctgcagtggccttcgtcgccgccgccctggccaccggcgccgcggtgctgcggccaccggcgccgctgcggttcgggccgggcggccggttcaaggtggcgctgttcgcggacctgcattacggcgagaacgcctggacggactggggccccgcgcaggacgccgcctccgaccgcgtcatggccaccgtgctcgacgccgagaagcctgacttcgtggtgtacctcggcgacctcgtgacagccaacaacgtgccgatccccaacgcgaccctgtaccgggacagggcaatttctgcttcccgacgcaggggcctcccgtggtccaccgtgttcggcaaccacgacgacatgcccttcgagtggccgccggagtggttctcccccgccggcatcccgcccgtgcactgcccacctgccgcgtcagggtgcagcttcagaggaacgccgcgcatcgagttgatgacggccgagctcaaccgcgacggtgccgacgggttatcgcgctcgtcggtcggcccccaggagctctggcccggcgtctccaactacgttctgcaggtgctctcgcacgagaagcaacaagaccctgctctgctcat

SEQ ID NO: 16664 - DNA, 733 bp, Triticum aestivum
  unsure (1)..(733): unsure at all n locations
  Clone ID: PAT_TA_16664
cgtccgcccacgcgtccgcggcgcaaagaagcctccagctccggccgctgagccaaccaaaacggaagccatggcgaccacgtcgaccaccccgttccaccgtctcctcgccccggcccggtcgaatcccgccgcgcgcctctccctctacacccgcggccctcccatgctctctttctcccgctccatctccgtccgccgaagtctcgctgccgcatccaaggacaccgccagcgacaaggggcaagaacaagaatcgtccacggcagcgggcggagccgcggagcccgcagaggaggaaacacctccgggtgaaaagacctcagatgaagtggcgacggagcttaaggaggtgatgcgtgcgcgtaaggaggcggaggtcgccaggggcggcggtgggtggtgggccggggtggcgcaggagatgacggagatcgagtggccggcgccggggaaggttctgggcaccacgggggtcgtcctcgggatcatcgcgggatccacggtcgcgctgctctccgtgaacgcgatcctcgccgagctctccgaccgtgtcttcgctggccggggccttcaggatttcttctaagggtgaagtggcatcaatttgtctccgtttatatttcgagaattcagataggcgtattgcaaggttgatagattgaaaatggctgtgttgctgcaagagaaatatgatacgctgttnccgcagacaattgcattgtgctaacat

SEQ ID NO: 16665 - DNA, 1334 bp, Triticum aestivum
  Clone ID: PAT_TA_16665
gaggcagcagccgccccaccaccatgctcgaaatccgatacatggtcgacctgacaccatcacaagcagctgtaggtgtggttcagaagggattgcggtcccacaataccaaaaaatgctcatgcaaagcttgcggagctccttctgaagtgctggcagcaggaccctgctgaaaggccagatttctcgcgagaatattacgaagctcttaagaaaatagcacgaggaggttggtagatgagcatgacgggaagcacaaggacaaatccctggggggattcttttcgtctctgaagggggcgagggacactaaggtggcgcaaggtgtacatggtttgaaatccatttggacgggcctgagccaagatcagcgcctgtttttcagcataccccagtgccagtcaatagcataaaggtatcttcaagctccctgccttagttggagttgcaatggatgtgtcaaaatgcatgagcaacttgcaccaaacaaaaattattcatcgggatcttaaaacacttaaggttcttatggctgaaaacgtgagggttaaggttgctgagtttggagttgcacgtatttaagttcagtctacagtaatgaatgcagaaatgagaacatacgcctagatgtgggcggaggttatagaacacaagccctacgaccacaaggctgatgtttttagttttggaattttgttgtgggaactgctcactgggaagattccttacgagtacctgacaccattacaagcagctgtaggtgtggttcagaagggattgcggcccacaataccaaaaaatgctcatgcaaagcttgcggagctccttcagaagtgctggcagcaggaccctgctgaaaggccagatttctccgagatattagaagctctcaagaaaatagcagaggaggtcggagatgagcacgacggaaagcacaaggacaaaagcctggggggattcttttcgtctctgagggggcgaggacactaaggtggcgcaggtgtacatggcttgcaatccgttcggacgggcctgagcgaagatcagcgcctgtttatcagcatacccagtgccagtacattgagatggacagtgaactgggccggatggcaacttttcagctgtagctccactcatcggccacagccaatagttttttcttttgtctggttatttacttccgggttctgttacatgtaacataggaagagaatgcttgtggactgtacattgtttaatctgattttaacaggctttaacttgcacatgaaataataagcctagcttagggcgctaaataaaaaaaaaaaaaaaaaaaaaaaaataaaaaaaaa

SEQ ID NO: 16666 - DNA, 808 bp, Triticum aestivum
  unsure (1)..(808): unsure at all n locations
  Clone ID: PAT_TA_16666
gcgtctctccagaacatcaaccttttcttgctccgccatcgccgttgcaaagaaacagaaccaagatgcacggggccgccgccgccgagaagaacaagaagatacgaagggcgaggtggccgtagtgagagtggaagcagggccttgagatggacccgtgcccgttcgtgcgggtgctggtcggcaacctggccctcaaaatgccggtcgccccgcgccccgccggcgccggcgccggcgtgcaccccaccacctcgccgtgctactgcacgatccggctcaacaagctgccgcttcagactgccgcggccccgctgctgccctcggacgacatgacgcagggtcccgccgcgacgggcgcactggcggccgccttccacctctccaaggccgacctcgaccgcgtcacggccaagccgtccctgttcgtcgcccgatccgcgaggctcaaggttgccgtgtacgccgggcggcggggcaccacttgcggggtcaactccggccggctgctcgggaaggtggtcatcccgctggacctcaagaccgcggtggggaagcccatcgtgttccacagcggctggctctccatcaacaagcgcggccgtaaggcctctgccgtctccggctccgcgcagcttaacctcaccgttcgcgccgagcccgacccgcgcttcgtgttccagttcgatggcgagcctgagtgcagcccgcaagtgctccanggtgcagggtggcatgatgcagcccatgttcacctgcaagttctcctgtcgcagtaacagcgacctccgctctcgatcaatgcact

SEQ ID NO: 16667 - DNA, 708 bp, Triticum aestivum
  Clone ID: PAT_TA_16667
tcggcacgaggccccagtgctatccgcagcgggaccccttgttcgaccccagcacgtcgagcaccgccgcggccgtccgctgcagctcgcccgcctgccgctccctcggcccctacggcaacggctgctccaacacgtccgccaacgccgagtgccggtacctcatcgagtacagcgacgaccgcgccaccgccgggacgtacatgaccgacacgctcaccatcagcggcagcaccaccgtccgcaacttccggttcgggtgcagccacgccgtgcgcggcaagttcagcgacctcaccgccgggaccatgtccctcggtggcggcgcccagtcgctcctcgcccagacggcccgctccctgggcaatgccttctcctactgcgtcccgccggccagcgcctccggcttcctctccatcggcgggccagtgacgaccaactccacgaccgtgttcgccaccacgccacttgtcaggagcgccatcaacccgagcctgtaccttgtgcggctccagggcagtcgtcgtggcggggcgccggctcaggatccagccggtggtcttctccgccggggcggtcatggactcgagcgccgtcatcacgcagctgcccccccaccgcataccgcgcgctgcgccgggccttcaggagcgccatgagggcgtaccccgaggagcggggccacggggaccctggacacctgctacg

SEQ ID NO: 16668 - DNA, 890 bp, Triticum aestivum
  Clone ID: PAT_TA_16668
gcacgaggctaacacgccgcggatactcttttagccaggagacacagatctcacgccctctcgaggcactgcaagctcggcgacgatgatcggcgagatggacgcggacatggtcgtaggatacttcggcggcaagagcatcctcatcaccggctcaactgggttcttaggaaaagttctcgtggagaagatactgagggtgcagcccgatgtcaagaagctcttcctcctggttcgtgcccccgacgtcgaatccgcaaagcttcggattcagactgaggtcacagggagggagatctttctagttctgaaagaaaaacatggtatggggttctacgatttcatcgatgaaaagatctgccctttggcaggagacatcatgcatgagaactttggactagacactgccaacctgagagaattgtccaaggacatagacatcatggtcaacatagctgcgactacaaacttctctgaaagatacgacgtggctttcgatgctaatgtcttgggagccaagcacgtgtgcgcattcgcaaggaagtgtacgaaactcaagatgctgcttcatgtttcaactgcctatgtagctggtgaacaagaggggctaatactagagaaaccgttcttgatgggtgagacactaaaggagggcacacatttggacatcgaatccgagctaaatctgatcagagagaccaggagagagctgaaggctaactgttctttggagaaggctgagaggagaaccatgaacgagcttggcctcaaaagggctcggcagtttgggtggccaaacacatatgtcttcaccaaggcaatgggggagatgctgctggggcatctgcgaggggagcttcccgtggtcatcctccggccgagcattataa

SEQ ID NO: 16669 - DNA, 1046 bp, Triticum aestivum
  unsure (1)..(1046): unsure at all n locations
  Clone ID: PAT_TA_16669
ctcgtgccgaattcggcacgaggggcaaagcagtagtcaccagcagactgctgagtgctgacccctccgccgccggggacgcggccgcccacagcccacgccgtccggcgtagcgcgcttcgacgtttagcgccggtagacagtgggccccgggtgggcaggtggccaacgtcgttgcaacggtgcgccagatccgcaagcgccgccacagcaggcccagcagaacagcaaggagctggcgggagctcacccacactctgcccaacgtactgccctaactacaaatacccgggccggcgaaccgaccagggcagacggacacagtgatgagggaagctcaaggggaccctccgccgaagcgttgaccctcatccagtcctgccacgactgttactgtattctcccgtaagccggaaggccgccgaacttagatggggcttaaacgcgaaaggtaattgaaggtgggattgaaatcaaaaagatcaagcgaaggccatcacggtcatcaatttcatcaggacaagttcgcacaaatcacgtagcagctgcagcacctagcgcagtcccactcccagctcaaatttatgaccacggctcctactatcagtgttgggcacaaggaggaggaggtgcctcccggcggtgttctcttgcctccccccttcttcagcccgcacctctcaatgctcaccggactccggttccgtctccctaccttgcttccccagccccctcggcctcgggttataatctatattctttgtgcacccttccaaccgtcaacaagatctttgacagtatgtgtaatggattccgctagtgctagtcgttgcatctggggtgctattatctttctggatgacaaatctgtacccatctgtgcacttaatttgtgcagagactatgaatgataaataatttgttggcagcaaaaaaaaaaaacagccccggcggccgcgcgaaccccctagtgaattcggccccgcggcccccaanggngggacnggancaattccaacgtccggccnaaattncgcccctanaag

SEQ ID NO: 16670 - DNA, 902 bp, Triticum aestivum
  unsure (1)..(902): unsure at all n locations
  Clone ID: PAT_TA_16670
tcggcacgaggctgcagcgccacctcaagaaacgttgccatggcagaggcagaggcggaggggtcggccatgtagtggagcggcaccggccgaccggcggaggcggaagagttgtctggggatcgaccgatggtcgtgcacgtggtgctgctcgccgcgccggcggtcggcgggttcctcctgcacgcgttcaagttctccggcctcctgtggccgttcaacctcacgctgccgctgctgcgcgacctgccgcgcgtctgcgccacgctccggggcgccgcgtcgctctacgccgccgagctgcgcgcgtccctcgccggccgccggcggagggcgccggcgccgcagctcgaccgccagtacttctccctccgcggcgtgcggagacggccggcggaacggctcgtcgaccacgccatgctagccctcgttgacatctcctactgatgccgctgcgttgccaaggtggttgcatgccggagctgtttaattccggcggtgctcggtttggatggaaacgttggttcaagaattttctttgggatcatgtacataggcgttccatttttttattatcttttttcctgcatttgtcggctgcacttgttgtaactaatccaatgtcctgcgtaattacaccggttctttttggctatcctcaatattactccccgtctcaaaaataagcgaccaatttgtactagctttagtataaaatagtacaaaacgatcattatttgaaacggaggaatatataagataacaaagtgaatgttaataacaatgctattgcatgaatataataatacngatatattgatgtggtgatgaaaaaaaaagggggggcccggtaccaattcgcctaagtgagtctattacgcgcgctcacggccgtcgtttaa

SEQ ID NO: 16671 - DNA, 925 bp, Triticum aestivum
  Clone ID: PAT_TA_16671
agcaaaccgatcgcaatgccttgcgtgccagctccaatccccgcgccccgccccgcctccctctccaaccgcaatcctcccccgattcttccgagttcagttaccactgcccgtaccaccaccactacttgaacccgccgccgtcaatctgcgtcgggggtttagcagctccgcccgcccgtccccaaaggtccagcggcgaagagtaaaggagcctgcccggattctaagcggcgggatcggattccatcccttggataaattgccaccgatcggcttttttccttccttccttccgccggtgtgccggtgcgacggccgggtagcgagaggggaggtccgaggataggtggaactagaaggccggtactactggctcctccgtttggtttgcaggggaggggttcagtcagatgggggccatcatgtgctgcttacgcggccgcggccccggcgacgacgcgcctggctgctgctgcctgccatggcctttcctgaacaacgatcgcaacaacgacaacaacaacaccaatcacaactcgggccctcctgctcctcaaagagcgaatacacgggttgcgcctgttcagggaagggttcctcctgcgggttcacggcaggatgattcaatgaacaccttccgctgccctcctaggcctttgccttatgatgatcctcaattcagacatcaaacggagcgccacccgctggtggcaggacgtgacaaggcttcaacacaatcccagaaatctaatctacttgaagaaagcaatgatgctgataccagatcaacttgtgccgatgagaaggctgatggatcgtccctgaaagctgagtcgggaggtaaaaaactcgggggagctaaggtctgtgttccttctgattgtgaggatgactgtccaatatgcctagaagagtatgatta

SEQ ID NO: 16672 - DNA, 636 bp, Triticum aestivum
  unsure (1)..(636): unsure at all n locations
  Clone ID: PAT_TA_16672
cgtccggacagacgcgtgggacaagtcctcccccccctctccccctctcctgttcccctctcccgtcgccggcgacctcgacggcggcgtctccggcgacccaggcgccggccacgcctccccattcatccgatcgatagatatctcgggcctgggacctcttatcccctccccagaaccaccgcgcctcttcgctctgttcacaccctcgtcgtctagtgttccaaggagccaatccccagcgggcacgaagcgcctgggccgggtgctcgcgccccagatccagcgaccctcctgccatcgcggcctccatggacgacttccagggcatcctggcccgcgacttcggcctccgccctaaggggaaagctgcgcccatgtcggccgcccgcgccgcggcgtcctctggatccgcctgggacagcaccagatccgccgccgctgccgcgccatccgccccctcctacgacgatctcttcggggccccgtcctccgcgccgccgcccaagcccacgcagccgacctccatcgactccatgttcgactccttcgcggagccctctgcctcagccgcgccgcccaagcccaagcactcgtnnntgccccgtgttcgacaagccagtctannacgacann

SEQ ID NO: 16673 - DNA, 785 bp, Triticum aestivum
  Clone ID: PAT_TA_16673
ccgcgtgcggcgcggccgcgcgcgctcctattcccccaagtccgggcccctccgctcgccgctgcagccggtgcgacgggagatccaaaagggcagggctgcggttgaattcgaaaagaaggcacatgctgataaccttttacaaagtaaagcaatggagaaaaatatgattgccgtggctagtgagattgagaggcttcggggtgagcttgtaaatgctgaaaagcgggccactgctgtcaccacggcagcagctgtaactaaccctgggtatgctcaaccgtacagcagttctgaggcaacatatgccacaatgtatggcaatcccgaggcagcatatgcagcatatggcagtgctgaggcaacatatgctggaacatatgccaattctgatgcttatagcaccactaatcaggctcagactcgcactgatggcaatccacattacatgacccagccggttcactatgcgcagtacgagggccagcagcagcagcagcagcagcacaccaatgcgcaaagatgaacgctgactcagggtatctttgacctcgcgcgctaccttcttagggctttgccagtgtaaacgagtagatgcaggatgcaccgaattgaggctggcggagggatgaattcattttgcattggaggtgccaggagatcttgtttatacattgtcattggttaatcaactctgaaatgtctgtacaagtcgatagctcggagtccgcaaattcttgatgcagtgttgtcttgatcagcaatccaccagttagttgattgtc

SEQ ID NO: 16674 - DNA, 482 bp, Triticum aestivum
  Clone ID: PAT_TA_16674
cgtccgagcgcaacaaagcgatgacacgcggctgctaaacccaccgcaggcggagggaccgagactccgagaggcgcggagaagcagagcgagagagcgcgagagggagggcggaatggcgtcggcgggcgtggtggccgcggcggcggtggtggcggcgctggcggcgttctgcgcgacggacccgatgcggctgggctccatggcggacttcccgggcttcgaggcgcaccccgtggagctcccggacgcggcggagatgcccccgcacgcggacgccgcggagcggctgcgcggcgcggagatccggttccgcggcgaggtgcagggccccgagagcgtcgccttctacccgctcggccgcgggccctacacgggcgtcgccgacggccgcgtcctcgtctgggacggcgcccgctgggcctacttcgcgcacgcctccccgggctggaccgccgagcgctgcggcgggcccaaggcgt

SEQ ID NO: 16675 - DNA, 754 bp, Triticum aestivum
  Clone ID: PAT_TA_16675
attcggacgaggcaacaccctcttcctgctcgccgccgccgcctcggccgacgagcgcatccgcccctacactcgcaagtgggagtccagcgtcatgagcaccatcgacgagctgcgcctccgggccgtgcccgtccccgaccccgagggcgctgcacgctgcgacgtccggcacgacgtccccgccgtcgtcttctccaccggcggctacaccggcaacgtgtaccacgagttcaacgacggcatcatcccgctctacatcaccgcgcgccggtacaacaggaaggtggtgttcgtcatgctcgagtaccacgactggtggatgaccaagtacggccacatcgtggagcagctctccgacttcccgcccgtcgacttctccaacgacacccgcacgcactgcttcccggaggccgtcgtcggcctgcgcatccacgacgagctcgccatcgacgcgtcgcggatgccgggaagccagggcatccaggacttccggcacatgctcgacgacgcgcaccgcggccgcatcaacgcgatcatcgaggaggagaacgccgcgccacaagcggcgccggcggcggcggcactagcgcagaaacggcaacctcgcagcagcagcagcgacacggaggacaagccgccggctggtgatcgtgtcccggaacgggtcgcgcgcgatcgagaacgaacccgagctggcgcgcgcggcggcgagggccgggttccgggtgaccgtgctgcggccgcgcccgga

SEQ ID NO: 16676 - DNA, 1007 bp, Triticum aestivum
  unsure (1)..(1007): unsure at all n locations
  Clone ID: PAT_TA_16676
gacccacgcgtccgctgtttcgtctagaacgacgcccgcagaccgccccgctttcttcgctctctcgactgctcctccgccaccggagctccgcccgccggtcgtcctccgccccctgtacgccctccaccgcgcgagcctgtcccgtcccgccctatcttccgcgcggccccgtcccggccccgccttctcctcgccgcgccgccgtccgcgatcgccggggtgatgaacaagcgaccccgcgacgagccctcctcctccctcgcctccgcccaaaagcgccagttcggcgcaggcggcggcggcggcggctacgggggacaacaagggtactcggaggagcggaacagcgcgcggcgggtggcggaccactacagcgcccgatcgaatcagacgctcgaggagcgcgagaacagccccatcatccacctcaagaagctcaacaactggataaagagcgtcctggtccagctgtatgcgcgtccaggagactgcgttctagatcttgcctgtggcaagggaggggatttgataaagtgggataaggccagggttggctattatgtaggcgttgatattgcagaaggctcgataaaagattgtatgacccgttataacggtgacactgatcaacaacgaaggaagaagttcagttttcctgcacggcttatttgtgctgattgttatgagactcgtctggatgagtatctatgtgaggatgctccatttgacatatgcagctgccaggttgcaatgcactactcatggtcaactgaagcacgtgcaagacaagcccttgctaatatatctgcattgcttcgtcctggaggcacgttcattggaacgatgcctgatgctaatgtcattattaaaagactaagagaatctgaagggatggagtttnggaacagtgtttactgtattacctttggtgaagagtacacagaaaagaaattcccggcatccaggcccttttggtatcaagtacaaggttcatttagaggacg

SEQ ID NO: 16677 - DNA, 763 bp, Triticum aestivum
  Clone ID: PAT_TA_16677
tcggcacgaggctcgttagatccctcaccaggttcctctcatccacatgcgccatttcttccgatttgctgcgagcgattgagagatgtcgctgctggcatcaagtaatcgagccccatgctatcctgaatctagttgccacttattttcttttgaatttctcttccttgggtggtggcttaggtgtccggatgagtgcgtgcacgcgtttgatgcagtctctacgggtgcggatcctcacttacctcgtcgacactggcaacacggctacggtgagcgccaggcagaaagcgccggctgtgctgctcgacctcgtctagcggccgtggcagaggtgctgaaggttgggggcgcggaggagacggtgggggatctcacggaggatggggcgccgcttcgtggatttgcagaacgaaatcgtgctactgacttactgagttgttaccctcctcatttgtcgtgctgtcggactcgtactaaatttcccttggcgtgtgctgtttgggcgcggcgcccatctgtcgttcctgtcgccccagttctgccgcgtggctccccttgcgccagcgcccctgctcctgtctttcttggtggggtcacgtcgcgcgccgcctgtccggccctctgcctgcctcgggggccagttgggcggcgggtcccccgctgcggcagcgcttccgctccgcgtttcttggcggtgtcgagtcgcgcgccgggtctccccccgctgcccccctccagcttcttggttttggctgatttc

SEQ ID NO: 16678 - DNA, 833 bp, Triticum aestivum
  Clone ID: PAT_TA_16678
cggccggagcgtagccggaggagaagaaggcaagcgaccgggcgacgctgtccatgcccgggccgagctcgctccgcgccctggcccctccggctctgctcccgtaccctctggggacgagcgggtccgcgcgcccgtcgccggcgcaccgggcggcgcgggggatgatggtggcccggcggagggccgtggcggttgcggcggcggcggtggcggcggacgcggggtggctggagggggtgtcggagaaggacaggccactgaacacgcacagcacgccgtccaccgaggcgtcgctgagccgcgtctgcttcgcgcagtccccccgggaccgcgccgggtccgccgcccaagacccccctctgccacgcccgccccatgcctcgacgtcatcgacctccacgacatctacctgaaatacggccctcggcgcctggagaacggcacgaaggggataggaagcagcgccagtgtcgcccagggcatccaaaacaccgtcctcggcagactttgccaagcatgcatctctcccacaaacaaatcaaccctatccatcgatcgaacccccaaccctttctctctctaagcacgaccagccccctgcaagattccagtgtcaactgtcagcgctgtgtcactattctgctctgcaatactaatttcaacatggttaatctacacaagcgagataggattcagtgccagtgtcgcctctgttttcaggcagacctgtacactttcggctgagctataatcagtggaaatgagatcagccaagaactcggcagggttctcatgatctgggcactggtacctcggccgcgaccacgcta

SEQ ID NO: 16679 - DNA, 763 bp, Triticum aestivum
  Clone ID: PAT_TA_16679
agaaaacaagatcgttggacttcattgctatatgacccagagatctcagcacaagcttctgctcggatggttgagtatgagactgaactttccacttccaaccctgccaagctacataaacttgtcaactcgaaggcaaaagatttctcatttcagaagcggaaaatagagagtgtcaagaatttatactatgcgatgagaaagagagtatgcaatgaaccctgtaacaccaacgaccttggttttctcattgccccttgttcttgcatggcgattggcggggagtgtgtctgcggaggcgtacctaaaccttcacatgaccagcatgtagttcaaaatattgaaccagggatgaatacagtgagctgttatgggcaagcaggtggaagctacagtggtgcacaacagacgcatcctgaaataaatggccattctttccatgcacagcatcctggcagcatgataaaggcgcggggggccaccaataatgcaccatatgtctattcagatgttcaaatgtatgacacctacacgcaaaaagttcctgagcctagtgaagtgaacaatgtctctcttagaggtatcacagattttcaggattctatgcagtttcagcaattggcatctagcaaccaatgtggcaatgaagtagtagaatcaaaagaaatgttgattactgatcaagttggagttgagcacgtgcattttcctgctaataacagcggaaaaacaatctggaacggtgttgatgaaacaaacacac

SEQ ID NO: 16680 - DNA, 1534 bp, Triticum aestivum
  Clone ID: PAT_TA_16680
aaatcgagggtttcgagagggacatcagacgctgcgaagatggacggcgccggcgggatcttcgccgccgtcgtgtgcgcgctgctggtctttgccatcttccccctcctcctctggcgccgccgctccgatgccgccgccgcggtcgacaaccaccgcctcccgccccagccactccagggggagcgggtgcttcgtggcggcgctgcggcgcgccgcatgcgtaggaggccagctgcggcgagttcgtcggcagcgtccaccagtcgtgatgttgcagatgatgagtccgggagcgaggaggaggatcccaatgtccctaaaggctccaagaaggaaaggaaaaggcaagagagggaagagcgggaggcgcagcgtcaggctaatgaagcagcacggaattcaaggagaactaatcaagaccgttatgaggaaatgagaaggaagaaggatgaggagcgtgaggcccaggagagattattggaagaagaagctatggcacggaaagccaaggaagaggaagctgctgctctggaatttgagaaatggaaaggggccttttcagttgatgctgaagggacaactgaaagtgagacgcaagatggtgggcagggtttgctccacaattttgtggaatacatcaagaagcagaagtgtgttccactagaagatcttgctggagagtttggaatgcgaacccaggactgcataaaccgaattattacggcttgaaggcatggacagattatctggcgtgatggatgaccgtgggaagttcatatacatatcaatcgaggagatgcaggctgttgcagactacatcaggaagcatgggagggtgagcatatcacacctggccaacacctcaaatgaattcatgcatctagggccgacccgggtttgctccgcaattttgtggaatacatcaagaagcagaagtgtgttccactagaagatcttgctggagagtttggaatgcgaacccaggactgcataaaccgaattattacgcttgaaggcatggatagattatctggcgtgatggatgaccgtggaaagttcatctacatatcaatagaggagatgcaggccgttgcagactacatcaggaagcatgggagggtgagcatatcacacctggccaacaactcaaatgaattcatagatctggagccaaagcccctgtacgatgagaaggaggagagccatcaagatgaaagcgccccggcaggcgtagttgcagaggcctgatgagtactcacggtcgagcttattgcccctgcaacaaagcatctatcgttttaatttctgtgcaagatcaggtacatgttttctagagatgttactatagtttgtgctaaccttggtggcggcttggcatctcggacttgacaagatcaaaaagggttattacatcatcggaaattcagagctgtgctgatttttttttttgaggggaaacgttgctgcctttttattgcctactgagagctgggtgctgatacaatgaaaggtttcatataaaaaaaaaaaa

SEQ ID NO: 16681 - DNA, 835 bp, Triticum aestivum
  unsure (1)..(835): unsure at all n locations
  Clone ID: PAT_TA_16681
tcgaggccggnncgggccgggaacctctcgcctcgtcctccccacaattcccgaccctgccaaatcccaatcgcttttaacttcgagatttttatttattgtccgccttcccgtgggcgcagctgcctctctgccccggtgctgctgctgctgctcccctcccacccgccgcgcgccgccgacgcctccgccgatggaccgggaacaagtgacggagttcctgggccaggtgccgctcctgcagtgcctccccggctcctccatccgcaggatcgccgaggccgtccaggtcaagcactacgaacctggtgattatgtcgcccgtgaaggtgaacccgtggatggcctttgcatcatattggatgggcaggctgaagtttctgctcctgcaaacacagaagaagcaaaccgtccagactatgtgttaaataagtatgactactttggttacgggaccaatagttctgtacatcaagtaaatgttattgcggtgacaaagctgtcctgctttgtattgccaagtcaatatggacatctgctgcaaaccaagacaatttggaatgcagaagaaacacctgaaagccattcattgatggaacaaattttacatttagagaaattagaggttgatatctttcgtggatttactttgccagaagctccaacttttaatcaagtttttggaggacaattgattgggcaggcactagcagcagcatccaagactgtcgattgcctgaaacttgtgcatagtctgcatgcaatttttctaatagcaggagacaataacatgccaataatatatcaagtgcatcgngagcgtgatggaaccagc

SEQ ID NO: 16682 - DNA, 1687 bp, Triticum aestivum
  Clone ID: PAT_TA_16682
agcctgtcgttcctcctccagaacagctcttgcatatcccgatgacattggaaagagggctcactgttccccgctttctgacgccacatagctacccagctgccccgctgctgctgctgctcccgtcccgccccacggacgcctccgcagatggaccgggaacaagtgacggaggtcctggacgctgtggcgctcctacagtgactcctcggcttcaccccgcgccggatcgccgagttggagcaggtcaatcacaaccaacatcgtgagtagtgtgcccacaaacgtgaacaagcagatggctgttggttcattttggatggccgggctgcagtatctggtcctacaagcatagaaaaagcaagcactggcgactatgtctgaaagacgtatcattactttgatcaaggaggcgataattcggaggaccaagacaaccctggcaaggcgacaggcctgtgctgcttgatcttgagaagtgcattgggagggctacaacactctcgtacaccttggtgtccagtatttatatcttacagaggaaaccagggataaattgaattttatatttagcaatactgctccctgcttttatttgagaaattacactgatagaaaactgagatttttgtataggtttatggctatcagcgtttacttggcccatagctgaagcatcctatcctcgcaatcgccttaaacttgtgcatagcctgcgcatatgtgttcgaatagcaggagacaataagatgcccataatatttcaagtacgtcgggagcgtgatggaaccagctttgccaccagaaaagtggaggcaaagcagaaaggccttgttatgttcactttaattgtttctttccagaaggaagaattagggtttgagcatcaggctgcaatcatgcctgacgttcctcctccagaacagctcctgaatatggaggagatacgggaaagaagactcactgatccacggtttccgatgcaatataggaactcagctgccaagaaaaagtttgtaccttggcccattgaaatgaggttctgccaagattctaaatctcaacatgaaccaagcctgcattattggtttagagctagaggaaaactttcggatgatccagctctgcatagatgtgttgtagcatatgcttcggatctactatattcaggcgtcagcctaaatccgcaccggaagaggggtttgaagacatactctctcagtcttgatcactcgatgtggttccacaagcctgtgaaagctgatgactggttgttatatgtgatcgacagcccatccgcacacggtggtaggggattcgtcaccggacgtatgttcaaccggcaaggagagctcatcgtgtcgctgacccaagaggcgttgattaggagggccaagacacctgggcaaaccccaaggcctaagctttgagatgtgcagaagagccgtgcccgtactttaatattttcttttatcttatagtacaccgagacagctgtgagatttatgtataggagtacagcttacggcttgaatttggcacacatgcttagtgtgaatgattgtatccttgcatgctgattcacattcaggttttcctcttaatatgtggattgcaattgccatccaacatgcggcacagaatgtagacaaatgtccctcaaattcaaagttttatttgtccacgc

SEQ ID NO: 16683 - DNA, 620 bp, Triticum aestivum
  Clone ID: PAT_TA_16683
catctctctccctctcccatctcccctcgccttcttcccacagcgcgcacgcggcgcagccgagagagcacgcgaggaggagaggtacccggcgctcggagctcgcagggctcacccggaaccgtcgggcggcagtggcctggcctggccctggcgcgtgcgcgtcctgtgcgtccgggagctgtggcggcgccggctcggctgaatgcgatggacagctcgtagcggctgcttcagtcatgcactttctggcggtctaatctttccgaggacgtcggcaatatcgtatgccttactatctggcattggctggcttagatgtcgtttcgtagcatagctcgtgatgttagggatggtttcggtagcttgtcgagacggagctttgatgtgacaatcgcaagcctttatggtcttactgggcatcacaaggggaaggctcaaagttcattggatgacttccttgatccagctcctgtaattcaagagagtcggtgggcaagtcttcctcctgaactcctccaagatatcatacggagactggaggctgatgagagcacctggccatccaggaagcacgtcgtctgcttcgcggctgtttgtaagacatggagggaaatgtg

SEQ ID NO: 16684 - DNA, 485 bp, Triticum aestivum
  unsure (1)..(485): unsure at all n locations
  Clone ID: PAT_TA_16684
cgtccggcctcccaactctctctcagcaagtaaactcgtattcaaactagagggcaggtttactcgctccggagtcgagatcagggatggggggctgcttctccggcgacgtccgcggcggcacggaggcggtcggcgggggcgcgacgggggcggcggcggggcagggccagggccagggcgggccgaacgaggcgctcgaccacttcctccagggccacgggctgcgcggcctctacacccccctcgagctatctttttcaagcttccaagttgaaagatatggatgctctttctaagagtggattcctaatgttgggtgggtttacacaaaaaaatgggatgggaanggctacaaacagtattgggcccgcacttnaaagtgataattgaattcactgggaancattgtggatnnacaaaaggccantgataaatttncnattttgggatttgttcaaacccctcctatttcagggatnatt

SEQ ID NO: 16685 - DNA, 583 bp, Triticum aestivum
  Clone ID: PAT_TA_16685
tcggcacgaggcatagttcgtgtgaatcatgactttccctgcatttacctaatttcgctcaaaaaaagttccagttagctataaggattctttagaaaaaattctcagggactattgaatcaggggcgaagactcaaatgtgtagtgattctttagacaaaagccgaaaagggtctgattattgtgtctgttcagtgtccaccatccacaaatggctctatttaaattggagtatgtagttcattttagccgatgaacttgctggatcacctccattgcaggagtttagctgatatgtattgtatgcagatgattatgagcaagatgcaaggacacaaaaagcctgggatgcagaaaggttagaggcgagctgccgctagcgcacggtggcgtgctgcatctcccgtcggtgcttgccacaggagaactacatccctggcctattcttctatgcctcagctgctgcctctccaagcaatgccaaacctataggctataacaggttcaggaggtgtttatccaatgattcagtaacttaacattctaatttacttgtcttttgctcatgaggcatggtgtcttt

SEQ ID NO: 16686 - DNA, 681 bp, Triticum aestivum
  Clone ID: PAT_TA_16686
tcggcacgagcccgcggcccgctcgaagcacttttctccctctccttcgtcgtctcgctgagtgcccgcttcttaattaggctccgaggccatgggcagcagcagcaccctgtcgtcggtgcgcgagatccggcgcttgcagcgtgccgacgggcctgcggccatcctcgccgtcggcaccgcgaacccgcccaactgcgtgtcccaggaggagtacccggactactacttccgcgtcaccaagagccagcacctcaccggcctcaaacaacagctcaagtccttctgccagatgacctcaacggagatgcgctacttccaccacacggaggagctgctggacgcccaccctgaattcctccgccgcgacacgccgtccctggacgcccggctcgacatcgccgctgccgctgccccggagctcgcggcgtcagccgcagccaaggccatagccgagtggggccgtccggccaccgacatcacccacctcgtcgtcagcaccaactccggcgcgcacgccccgggcgtcgacctccgcctggcctctctcctcgccctccgcgcgtccgtatgccggacgatgctcaacctcaacggctgctccgctggtgccgcttccctgcgcctcgccaaggacatggctgagaacaaccgcggggcgcgcgtgcttgtggcctgcgt

SEQ ID NO: 16687 - DNA, 754 bp, Triticum aestivum
  Clone ID: PAT_TA_16687
gtcagagacaaacaaaaggaattgcaggatctaggggcttctcacaaggagtttacgggtctgatttccaacgcctggcggaaataaggagacgtcaagaagagagaattgaaattttgaacaagttggctacttttctgaacattttgacggatttgaagagcatttcttcttcaaaagctttccaagttctgaaggatcaactccagaagtcacaagcagagttggaccaatgccggacactattagagaaattacacgtcaataaggataaattgatatggcaagaaagggaagttaatgtaaaagttgatctgtctggaattcctcatagggtatctctcaattgtgagtcaaccattgcagttttaaatcagaatctgcggaaagtagttgatgaaaagaatatgcttgcactgaaacttgaaaaatcttcgagagaacctggtcggaaccaaatcatatcagaatttaaagcgctggtgtcatcactgccaggagaaatgggcgctatgcaaactgaattatccaagtacaaggatgatgcttcagaattgcattctttacgagctgaagttcgctccatttctgatattctggctagaaatgagcacactatcaacgaatcattatgtaggtctactcatgctggatctgaagtaagggatctacggtccagggttcatgaactaaggcaaacgaatcgcgagttaaagctctttgtggaaatgtataagcgcgaatctactgattc

SEQ ID NO: 16688 - DNA, 583 bp, Triticum aestivum
  Clone ID: PAT_TA_16688
tgccgcccgtccgcccacgcgttcgcggacgcgtgggcgcctttccccattccccccaccctccctctcttccgctcgctcgctccgggtctccctccttccctcttcacacccacctcacctcctctcctccctcttcgcgtgtccaagaaaggaaccaccaggcgggaacggcgtgagcgcagctggggctggagccggatcgaccccgttcgtctccagaggcggcggcacgggcgcaggagctccggatcggcgctcaagaagtatgctccagagcagcagctcacgttgctgatttcttctacctagacatactccagagcagcagctctgccctgtcggcgtgatctgcaatcgtcttcagaaaagacaacagtttagaaaggttgtcggcggcccaagctctgagcttcagcctgcatctagctagcgcagttgtcgtggagcttcatagtgaccatctccggcctctccggcctcaccgggcaccacaggggcaagggcctgaccacggcccgcctgcgccgcctcgccgggctcctcggccgcgagtgccgctgcgcgcgcctccctccggagc

SEQ ID NO: 16689 - DNA, 719 bp, Triticum aestivum
  Clone ID: PAT_TA_16689
tcggcacgagggtcaggtacgagaaagatatcttcttcgagaccaccgttctcatccaacttgggacatcgttcaattcggtctgtgcagggagcagcaacacgcacacgctttggatcgtggcgatagcagtccccataaccgtgctcctctgcggcttcttggcatgtttcatgtggatgagaaggcgaagaagaagagtgaccaatctctcagggagggtgaacataccaaccatgtccatggagatggagcaggtgctcaagctatggaaaatcgaagagagcgactccgagttctcgctctacgatttcgaccagatcgcagacgccaccaagaaactctccaacgactacaagctcggtcaaggtggctttggcgctgtttacaagggtgaactgcctggcgggcttgaaggcccaatcaaagaggtctctacgtgctccctgcaagggttgatggaattcaagaccgagatcaactgatcgccaaccttcagcacacaaccttgtaaggctcctgggctgctccccaagccccgaggagatgttgctccgatacgagtacatgcacaacaaaagcttggactgcttcatcttcgatagtgcgaagggggcgatactgaactgggagcggcgcttccgaataatcgatgggatcgcgcaggggcttctttacatgcacaagcattcccgcttgcgagttatacacagggatct

SEQ ID NO: 16690 - DNA, 1323 bp, Triticum aestivum
  unsure (1)..(1323): unsure at all n locations
  Clone ID: PAT_TA_16690
ggccgcacgcgcgccactccccctccgacggcgacgcagatccgccgccgtccgtggccgccgccgccccccgcccccgccgcccccccccccgcccccccccccccccccccccgcccgcccgcccccccggccgcgacgaggacgactgctacgacctcctcggggtgaagcaggatgccaacgcgtcggagatcaagaaggcctactacaagctctccctcaaacaccacccggacaagaaccccgacccggagtcgcgcgcgctcttcgtcaaggtcgccaatgcctacgagatactaaaagatgaagaaactagggagaaatatgactatgctgttgcacatccagaggagttcttctacaacactgctcaatactacagggcttactacggatataaaacggatactcgttctgtgttgattggccttcttttaattgtgtcagcattccaatacataaaccagttgacatcgtacagtcaggccatcgaaagtgtgaagcaaactcctgcctacagaaataggttgaaagcattggagtttgagcgaacaggaggaatttcaagcaaaaaaaagggcaacaagccgatggataaaaaggttgaagatgagcttagaaatgaagtcgacttgcaaattcagggagttcagaaaccttctgtgtggaatctctgtggtgtccaattgatacttctgccttacttaattggcaagctgcttatttggcaaatttgttggttttggagataccgggtaaagaaatcaccatatgcatgggaggatgcttgctatttgacccggacatcccttaggatgcctgctaacacatggcaaaatattgatgagtttacgaaggaggatctcgtcatgaagcgcctctgggagaaggccaacatggagaggcacatagcggaggcgagaagagggtcgaagcagcgtagaagatagcttctcttgtagcagctcaattttgactgaagattacgagatgaggctgtttaacagcatgtcatgtaggaggacaactacatacccgagtggaaagggaaggcatacatgagtcaggcctgggttcgtcgacccataaacatgggacattcatactgaagagacataagatacaggggattcttttaccatatcggtacaccatgggccgcagttatgttgtaatgataacatttcttacgtctatttggattctatagatacatctagttggacatcaaccggggggctccttgcttgtctcctccttggtttggttatcatgttcactgttgctatgattttgctgaaaanaaaaaaaaaaaaaaaa

SEQ ID NO: 16691 - DNA, 762 bp, Triticum aestivum
  unsure (1)..(762): unsure at all n locations
  Clone ID: PAT_TA_16691
cacctgcgcaccacataccacccccccccacccacccacccatcttctatcgatctatcgatccttcttccgtgcttccctgagcctcggccacggccgcgctcacgggcaccccggcaggcaagccggcaaggcggccccccttcctcgcctctcgcccgcgcaccgtgaccgcgggccgtgtgtgcctgccgaccgctccaacggcgactccgccataccgccacgctgcggatccccgcgacaaggccatcgacggcgtgaagggggtggacggcgagttgaggaggggcgtggaggagcctgcggaggggcgctcgggcaacaccgagggcgccgcggaggaagccgccgagggcgccagggaagggggcgcgcaaggcagggacttaggcgaacgacgcggacaaggagacggaggaggcgtcggacgacgccaagggaggccgcaagggccatcaccaagaaagccgccaccggggccaaaaagcaggctaactgagcgaacactaaggttactagttcggtttacatctctcaaatcatttccctttgtacgtaatgcatttacgtaattcggtaaaaaagataaaatagctgtttgttacaacaggaaataaaaaagatggctttatttatttcaaacgcaataaagaaaatgatttttgtcaaacgcaataaagaaaatgatgctaaaaggtttccatgataccngttcattacnccttaaacctttcagtaanaagccccntctcnatccan

SEQ ID NO: 16692 - DNA, 707 bp, Triticum aestivum
  unsure (1)..(707): unsure at all n locations
  Clone ID: PAT_TA_16692
tcggcacgaggcgactggagctcctcagagccaagcctagcttgcccccaagccaagcttagcttctgccggcagccacagccactctcactcccgctcactgccactgccactgccactaccagctcgctgtaccgccacccgccattactgcgagctactagctagctagccaccccactccactcgctgcacgctcctgtagcgttccggtagtacaattaagctggtcaggcatggcgccggagtgggaggcagccttgggcatggagctcggcatgggctcgcactaccaccacgcgccgccatccgccgccgcctcgcccatgaaccaacaccaccaccaccactccgcatactcccactcccagcccccgcaccagtaccatttcntacggggngcgccgctgggcggcgacggcgccgaccccatgcgcgtcgacgagatgctcgacctctcctcccacctcggcgcgcacgacttcttctccggcgcgaataatggcgccgccgacaacgcgccggcccagcccgcggctgctgcggcctcctcgtccgaccaccagcaccaccacccgtcgtccttcaacctctccttcgccgacgagttttacctgcctgtcccgactgaggaagccgcggagcttggagtggctgtccaacttcgtggacgactcctacccggacatccccaactacccgccggc

SEQ ID NO: 16693 - DNA, 694 bp, Triticum aestivum
  Clone ID: PAT_TA_16693
cgtccctcttccggtgccgccgccgccgccgcccatttcgtgcgcctcccacaacccgagagcgaggagttcaggccgcgtcgccgctcaccatgggtgtagccgcccaagaattaccagggcaccaagtacgtccgagctggttgttccacgttttatccggagtttccagatgactggtataacatcgaggaccctcccatgcccaaggacacttcccgcaagaagcgcaatcagacttacagggcgcataaaccgactcgcaaattgctgtttgttctcagtaagaaggtgaatgtgaaggcatgtggtactgatagcaggaacacgcaggccaaggggaaagcagccaggcgtgctgctgcagcaagttctgagtttgcaaactattctactgataagctctttgcaagatgtgatgtcgagggtaagtcagaagagtagctacttgctcgtcaagggtcaattacttaggtcactctgctggtcgtccaaattgaaatcgtcaagtcctttgtgctcctgtcaaataaatcctgtttgtcgggctttgattcaaacttgtgatgttataatgcatacaatgcattacaatgcacttgatgattgactaatgccaccactatccgactacatgtaatgtggtataagatggtttctgataagctgtgtaatatttccttcaaaaaaaaaa

SEQ ID NO: 16694 - DNA, 1433 bp, Triticum aestivum
  unsure (1)..(1433): unsure at all n locations
  Clone ID: PAT_TA_16694
gtttttgtnggcgtgttgtgctatttcggaggaatatgaaaaggagatcaatgacacccggccccacgcgcgcggctttctgaatggtgccttgctaggatgacccaaattatgttagtgtcggtacgtttagttggtgatggtttagcgggagcgacagctgcatctgtaacttacgtaacttacccattggatgttgttcgaactcgcttggcaacacaggtaacgtccgtgatgtgtcctgtttaactctttgggatgttcagtccattgcttatattgctggtacaggagggtgaggcagtgtcaaagctacttagcattctaagattgtgaaccagtatatgggtttgcacatctgagtgctggtgatcttcttcgcgaagaagttaaatgtgatatggagcagattaaaattgaccatgagctcgtactattaattgatggctcaagggaagagacagcggcatattcttagttgaaatcagtttgatgtttttcaggaatgaattccactcgttattcaataccactatgagaaaagtagtgaaatgctggccgtctgcaaaatgtactggtccgtctcgcggtctcaccccaaaaacagaggagaggagcagggagctcctccctcacacttgtcggctccaaggagccccgccaccatgcatggagaagaggagcgcggagctccgccgccgcgtaaggcaaaccaaggctgcaacgtttgaatattatactcagtcagttgctcgactacttacagtcctattacttgagacttaatactcggtcagctgccgtgtacattgttctgacataaatgccaccatgtctatgcgcaagtcagaaggaacttaccatctaaaaagatgtctaattagtgtggtacatgcttcagtactgcaagttggagtagcaacgtgttgacgtggagcttgtccattcgcgacataccttgtttatgtgggagggctggacgattctttgtcggacgttcccctgccgtcggctcaatgagaacatatatcctttttctaatctctgtttttctaagttgaaactatttctttgttacttggtttgaggacggcaaaagactggccttttgccggacagagaaaagaccggcttattttattttaacacaacatagcaagctccatatatttcagttagtacatggcaggatgcagactatgtgcagtattagtggtgtttagactccaaaatggcagtattagtggtgttttaaagagaaagattcgtaaatgatgttgttctctactaagaaaattcagtagtcggtgtcaccattgagtgccaatgtgatgggcatttaagatttagattcagaactcctgggttcaacacagatggcttcacttcaatatttttccccatgtggttgatggatgcatacatatctatgt

SEQ ID NO: 16695 - DNA, 713 bp, Triticum aestivum
  Clone ID: PAT_TA_16695
ccccatcccccaaaccaccaaaagaaaaaaaacctcccctccccccaatcgtaaaccctagccccgcccgcccgcccgccggaccgccggagcgccggatgccatgggggccagtcggaagctgcagggcgagatcgaccgcgtcctcaagaaggtgcaggagggcgtcgacgtcttcgacagcatctggaacaaggtctacgacaccgagaatgccaaccagaaggagaagttcgaggccgacctcaagaaggagatcaagaagctgcagcgctaccgcgaccagatcaagacctggatccagtccagcgagatcaaggacaagaaggcgcccccccttccccgcgccccccttgtccgcgtgttgggtcgttgttgcctggatggatggaactgcttcctcccttccttcctccatgagaattatctgctgccacgctcgtctgttcagtcaactgtttagttcagatgcggctttggtgctaagttatctggaggaaatgccttcttacaggcgttgggggaggttaagtgtcttaactgtcgctgctagctgcttggacgactgttaatccagttttccgtgcttctgtgtctgtcttagacattgatattcttgctcgactttggttgcacgacgtcgtactagtatccgtctaggtgcacttctcttctgaattgaaagaaaatttgataaaaaaaaaaaaaaaaaa

SEQ ID NO: 16696 - DNA, 957 bp, Triticum aestivum
  unsure (1)..(957): unsure at all n locations
  Clone ID: PAT_TA_16696
cgggccaattcccgttcccaaaaaatcctccccaccgccaccgccaccggtatattccaccccgccccgggagccaagccgagccaaaggccgccgcagcgaatggctccgcctgccgccggcaggccctcggcctccgccgcgccggtagcctcccctgcgggaggccgccaagcgccgacgcgcccccgcgtgcgccggcgcttgggcgcgcatcctctccttgggcgtgcggggcgccgtgatggtcgccgcgctcgtgctcttcctactcttcgccgccgccgcggtcatcctcatgcttgcgctcctcgtcgccgcgcgcgccttccgccagcagggccgccgtcggcaccgcgccccgcccgactcctccgctccgccgccgccccccgccgtcggcctcccgtccgccaaaatccgcctcctgcccagcttcgtgccctgcccgtgcgatgcccgcggcggcggcgaccccgccccttcctcgccgcggatctgccccgtctgcctcgacgccgcgcgcgccggggagcggtggcgcgcgctgcccgcctgcggccacgcgttccacgccgcctgcgtcgaccggtggctcctcttgtcgccggggtgccccgtctgccgcgccacggtggccgtccccgtcagctgatcgcgagctcccggcacgggacggcatcaagaagttgcgccgcgccagggctgtaaaggttcggtttccgtcagctgttcgacgaaaagcctccccgctttgctctgtagtctagcctgctttgtgtggatctttctgctgttgtaaagcgagaggcagggagacgatgcataaaacaagtttctccttaaggagaactttgcaatgtcaacttctttatctattttcatctcagtattgtgtagttcaaaaaaaaaaaaaaaaaactcgaaaaaaaaaanaaaaaaaaaaaaaaaaaaaan

SEQ ID NO: 16697 - DNA, 696 bp, Triticum aestivum
  unsure (1)..(696): unsure at all n locations
  Clone ID: PAT_TA_16697
aaagcacaagaggtacacaagttagcgtcaatgnagatagaccctgacactgctgatgagagcttactgcactgctcaccggaaccgccaggtaaagaaatccaggtagatgcattcgttggccggatgaatgttgatgaaagcttggtgcactgctcatcgacacctagcgatgaagaaattccagtggatgcattctgcagccagatgaatgagcttcctcctatcagtgactatgtttgcacaactgacaaactctcactggatgatatctcaaggctggcagatatgtttcctgtcaatgactttgtcgacacaacaggtgagccgcctggtgacgactacatcgggctggcagacatcagtcatctaccgatgccaatgttcgagttggatacagaacttaattgggaaggtttcgactttgcttcgatggaacgtgaactagagagactttaggcctcgacaacattgaggttttcatctttcggacagatgtcagggtgagtttgtgatcaggagatgtgttcatctccaattttgtcggaaattgtacagtccacccccccttagattaatctggttgagccttatatgcaccgtgtaatatgtacatgatcatctaatttgaatctgctatgaagttcataaggtccctcctctatttttcgttaacaaaaanannaacccacaaca

SEQ ID NO: 16698 - DNA, 909 bp, Triticum aestivum
  unsure (1)..(909): unsure at all n locations
  Clone ID: PAT_TA_16698
ggaagcaggcaatttggctgcggagcagaattacaaacacagtgctctgtctgaaggaaggaaaaaacagtttgaaatcacagcatctcccgcatctgaattatgtacagaatttgacccccaattcctcctcctctcctcttcagcaactactagtagttggtgtatgtacaacgaagatgatgaagaagaaaaagcaaacagccgccgccatgaaccgaaccaatcggaaccaattggaagcctaaccctactcctaatccacgtcctcgatcctgatgttgaccggctcctccctctgctcctcctcctgctgcggcctctccgctcctcgcagcgtcacgatgctgaccagcaccgcgcccctgggcccgcgcctctcgccgtcgccgttcggctgctcctcggccgccggctccgccttggggagctcgtggcggcagacggggcagctcccgtgcacgcccagccaccgttccaggcactccccgtggaagcggtgcccgcacggcatctccttgccggccccgaacgcgtcgaggcaaatcgcgcagtcgcccagcgagccctcgccctcgccctccccggcggcctggacctccttcagcgaggcgatcgccgccttggacgccggcgggacgctgccgccgacctcgccggagaagaggtcgccgccgtcgccgctgaagatgaagtggcgcacctccacccggccgccgcccgccacgggcattgcgtcggcggccgagggccccctcgccatcagcatgagcagccgcatgatgccggccgccatgttgtcgccgttcgccgagtccatgggagggagggaaggagccgagagcgagaggggaggagaggaggaggaacctctgtccttttgccggcgagttnnctgcggacgcgtgg

SEQ ID NO: 16699 - DNA, 993 bp, Triticum aestivum
  Clone ID: PAT_TA_16699
gacatgaacaacatggtgtacctaagagcagtaataaaagagtctctcaggttgtatcctgttgcgcctctccttgctccgcacctggccatggctgattgtaccatccatggatacatggttcctgctgggacgcgtgtcgtcgtcaatgcatgggccgttgggagggattcgagctcctgggaggatgcagaagagttcatacctgaaagatttacagatgaaggcaacgctacaaatgttaacttcaaggggaatgatttccagttcttgccgttcggggcaggacgaaggatatgccctggtataaacctcggaatcgcaaatgtcgagcttatgttagcaaacctcatgaaccattttgattgggaacttccggttggggttgagagaaaagatatcgatatgacagaggtgttcgggctaactgttcgtaggaaggagaaactattgttgattccaaaatcatgcatgtaaaataaagctaagccaaatactttatgttatcactataacggttttctagggacgaaggtgttaccagggtataatggcaccaataaataatggccaatgccccttttaaaaaccatgcacacatggttccccctggaccccgcgtcatcgccaacgcatgggccattgggaggcattccagctcctggcatcatgcgcaagaattcgtacctgaaagatttacagatgaaggcaacgctacgaatgttaacttcaaagggaatgatttccagttcttgccgttcggggcaggacgaaggatatgccctggaataaacctcggaatcgcaaatgttgagcttatgttagcaaacctcgtgaaccattttgattgggaacttccggttggggttgagagaaaagatatcgatatgacagaggtgttcgggctaaccgttcgtaggaaggagaaactattgttgattccaaaatcacgcatgtaaaataaagctaagctaaatactatgtgttatcact

SEQ ID NO: 16700 - DNA, 865 bp, Triticum aestivum
  unsure (1)..(865): unsure at all n locations
  Clone ID: PAT_TA_16700
gccggccgatcaagaaagagaactgagctcagcatggcaaacctcgtgcaggagctcatgctagagacgcccccgcgggcatggtttctgttcctgctccccctcctcctcttgtctctgcatcactggttcaccagaaagacaggatcaacagggcagcgcctcccaccttcgccgccggcgctgcccataatcgggcacctgcacctcgtcggcgccctcccacacgtctccctccgtgacctcgccaggaagcacggtccggacgtgatgctcctccggctgggcgccgtgcccaccctcgtcgtgtcctctccgcgcgccgcagaggcagtgctgcgcacgcacgaccacgtcctggcgtcgcggccacgctccgttgtctccgacatcatcatgtacggctcctctgacatcgccttcgcgccatacggcgagtactggcggcaggcaaggaagcttgtcaccacccacatgctgagtgttaagaaggtgcagtctttccgcagccccggcgcggaggaggtcagcatgtcgatggccaaaatcaacgaggcagccacagctagtggtacagtcgacatgagcgagctgctcaactcattctcgaatgacatggcatgccgtatcgtgtcgggcaagttcttcctgaaagatggacggagcaagttgttccgggaactcatcaacgacacctcgcggcttctgggcgggttcaacttggaggagtacttcccagcattgggtagggtaggagtgcttaagagggcggtgtgtgccaaggccgaagagtgaggaacagatgggctgatctgctggacaagtgatcgacgatcgtgtgagncagcgtaaatcagcgtctgat

SEQ ID NO: 16701 - DNA, 1784 bp, Triticum aestivum
  Clone ID: PAT_TA_16701
taacactccatttccagatagcgtacactaagctggttcacaagaacaatttctctgatcagagctccacaaagtactaccgggccgagacaatagtttacgatggaagatctcgtgaagaaacccatgccagagacacctccgcgggcattgtttctgttcctattcttcctcttcctcttgtttgtaagctggttcactggaaagacaagaaaaatgcagcatcagcagcgagaaaacaaccacctcccgctcccgccttcgccgccggcactgcccatcattggtcacctgcacctcgtcggctccctcccgcacgtctctctccgcagccttgccaggaagtatggtcccgacatgatgcttctgcgcctgggcgccgcgcggaccctcgtggtgtcgtcgctgcgtggcgcagaggcagtgctgcgcacccacgaccacatcttggcgtcgcggcccagctccgtagtctccgacatcctcacgtacggctcgtctgatatggccttcgcgccatacggcgagtactggcggcaggtgaggaagcttctcaccacccacatgctcagcgttaggaaggtgcagtctttccgcagcgccgccgcggaggaggtcagcattggcgaatggccaagatcaaccaggcagcagctgctgatgctgcggtggacatgagcgagctgctccacacattcgcgaatgacatggcgtgccgcattgtgtcggggaagttcttcctgaaagatggtcaaagcaagttgtttggggaactcatcaacgatacctcacggctgctaggcgggttcaatttggaggagtacttcccagcattgggtagggtaggagtgcttaagagggcggtttgtgccaaggccgaaagagtgaggaacagatgggctgatctgttggacaaggtgatcgacgatcgtgtgagcaagcgtaaatcaacgtctgatcacaaggatggtgatttcgtcgatattctgttgtctgtccagcaggagtatgatctcacaagagagcacatgaaagctctcctcacggatgtattttttggtgcaacagacacgtcagctaacgccctcgaattcaccttggctgagctcatgagaaagccacacctcatgctgaagctacaagatgaagtgaggggtattgtaccccggggacaagaaattgtgagcgaagctgacatgaacaacatgacgtacctaagagcagtcataaaagagtcgctccggctacatcctcttgctcctctccttgctccgcaccttgccatggctgactgcaccatcgatggatacatggttcctgctgggacgcgtgtggtcgtcaatgcatgggccattggtagggatccgagctcctgggagtatgcggaagagttcattcctgaaagatttacagatgaaggcagcagtatgcatgtcaacttcaaggggaatgatttccagttcttgccgttcggagcaggacggaggatgtgccctggtatgaacctcggaatcgcaaatgtcgagcttatgttggcaaaccttgtgtgccattttgactgggaacttccggttggggttgagagaaaagatattgatatgacagaggtgtttgggctaaccgttcgtaggaaggagaaactattgttgattccaaaatcacgcatgtaaaataaaactaagctaaatactgtgtgttatcacataatgcttttctttgtaaagaaggtgctatcggcaataatggtacaaataaataatggccaattcttccttcttatagct

SEQ ID NO: 16702 - DNA, 2116 bp, Triticum aestivum
  unsure (1)..(2116): unsure at all n locations
  Clone ID: PAT_TA_16702
gaaaatacnnnannaannaaaaaaaaaaaaaaaaaaaaaaaaaaaaaaagatagagcaactggagctcagcaccgtgcgaacccggcaactccccaggtcggagcatggcaaacctcgtgcaggagctcatgctagagacgcccccgcgggcatggtttctgttcctgctccccctcctcctcttgtctctgcatcactggttcaccagaaagacaggatcaacagggcagcgcctcccaccttcgccgccggcgctgcccataatcgggcacctgcacctcgtcggcgccctcccacacgtctccctccgtgacctcgccaggaagcacggtccggacgtgatgctcctccggctgggcgccgtgcccaccctcgtcgtgtcctctccgcgcgccgcggaggcagtgctgcgcacgcacgaccacgtcctggcgtcgcggccacgctccgttgtctccgacgtcatcatgtacggctcctctgacatcgccttcgcgccatacggcgagtactggcggcaggcgaggaagcttgtcaccacccacatgctgagtgttatgcagtctttccgcagcgccgccgcgaaatcactgccgtctttttcgatgcgccggccccacaggaggtccaagcatgaggacgaggcgaggtcaaattgcagaagcaagacatggaagtataatatacaacaaatatgagcaaaactacgtacctaatgacagggataaaagagtcgttccggctatatcctcttgcacctctccttgctccgcaccttgccatggctgactgcatcatcgatggatacatagttcctgctgggactcgtgtggtcatcaatgcttgggccattggtagggatccgagctcctgggagtatgcggaagagttcgttcctgaaagatttacagatgaaggcagcagtatgcatgtcaacttcaaagggaatgatttccagttcttgccgttcggagcaggacggaggatgtgccctggtatgaaccttgggatcgcgaatgtggagcttatgttggcaaaccttgtgtgccattttgactggcaacttccgcttggggttgagagaaaggacattgatatgacagaggtgtttgggctaaccgtccatcggaaggagaaactattgttgattccaaaatcacgcatgtagtcatgaaaataaaactaagctaaatagtgtgttatatcgcacaaggaacatggtgggagtaagagtagcattaacagggtccctcaagttttatcctgtcgcgcctttccttgctccgcacccagcaatggctgattgtaccatccatggacacttggttcctgctaggcacgcgtgtccgtcaggcaactggatggtccgttggtacggatcagacttcccggggaggcatctggagtgtacacacgcgaagaattgatagcttcaagggacgttacaagtgtgatcttgcaaggcggggtagtttcaagtttttgcccgttcagggacagcagaatcgctattgctgagtttaagctgccgaacctcccgagtccctttgccattcgggggcagggtggaagggatttgccccgagttcgagaaccctggggtgttcggcgaaatcgttagcacgaaggtggccagccttgctgttccacaattatgcatgtaggatcttcctgctcaaaattttgagtgtaaaagacatcgatgtcacagaggtgattttgtgctaacaatggctgcctggggaggaaagcttttcctaattcccaaagcacctggatgtaatcgccaatactaacttctaagcttttattggtataaagtttttctttgcaaaaaggtgttaccggtatacagttgctaccaaataatgtcagttctcccttgttttaaataaatgttgcaaatgtttagctacaaatattgttcttatgaacactgatacgatattcaagacactagtttgactactattgttggtttgtacatacatatgaaataaactagaaatgccctcgggccgaattcggcacgagaaaaacgtctttatatttttattcaaagggagtacatctgacaataaataaagggaaacaatgacttccctgtgtctcgct

SEQ ID NO: 16703 - DNA, 798 bp, Triticum aestivum
  Clone ID: PAT_TA_16703
attcggcacgaggccagcgcgccggcgtcggcatgaccatcgccatgctggcgaacgtggccgcggcagccgtcgagaccaggcggaagtcagtggccgccgccagcggcatgctggacgcgcccaaaggcgccaccctgcccatcagtgtcttctggctggtgccgcagtacgccatccacggcatcgccgacgcattcatggacgccggccgcttggtgccggcccccgtcctggcgccccgccgcggctggagcaccgcggcggcgctctactggctcaccatctcggcggggagctacctcggcacgctgctggtgaccatcgtgcacgagaaaacgcgggcgagcgggcagtggctgcaggacaacctcaacagagggaagctggataactactactggctcgtcgtcgggctgcaggggctcaacctcgtctactacttcgtatgtgtcaagtactacacttttaagccattggagacggaggtcgagcaccaacctggccatggcaatggcaccgagagcgcccaagaagggtgtaagctacaagtaactagaatgcgtggtagaatgtatcttgccatttgtcatgatatactaatattgccgagagtttaggaacactctcgaacgtagtgatatttggaaatgtaatcgttcacgaaatgtatctacactactatataggttaccaattttgaaaatttgaatcctaggattcaaacgtgatatcaacggtcaatttatgtcaatccaatggtcaacatatagcaaaaaaaaaaaaaaaaaactcgag

SEQ ID NO: 16704 - DNA, 1179 bp, Triticum aestivum
  Clone ID: PAT_TA_16704
ctgtctcaccccactgtcctgccccgcctcccgccgccataccgccattcccgccgccgccggcccccccccacccccccccccccttttccccccttttatcctccccccccccccggcctggccggggccgagcccagcccgtcctgggctgggacaacccagtctcgtgttggaagaccagaccggctgcgtgccgagcgtgaggtcgggagaggcaatcgcgagttggttcaacgcctcgcccacaacccgtcaagccgagcaccagccggcagaccgcgacaggcaatggcgacttcgttccaggggacgcccaccaagtgcaacgccgtgcgacaagacggtgtacctcgtcgacaagctcaccgccgacaaccgggtctaccacaaggcctgcttcaggtgccaccactgcaagggcaccctcaagctcgcgaattacaactccttcgaaggagtgctctactgcaggcctcactttgaccagctcttcaagaggaccggcagcctggacaagagcttcgaaggcactccaaaggttgtcaagccagaaaggaatgttgggaatgagaatgctactaaagtctcgagcgcatttgctggcaccagagagaaatgttttggatgcaccaagacggtctatccaattgagagggttactgtgaacaacaccatgtaccacaagagctgcttcaaatgctgccatggagggtgcaccatcagcccttcgaattacatcgcgcacgagggaaagctcttctgcaagcaccaccacacccagctgatcaaagagaagggcaatttcagccagctcgagaacgaccacgacaagacgtcacagagtgccgggtcagtggatgatgaagactcggagtattagtcagtccttgaggatatccatagatgaataacgagcccttctgcatttgcaccagagcagtgtatccttctgctgcgtggttcttttgagattttccaatcgagatcaagtgcattccaaagacaattatgttattgccttgtacgcatgtaaaccttgttatatccatgtcaaaatatctctacctggttcgaagaaaaaaaaaaaaaaaaaaaaaaaaaaaaaaaaaaaaaaaaaaaaaaaaaaaaaaaaggaaaaaaaaaaaaaaaaaaaaaaaaaaaaagggggcgccccaa

SEQ ID NO: 16705 - DNA, 696 bp, Triticum aestivum
  Clone ID: PAT_TA_16705
ttgttgagcgctagctagacggaaaccatctctcccctgctcctgcttccgtctcaccaagtcagccacgatggccgtcgtcgccgacaggtcgatgctccggtcgtacgcttctctcctccgcgctgctccggcgagggcctcttcctctgcggcgcggccgtcccttcgccgcgcgctgggcgcgccccctcgtctcctcaggtagcccgtcgaggcgagcttctgcgtggagtcgctgctgccgctgcacagcgccaccgccgcggcgcggatgacgtctatgctcgccgtgcctggccgaggcctcgggtggctcacggaagggaaagacgaaactagatgaagaccaacttgggaaagctgaaattgatggagtatgatgctgacctgccaacggagccaggagattactagtctttcaggatgagttgacaaagaaaggaagcatgcttttctttttctgtatgtgaactacgatgaaatttttaataaatgatgtttgatattgcttaaacttcatttccccaccttcatcttcattaaccagaatcattatggttatgtgatgagaactgtgctaggggtgtagaagtttgaatcgctggcaaaatgaatactatgtttgaccttttgtatgtgtttgtttggtttgtcagcatgatctggtgattaaaagcctgttccctttctttt

SEQ ID NO: 16706 - DNA, 675 bp, Triticum aestivum
  Clone ID: PAT_TA_16706
ctgtgcggccgctcgaggcggccgggccgaaaagcatcagaatacatactgctcgcacatagacgacacaagtacgtctgcagctgcagcgtattcttatttacctgcttcccagtcgaaagagagaaagaatggcggccaggctcagagcgggagcaccggcgggcgctctcctcctggtggcgtgcctgtttctcgcgacggcggcggccgtgagtggcgccaggccgctagcggtgcgggaggaagggggcactgcgcgtgcggtgacggtggaatcgccggcgggcgatgctatccggacggtggtgagggccgtcgagcgcaggctaatgttcgacgtcggcatgctccgcgggatcaaggactccgggcccagccccggtgccgggcattaagcgccggacatgccatgccatgccacggctgccattagaactcgggaggaggcgtaggatgattcaaggtttcatgattgtttctttagttctttattcatgtatacgtagacgagtaacggagtaagtaccatagtttagtgtgtatatctgtctgattttgcggtacaatttaaagcatttttttatatgtgactagcaaaagagtccgtgcgtagtaatgggagagaaaataacacagttttcaacccaaaaaaaaaaaaaaaaaaggccccta

SEQ ID NO: 16707 - DNA, 730 bp, Triticum aestivum
  Clone ID: PAT_TA_16707
gccgctcaggcggcgggcggaggcaaagcaaacgaagcaccagaatacatactgctcgcccatagacacacgtacgtgtgcacctgcggcgtattcttctttgcctgcttcccagtcaaaagcgaggaagaatggcggccaggctccgagcgggagcaccggcgggcgctctcctcgtggtggcgtgcctgcttctcgcgacggcggcggccgtgagtggcgccaggccgctcgcggtgaccgtggaatcgccggcgggcgatgctatccagacggtggggagggccgtcgagcgcaggctaatgttcgacgtcggcattctccgcgggatcaaggactccgggcccagccccggcgccgggcattaagcgccggacatgccatgccatgccacggctgccattagaactcgggaggaggcgtaggatgattcgcggtttcatgattgtttctttagttctttattcatgtatatgtacacgagtaacggagtaagtaccagcgtgtatatgtgtctgatttgtgccgtgagttcacggaggaagaggtcaaggaggcgctgttctctatggcatataatagagcccctggtcctgacaacattcctgttgaattctattaggtgtgctgggatattgttaaagaggacattatgaggttgtttgcgagctttcataatggaactttggatgtccaacgtctaaactatggggtgatcacccttttgccc

SEQ ID NO: 16708 - DNA, 1671 bp, Triticum aestivum
  unsure (1)..(1671): unsure at all n locations
  Clone ID: PAT_TA_16708
gccggccgggtcgcgattcttcctaaattccttgaggcttcgaccagatcacaactctccagttaccgccagccatggctgccaagaccacctcatgcttcaccttcctcaaggaagcgctggtcctccccacgcgaaaccccaagctcttcgcccccatcctcatcctcctggccatcatcgccttccttgtccccgccgtcaacgtggtcctcatccagccgctcaccgcccagatgctccgccacctcaccgagatgcagaccaccgacccctcaagcgccgagtttgccaggctcctggaggagatacggcaggaagccagggagctcgtcctcatctccgtcggcttgtttttcgtcaccctggcgctggtcttcgccaagcagatcctcgccttctccgccgcctccacgacctactccggcgaccgctactcgctcgccgagctcctccgaagggtgaccaagtggggtaatctgaggggccctctcgtcaccgtgggcgtggtcaccgcgctccagctcacgttcatgacgctcctgggcgcctacctctccaccgtcatgcgccacgcggaggcgctctccgtgcaaggtgcgctcttcgccctcgctttcctggccttcatgtacttcggggtggtggctgtggtgggcgtcgccgtgtcggtggccgacgaggggtgccgcggcgtgcgcgcgctcctgcgctcctgcccaccgccgcctcgagcgccgagtacgccaggctcctggaggagatcccttcggtcgggcgtgaggcttcaaccagatcacaactctcaagttaccagctagccataggtgccaagaccacctcatgcttcaccttcctcaaggaagcgctggtcctccccacgcgaaaccccaagctcttcgcccccatcctcatcctcctggccatcatcgccttcctcgtccccgcggtcaacgtggtcctcatccagccgctcaccgccgagatgctccgccacgtcaccgagatgcagaccaccgacccctcgagcgccgagttcgccaggctcctgcaggagatactccaggacgccagggagctcgtcctcatcgccgtcgggctctttttcgtcaccctggctctcgtcttcggccaagcagatcctcgccttctccgcggcctccacgacttactccggcgacgtgctactcgctcgccgagctcctccggaggggtgaccagagtgggcgcaacctgagagggccctctcgtcaccatgggcgtggtcaccgcgctccagctcacgttcatggcgctactgggcacctacctcgccaccgtcatgcgccacgcgggggcgctctccgtgcagggcgcgctcttcggtcctcgccttcctggccttcatgtacttcggggttggtggccgtggtgggcgtcgccgtgtcggtggccgacggggggtgccgcggcgtgcgcgcgctcctgcgggcgtggcggctcatgacgcgggtgagcaagaaggagggcgcccttgctggcggcggtgatggtcctcctgtcgaccgctgtgagcccggttgtacgccctaagcgctccgtttnacgccaangaaaaagcatggccgggtggggcttttccctgcttgtttgggtatgctcctctgntctgccaacgggggangctgttct

SEQ ID NO: 16709 - DNA, 737 bp, Triticum aestivum
  Clone ID: PAT_TA_16709
cggacgcgtccgcccacgcgtccgtagagacaagcgcaagaacggttcatcagtggttcttgctggaagcaaaagttgagttagatcagatcatgggcgccttggatcacctgtcccgtctatgcaacttgacacatacaagggaagccatcaggattaagaaaaggcggccactgacgacggtgaacatcaaggtgaagatggactgtgagggctgcgagaggagggtcaagagcgccgtcaaatcgattcggggtgtaacgacggtggtggtgaatcgcaagatcaacaaggtgacggtgacggggtatgtggagcctcgcaaggtgctggcgagggtgaagagaactgggaagacgacggcggatatgtggccgtacgtgccctacacggtggccacctacccctacgtcggcggctcctacgacaagaaggcgccggcgggcctggtccgcaacgtgccgcaggccatggccgacccggccgcgccggaggtcaagtacatgaacatgttcaacgacgaggacgttaccgcttgcaccgtcatgtgattcgatcatatcatattagcatctgcactccggccatctgcacccagccacgacgacatgccgagattactactgtagatatatcggtgttctcgcagcgctggggaagaatgataccaagaagatgagcttgtgcatgtacggtactgatggatgatgtactccaaattaagagccataattcgg

SEQ ID NO: 16710 - DNA, 1064 bp, Triticum aestivum
  Clone ID: PAT_TA_16710
cggccgctcaggcggcgggcgggcagaacagcgcttcgcctggctccacagcgcttctggttgaggttcaaaggcaaaagttgtgtgagatcatgggcgccttggatcacctctctgatttgtgaagcatgacggagacaaaggaagccctcaagctcaggaagaagcgcccactgcagacggtgaacatcaaggtgaagatggactgcgagggctgagagggaggagggtcaagaacgccgtcaaatcgattctggggtgtgacgaggtgtggccgtcgaaccccaagatgagcaagataacggtgacggggcacgtcggagccgcgcaaggtgctggagcgggtgaagagcacggggaaggcggcggagatgtggccgtacgtgcccctacatcgctcgccacctacccccgtacgtcggcggcgcctacgacaaggaagggcaccggccgggctttcgtccgggcagcgccaccgcccaggccatggcccgaccccgcggcgcctgagatccactacatgaacatgttcaacgacgaggcacgtcaacgcctgcaccagtcatgtgatctagatcatcgtaatcgccagctccttgaccactctagccgacgaccagacgcccagcggaaagacatgcttgatatgtcttcatgcatcacagagactgtatttgtatatatatgtctttctcgcttgggaaaaggggataccaagaagacgagcttgcgtgcgaacagctataatatactacaaagaaagagctaaagtttaataagcgtacataactaagtgtgaagcgcgccgtttttcaattgtgagattgatgcaaccacccattttcatactcctttctatacaattgcatatcagcaacttcaatagcttcaatctaatggagaccctcacaagtggacctacccacggaagacaaccagctcttatgtttaatctttagccttgatgtttggtggaactggtatttgttgatagacttgtaattgtttactctcttttttatgaaatgaaattaccttaaaaaaaaaaaaaaaccaagcccagc

SEQ ID NO: 16711 - DNA, 719 bp, Triticum aestivum
  Clone ID: PAT_TA_16711
tcctctatcccgagttagtgacacaggaatatttccctgtgcagtcttgtgctagctgccgtgtctgccaggaatggccgacggcgtccttctgacaaccgcgccggcagcgctaacactggtgttcttgctgttcttcggcgccgcgcacggtcagcttcagatggggttctactccgactcctgccccggcgccgaggacatcgtcaccgccgccgtccaggaagccgccgcctccggacgccaccatcctccccgccctcgtccgcctccagttccacgactgcttcgtcaagaggatgcgacgcgtcggtgctgatcacgagcgcgggcaacgccgccgtggtgaacaacaacaagcaccagggcctccgccgcctggacgtggttgaccgcgccaaggcgggccccgagggccagccccccggcgcccccgcccgcgccgccctcgccgctcccgcctcacccgtcccccggcccctgcccgtcggcccgccgtcccgggtcccgacgccgcgccgcgccgcgccgtcgtcgtccgtgccccacgccgacctcccgccggccgtgcgcgcctccatccaggtgctccgctccaagttcgccgccagcggcctcaacgaccgcgacctcgttctcctcacagcggcgcacacgatctggcacgacggcgtgcttcttcgtcaaggatcggctgtacagctacccactgccgggcg

SEQ ID NO: 16712 - DNA, 988 bp, Triticum aestivum
  Clone ID: PAT_TA_16712
ggttcggtgcagctcctctttaacttgccacgctccttgaagatgtctcgaatatcccgtgtttggtcttcattgctcctctgcatgttcgcactcgtggttttaaaatatcaacatggcaagaaaaatatactactagtaatactcgcgcatcttgtgggaacatgaaagcactcgtctgccatgttagagcatctccaacaagataaactactcatacaaatgcatcttgatgcgggcaacgcaggggcatcttgctagttctaaaaaactttccatcatttgccacactactggttgcatatgaaaaacctacccaagcacagcacgatacaggagcgacgcacaattacaagctgatattctgttggacaatggaggctataaccaattacttttacgggaacaatagcacctaggcaatttgatgggtaggtatgaacaaaattggaactgcacatgtactgctaagtgattcaatacacacattaccaatcgaggaggagaacgatggtcgcggcggcctctgtgagtcatggtcggcaacgggagtcaattcattgtccacgacggtggtgcttctgcgcttggcatcggcttccgggaagcagatctgagaccatggaagacgatgccggggaagaggctccgtgtacgacgacgatggtggaccggctccagtgcggcgtatgaggtcatcaatgaggcagatgcactgcagtggacaagtgcgccgatgtagaaggggaggagcacgaaggctgcggtggtgtggagaagtctattttgtggtggggatagaaaatggggagtattcaggtgtactactctgggtgccgggtggggttggctgggtacgatgaacctaaagttacgaaaacagctccctaccaagcatcatccataggcctgttctgaaggctatgatggtaacttcccactgctcaaatcagggtcgcgggagattttcccgccgaccacaaaattt

SEQ ID NO: 16713 - DNA, 1475 bp, Triticum aestivum
  Clone ID: PAT_TA_16713
actgcgaccacgcatccccctcgcctcctcgcccccgcgtcaacggccaaacttcctgccgcctcctccctcctcctggtacaaatccatagccttctccggcgacgaatcgggggctgtgctccttcgggccgcccatggcattcgcgcccctggcggcccggctcgccgcctccgcactcgtcgccggcgtcgtggcggcggtggtggcgatgccggtgccggcagccggaggggtgtgcttcgacaggatattcagcttcggggactcgctcacggacacgggcaacttcctgctctccgtaccggacgacttcccggaccccgcgcggagcctcccctacggccagaccttcttcggccgcccctccggccgctactccgacggccgcaacctcctcgatttcttcgctgaagcattcgggatgcctttcgtgccaccctaccttggcggtggtgacttcctgaatggtgccaattttgcggttggcggtgcgactgcgctcaacaactcgttcttccgagagcttggcgtggagcctacatggacaccacactcccttgatgagcaaatgcagtggttcaaaagactgcttccctccatcgcctccacggagtctgaacacagtgttatcatgtcaaaatcacttttccttgttggagaggtcggtgggaatgattacaaccatctaatggtcagggggaaatctcttgctgagctacgcgagcttgttcctcaggttgttggtgccataagcttagctatcacggagcttataattcttggcgcgaagaaattcgttgttcctggaaatttcccgatagggtgtgtcccattgtatctcgcaatacttccaagtgaagagaaggattactataatgaagaaacagggtgcattaagtggctaaacgaatttaccgagtaccacaatcgtttgctccaggaggagctagagaaacttaggaatcttcacccagatgtatctgtcatttatgctgattattatggtgccacactgaacatataccgtgccccactgcagtttggtttcactgtcccattgaactcatgctgcggaagcgatgccccacataactgttctctgtcagtactatgtggaaaccctggatctttcgtctgccctgacccatcgaagtacgtctcatgggacggtttacacttcaccgaagcgacctacaaagttatcatccaaggagtgctggggtcttatgctgttcctcctctttcggaaatttgtcgggatggagagtacaaagtctcccagcttcatcaatgtacagacagcaatcctacaaacactgtaacatacgatgctatgagctcttttatttgataatgtgggctctgctacacgtagaatttcaagaggcaatacatagataatcacttcgggctcttctctaaaatcgtgaagagaagtggtgagctaactcccaaaaaaaaaaaaaaaaaa

SEQ ID NO: 16714 - DNA, 1247 bp, Triticum aestivum
  unsure (1)..(1247): unsure at all n locations
  Clone ID: PAT_TA_16714
gttcttgcaccactgacagtgagcggtccttcggaaatgttcctcagcctcatgccatactgtattatcaacagagaacaaccaaaggaggccttttgattgctgaggccactggagtttcagacactgctcaagggtacaaagacactcctggcatttggacaaaggagcaagtagaagcatggaaaccgatcgtgaatggggttcacgcaaaaggaggaatatttttctgtcagatttggcatgtaggaagagtctccaatcacacttttcagcctaacgggcaggctccaatttcgagcactgataagccactcaaacctgtagttagagccaatggcatagatgtgcctacaatttcaactcctaggcggctacagactaatgagattcctttggtaatcaacgattttagggctgctgctagaaatgcaattgaagccggatttgatggtgttgaaatccatggagctcatggttatttgattgatcagttcttaaaggaccaagtcaatgatcgcactgacaaatatggtgggagcttagagaatcgctgccgctttgcattggaagtagttcaagctgtagttgatgaagttggagctgataaggttgngataaggctctctccgtttgcaaactattcagaggcatncgactcanaccagaagctctaggcctatacatggctcatgcactaaacaaatttggaatcctctactgccacatggtggaaccacggatggtgaatattggggaaaagcttgaaaccccgcacagccttcgccccatgagggatgctttcaagggaacattcatcgtggctggtggatatggtagggatgatggagataaagcgatcgccgatggctatgctgatttggttgcatatgggcgcttgtttttatccaacccggacttgccccggaggtttgaaatggatggtcctctcaacaagtacaatagagatactttctacctctctgatccagttattggatacactgactacccgtttctaccgtccgatgtatgaacgggcctttcaggaatgaatacctccttcctgtcatcagatcatttaccttacgtatcacaactatgttgaaggaataaggtcattgatttcttctcactgtgtgtgtgtgtgtgtgtgtgtgtgtgtggtcttatgtatgctggatcaacactttgtatctcccccctatggggtgtttaatttaacgtcaggcttcagctttgggttg

SEQ ID NO: 16715 - DNA, 1552 bp, Triticum aestivum
  Clone ID: PAT_TA_16715
cccacgcgtccggcggaggaagagaagcgagagaaagaaagggaccaaagaagagaggaagggaagatgagcaacgcagctagcacaacccccctcctcgcccactacaagatggggaaatttgatctttctcacagggtggttcttgcgccgctcacaagggagcggtcgttcggaaacgttcctcagccccatgccatactgtattatcagcagagagcaaccaaaggaggccttttgattgctgaggccaccggaagtttcaggacactgctcaaggggtacaaagatacccctcctggcatctagcaagaagcaggtagaagcatggaagccgatcgtcgatggggttcatgccaaaggaggaatatttttctgtttaggtcagatttggcatgtaggaagagtctccaatcatacttttcagcctaatgggcagatgctccaatttcaactgataagccaatcaaacctgaaaccgcaacgagagccgatggcattggattggctaaagtctcaactcctagggcgactaaagactgatgaaatcccgttggtcatcgatgatagggtggctgctagaaatgcaattgaagccggatttgatggtgtcgaaatccatggagctcatggttatttgattgatcagttctttaaggaccaagtcaaggatcgcactgacaaagacaggtgggagcttagagaatcggtgccgctttgcgctggaagtagttcaagctgtagttgatgaagttggagctgataaggttggcataaggctctcaccctttgcgagctactcagaggcatccgactcaaacccagaagctctaggcctatacatggcacaggcactgaacaagtttggaattctctactgtcacatggtggaaccacggatggtgaatattggtgagaagtttgaaactccccatagtcttcgccccataagggatgcttttaagggaacatttattgtagctgggggatacgacagggatgatggaaataaagcaatcgccgatgactatgctgatttggtagcatatgggcgcttgtttttatccaatcctgacttgcctcggaggtttgaaataggtgctcctctcaacaagtacataagagatactttctacctctctgatccagttattggatacactgattacccatttctgccgtccgatgtctagatgggcctttcaggaatgaatccccaccccatcagatcatctacctcatgtatcagtactatgttaaaggaataaggtcattgatttcaatgctcatgtgtatcggcacggtatggataaaatatgtaatcatcattgcaatttaagaagtgcaagctggaaagcaaattaagaagtcaaaaaaaaaaaaaaaaaaaaaaaaaaacctgcccgggcggccgctcgaaatcactgagtgaattcccagttgttcggtagaattagatgaacaaagtcattgaactgaatgctttgtttttatgtgtactagaggaatacagacattggtttgaaaaaaaaaaaaaaaaaaaaaaaaaaaa

SEQ ID NO: 16716 - DNA, 790 bp, Triticum aestivum
  Clone ID: PAT_TA_16716
atctcccacattcggagagaagccacacaaacaattataacatcaaagggatagagaaggctcaagtgtagcagatacaaaagccatagccatggcgaaactcatgtgcttatgtttcatcatcctcactatcggggtagccgtgtcggccgatgaatgtgagggtgaccgacaggccatgatcaaggagtgtgctatgtatcaaaaatggccagcaaatccgaagatagatccgtcagacgcatgctgtgcagtgtggcaaaaggcaaacatcccatgcctttgtgttggtgtcacgaaggagaaagagaagatatagtgtatggagaaggttggctacgtcgccaatttctgcaagacgccgttcccacatggctacaagtgtggaagtaagtgaaatatattaagggaattgtgatgatcggcattgcatacatgcagttttgatatttattattctttggagtcacacggctttgattttagttatgcatttcgtatgcttcttgcgctattctgatcatatgtcgggtcaaattgaatggtcttgcaggttacacatttcctcctctggcgtagtgattctagtttagccgcgggaggagaagcattgaagcttttacattatatgtgtgtggcctcacaagagcttccctttcacatttgtaattcgtgaggttttactcataatagtttaattcgtgaggttttactcataatagtttatgttaatcaccctgtatgagaacgtttgtgaaactaataaagtcttcttctcaaatgtcaaaaa

SEQ ID NO: 16717 - DNA, 1031 bp, Triticum aestivum
  Clone ID: PAT_TA_16717
ggcgtggaccggaaagacttcaactcatatggtagccggcgcggtaacgacgaggtgatggcaagaggaacatttgcaaacatcaggattgtgaacaagtttctgggtggagaggttgggcccaagactattcatgtgcccacaggggagaagctctctgttttcgatgcggccacgaaatacaaatctgaaggtcatgatacgatcattcttgctggcgccgagtatgggagtggcagctctcgtgattgggctgccaaggggccgatgcttcttggtgtgaaagcggtgattgccaagagctttgagcggatccaccgaagcaacttggtcgggatggggatcatcccaatgtgcttcaaagccggcgaggatgccgactcactcggccttactggacacgagcgctacaccatcaaccttcccaccgatgtcagcgagatccgtcctggccaggatgtgaccatcaccacggacgacgataaatccttcacttgcatacttcgctttgacacagaggtggagttggcctactacaaccatggaggcatcctgccctatgtaatccgcaacatggcaggagctcagaactaaggcgaaagaacgcgggcgtgcacacaaacacacaccctttcgaccacgacggtggcacggcagtcttgttagtgccatcgtcgacgtcgagggttggtttagaatttcgccgggcttcgttcgctttacaaataaaccggaaaataaagccccgtaggagacagagaaagggcattttcgtacccgatgctcatcttttggctgtgattatgaaaccatcattcggaacaaatcttcagttgtggattaaatcgttctgtagtgatctttcgggctgtttattttttcttttcctctttgaatgtgctgtagtggccttattacatcatcgtatttgtcttgcagaacaattttattttatatgtatgtatactaattttatagacatagaaaacatgaatgtatactaattttttccgtaacgaaaataaaaagct

SEQ ID NO: 16718 - DNA, 638 bp, Triticum aestivum
  Clone ID: PAT_TA_16718
aatgtatcccacgcattcacggagaagccacacaaacaattataacatcaaagggatagagaaggctctagtgtagcagatacaaaagccatagccatggcgaaactcatgtgcttatgtttcatcatcctcactattgcggtagccgtgtcggctgacgaatgtgagggtgaccgacaggccatgatcaaggagtgtgctaagtatcaacaatggccagcaaacccgaagctagatccgtcggacgcatgctgcgccgtgtggcaaaaggcaaacatcccatgcctttgcgctggtgtcaccaaggagaaagagaagatatggtgtatggagaaggttgcctacgttgccaatttctgcaagaagccgttcccacatggctacaagtgcggaagttacacattccctcctctggcgtagtgactctagtttagccgcgggaggagaagcgttggcttttacattccatgtgcctggcctcacaatagctttcctttcagatctgtaattcgtgaggctgtgctcagaaaagtttatgttaagcactttgtatgagaacgtttgtgaaactaataaagccttctcctcaaattgtctaaaaaaaaaaaaaaaaaaaaaaaaaaaaaattttcgggcgc

SEQ ID NO: 16719 - DNA, 2157 bp, Triticum aestivum
  unsure (1)..(2157): unsure at all n locations
  Clone ID: PAT_TA_16719
gccacacacacaaatacaataacaaaatgataggggtagagagtgagagagagaagcaagataaaaaagaaagaaacctaagagatttagtttgcttatgtttcacagttacaaatttcgcgggcctggtgaaacctgagggtgcagagggtgtccgacggacgaagagggaagagggcaagagctgacaaaaataacgacgatgatcacgtcctaaggaagcagaagcctcgcgaggaaggggataaaaacgaagcctccacgtgggaatgaacgtggggatgtggcaacgtaatagctatagcggaagtgttgtcaactgaggaaactaagccagaacgtcttgccaagaggtggcactgtgcgaaaattacaacaatagtcagctaacccgaagccagtccctccgcacgcatgctggttggtgttgcagttgtactgcatcgattgccgttgcgttggtgtcaccactagtatggagataacatatatcactgcgttagcataggttacatttcttatgcataatttcttcaggggaagactgtttcttcaattcttttaacgtgcggcaacgtaatacactctctcttcttaactgtaatgcatgctaggtttagctaagagaggttgatggtgagttggactgttacgaagcagggtttcctagcctcaagaatttgtttccttccagatctgaaatttcgtgatgtgtgtgctcagagaggtaagtgctatgaactttttatgcgaacgcaaaatgcacggctaagggtcacaacactatcattttcaaatcccgcgaggtatggctgtggctgcgctcgtgattggacctgcccgggacaccaatgcatcttggtatgaaagcggtcatttctaagaccttggaacgatttcaccgtcgccacctggtcgagatggggatcatcacgttgtgttttaaagccggtgacgcagacgactaactcgcctttactagacatgagcgctacaccatcaaccttcccaccgatgtcagagagatccgccctggccaggatgtgaccatcaccacggacaacgataaatccttcacttgcatacttcgctttgacacagaggtggagttggcctactacaaccatggaggcatcctgccctatgtaatccgcaacatggcagcagctcagaactaggcgaaggcgcacacaccctttccgccaacgatggcggcatgccaatcttgttagtgccaccatcaacgtcgagcgttcactcttgattttgtggccttatgaataaaccgaaaataaagccggcatttccatacctggcgtgggcgcaagttgatttgtgggtgtttggttgtggttatgaaaccgtgtggtcattctgaacagacatccaattgtggaggattaaaatcgtagagtccggtgtacattgctttgtgccaaaaacatatgtaaactgatagcaatctggagttcttttttaacctttacctcccaaaatcgccttgcagcacatcccctttcgccagctgcgtaataacgaaaaggcccgcaccgatcgccttnccaacagttgcgcacctgaatggcgaatggcaaattgtatcatccgtgggctcactattggggtagccgtgtcggctgacgaatgtgagggtgaccgacaggcaatgatcaaggagtgtgctaagtatcaacaatggccagcaaatccgaagctagatccgtcggacgcatgttgcgccgtgtggcaaaaggcaaacatcccatgcctttgcgctggtgtcaccaaggagaaagagaagatatattgtatggagaaggttggctacgttgccaatttctgcaagaagccgttcccacatggctacaagtgcggaagttacacattccctcctctggcgtagtgactctagtttagctgtgggaggagaagcgttggcttttactttcatgtgcctggcgctcacaataactttcctttcagatctgtaattcgtgaggctgtgcttagaaaagtttatgttaagcactttgtatgagaacgtttgtgaaactaataaagccttctcctcaaattgtctaaaaaaaaaaaaaaaaaaaaaaaaaaaaaggggggggccgttttaaagaatccagcttaactaccccggcctggcaa

SEQ ID NO: 16720 - DNA, 1044 bp, Triticum aestivum
  unsure (1)..(1044): unsure at all n locations
  Clone ID: PAT_TA_16720
ggccgctcgannggccggccggttggcggcctgctcaggaggtcagacctctctgaacagtcaaccacttgtttctcaatacttccttgagaactactctcgcgcccttcaccatcatggtctcgttcaaatcccttctcgtcgccgtctcggcactcactggggcacttgctcgtccctttgacttcctcgatgagcgtgacgatggcaacgccacctcggtcctcgaggctcgccaagtcactggcaacagtgaaggttaccacaacggttacttctactcttggtggtctgatggtggtggttatgctcagtaccgtatgggtgagggcagccactaccaggttgattggcgcaacactggtaactttgtcggtggaaagggatggaaccctggtactggccgaaccatcaactacggaggttccttcaaccctcagggtaacggatacctttgcgtttacggatggacccgcggtcccctcgtcgagtactacgtcatcgagagttacggttcttacaaccccggcagccaggctcagcaccgaggtaccgtctacaccgacggtgacacctacgatctctatatgtccacccgttaccaacagccttcgatcgacggtgttcagaccttcaaccagtactggtccatccgccgcaacaagcgtaccagcggctccgtcaacatgcagaaccacttcaatgcttggagatctgctggcatgaacctcggaaaccactactaccagattctggccactgagggttaccagagcagtggctcatcttctatctatgtccagactagttaagggatgtcagctgtggtcggttacagatgatttgagagatcatgtgtggaaattgaagagggaaaggttcttggctgactgaaggatggtcactgttactgtctgatgtatatttttttgcgactttggcaagtctctggcgcgaaagatcatcattgcaatacgggtcttcaataaaactgacattttggacaaaaaaaaaaaaaaaaaagaaacctaaaaaaggccccta

SEQ ID NO: 16721 - DNA, 797 bp, Triticum aestivum
  unsure (1)..(797): unsure at all n locations
  Clone ID: PAT_TA_16721
cattgatttcctgacagtggnctgtattaangaacatagagatgtttggtagaggaggactagctcctggtgttgggtttggctgggggacgtgcgggggtgggttttggtctctgaaagcctacttgcacaactggattcacagttggtcctagagttgataaaaattatctatgctgcgccagaagccttgttaccctcagtaaaggtgcaaactcggataatgtgactaatccattcgccaacgcttcagagagaatcagtcctgtccttggtgtatctttgattgccggacctggccagatctctaccttggagagagcctttgatatcctcttccaaccttcagttctgaaatgtctcaaatcttccatgcattgtctggcttctcaaaggaaattaccaaaaacttttgagtgggacataactgaggatgagtatcagcattttagcagggtgctaaattcacatttcagatccagatggtgggccatcaagaagaaaaatccagacaaacatgcaagaaacaacagtgccataaataagccaaaagtaccagaaacgttggagacgattcaagaggaaatggagttaacagaagttgtgaatccaccttgcagcacgtttgttctagagtggccacaccagagactgcctcttcctgcgcatgggattctaagctcctgcggctgcagtgtcggcgctgacgtctcgtgtgctggtcttggcttggaactgttnactncccnttttttttnttctttgtttggaaaaacctccctttttccttnncccan

SEQ ID NO: 16722 - DNA, 1082 bp, Triticum aestivum
  Clone ID: PAT_TA_16722
cggtggcctgtcgttccccggttggacaggaggtcggtatggggcacagctacacggcacacttcagggcaaccctcgagggttcctcaggatcaggctttgagtggctcagatggcatccacgcggtaatttgataattgcaggatcagaagactgtaacgtatggatgtggaatgctgaccacaatgcctttctgaatacgtttgctggtcacagtagcacagtgacatgtggtgattttacccctgatggtaagcttatatgtagtggatctgatgatgcaacattgaggatatgggatcccaaaagcgcacaatgcagacatgttgttcggggtcatggctatcatactcaaggattgacatgcttagccattactccggactcccaatcaattgttagtggctcggaggataattctgtgcacattgtgagcataaactcaggccaggttgttggttcattagttggccacaccaattccatcgagtgcattggcatctcatcgaggtacaactgggtggctacagggagcattgatagaactctcattatctgggaccttgctcgtcaagcaattcgatctacttgcgagcatgatgaaggtgtgacatgcctggcgtggctgggttcgtcgaggtatgtagcgtcggggtgcatcgacggcatggtgcgcatctgggacagcctctccggggacttggctcgcatgttcagtgggcacagggacgtcgtgcagtcgctggctgtctctgccgacggcaactccatagtctcggtctccacggataaatctgcccgcgtctttgacatctctatgttcaagtgagaaaaaaatcatagtagcaacagcttggttgatttggttggtcagtcaagattggggtttattcagcttgtatggcaggaattatacttacaggcttgcagccatcatgggggactcaaacttggtacttgttcttgacatgttgtcagtggcgcaagtggtacaagagtcacaagaccctcctaagttgagggtagtcggtcgtgtgtacaagcactttatttacctaacgttggggttttgcttgacatt

SEQ ID NO: 16723 - DNA, 866 bp, Triticum aestivum
  Clone ID: PAT_TA_16723
ttcggcacgaggcttgcctccatcccattcaaagggcaggttcttaacgagacaagcctttggtggttcaacaggaccagtcacatcactccaaatgcagtggtctctagtcctgacaggaatgtgacaattgccaaaaggtgctcagtttttccagttgaatttgtcgtgaggggattcgttactggaagcactgatacatcactatggacagtttataacaagggcgtgaggaattactgtggaaatgccattcctgatggcatggtaaagaatcaaaagctgccagcaaatatcctcacgccaacaactaaagctgctgatcatgatgtccctatcactcctgatgagatagtcaagtcagggctgatgtccaaggatgattttgatgaggcaagaagcaaagccttaagcttatttgagtatggacagaaagtggcattagagaatggagtaattctagttgatacaaagtatgagtttggaaaaacagctgatgggacagttgtgttgattgatgaggtacatacacctgactccagcagatattggattgctaattcatatgaagagagattcaaatctggccttgaacctgaaaatgttgacaaggagttcttaaggctgtggtttaagaataattgcaatccatatgaagataaggttctaccggaagctccagaagaactagtttcggagcttgcttggcggtacatattcctgtttgaaacaattacaaatacaaagtttgagatcccagaaacacaggaaccgatccatgaaaggatatcaaggaacgtggcacaagccttacggaatttataattgctaacactgaaaaaagcacttgctcgtgacaataagcg

SEQ ID NO: 16724 - DNA, 870 bp, Triticum aestivum
  unsure (1)..(870): unsure at all n locations
  Clone ID: PAT_TA_16724
attcggcacgaggcccagctggcccatattgggcccaaatggccagcctacttagcccccagccactggaaccctagctcccgacctctccaatcgccgccgccagcgccatcacgcacgagagcacgcgtgcacgcgacccgcgcctcctgccgccttccgccggtcccggccgctgccgccgcgagcccgccgaccaccaccatgcctcctcctttcctctcctctctctctcttccttctctcccgtctcaaggccgcgtgcccctacgggtcacggccatggccgccgcctgagcacaagctccagccggccgccgcacctggctgcgccatccgccgtccctgcggtgggtggcggcggcggcggcagggcagtgggtgctggcggcgcctcgtcccagctgaggcagctctcttttttgagtcgctcgactcatatatgtcgactagtccagactagtcgtcgactagtccatccacggctcgactcgtatttgtagtctacacgagaaaatgagtcgacatccactctgcgactcgtagactagtcgagcgactagtctagactagtcgttcgactcgtaatcnactgatagttgtgccactctcttttaggttttgtttctcatctttagaagtctnttgtagtggaaggaagggcaaggcaaaacctgtctcaggtacctcgctctctggggcatgtcaccccctggcctcggcgccgcttcgctctcgccctgtgcgacctgtgtgtctgtgcctgtccgtgctcttttggcaaattacttatttatgatgaggtagtgtaaattgttttgaaactatacaccatctatccctgatgctaactcagtctctcctcatatg

SEQ ID NO: 16725 - DNA, 1122 bp, Triticum aestivum
  unsure (1)..(1122): unsure at all n locations
  Clone ID: PAT_TA_16725
cccacgcgtccgttggcgcgtgcgtaagtatggcagcttgctcagccctctctgcggcgacccttccctcggccgcggcgccggtcagcagacggcgagcgacagcgtcgccgcggcttcccggcaagcgcgtctccggcgctgtgcggtgtagggctgctccaggcggactcggtatctcggggaaggtggccgagctgtggcaggcagcgaggagtgcgcctccggggaccgtgctcgccgccgtggctgccgcggcggcggtctacaaggtggcgtccggcctcctcgccccgccgcctccgccgccacgacgatggcaggaggtggctgatgaggcgctgccaccagctccggagcctgtgcaggtgggggagatcacggcggatgagctgcggcagtacgacgggtctgaccccgagaagcctcttctcatggccatcaaggggcagatctacgacgtctcccagagcagaatgttttatgggcctggtggaccatatgcattgtttgctggtaaagatgccagtagggcattggcaaagatgtcctttgagccacaagatctgacaggtgatgtatctggccttggtccatttgagcttagtgccctgcaggactgggagtacaagttcaccagcaagtatgtgaaagtaggaaccgtcaaaggaacagggcccgtagaacaaggtaatgttagcactacctctgaaatacaggaggaagctgctgcggtgaaactgaatggagagaaagcaccatgaggcactactgtacataattgaccctgaatttcgacgagatatactgtatagctttggatccaaagagagccagaaactggatgcctcctagctgctacagtgatgttacctacatgctatctggagtgtaattcacagatatactgtatagctttgtccgactagaagctgaagtgtaatgttaagtatcgaatgactgaattagagaattagtagagtatgatgcctcgttgttgcactccacaagataatgctgttgattttcctttgtcactcgaaaaaaaaaaaaaaaaaaaaaaaaaaaaaaaaaaaaaaaaaaaaannaaaaaaannnaaaaaannaaaaaaaannagaggg

SEQ ID NO: 16726 - DNA, 699 bp, Triticum aestivum
  unsure (1)..(699): unsure at all n locations
  Clone ID: PAT_TA_16726
ggagcgcggcgccgggcaaaggtggggcggaagcgccgatctcccccgattccatgagcaggagcggaggcggcggccgcgggagacaacaacccgaggccgaatctgcggccgtgcccgtcccggggccctgcgcctcgacccatcgggctctcgccgagtgccaccgccgtgccgcccgcggcccgctgcagcccgaggtgccgtgccggcacctcaaccgggccctagccgagtgcgtggtgaacatgtgctgccccggcgagaccgacgccgtgcgcacgctctgcggcagctccggcaccgcgctcaagcgctcccagtgcgagcgcgcgcgcatcgacctctccctctgtctcgaggcccatacatgacctacgcaacccaaaacccatgtggtccggtacattcctatgctgttttattgtacgattttctgtaaattcactgatgttggagatgtggcctggttcgggaacacccctttatgcatagagtgtatagtaagataagagaggatccagggactctggagacaagacgtgttcttgttactgaataacttcaattccaaatggacgttcctgatcatgacttcctatctattacgggtttactgggtatcgacttaagngaatacacaagttgggaaccggcaatatnctacgggtatatcccaanaatgcccaaatntcccaa

SEQ ID NO: 16727 - DNA, 354 bp, Triticum aestivum
  Clone ID: PAT_TA_16727
cgtcgcgccgtcccgcgccaccgtccagcgagagatccgggaggccatccgctccgtggagccgacggtgacgccgaccgccttgtagcatccatccatgttgtcatgtcgatgttgcgggcgctgctggccgggtgttcttgggccttaatgaatcgcgcccatagttttgacgcggcagacgggggcgaattggggcaactcttttttttttagggttccattgttgtgtgtgtgttttttggggtataacggtcgttggtacatacaccaatgtctgcagctagcagttcagatgaaatgtatgttgcgacatccatttgaggataaataaatcttgtaattaattaaaaa

SEQ ID NO: 16728 - DNA, 1313 bp, Triticum aestivum
  unsure (1)..(1313): unsure at all n locations
  Clone ID: PAT_TA_16728
ggcgggggaagggcgcactgcaccgcagtctgcgccccggtggcgcacaacgaccggtccccggtgctgctgccgatctgcggcggcatgggcgccggcaacacgaccgtgctcacggcggtactgccagaggcgttttgggcagaggcggggacgaacgcgctggtggttgaggccgccgctttgtaggagaaggaatccatgtaccgcgcaattagctccatgggccaccacaacgacatgcttcagagcgcagagctggtgcacaagtcgtcgattgacgcggcgtcgtcgctgctggtgacggcgctgaacgaggggcgcgacgtgatcctggacggcacgctctcctgggagcccttcgtggagctgtctatcgccatggcccgggccgtgcactcccagcgccaccgcatgggcgtgggctacaaggtggacgaggacggcaccatcaccgagaactactgggagcccgtccccaacgaccaggacttcgtcgccgccaacagggaccggaagccgtaccggatcgaggtcgtcggcgtcgtctgcgacgcctacctcgccgtcgccagagggatcaggagagcgatcatgacggggagagcggtgagggtgaactcgcagctcacgtcgcacaagaggttcgcggcggcgttccagaagtactgccagcttgtggacggggccaagctctacagctccaactccttgggctctccacagctgatcgcgtggaagggcgacatcaacggcagcctgctggtggagccgcgcgagatcgactgcctggacaaggtgagcaacctcaacgagggcgccacctccctgcacgacctctaccccggcggcgccaccacctgcggctcccgctccatctgggacgacatgatcgtcgcgccgtcccgcgccaccgtccagcgagagatccgggaggccatccgctccgtggagccgacggcaacgccgaccgccttgtagcatccatgatccatccatgttgtcatgcatgttgatgttgcgcgcgcactgctggccgggtgttcttgagccttaaaaatgatcgcggccacggttttgacgcggcggaccgaggcgaattggggcaactcaagttgctgtgtgtggttttttgtggtaaatggtcgttggtacatacaccaatgtctgcagctagcagttcagatgaaatgtatgttgcatcgacatcaattgagagtaaataatcttgtaactaattacctgaataataatatttctctactctatagtccaacttttattaaaaacagggggccggaccaatcncctaa

SEQ ID NO: 16729 - DNA, 218 bp, Triticum aestivum
  Clone ID: PAT_TA_16729
gtacggactgcaattcgcgggcagacggggaacgccaggagtttctgagtcgagccaaggatggatgcttgagccaagtgtggttgtgtgtaattatggtccttatgtcgacgtgttaattgtcgtgatttgccgattggtactctatatgtttgccaaataagctgtgcaccgtgtgcacctttggaacagtgaagtagtaattattttgtgagctt

SEQ ID NO: 16730 - DNA, 911 bp, Triticum aestivum
  Clone ID: PAT_TA_16730
cccacgcgtccgcccacgcgtccgcccacgcgtccgggaaacacgatcgtggtgaagacatccaccggcgatgagttccacggcggcaagtgcatcatcacggtgggtgcgtgggcgagcaagctggtgaagtccgtcaccggcgccgacctgcccgtgcagccggtgcacaccctcgtgtgctactggagggtcaagcccgggcacgaggaggagctgacgacggaggccggcttcccgacgttcgcgacctacggcgagcccggcttctacggcacgccgtcgatggagtacccgggcctgatcaaggtctgcaggaacggcgggccgccgtgcgacccggacggccgggactgggccaccgggaccggcgcgggcgggatcgcggaggtcgtggcgcggtggatcgacgagtttatgccgggcgtcgtggacaccgccggcgggccggtgctccggcagccgtgcatgtgctgcatgacgcccgacgaggacttcgtgatcgacttcctgggcggggaggagttcgggaaggacgtggtggtcggcgccgggttttccggtcacgggttcaagatgggcccggccgtcgggacgatcctcgccgagctggcgctggacggcgagtcgggcacggcggcggaggccggcttggagctcgagcactacctgatcggacggttcgagggcaacccgatggggaacgccacgagtcactgaggtgaaaattgccgtcgacgtcgttcacttcaccgtggctgtgtgtgaccaccgcgattgccgtccaattggtctgtgattgccaataatctgctgcactgtgtgcaactttaatatgttcatttttctccccactagaagaaatatttttatgtgagctttcgcaaaaaaaaaaaaaaaaaaggccccta

SEQ ID NO: 16731 - DNA, 1767 bp, Triticum aestivum
  Clone ID: PAT_TA_16731
cttccgcccacgtgcctcccaccgcgaccacgcgtggagaacacgcacggaaacagcaaccatggctgcgcatcatggcgagcgctcgttccgcgtgatcgtggtgggcgctggcatcatgggcagctgcgcggcgcacgcgccggcggcacggggcgggcgcgtgctcctgctcgagcagttcgccctgctggatcagcccgcgtcggcggccggggaggcccccccgaggggcgcgtcctacccgcagccgcgctacgcggccatgggcggccgcccgcgtcggccccgggagcgcccccgccgtggccgcgcagccggtgcgccggcagcccgaccgcgagcgcaaccagctcctgaaggaggacccgcagggaacggccagcgggtccaccacgtgctgcactgtcggcgggcgcgcctcttcctgccctctgacgggggaatacccggccgcgctctcggtgcgcgggaacggttcgccggcgagcgacgggcagggcgggggcacgaaggcaggcaagggggtgggcgggatcgcggagcatcgtggcgaggtggatcgaggagtttatgacgggcgtcgtggacacaaccgacgggccggtgctccggcagccgtgcatgtgctgcatgacgccggacgaggacttcgtgatcgacttcctgggcggggaggaattcgggaaggacgtggtgattggcgccgggttctccggccacgggttcaggagggcccggcgcttcgggaagatcccccgccgagctgggcgttggacggtcgagtcgggcgcagcggcggagggcagcttgggagctcgagcactacctgatcggaaggttcgagggcaaccccaatggggaaccccacgagtcaatgtggtgaaaactgggcgtcgttcacgccagggtcaccgtggctgtgtgtgaccaccgcgattgccatccaattggtctgtgattgccaataatctgctgcactccacgtgtgcaacttcattgtgttcctttttctccctatggaagaaatatttttatgcgagctttcgcacagtgaagtgaagagggacatgtgcgaatcgccagacgggcgtactgatgtctgtccgttagttagctactctgggggtagacagtgtaatattagatgcatgcatgatatggtatccccgtcgccctcgtagggcgtagcgattgatgccgctggtgagtcgttttcgagtagatggacttgtgcacggcaggcagtgatgggtggacaccactcacttgcccaggaatgtgttcaaatcccaagcgaagtccaaatctgcttatctcattgcttctataggcaaacacactttttcaacatagtagaaagtagaagaccttctatacgcctgtaattatggtccttatgtcgacgtgttaattgtcgtgatttgccgattggtactctatatgtttgccaaataagctgtgcaccgtgtgcacctttggaacagtgaagtagtaattattttgtgaaaaaaaggaaaaaagaaaaaaaaaaaaaaaaaaaaaaaaaaaaaaccggccgcccaaaaggatcaaacctaacttacccttgaaggcaactccaaacccctccaaaagggccaccaaaatccaatccacgggccgccgtttaaaaacgccgtaacgggaaaaacccggccgtaaccaaactaaaccgcctggaacaaaaccccccttccgcaaccgggcgtaaaaccaaaaaggcccgaaccgattgcccttccaaaa

SEQ ID NO: 16732 - DNA, 521 bp, Triticum aestivum
  unsure (1)..(521): unsure at all n locations
  Clone ID: PAT_TA_16732
aagactgcgccaaggacaacaaaaacgaataggaggtagtactgatgcctcagataacatcatatctgacaccgacaagatctgcatgcagctattccttgatattcaggaatatgcgcggaaccttcgcaccctgggaatagatgcgagagaaattgaatcctacagatctctctggcagtgcgtcgcccctaaagacaagcaagatagcatccagttttgatgtaaaacacattgtcagtacatagaaaatgttgcctataggtccttgggattgcctagatatgtctggtgttgttcattagcttggagattcgtgagacttgtacgtggtagagcgctggaccttgatcgctgtcattgtttgaatttactagtcggtcacctccagaatccagattttacaatgacagactcaaaacgtctatcagtcagtcgccctcggggtaacccccctaggctgtctggccctaacatttagatcaaccntttgcgagcaacaatcccccccctctttcggc

SEQ ID NO: 16733 - DNA, 1139 bp, Triticum aestivum
  Clone ID: PAT_TA_16733
ggcccgccgcccgacctacccaccaaccaccccgcggcgagactgaccagactgaccagactgaattgatcggcaataaatcagcacgctgcacgcgctgggggtctgagtcggaggaggaagaagatcgaggagcagctgattcgctcgcacaaagcgccgggatcagatccatctctccgcgcgcgatgtctgaggtggcggcgatggcggggcaggcgtacatgagacagctctccaagcaccctctccgcaccaaggccatcacctccggggtgctggccggctgcagcgacgccgtcgcccagaagatctccggcgtcaagaagctccagctcaggaggctcctcctcataatgctctatggatttgcatacgcaggaccattcggtcattttttccacaagcttatggacaagattttcaagggacagaagaaaggaaaagaaactacagccaagaaggtcatagtggagcagctaactgtatcaccatggaacaatatgatgttcatgatgtactacggtctggtagttgaagggaggccattcgggcaagtaaagagcaaggtcaagaaggactttgcaaacatccaattgacagcttggaagttctggccaatagttagctggatcaactatgagtacatgccactccagctccgagttcttttcgccagctccattgcatcatgctgggcagtgtttctgaacctgaaagcagcaagatccattgccggcgctagtaagaatgcataaaagaaggatggaaggaaggggctagtgctacattgtatttctagctaattaagtatccactagtgattttctcagttcatttttatcactcagtttgtatttatgtttctatgtgaacccctcgagcatcgagaacctagagtgaatgtttcaactaagtatgtgagtatgtcaatgtgaagagtccctttcttgccactgggaaaaaaaccctacaaagcaaaaattatcctctagaaggtaccatgtttgtttttcctttgggaggaaaatagggactgtactgggatctgacgcgtggaaataaatgaacatgctctgaggtttgtagaatctcaatgaaaaaaaaaaaaaaaaaaaaaaaaagtcgacgcggccgcg

SEQ ID NO: 16734 - DNA, 634 bp, Triticum aestivum
  Clone ID: PAT_TA_16734
attcggcacgaggcgcagtttcgtgcaccgcatcttctccacccaccacctacctccccccgtgttcccctcccccctcaaaacctatcgccgcagaccatccacccaccgacgagcgatcgccacggccgattgatccacagcgcggggcggtggcgcaccagatccggccgcggcggcgatgatgaagcagctgctgccgcagagccagctgcggcgctcggcggcggcgtcggcggcgcgctcctcggggggcggcgtcggggccgagggcgcgggtgggcccgacggcgtcggcgcgggcgcgggggcgggcgggcggaccgcctcctcctccaccttctggttcctgctccacgcgttctgctgcctcatctcgctcttcctcggcttccgcttctccaggctgctcttcttcctgctcttctccagcagcgcgctctacgccgccacctccaacaacaagtcggccgtgctccgcgccatcacgacaaccacgacgacgaccacgacgaccacaaccacgaccaacaccttcaccctctccttcgccgccgcgggcaacccgcccccgtccaacccggacaacctcaccgccgccgcgctcgaggaggccgcggggagcacgcagagc

SEQ ID NO: 16735 - DNA, 919 bp, Triticum aestivum
  unsure (1)..(919): unsure at all n locations
  Clone ID: PAT_TA_16735
attcggcacgaggccccctcaccgccggccaccgccgccgcagccgccgcgatcgatcgccgtccgccatggcgctacgcagagccgcctccctcgtcctcaggcagcgcctccggaccctcgcccccgttcccgcgcccgcgcccaaacccccaaaccctctgctcccgcatccccgccgccattactccccgcggccgccgcccgcgctccccgcgtccgcccgcgccctcgcggaggcggccgaggaggcgttcgaggcggcctccaccaccaccgacctcttcgccgccttctcccgcctagagaacgccgtctcgcccaccgacaagcggctcgccctcgcctgcctcaagctcggccagcacctcgactcctcggcctccgccgacccctcccgcgtcctcgagctcgcgctccgctccgtcgggatcctcgaggccgggggcgccaggtcctccggggcgtcgtcggactccgacgccgtctcgctcgccatggccctccacctcgccggctccgcctccctcgacctcacccgcttccacgacgcgctctccttcctctcccgctccctccgcctcctcaccccgcttctcccggctaaagacgccgccgnttggggacgagggcggcgaccccgatgccgaagggttcgacgtgaggcccgtggcgcacgcggtgcggctgcagctcgccaacgtgaagacggcgctggggaggcgggaggaggcgcttgccgacctgcgtgccagcgtggagctcaaggagtcgatcctgccgccgggcagccggggagctcggcgctggcgtatcgggacctcgcggaggnacacncctccgtgnctttgacntcangcaggccgctgcccttctnccnaaaacgggngcttggcagtctgcaatgnactccgactct

SEQ ID NO: 16736 - DNA, 1436 bp, Triticum aestivum
  unsure (1)..(1436): unsure at all n locations
  Clone ID: PAT_TA_16736
gttctagnacgcgatctagtaactagcggacgcgtggggaggaaataggtttgggtaaaactcaaactgcatctacttctgtccatcagcctgccggacctcgcaatttggccattggtgtgaaatcatcaaatggtgctggtcctggtgtacaaaggcgaggtataaaaaaccttggttgcacatcaatctctgatgttttgccgtcaggctgttcttcatctaattctgtccatagtaagaggactgagattacgagaaagaggatttctgatggggagacttcttcaagaccaagggctttaagtgggcagccttccttgtatcctggcagtactggtcctagagtcagagactctgaacaatcagcttctcaacaaacaacaaggactagcaacagaattattcgggattctgcagattcagtaaggactaggcgtccttctactcagcaggctaggatgaggatgccagatgaaacagagcagggcgtgtttgctctgcgtgagactttttcaggggctcgtcaaccagattgggcccgattttcgatgaacgaagttcccccacagaggtcaacaaggccttttcctatggagttgcctcatgcaatttactcttctagtcgtcaaggctctagtaaccgtgcatcaaggagcagagggagttctcgtcccgaggatagctctccacaaatgtttagagatgtctacagacgcatgaacatggacggaattgcagaggtgttgcttgcattggaaaggatcgaacaacatgatgaattgtcttatgagcaactgctggtgctggaaaccaatctattcctcagtggccttggcttgaatgatcagcatagagatatgagaatggatattgacgacatgtcttatgaggaattattacaactagaagatagaattggctccgtgagcactgccctttctgaagagcaattgacaaattgtctcagtcgagtcgtgtataaacgggcgaatccggcgctagaagtgaacgaacctgtcgtagatgatgtcaaatgcagcatatgccaggaggagtacattgaggacgaagaggtcggtagaatgaagtgtgagcatcagtaccatgtgtgctgcattcaggagtggcttcgacagaagaactggtgtccgatatgcaaagcttcagcagtaccttcgccgtcggacgccgcggacaagggggatacatgaatctatgtcaaataccccctccgtcccataaccagtgtctcaacgcgttcttgacgctacaccttagtttgtgggacggagggactggtatgctctgaccgtgggaccaggttggacatcccaggcgccgcccctagtcagcgcccgccctcccgcaaatcaaggccctccaacttgtgaatatatacatgatgaactgtttctctcaaaaaaaaaaaaaaa

SEQ ID NO: 16737 - DNA, 655 bp, Triticum aestivum
  Clone ID: PAT_TA_16737
actgtgcggcgctcaagccgggcgggggccggccggccgggccgggatcccaaaagtttctcatccacgaaagacaccgtcgatcaagatgagagccaaatggaggaagaagcgggttcgccgcctcaagcgcaagagaagaaagatgagggccagatccaaataaacgcatcgcatctcaacctgacttgactcatctatcatgatgttacgacctcgcacgcctcaacgataccttggccgaagcagggcacttgccgttctggcgcctctgggatctcccgcaacgcattgagctgggatttgactttgggaattacgtcagggtggttgaaccccgcacttgagcggctgatgtggcacacaatgaatattatggtggatgggattatgacaatcagatggtcaggtacaaggcggtgttggatcgaccactatcaaatgctcaccaacacaaagcatcacaacaacattcaaagataaagaaatacagagattcctctgccaaaaaaaaaaaaaaaaaaggcccctaaaaaaaaaaaaaaaaaaaaaaaaaaaaaacggcccctactaaacactcccatcacacacactgcaagaggaggcccctggcaatggtcgaggttcaattgagtgagaatgaggaggagcccga

SEQ ID NO: 16738 - DNA, 783 bp, Triticum aestivum
  Clone ID: PAT_TA_16738
gaggggcaaaccctactgatatatcctacatcttttctggtacgcacctcttagtatccgcctggttcagcatggtgtacaattgtgctggcgatctattgaagaactgttgaaattattgccaggtcctcatatggatttgaaaagaggtgtctcgaccattagttcatcagaattactaccaggttccgggtcacaacagagtaccgacagggttggtcatcgctccctggttctggttgtatttattggtggtgtaacatctgctgagattgctgcacttcgatttcttagtgcacaggaaggaatgggctatgacttcctggttgcaacaacaaaggttatcactggcaacacattactgagaccaattatagccagcagcaaagagggaatgatttagttgtcttttctgtgcacacccctttttgattgtacaaagcagcagcgcacacccgagcccaagatgggattttccttggttcagttctaggccacttctattctgccaccagaaatgctattgcttgcgctcttgcgttcatcagtcttggttttctcgtcagatagcgcatgtacatcgatatctcctgtacagacacagccgcgctagttccttccttggtgctggatggaagttcagcattatgttttttcatgtatattctcgaaatacacaccttcatttctaactctgttctgctttcaccttgtacatcacgacgggtatgtttagttcttttttctgtgcggcaatgccaactctgcagtgcaaaaaaaaaa

SEQ ID NO: 16739 - DNA, 678 bp, Triticum aestivum
  unsure (1)..(678): unsure at all n locations
  Clone ID: PAT_TA_16739
cggacgcgtgggcggacgcgtgggcgacgcagcacacatccgccgtagccaccgctcctcctagcttgcttgttccgttgttcgccggcggcagagaaagaaggcagacagaggaggaatataccggtcgagatgtcgaagtacgtggagatgctggacatgggcgtgcgcatcgcggccaggttccactcccactgcccgcagacggcgcgcatgtactacaagccgccgcagtccacctccacgtcgtcgtcgggcgccgccgaggccgcgtcgacggatcggagggccgccggctttgacggcgaagacgtggctgctggcttccggcccttcgccgcatcgggagggttcggcgacggcgtccagccgcggttcggcttcgacaccgcgcaggtcgtcatctacgaggtcgtatgagtcgagggcttgaacaacggcgacgaattctaatttctaaaaggaaagaggtctctttgatgagatttttttttgcggccaatgagttgattgattgtactagttgtctataacatcattctttttgtagtttgtggccgtgctggaattgatcaaatacagaattttcgttattgattacttgtattaatttgggcatttgncatactgacaacaaacatgaatctcgtcctaaaaaaaaaaaaaaaaaagggcggc

SEQ ID NO: 16740 - DNA, 689 bp, Triticum aestivum
  unsure (1)..(689): unsure at all n locations
  Clone ID: PAT_TA_16740
actgtgcggcgctcgagccggccggaaaaaaaacgtgccatcccaagcacacgcaacacgcatccccgtaccaactgctcctcgctccgctcctccttgttccgcggcggcggaacacatcgagatggccaagtacgcggagatgctggacatgggcgtgcgcatcgcggccaggttccactcccactgcccgcagaccgcgcgcatgtactacaagccgccgcagtccgcctccacgtcgggcgccgccgaggccggcacgacggaccggagggccgccggcttcgacggcggcgaggacgtggctgctgccttccggcccttcgccgcctcgggagctctcggcgccggcgtccagccgcggttcggcttcgacaccgcgcaggtcgtcatctacgaggtcgtatgaggctcccagcaacgagggcgggctcttctgtggagagatctcttggatgagaatagttttgcgaccattctttaattagtttgtgtatacgtgctggaagaattgatcaaagaaagagctttttcttcttagagctttttcttcttacttgcatttgtgcatattggaaggacaatgatgaatctcgtctagtttttcccttcagaggaatcnnaananntnanaccacccgctctcaataaacaaaaaacacaaacacattatgaaaaaaaaataaaaa

SEQ ID NO: 16741 - DNA, 651 bp, Triticum aestivum
  unsure (1)..(651): unsure at all n locations
  Clone ID: PAT_TA_16741
ctctcctccgcaagcacacgcaacacgcatcccccatagccggaacgagctccgcttctccttgttcccgcggcggcggaacacatcgagatggccaagtacgtggagatgctggacatgggcgtgcgcatcgccgccaggttccactcccactgcccgcagacggcgcgcatgtactacaagccgccgcagtccgcctccacgtcgggcgccgccgaggccgccacgacggatcggacgaaggcggccggctttgacggcggcgaggacgtggctgctggcttccggcccttcgccgcctcgggagctctcggcgccggcgtccagccgcggttcggcttcgacaccgcgcaggtcgtcatctacgaggtcgtatgaggctgggaacaacgagggcgggctcttctgggaagagatctcttggatgaggatagttttgcgaccgaggaattggtcgattataacaccattctttaattagtttgtgtacatgccggaagaattgatcaaagaaagagttttttgttattgcttgcatttgtgcatatatactgggacgacaatgatgaatctcgtcctgttttttccttcagaggaatcaccaaaatgtccgttaaacaaacaagaaaaaaaaaaaaaaaaaaaaaanaa

SEQ ID NO: 16742 - DNA, 663 bp, Triticum aestivum
  Clone ID: PAT_TA_16742
tcgacccggcatccggcgaccgcccgtccgtcgacgctaggtccgagccagaaaaccaaaagcgccggtcgccggatcgccggatcgccggacgagagagaccatgtccctcccgcgggcagccgcccccgtcgcgtgaccggccaccggggcagccatcgccatcgccatcgccatcgccgccgccgccgcccaggccatgcccaagcagcaccccaaaagtccctgccctccctccctccctacggcaagcaagcaagcaagcaagaaagcggagcagggtaaggaggggggatggcggatagcggcggggtcaacgccaacaacgccgccgccggcaacgacgaggaggagggcaacaccgccccgttcccccgagtcggtacaaatatgaggatatcccgagtacagggtccctaggaagctcggcaaatatggctttggaaaggtcttggtcggcgtgcgcctaaccggtggaaaagcgcggcgcgcaccagcagctgcggttgcaactaaggcccaccacacgactggcgcgccttttctgctcgtaccggtactcatggtgtgcccaaggtgcattataaaggccgtcagggtgactactatgtcatgatcatggatatgctggggcctagcttgtgggattcctggaattcagca

SEQ ID NO: 16743 - DNA, 2045 bp, Triticum aestivum
  unsure (1)..(2045): unsure at all n locations
  Clone ID: PAT_TA_16743
agctgaaccgttccaaacttgcagttccaacttcaacctcctcctctcactcactcctatttattacagtagctaagcttccctcttctcctcccgccgagcccccttccttcctgatcacagacagccatttcttgccattcgcatcacatagcagccagcagccacctcacctattttccacgcgggacagtgaaacaaattggcggcgcgcggaaaggaaacggagccacacgacgcctgaccagaggtttccagagggagagggggataaggcaggcaggcaggcaggcaggggatgagtacaaccaaggtgaagaggcgtgtgggcaagtatgagctaggccggaccatcggcgagggcaccttcgccaaggtcaggttcgccaggaacaccgagaccggggaccccgttgccatcaagatcttggacaaggagaagcttctcaagcacaagatggtcgagcagatcaagcgggaaatcgcaacgatgaagctgattaagcatcccaatgttgtccgcatacacgaggtgatgggaagcaaaacaaaaatctacatagttttggaatacgtcaccggnggcgagctctntgacacaatcgttaaccatggcagaatgagggaagatgaggcaaggagatacttccagcagttgattaatgcggttgattattgccatagcagggggggtgtaccacccgtgatttaaaaccagaaaatccgtgtactaaaaccatgaaaatattacttgattcatgtggaaattgaagtgtctgattttgggctgagcgcgctatctcagcagctcaaggatgatggattactgcacacgacctgcggcactccaaattatgttgcaccggaggtcctcgaagatcaaggctatgatggcgcaatggcagatttgtggtcatgtggagtaattctgtttgttctgctagcagggtatttgccttttgaggactctaatcttatggccttgtataagaaaatatcagatgcagagtttacgtttccgccttggacgtcttttcctgccaagaggttgttaacaagaatccttgatccaaatccgatgacgagaataacagttcaagaaatgttagaggatgagtggttcaagaaaggttacaagcgtgcggagtttgatgagaagtatgacacaacactggacgatgtggatgctgtcttcaatgattcagaagagcaccatgtaacagaaaagaaagaagaagaaccagtagctctgaatgcatttgaactgatttcaatgtcagcaggccttaatcttggaaatttattcgactctgagcaagaatttaaaagagaaacaaggtttacatctaaaagctcgcctaaagaaattctccgcaagatcgaagaagctgcaaagcctctaggatttgatattcacaagaaaaattacaagctgagactagagaaggtaaaagcaggaaggaaggggaaactcaatgttgctaccgagatactgcgagtcgggccttctcttcatatggttgaagttcgcaaagcaaaaggcgacactctagaatttcacaagttctacaagaacctttcaaacaccttgaaggacgttgtatggaaatccgacgatcttcagatccaaccttcctagcagcagcttgggagaaggggggatgggtaaactattagcatcccattcctcctgagttgatccattctcaggagctggatcaagaaaaaattgttcaccgcattttgtaagtaccgatggatagccctgttgtcagctgtgcttgtcctccactggtgttgtatatgctgcattttgagagacttcttggaacagtttaagtcaagcacattcaagtaggttttgctgtatattaggcatgtgggttttcgcaagtcgtatcgagttcactttggaacaatgcaatcaggaattcgcaaacatttagccgaatatgcttgtaaactcacatcggccggtcatcatttcgttcgttcccattgtaaattgtgagaccatggagttaatttcttgtttttgccttgtt

SEQ ID NO: 16744 - DNA, 1111 bp, Triticum aestivum
  unsure (1)..(1111): unsure at all n locations
  Clone ID: PAT_TA_16744
tccaaaaacttgccccgccaacctcctcccgcccccacctctcttgcatagtttatactccttcactctcccacgccgactcaccacaaggcccaagcaggcatgaacgggaaactcaaggccccttccgagcttctccgcgagcagccgcctcttcacatggttgcagttcgcaaagcaaaaggcaacactctagtatttcacaaggtaaattatcacacaattatgatgcgggtgtggggtccggctcctgaggggggcgccgattacggctacggtgacatggggggtctggacacgacgagctaccggcggtgtatgggcaagtataacctaggccggatcaccttcgccaaggaacaccgagaccggggaccccgttgccatcaagatcttggacaaggagaagcttctaaagcataagatggtcgagcagatcatgcgggaaatcgcaacgatgaagctgattaagcatcccaatgttgtccgcatacacgaggtcatgtggaagcaaacacaaatctacatagttttggaatacgtcaccgggggcgagctctttgacacaatcgttaagcatggcagaatgagggaagatgaggcaaggagatacttccagcagttgattaatgcggttgattattgccatagcaggggggaatgtaccaccggcaattctaaaaccagaaaaacctattacttgattcatgtggaaatttaatggtgtcttgaggttgggctgagctgtctgattttgggctgagcgcgtgatctcagcatgtcaaggatgacggatactcgcacacgacttgcggcactccaaattatgttgcaccggagttcctcgaagatcaaggctatgatggcgcaatggcagatttgtggtcatgtggagtaattctgtttgttctgctagcagggtatttgccttttgaggactctaatcttatggccttgtatacgttcctatcagctgcagtctgcacgttttgtaactgaacgtcttttcatccgtcccagaatacaactaaaaatcttgatataaatccgataaggtgcaaaccagttcatgtaaaattgaccacctggnggngggnntgttnaagatnaa

SEQ ID NO: 16745 - DNA, 552 bp, Triticum aestivum
  Clone ID: PAT_TA_16745
gggggcaccagaactcgatcgagatgatgccgctcttccccgccacgctgctgctcggcggcctgcagcacccggtcgtcgccgccgcgctggggctcctctacaccgtcgccaggttcttctacttcaagggctacgccaccggcgtcccggagaaccgctacaagcttggggggctcaacttcccggcgataatggggttgatcatctgcacggcgtcgttcggcatcaaccttgtcatcagggaagcgatctgaggctccggactgatgcctgacttgatagccgttgtgactggatcactggagtcatttcggcgtggtggtgatgatgtcttttgaagtgtcaaatgtgtgtgtgcgtttgttttactctcagaataaagctggatggagacagttttgcagtgcagattttgatacagtttccgtaaatctccttaccaatttccttgtgcgacatctgcggagcatgttatgctctcgttgtaatctccggtgacgttgatgttgttgtgcacattcctttttgatacaatctttaagccccttc

SEQ ID NO: 16746 - DNA, 903 bp, Triticum aestivum
  Clone ID: PAT_TA_16746
atttctctcggtttccaggaaggaagaaagaaaatccagagaaactccagagaagagaccaaaggtagacgacgatggcggtgttggtggagctgaccaaggaatacggctacgtggtgctcgtcgtggtggcctacgccttcctcaacttctggatgagcttccaggtcggcgccgcccgcaagaagtacaaggtgttctaccccaccatgtacgccaccgaggcggagaacaaggacgccaagcgcttcaactgcgtccaggtccgccgccgccgccgccagattccctctccgccccgctgatttcatttcgtctctgttattcgagtgactgaacgaattcttgtgggcttgtgttgtggggattgcagagggggcaccagaactcgctggagatgatgccgctcttcttcgtcacggtgctgctcggtggcctgcagcacccggtcgtcgccgccgcgctggggctcctctacaccgtcgccaggttcttctacttcaagggctacgccaccggcgtcccggagaaccgctacaagcttggggggctcaacttcccggcgatcatcgggctgatcctctgcacggcgtcgttcggcatcaaccttgtcatcagggaagccatctgaggctccggactgatgcctgacttgatagccgttgtgactggatcactggagtcatttaggcgtggtggtgatgatgtcttttatagtgtcaattgtgtgtgcgcgcgtctgttttactcacagaataaagctggatggagacgggttttgcagtacagattttgatacagtttccgtaaatctccagttttcttgtgcgacatctgcggagcataacattttgcagtacagattttgataccgtttccgtaaatctccagttttcttgtgcg

SEQ ID NO: 16747 - DNA, 837 bp, Triticum aestivum
  unsure (1)..(837): unsure at all n locations
  Clone ID: PAT_TA_16747
gtgcggcgctcgaggcggccgtatctcgactccatctcgtttccaggaaggaaggaagaaaatccagagaaactccagagaagaagaagaagaaggtcgacgacgatggcggtgttggtggagctgaccaaggagtacggctacgtggtgctcaccgtggtggcctacgccttcctcaacttctggatgagcttccaggtcggcgccgcccgcaagaagtacaaggtgttctaccccacgctgtacgccatcgagtcggagaacaaggacgccaagcgcttcaactgcgtccagagggggcaccagaactcgctggagatgatgccgctcttcttcgtcacggtgctgctcggtggcctgcagcacccggtggtcgccgccgcgctgggggtcctctacacagtcgccaggttcttctacttcaagggctacgccaccggcgtcccggacaaccgcctcaagcttggggggctcaacttcttggcgatcatcgggctgatcctctgcacggcgtccttcggcatcaaccttgtcatcagggaggcgatctgaggctccggactgatgtgcctgacttgataggcgtttgtgactcgagtcatttagacatggcggtggtgtcttttatagtgtccaaaaatgtgtgtgcctctgttttactctcacagaataaagctagatggagacggtttgtaacatcgaggttttgtagcttttgcagcacagttttaaatatggaggtgaatctccttccatttccttaaaagcctgacgtctccgggacatgataatggtcgctgntatgtccgaaagaatttaacgttatgtaatgttgtg

SEQ ID NO: 16748 - DNA, 906 bp, Triticum aestivum
  unsure (1)..(906): unsure at all n locations
  Clone ID: PAT_TA_16748
cccacgcgaccgaccacacaagggcgcagggagggaagacgccgaggtagacgacggaggaggtgggcgaggagcagcgcaaaggggaggtctacgcggtgggcgccgcgtgttccaatctctgcttccaatggcaaaccaagaggagagaccaaggtagacgacgatggcggtgtcggtggagctgcccaaggagtacggctacgtggtgctcgtcgtggtggcctacgccttcctcaacttctggatgagcttccaggtcggcgccgcccgcaagaagtacaaggtgttctaccccaccatgtacgccaccgagtcggagaacaaggacgccaagcgcttcaactgcgtccagagggggcaccagaactcgattgagatgatgccgctcttcttcgccacgctgctgctcggcggcctgcagcacccggtcgccgccgccgcgctggggctgctctacaccgtcgccaggttcttctacttcaagggctacgccaccggcgtcccggagaaccgctacaagcttggggggctcaacttcccggcgataatggggctgatcatctgcacggcgtcgttcggcatcaaccttgtcatcagggaggcgatctgaggttcccggactgatgcctggcttgatggccgctgtgactcgagtcatttaggcgtgttgatgatgtcttttaaagtgtcaaatatatgtgtgtgcgtctgttttactctcacagaataaggctgtatggagacggattataacatcgaagttttaggttttgcagtacaaattttgatacggttttcgtaaatctcgttactttcttgtgccacatctgcggaccatgttatgctctgttgttatctccggtgacgnttgatggttggtgtgcacattccctttttgatact

SEQ ID NO: 16749 - DNA, 893 bp, Triticum aestivum
  unsure (1)..(893): unsure at all n locations
  Clone ID: PAT_TA_16749
cgctcgtcggccggccggtccatctccggaacgtggccggctggcgcggggcttctcatccaccaattgtcatcacaaccaagcctttcgacactctcatccatcacagtctttcagactcacatactccctttttaaccacaaacccccccaaaccacaaaccctccaaaatgactggcggcggcaagtctggcggcaaggcctctggttccaagaacgcgcaatcgcgttcctccaaggctggtctcgctttccctgtcggtcgtgtccaccgtctcctccgaaagggcaactacgctcagcgtgtcggtgccggtgctcccgtctacctcgctgccgtcctcgagtacctcgctgctgaaatcctcgagttggctggtaacgctgctcgcgacaacaagaagacccgtatcatcccccgtcatcttcagcttgccatccgaaacgatgaggagctgaacaagcttttgggtcacgtcaccatcgctcagggtggtgttctccccaacatccaccaaaaccttctgcctaagaagacaggcaagactggcaagacctcaagcatggagctgtaatcgggtcatttggttctgtttttccatgcgatggcaggttgtttcggttgtcatgacaaaggggtcacggtttaagggtttacacggttgcttttcatcagtttattcgcgcgttcgggttgtacaataatcccccacggctatggtcatgaaataagaatacttctaagatcaaaaaaaaaaaaaaaaaaggcccctagtgtccagcctcttgcagntgtcagcttgaacatgtattagccgcttgatctgtgttcttgngtttgagacagcaccgctatgtaagaacagcgtggtggcagctaattcgcgcactc

SEQ ID NO: 16750 - DNA, 1077 bp, Triticum aestivum
  Clone ID: PAT_TA_16750
gtccacgggctgtaccacgagacggaaaagaccatcacaattggtggcgagcatggcacggtcgcctgggtggacctctggcgtggcatcttcttttgcgacgtgctcaagaaacgcccactgctccgggatgttccactgccggtgccggcaaggtctaactgggatcgcctcctcataaatgatgaccccggctatttccgggacgtaactatcagccgaaacaaagactcgatcaagtatgttgagttggaattccggtcaatagaagtgctcaaccccgccaccacccctgtttcctacaccgactgggtggcggtgaagaattcctcaaggaaatctcttcatgtcatccgcgatggctggaagtccacaacatggagcatggcaatacccgttggtttgcaggagcgctggaaccgtgactgtgtatttgatgttaaagacatcagcttggagccatgcctttctgatcgcatggctatgctgagcagcaagaccatgaaggaacttcaagtgggacaccccatcctaagcatggatgatgacgtcgtttacttgctttctgaaaccacacccaagcacatggacaagttggcactgatgtttgctattgatgtgaagaagtcaacactgcgaggattggctgagcttgatgtcaagaagttcgattacctgtccagcttctgcactagtgagatctgcaggggtacctgagcaatattaaggtagaagcgagctctatcgaataaacaaactgaagagggtaaaccatctgaggttcctgcgaagaactggctaggacaaagaaatttcaaccatgtttgttgaaacttgggagctggatgtgaccttggagattgaatttctttagttgatttattatgtattacatgtaatgcaactatctgggttatattgcttgcttatgtacttgtcccggtcaaaaaaaagtgctagtgaacttgtgtgggctaaatgtcttggttgaaccatgttttaatgtgtgttggtttggtgtcattgcttctgcccgccctcctgaagcccgaattcacccaaatttaaaaaaaaaaa

SEQ ID NO: 16751 - DNA, 1013 bp, Triticum aestivum
  Clone ID: PAT_TA_16751
cccacgcgtccgagaaatcagcgcttaatctgcaccgcagctgtatatattagctcgaactcatcgtccggccgggctccggagtccccaagaacgaacaggagcgaggaccggactggagacaatggcgtccgagtactcctttgcccgaggcgtctccctccccgcgcaccggccgcccctcgccttcacctcctacaggctgcggcacggtgccgccgtcgcgagggcgaatcgccgggtcgtggcagccagagcggcgagggcggtctcagtgggcgccgccaggaggatgcccggctcagtcagatacggcggcgccggggtagcggcgttgcgggtggaggagcggggggtggccgtgccaccgtcggtgccggtgcgcgtcgcctacgagctgcagctggccggccaccgctatcttgacgtcagaacggagggcgagttcgccggcgggcatccggcaggagcggtgaacgtcccctacatgtacagcaccggctcaggaatggcgaagaactcgcactttgtcgagcaagtgtcggctatcttccgcaaggacgatgagatcatcgtcggatgccaaagtggcaagaggtctctcatggcagcagccgaactctgctccgctggcttcactgccgtgaccgacatcgccggagggtattcgacttggagagagaacgggctgccggtccatggacggtgacatcgcgggctgaaccatcataatctgtcttagtatcccccgggataccacgtcagtgcactcaataagcaaatggagcttgataagatgtgtagaatatatgtgcaaggttaatgttagaatttccgttcatcacctgaactattgtaaactggtcccattacaagaatagggcatgcactgaatctaaagaatgctactaataatgtactgtagagttacagacaaggcggctagttaatgaacgactctttttttttggggggtgtagattactcatggcccatcatacagtcctccttac

SEQ ID NO: 16752 - DNA, 1022 bp, Triticum aestivum
  Clone ID: PAT_TA_16752
gtttctgccaaaagtagcgcttaatctgcatcgtagctagtatatatattggcttgaactcatcgtcccaagaaggaacaggagcgaggaccggactggagataatggcatccgagttctcctttgcccgaggcgtctccctccccgccgccgcgcactggccgcccctcgccttcacctcctacaggctgcggcacagtgcggcgtgcaccagggcgaatcctcgggtcgtggcggcggcgagggcggtctcagtggccgccgccaggaggatgcccggctcagtcagatacggcggcgccagggtagcggcgttgcgggcggaggaggccgaggtggccgtgccaccgtcggtgtcggtgcgcgtcgcctacgagctgcagctggccggtcaccgctacctcgatgtcagaacggagggcgagttcggtggtgggcatccggcaggagcggtgaacgtcccctacatgtatagcaccggctcaggaatggccaagaacccgcactttctcgagcaagtgtcggcgatcttcggcagggacgacgagatcatcatcggatgccaaagtggcaagagatctctcatggcggcagccgaactctgctcctctggcttcactgccgtgaccgacatcgccggagggttctcgacttggagggagaacggactgccggtcaatggacgcgggcttctataaatgtggttgaaacatcataatttgtcttagcatgctccgagacaccccatcagtgcactgaataagcaaaatggagtttgatatgatctacgcctccgtaccagaatacttgtagctggggaagctaatacaagttcccccaactacaagtatttcggtatataggtagtataggatgtatgtgcctatattaatgttagaatttccgtttttcaacttacctcctgtaaactggcccaatacaaaataacacatgtatgctacggtatttgcaaaacggaaccccaaaattacataataacatgtttactgatcgttcggctt

SEQ ID NO: 16753 - DNA, 2586 bp, Triticum aestivum
  unsure (1)..(2586): unsure at all n locations
  Clone ID: PAT_TA_16753
tgcaggnaattcggcacgaggacgataccgacgcgcccgcttttcttccttccggcaccttccaagtcccccttccttctggcctccccggcgatggcgacggcggcgagctccggcggcccatccgaccatcagtatgtctcggtcaagttggagagcccccgcctggcggcgctcgacctcgcccctcacctcttcggctcccaccccgccgccggctcgtgggacccttccaaagccctgccgatggagcgggcggcggccgccatttgggagctcagctgcgtcctcccttctcgacacgaaacactggatttcaagttactattgaagccaaaagccgatagctcagagtgcattgttgaggagggaccgaaccgaccgctaggttgcgggagcaatcaagtggaaatgacggatgcagtctttaaactcgctgagaaagattcacttgagtgtaaggtttgggttgagacagagatgttgtccccatttgacctagccgcaagctggaaggctcatcaggagaatcttcagccttcaagggtgcgagggacctatgatgtcgttatgaacactgagactgaagccagggacgagaatgacttcgcttctggtttggagcttgatttagagaagtatgtagtaccaacaacacccaacatgggctcaggtgttgtttatgcagctaacttgactgagaatccccgctctttattggacaccggtatctcaccaaacaatttgatcaaaggtgacgcacccctgaatcattatgctaacacaaagaaggttgtagatggaagacatactccgtcacaggaagaacaaaaggcagtctttgtagatagaggtgttggttcaccaaggtttgctagaccaacaaacgaaaccgtttcaacgagcaacatcaagcaggattctgaaacaaagttgggtatgccagcagcagaaggagctgttgcagcagcagctgtagctgatcagatgtacggaccaaaagaggaccgcaagttggtcattgtgctggttgggctgccagctcgtggtaagacctttacagcagctaagcttacaagatatctccgatggttaggtcatgaaacaaaacacttcaatgttggaaagtaccgtcggctcaagcatggcactaatcagactgctgatttctttcgtggagataacaaggagggtgtggaggcacgtaatgaggtggcagcattagcaatggaagatatgctatcatggatggaggaaggtggccgggttggtatttgtgatgccacaaacagcacaagaagtcgaaggaacatgctgatgaaaatggctgaaggaaaatgtaagatcatctttgtggaaacaatatgtaatgatcaggatgttcttgagagaaatattcgcctgaaagttcaacaaagtcctgattatgcggagcaaacggattttgaagcgggtgtgcgagatttcaaagagcgactggcatattatgaaaaggtgtatgaaccagtagatgaagggtcatacataaaaatgatcgatatggttagtgggaacgggggccaattgcagatcaacaatataagtggttacttgcctggacggattgtcttcttcttggtgaactgtcatcttacacctcgccctatcctgttaactaggcatggggaaagtttagataatgtcagaggaagaatcggtggagattcatctttgagtgaggtcggggaggtttattcaaggaaacttgcaagctttgtagagaagcgactgaagtctgagagaaccgcctccatatggactagcacactccagaggacaatattaactgcacagccaatcatcggatttccaaagatacaatggcgtgctcttgatgagataaatgctggtgtttgtgatgggatgacatatgatgaagtaaagaaaaataatgctgaagaatatgaatcacgtcgtaaagacaagctgaggtaccgttatcctagaggagaatcctacctcgatgtcattcagagattggaacctgtaataattgagcttgaaaggcagcgtgccccagtggtagtcatagctcaccaggctgtgttgagatcactatatgcatatttcgcggacaaaccactggaggaagttcctaagattgaaatacctcttcatacaatcattgagataaaaatgggcgtcactggtgttgaagagaaaagatacaaactcatggacgcagtgaacccaactgcagaggtctgaggcatggcgcatggagtctgtcctctcaattcagacagcacaaataaatttccggatgatagttttatttaccgaagtatgtagatgtagatgatacccaaacgtatcactatatttcattgtccagaagtaaagctatagtgcatcattcttttgaagtctggcacatagatgatcctagttttgaattttggctggcgatgtaaaggttcgcttggggcaatccagatggattcattcatgttcagctcaacttgttcattcaagatttacatgtaaccccacagattcactttatacggcccggatttgggatcgacccaagtaaccgcaaaaaaa

SEQ ID NO: 16754 - DNA, 801 bp, Triticum aestivum
  Clone ID: PAT_TA_16754
ctcgccgcacgcgccccaagccgccgcacccccgaaccctgaaccccgaagaagcagcgacggcagccatggcggcgacgaagatccggtggggcgagctagacgaggaggacgacggcggcgacctcgacttcctgctcccgccgccggtcgtcgtcgggcccgacgccaacggcctcaagaagacgatccactaccgctttgacgacgacggcaacaaggtcaaggtcaccaccaccacccgcgtcgtcaagctcgcccgcacgcgcctctccaaggcggccgtcgagcgccgctcctgggccaagttcggcgacgccgccaccggcgacgacgcctccacgcgcctcaccgtcgtctccaccgaggagatcttcctcgagcgcccacgcgccccagggagcaaggctgatgaaccaagtgcttccaatgatgaactggcgacggcaaacaaaggtactgctctcatggtctgcagatcctgtggcaagaagggtgaccactggaccgcaaagtgcccctacaaggatctcgtcgatactctggacaggcctcctacttctgacggacccgcagcactgaatgatcccgctaagagctcgtatgttcctccgaggctaaggaaggatgctgtttatcaagatggtgggcacgacatgaggcgcaggaacgatgagaactctgtccgcgttaccagtttatctgaggacacccgtgagcctgacctcctcgagctgttccgtgcgtttgcgcctgttagccgagtctatgttgcgctggatcagaggactggatcaagca

SEQ ID NO: 16755 - DNA, 568 bp, Triticum aestivum
  Clone ID: PAT_TA_16755
cccactagaaactccacgcgtatacgcacctgtatcggccattcagaggaaggcgggttcggatctcgaggttggtggcatcaaagtgcccgaaggcacggtcctaacgatccccatcgcgacgatacatcgcgacaaggaggtctggggagaagatgccaacgaattcaagcctatgaggttcgagaatggagtgacaagggccggaaagcaccccaatgccttattgtctttctccagtggtccgaggtcgtgcatagggcagaactttgcaatgatcgaggccaaggccgtgatcgctgtgattcttcagaggttctcattctccctatcaccaaagtatgtccatgcccccatggatgtgatcacgctgcggcctaagtttgggcttcccatgatcctcacgagcctagagatgtaaaaaaatgtgtatggtgttaagtataacacaaggtttctgtattatttgactggagtttagtttatgttgcacactagataagcttgtaaaattatcgatgtataatgtttccgatttgtaaattaaaaaataaagtgttttattaat

SEQ ID NO: 16756 - DNA, 730 bp, Triticum aestivum
  Clone ID: PAT_TA_16756
cccacgcgtccgcccacgcgtccgcacacatctcccagtctcaaccaactcaaacagcagtcgctgatatcttctacatgggtctcctctggatggtggcggcggccgtggcggcggtgctggcctcgtgggcgatcaacgcgctggtgtacctcgtgtggaggccgcgggccatcacccggcagctccgcgcgcagggcgtcggcggtccgggctacaggttcttcgccgggaacctcgccgagatcaagcagctccgcgccgacagcgccggcgccgcgctggacatcggcaaccacgacttcgtccccagggtccagccgcacttccgcaaatggatccccatccacgggcgcacgttcttgtactggttcggagccaggccgagcctgtgcgtggccgacgtgaacgtggtgaagcaagtgctctccgaccgaagcgggctgtaccccaagagcatcgggaacccgcacatcgctcggctgctcggcaaggggctcgtgctcaccgacggcgacgactggaagcgccaccgcaaggtcgtccaccccgccttcaacatggacaagctcaagatgatgacggtgaccatgtccgactgtgccgggtcaatgatgtccgagtggaaggcaaagatggacaagggcggcagcgtggagattgacctgagccaccactttgaggagctaaccgcggatgtcatctcccacacggcattcggtagcagcta

SEQ ID NO: 16757 - DNA, 1157 bp, Triticum aestivum
  Clone ID: PAT_TA_16757
ccctcccctctctcaaccaactcaaacagcagaggtatctcccaggtcgctgatatcttctccgccaccgtaggggcaaagctcccgacgacatgggtctcgtctggatggtggccgcggccgtggcggcggtgctggcgtcgtgggcgttcaacgcgctggtgtacctcgtgtggaggccgcgcgccatcaccaggaagctccgcgcgcagggcgtcggcgggccggaatacaagttctttgccggcaacctcggcgagatcaagcggctcctggcagccaccgccggcgccgtgctcgacgtcggctcccacgacttcgtccccagggtgcagccgcacttccgcaaatggatccccatccacgggcgcatgttcctctactggttcggagccaggccgaccctgtgcgtggccgacgtgaacatggtgaagcaggtgctgtccgaccgcagcgggatgtaccccaagaacatcgggaacccgcacattgcccgcctgctcggcaaggggctcgtgctcaccgacggcgaagactggaagcgccaccgcaaggtcgtccaccctgccttcaacatggacaagctcaagatgatgacggtgaccatgtccgactgcgctgggtcaatgatgtccgagtggaaggcaaagatggagaagggtggcgacatggagattgagctgagcagccaatttgaggagctaaccgctgatgtgatctctcacacggcattcgggagcagctacgaacagggaaaaaggtcttcttggcacagagggagctccagtttcttgcctactccactgtatttaacgtacaaatcccagcattgaggtaccttccaactgaaaagaaccttaagatatggaagcttgacaaggacgtcaggagcatgctcatgaacatcatcaaaacccgccttgagaacaaagacaccatgggttacggcaacgacctactcgggctcatgttggaggcgtgcgcaccagagcatgggcaaaatcctattttgagcatggacgagatcatagatgagtgcaagaccttcttcttcgcagggcatgacaccagctcacacctgctcacatggaccatgttcttgttgagcacacacccagagtggcaggagaagctcagagaggaggtgctgagggagt

SEQ ID NO: 16758 - DNA, 1178 bp, Triticum aestivum
  Clone ID: PAT_TA_16758
cggccgcgtgggcggcattcggaagcagctacgaacaggggaagaagtcttcctcgcgcagagggagctccagtttcttgccttctccactgtattcaacgtgcaaatcccagcattcaggtaccttccaactgaaaagaacctcaagatatggaagcttgacaaggaggtgaggaccatgctgatgaacatcatcgaaacccgtcttgccaccaaagacaccatgggacaccatgggctacggcaacgatctgcttgggcttatgttggaggcgtgtgcggtagagcatgggcataatcctattttgagcatggacgagatcgtagatgagtgcaagaccttcttcttcgcagggcatgacaccagctcacacctgctcacatggaccatgttcttgttgagcacgcacccagagtggcaggagaatctcagagaggaggtgctgagagagtgtggcaatggggctcccaccggagacatgctcaacaaactgcagttggtcaacatgttcttgctggaaactcttaggttgtatggccctgtagctgtcattcagagaaaggttggttcagatctcgaggtcggtggcatcaaagtgcctgaaggcacagtgctcacaatccccatcgcaacaatacatcgtgacaaggaggtctggggggaggacgccaatgaattcaagcctatgagattcgagaatggagtgacacgagccggaaagcaccccaatgccttgttgtctttctccagtgggcctaggtcttgcatagggcaaaactttgctatgattgaggccaaagccgtgatcgccatgattcttcagaggttctcattctccctatcccctaagtacgtccatgccccgatggacgtgatcacggtgcgacccaagtttgggcttcccatggtccttaagagcctagagatgtagtgttgtgttgagtacaacacagggtttttttattggtctcattgcaaatgtatttttttggaaagctactatgctggactttattgagaactagatagatcattcacaagttttttttataaagtgggttcctttcttataaattgtggtcaaagtctagagggtatgcctaagatgcatttcggtgttctaccaaaaaaaaaaaaaaaaaaaaaaaaagggcgccgctcgcgatctagaactagt

SEQ ID NO: 16759 - DNA, 1847 bp, Triticum aestivum
  Clone ID: PAT_TA_16759
gccggccttctcgggaaacggaaacaacacatttcccggccacgagcctgtctcaaactcacagaaccagagcgatacagtacaggccgccgatattttctcctccttcccgaatcctgagtgaccaccggcatgggtctcctctggttggtggcggccgccgtggcgggggtgctggcctcgtgggcgttcaacgcgctggtgtacctcgtgtggaggccgcgggccatcaccaggcagctccgcgcgcagggcgtcggcgggccgggctacaggttcctcgccggcaacctcgccgagatcaagcagctccgcgccgacaccgccggcgccgcgctggacctcggcaaccacgacttcgtccccatggtccaagccgcacttccgcaaatggatccccatccacgggcgcacgttcctctactggcttcggagccaggccgagcctgtgcgtcgccgacgtgaacacggtgaagcaggtgctctccgaccgcagcgggctgtaccccaagagcatcggaaacccgggaacccgcacatcgcccgcctgctcggcaaggggctccgtgctcaccgacggcgacgactggaagcgccaccgcaaggtcgtccaccccgccttcaacatggacaagctcaagatgatgacggtgaccatggccggctcaaccgtgtctgagtggtcggcaaagatggacaagaggggcaacgtggacatcgacgtgagcgagcagattgaccagctcaccgagcttgtcgtgtcccacacggctttcacaaccagctaggcatgcgggaaaaacggcaaacatggcgcacaggccgctccagcgctccgggttctccacttttcttcccttctcaaccggcttattcatgcatttccctaccttccaaccgaaaagaacctcaagatatggaagcttgtcaaggaggtgaggaccaggctgatgaacatcatcgaaagccgtcttgccaccaaagacaccatgggctacggcaacgaccggcttcggcctccgcgggcggctggcgcgggcgtgggcgcccgaggaccggcaaaatccgcttttgagtatggatgagatcatagatgagtccaagaccttcttctttgcccggcatcacacctgctcacatctgctcacatggaccatgttcttgctgcgcacgcaccccaagtggcaggggaggagctggtaggagaggcgggcagtcgagggtcccaccggtgacatgctcaacatgctgaacttgctcctcctggtcactctcgagctttacgcccctctcgcgctcatgccacgtattgcggggtaggagcgggaggttggtggcatcggcgcccctgagggcccggttgtgacgatccccaccgtgatgatccctcgtgacaaggaggtatgggggagaaagatgccaacgaattcaagcctataaggttcgagaatggagtgacgagggccggaaagcaccccaatgccttgttctctttctccagtgggccgaggtcatgcattgggcagaactctgcaatgagagaggacagggccctgatcgccgccatccctgagacctccgcgatttccctaccccctatcactgtccctgccccaagcgcccgtccatgcccccacgccgcggctcacgttccggcctcccttgagcctccacatgcctagaaagggcctagagtgttaaaaatatctgtatggtgttatgtttaactcaaggtttctgtatgttttgactggagtttgctttatgttgcactctagattagcttgtaaaatttgcgatgtataatgtttcctatttgtaaatgtctacagtttgtgttttattaa

SEQ ID NO: 16760 - DNA, 1380 bp, Triticum aestivum
  Clone ID: PAT_TA_16760
gcggggtgcgtcccccttgcccccggtcccctttccgctcctctcctctcctgccgcactccacggctgcacgcctgcacacgtacaagagaaccctaagcgtcaggccccaagtcgactgggctctcccatcggatccaagccgaatatgtcgtcgtcggtcggaggcggagggggaggcggcgcggctttggccggaggggacgtcgctggccttctggacaaggccaaggagctggaccagctgcggaaggagcaggacgatgtggccaccgagatcaataagatccacaagaagatcatctcctccccagagatggtggataaatcagttgatgccatgatggctaggcttcgtggtttttatgtacaagcaagagaactctctgagagtgaagtcagtgcttcatctgctttggttggactattagatggtttgttgcaatctggagtttcagctgcaccaagaaaaaagatagaaatcagtgaacagaaaaagaagaggatgaagtctgatacagatacaacacgattttcctctgcatctatgaggagccaacttgaccaagctgcaaaccttaaaggagagcaggttgcagctagggtaaaatcggatgatgaaaaagacgagtggtttgtggtgaaggttatacatttcgataaggaaacaaaagaatttgaagtattggatgaggagcctggtgatgatgaagagagcgcccaaaagtttgagaggaaatacaagttgcctatgtcatatattattccatttccaaagaaaggagatccgtctagtgctcaggattttggacagggtcggcaagtcttagctgtttatcctggcacaacagcattatatagggctaccgtagcctctcaacgtaagaggaagtctgatgattacaatctcttatttgatgacgacgaagaggatgggcagctaccagagagggctgttccattttacagagtggttgcgctcccggagggccatcgccagtgaaaagcctcgatatggtcaactggcttggctctagcaaacgatagtgtgtacgcagttggcagttttcgagcctgatggcgtcgtaatcgtactttacctgcacccgactactcggtgcagttcatatgactctcctactgtaccattgtatgtatatatcttgagttagagttggcttgcatgccatgtactgtatttcataggctttgcaagtggaaggttatgtaaatagaaattgattgagcgttgttttagaacctgaactgcccctgtcaggatttcgcttggcctcccctcacgctcgtgtggcctacgctggtgtcaatccgtccgcttcctcctcctttcaatgaacaaaccgaatctgcaactcctta

SEQ ID NO: 16761 - DNA, 571 bp, Triticum aestivum
  Clone ID: PAT_TA_16761
cgggagcatccgactccaccgagagagaccgaggggaagatgagcgcggcggcgggcgggctgcgtcagctgctgacggcggcggtgacggcgggggcggcggaggcgcgcgccgcggttttcgggcacgcggtgaacccgttggggaagcgcgcggcgacgaagctgctgcggaagaagctcatcggcgagcatgtcgcgcagtggtaccccgacgacatcaagcgcgacgaccccgtcgtcatggcgcgcgaggagaaagagcgtcttgcgaagctggaaatgctcaagcgtcgtgggaagggtccgccgaagaagggccagggaaggcgtgcgatcaagagaaacaaataagtgccttgcttctgtttaattttagtactgatttggcagctaatgccgaaatgtttgctgcgaaactaccctctgtaataggtcaatcaagcttcattttgttactgatttcgcaatgggtgtgcttcttcttgtctgattactcgtttgtttatgcttcttctggaaatgcaatacacatcagcatttggttattttattattaggttttagtttt

SEQ ID NO: 16762 - DNA, 625 bp, Triticum aestivum
  Clone ID: PAT_TA_16762
gcggtttgcctgttgcttccaccgttgtgggcttgcgctcgcccgcgccccggcgggcgggctgcgtcagctgctgacggcggcggtgaccgcgggggcggcggaggctcgcgccgcgattttcgggcacgcggtgaacccgtggggaaagcgcgcggcgacgaagctgctgcggaagaagctgatcggcgagcatgtcgcccagtggtaccccgccgacatcaagcgcgacgaccccgaagtcatggcgcgcgatggagaaagagcgtctcgcgaagctgggaaatgcttaaacgtcgtgggaagggtccgccgaagaagggccacgggaaggcgtgcgatcaaagagaaacaaataattgccttgcttctgtttaattttagtactgatctggcagctatgctgaaatatttgctgcgaaactaccctctgtattctctctctaaaaaaatctaccctttgtattaggtcagtcatgcttcattttgtcaccgatttggcaatgatgggtttgtttcttctagtctgatgaagacacgtttatttgtgctgcttcttgaaatgcaatacacatcagcatttggttataaaaaaaaaaaaaaaaaaaaaaaaactcgagggggg

SEQ ID NO: 16763 - DNA, 867 bp, Triticum aestivum
  Clone ID: PAT_TA_16763
gccggcgcaggcctggactccatcccggcccatccatattcgctctccgaccagcgaatttcaatcaacacaacaccgcgacaatggctgacgaatacgacgccgagcaggctgctgagctcaagagaaagagagcgttccgaaagttctcctaccgaggaatcgaccttgaccagctcctcgacctctcctccgaccagcttcgcgatgttgtccacgctcgtgcccgccgcaggatcaaccgtggtctgaagcgccgccccatgggtctcatcaagaagcttcgcaaggccaagcaggaggctcagcctaacgagaagcccgaccttgtcaagacccacctccgagacatgattgtcgtccccgagatgattggcagcgtcatcggcatctactccggcaaggagttcaaccaggtcgagatcaagcctgagatggttggtcactacctcgctgagttctctatctcatacaagcccgtcaagcacggtcgacccggtatcggtgccacgcactcttctcgtttcattcccctcaagtaagaaggttgtggtcttgggtggtttctgcattcacggacattttgggcgaaaaggactggttctggtagatgggcttttaaaacatctaccaaaattactgatgacaatgggtactatgatagtacaataaaggggcattgtccgcttgatgactacctacaaaaaaaaaaaatttgtgaaaaagaaagatatggtgatgcttctgagctatcgtgcctccctgacgtgaatggcctccctcacggtacactccctctgtctaggcaatccgaacccccatatcaatcataaaaatccattcgtataaaaaaaaaaaaaggcccta

SEQ ID NO: 16764 - DNA, 637 bp, Triticum aestivum
  unsure (1)..(637): unsure at all n locations
  Clone ID: PAT_TA_16764
ggccgcttcgaggngccggccgggccgggacgaaaaaaaaaatcgtcaaatcttcatactaacccgacgaaccgcagcccaccgtcaagatggtttccgccaagaagcacgtccctatcgtcaagaagcgcacgaagcgtttcgaaaggcatcagcatgatcgcttcatgagggtatccccaagctggcgtaagccaaagggtatcgacagtcgtgtccgccgtcgattccgtggtaccattgccatgccctctatcggctacggatctaacaagaagacccgttacatggctccctccggcttcaaggctttcattgtctcaaacaaatccgacttggagctccttttgatgcacaacaagacccatgctgctgagatcgcccacaacgtttcttcccgaaagcgagttgacatcatcgctcgtgctaagcaacttggagtcaaggtcaccaaccccaaggccaaggttaccaccgaggtttaaaaggaaatggatcggtttttgggctgctttacggttatgcatcggaagggggattgcgttgcttgcggttctggcacataaattatgcatgctagagaataaaaaaacgcgccgttgaacgacaaaaaaaaaaaaaaaaaaggcccctacta

SEQ ID NO: 16765 - DNA, 800 bp, Triticum aestivum
  Clone ID: PAT_TA_16765
gccggccgggagtgcggcggtcgaaaaagttcgtcaaatcttcatactaacccgacgaaccgcagcccaccgtcaagatggtttccgccaagaagcacgtccctatcgtcaagaagcgcacgaagcgtttcgaaaggcatcagcatgatcgcttcatgagggtatccccaagctggcgtaagccaaagggtatcgacagtcgtgtccgccgtcgattccgtggtaccattgccatgccctctatcggctacggatctaacaagaagacccgttacatggctccctccggcttcaaggctttcattgtctcaaacaaatccgacttggagctccttttgatgcacaacaagacccatgctgctgagatcgcccacaacgtttcttcccgaaagcgagttgacatcatcgctcgtgctaagcaacttggagtcaaggtcaccaaccccaaggccaaggttaccaccgaggtttaaaaggaaatggatcggtttttgggctgctttacggttatgcatcggaagggggattgcgttgcttgcggttctggcacataaattatgcatgctagagaataaaaaaacgcgccgttgaacgacaaggatactggcatcaaccgcttaaacagcaaatctctcggagtcagaggggcatgagaaacatccatggtctctactccaaaccgatgagggcgctaaggaggggttaagtaaaaagccttgtgcattacaggcgaggctatgaaataaaaacaaaacccctttgagggccccatcaaaaaaaaaaaaaaaaaaaggccccta

SEQ ID NO: 16766 - DNA, 1257 bp, Triticum aestivum
  Clone ID: PAT_TA_16766
caccaacctccgagcccccggccgtcgccaccgtaccaaccatgtcggccgcctacgaccgcgcagccgagctccgcgcgctggacgacaccttcgccggcgtgcgcggcctcgtcgcctccggcgtcacccgcgtcccccgcatcttccgcgtccccgacgacgcccacgaagcgccgcaggagcccaccggcggccggcaagaacctgcagccatcccggtgatcgacctcggctgcagcaatcgcgcggcagtggtggccgccgtgggccgggccgcggccgagtgggggttcttccaggtgacgggccacggcgtgcccctcgaggtgggcaccgcggcggtggaggcggcccgggcgttccacgagtcccccggcggcgagggcaccgacaaggcgcggctctacacccgcgagccggccagggccgtcaagtacaactgcaacttcgacctgcaccagtccaaggtggccaactggcgcgacaccctctacctacgcgtcgagccccaccctcccgacgccggggacatgccggagtcctgccgccgtgacgtgttctttgactacgccgagcacgtgaggaacctacgggacacgctctttgctctgctgtccgaagcacttggcctccaccccaaccacctcgccgacatgggttgcaaccagggccagatgatactctgccactactaccctccctgcccggagcccgagctcgccatcggcaccacccgccactccgactccggcttcctcacggtgcttctccaggacggcgtcggcgggctccaggtgctccacgagaaccagtgggttgacatcacgccaacaccgggagcgttcatcgtcaatgtgggcgatctcttgcagatgatctcgaatgacaggtttaggagcgtggagcacagagtcatcgcgaataacgatgcaccgagggtctcgatcgcatgtttcccaagcaacccaagttcggagaggatatatggcccgatcaaggagctgctgtcggggaagaacccgcccttgtacagggagacactcgctagggattacgtcgcgcactattactctgtgggattgggtcccaagatggccatcaatgattttcgtctatgaaatcattggaaaaatcctttgttatgatttcgtcaataattggacaacaacttccaaaaaaaaaaaaaaatagggccccttattccaagggaaactttgtgtattcagacaaaaaaaaaaaaaaaaaaggccccta

SEQ ID NO: 16767 - DNA, 622 bp, Triticum aestivum
  unsure (1)..(622): unsure at all n locations
  Clone ID: PAT_TA_16767
caacagcatctcccctgttccgcccgcccgctcgcctctgtttcttttctttctttccacagcggctctgctccgctcctcacctccctcgatcgcacataccatatttggtagctcagcacagccatggtggttcttgccagcacgcccgccgtcgatcacatcccgctcctcaggtcccccgaccccggggactacttctccggcatgccggttgtcgacctctccagccctggcgcgccgcgggccatcgccgacgcgtgcgagcgcttcgggttcttcaagctcgtcaaccacggggtgccagcggacacgatggacaggctcgagtcggaggccgtcaggttcttctcgctgccgcaggccgacaaggaccgctccggcccggcctacccgttcggctacggcagcaagcgcatcgggctcaatggcgacatgggctggctcgagtacctgctcctcgccgtcgactccgcgtcgctctccggcgcctgcgccgtcccgtcctgcgcgctcttccgggcggcgctgaacgagtacatcgcgccggggccgttcggggcggtgcggccgagggcggcgatggccggggccctgggcattgnaagngggggaacnnaat

SEQ ID NO: 16768 - DNA, 497 bp, Triticum aestivum
  Clone ID: PAT_TA_16768
gttcaccatcatcctgctgctctcgtctacctttcaataccagtctggtcaggtgacccaggtcgtggaggaggaagaccgtatccttgagaagctccggactggtgaaatgtccttctctgaccttctccggtcctgtcaagcggattccgatgccgacgattgagccaagattgattcagcatagataccgacgaagatcgtattttgtcaagcttcatatggttaatccattgcagtgtgtgtacttttggtttcactgtcgtggtttcttgaatgttctgttgatgagccttaaaacgtgtatcaatgcaatgcaccgtctcttttacttatgcaagctttctcgtggtaattcaatctggtgacctggcgatacaagtgtatatcatgttcatgccagttttgggaggagataaagcttacttattgaagtggtttaaaaagtgtatcaatgcaatgcaccgtcttttttattaaaaaaaaaaaaaaaaaaa

SEQ ID NO: 16769 - DNA, 942 bp, Triticum aestivum
  Clone ID: PAT_TA_16769
cccacgcgtccgtaatttgcttccatctcgtttcggttctgggttctggccggcacggagagaagagagaagaggagaagagttcgagctagcccgccggagatgcgaggggtggacggggcggcggcggcggcgggggtgtggggcgggctcaactccggggtggtgctcagcatcatcgcggtgctgtggacggtggtgtggcagaacctgcagcacctgcagctgcagcacttcgtcaatcgcaacctcggccgccacgcgcgccgcctcgccgcgctcgtcgacccctacctctccgtcaccatcgccgagtacgacggcgggaggatgcgccgcgccgaggccttcgaggaggtcaaggcctacctcgccgcggccacctcgcgcagcgcgcgccacctccgcgccgagggagccccggacgccgaccgcctcgtgctcagcatggtcgacggcgaggaggtccccgaccagctgttgcccgaggagggcagcggcgcagtcttctggtgggcctcctcacgcccggcgccgccgcaggaccggcgctggggcggcggcgggggaggcggggacgaggagaaccgccgcttctaccgcctctccttcctcgaccgccaccgcgagcaggtcctcaacgcctacctcccgcgcgtccgccgccagggccgcgccgtcatggtccagaaccgccgccgcaagctcttcaccaacatctcctcccaccagttcagcgacggcggctacgcccgctccgcctggacgcacgtgcccttccagcaccccaagacgttcgccacgctcgccatggacccggccagcaagaaggaggtcatcgacgacctcgacgccttcaaggccggcaaggagtggtacgagcgcgtcggcaaggcgtggaagcgcggctacctgctgcacggcccgcccgggacgggcaag

SEQ ID NO: 16770 - DNA, 1350 bp, Triticum aestivum
  unsure (1)..(1350): unsure at all n locations
  Clone ID: PAT_TA_16770
aagcaagaagcgcccaggtaagaacacacacaggcacaggcacaggcagagaggagaggcaatggcgaccactaacatgctgcctcccggccaagataccgagccgcaaaccccaccacccccgcacaccccgcaccaacccgcgatcccaaagtccaaccggccgccgccgcctctcctcgcctgcgagatcagcgccgccttctcccccgtctgtttcgtcggaggagcatcagcaaaatgtcaactgccactgctccaggagtgtcctttgctaaatccggggctggttcccgggccgttgctccggcgatcaggagcgcttccttcgttggttacaccaagcaaacaccaaacttgtcaggcctaaggatgtcaaacaagttcagggtgtctgccacggccgtgcacaaggtgaagctcataggcccggacggagaagagcacgagtttgaggcccctgaagacacctacattctcgaggcagctgaaactgccggagtggagctgccattctcttgccgcgccggatcgtgctccacatgcgcgggcaagatgacgaccgggggaggtcgatcagtcggagggctccttcctcgatgagagccagatgggtgagggataccttctgacctgcatttcataccccaaggcggattgcgtcattcaaacccaccaagaggaggaactctactaattggctcacatgtgcttgtgtggcgcaattgttgaagttcatggtgaattcgttgttcgagttgccttctgttattatctagagagatggctaggtgggtgcatcttcctggcaatcagtccggtcttttgatgagatcgttccatatgagttgtgacaataattgatgtaaaatggtttgtcaatccaaactgcatctgttcagattgcagcaattcgaactaccatacactgttggaagtcttgaaaacatgttgtacttgtgggccacttcctttcggaattatttgggcaccccctgtttgcatttttgattttggtgncggngaaaaaaagaaaccgaggggggccggtaccaatcccctaagnggtctatacgcccncacggcctctttaaagtctgactggaaaaccgggtacnactaaccttcagaatccctccantgggataaaaaaaaaaaaataaaaaaaaaaaaaaaaaaaaataaaaaataaaaaaaaaaaaaaaaaaaacaataaaaaaaaaaaaaaaaaaaaaaaaaaaaaaaatataaaaaaaaaaaatggggggccccttttaaagaatcaaaatttccttccccgggcttgaacaataaataatttttttatgggcaaccaaaattaaattaatg

SEQ ID NO: 16771 - DNA, 612 bp, Triticum aestivum
  Clone ID: PAT_TA_16771
gccggcctggccgggaagccccaattcacatcgctcctacccagccacgcacgcgtggagaagagaaacagcaagcaccatggccaagatctccttcctcttcgtggcgctcctcgtcctcgccgtcgcgttccccgtgaaggtgatgggaggtggcggcggcggcaagctcaagccatgggagtgcccgtccaagtgctcgtcgcggtgctcggggacgcagtacaagaaggcgtgcctgacctactgcaacaagtgctgcgccacctgcctctgcgtgccgccgggcacctacggcaacaagggcgcctgcccctgctacaacaactggaagaccaaggagggaggccccaagtgcccctagattcttgattttctttcttcttcttctggggtgccagcttgcggttcatggttattcactactcggccatcaagatgttactagatctgaattatgtgacaggcatttagtggcatgtgaattgccctaccaaaaaaccgtgttacaatcagtagtactaagatgtggaaaaatggaggcgctcccacatgattatagtgggacctctcgagctttattgttccttgtgcgcctgtgcaccgtgcttt

SEQ ID NO: 16772 - DNA, 736 bp, Triticum aestivum
  Clone ID: PAT_TA_16772
cctgagctccccccgaccgcgggacacgcaaggcaggcattcaccaaggctcttaccccagccacacgcggagaagagacgcagcaagcgccatggccaagatctccttcctcctcgtggcgctcctcgtcctcgccgtcgcgttccccgtggaggtgatgggaggcggcaacggcggcgccggcggcggcggcaagctcaagccatgggagtgctcgtccaagtgctcgtcgcggtgctcggggacgcagtacaagaaggcgtgcctgacctactgcaacaagtgctgcgccacttgcctctgcgtgccgccgggcacctacggcaacaagggcgcctgcccctgctacaacaactggaagaccaaggagggaggccccaagtgcccctagattcttgattttctttcttcttcttctggggtgccagcttgcggttgatggttattcactgctcggccatcaaaatgtactacagtagatctgaattatgtgatgggcatttaatcagtggcatgtgaattgccctcccagttacctgtatttctatcagtaagatgtggaaaactggaggcactccgccactcccacatgattatagtgggacctatcgagctttattgtaaaaaaaaaaaaaaaaaaaagggcgctaccatccggccggaatgatgagctaccacaatgaacaaaagcatgcaacgcccgttcatttttctttcaaaaaaaaaaaaaaaaaa

SEQ ID NO: 16773 - DNA, 770 bp, Triticum aestivum
  Clone ID: PAT_TA_16773
tcggcacgaggcaaccttccatatccatttatctctacctcccctgcttcattacaattcaaggtttctagctagccttgtagggatggcaacaatgccgcctacctccatcgtcttctctgcgatagtcttcatgctcctttccactgccaccgctactcaagccaatggctgtgtcagtggcaaacccaaggcgacacacctcatagtggaagcatgcaagaacgcctccgactactggcacaacatcacagaggcattctgtttgtcaaccctccagtccgacaatcggagtgccaaggctaagaacctccttgacttggtgcttgtctccatttgatatctttaagggacatgtccacttaaggttggcgttgatgtcaataaaaatgcttgcaaaatgcccaagaaaggcacaattatgatgcatgctctcccgtttttgtgtggtggactatgagaccgtgttgagcacccttaacatctgtgaagccatcattagggaataccaagctgaaaagcgtgggatgaagtcctcgaatatgccccaatgtgtggatctggcagagcatactcttaatgagtgcttgtctgagcttgctgatatgccatgggcgaaggcgctgatcaaagaaaatgaggagctgcgcatgctggtctacctcaacactaacttgcttgcaccatataatgttcatgattaatatggtgttagtttttatgcaataaagagatgtaattccgtgactaaaaaaaaaaaaaaaaaaaac

SEQ ID NO: 16774 - DNA, 972 bp, Triticum aestivum
  unsure (1)..(972): unsure at all n locations
  Clone ID: PAT_TA_16774
gcgcgtcgctccccccgcgctgctggggggtcggcggcggcggggggcggcggcagcgggggccgccccgccgccgccgccgccgccttcagcggcggccgccccgccgcctccgccccccgccccgccccccccccctcctcctccgccgccgcggccgacacccgccccgcctccacggccaccaccttcgacgactggtacatccccgaccgcgaggtgttcggccccgtgccctcccacgaggaggccatggccgccaccctcgacctcagggacgccttcgagatcgccaagattgattcccatggtggccgcctggatatctccaagacacatatctcccatgatggccttgatgatcccacaaaggttgctcaggaaacatttcaggatcatctccattcagaagcatctaagcatgaagagaagcatgacagtttatccgttgcctctggatcctctgcacgtgttattgaagccttcaccatgctacacgagagtcctgaagctcaggatgttgttgcttcgcttgcttcttgtgaagaatgtctggggaagctgttgattgaagatcaagaaactggtggagttttacaagacaaactcaagcgagtcatccagtgtcagctgacgaagctgagcatgagcgacgcccgagagctcgcagagcagcaatggtgtcgtctcgccggcagatgcatccagtgattacattcagatgatgaaggcgcnntttccgaatggngacnatcttccganaataatgcagacctggtggcactnaagacaaggcaaaacaagggagttnagacctgntacaatccaagaggttcacaaatggcgtctccttgtgcccngcancgctcatcgggcgttgccaactgaaatttaataaacaaggacggaaatggtgtcgattaattcttcactttnaaaaagntngttccttcattaatanaaggcatcccg

SEQ ID NO: 16775 - DNA, 1595 bp, Triticum aestivum
  Clone ID: PAT_TA_16775
ccccgcgtccgccccgcgtccgccccgcgtccataaggcatagcagcagcaggtacatgctcatctcatatcatccagggtagtaagttacctaattagcctacttagtgtatcatctgtacgtgacatgccacacttagctagccgactaccattcattgagaaactgatggctgctgcgcctaccttcttctccttctgctccgttaagccactgctccattcggcttcaccggtggccaggaatacttgccggaccagtcgcaaccgtggcttcttccgccctccaccggggatatatcccgggtgggagcctgcgtctcatgagctgttgcacgattttgacttgcaggaaagcctagtgaatgttcaagcgttattgcatcaacatccgaagagtagacgagccatgttgaccactgttgatcacctcaagcgcctctgcatcgatcattatttccaagacgagatcgacaatgtcatggatgcatgtgtggatctcgttcatagtgatgatctacttgatgcaaccctttcactgaggctaatgagagaagctggatattatgtttcggcagatgatgttctccggaagttcacaaatgataatggtgatttcaaccatgggctcagcaaagacattagagggatgctgagcttgcaagacatgtcacacctcaacatgggagaatcatcactctacaaggcaaatgaattctcaagcaagcaccttagattcgcaattaagtatttggagccaaaccttgcaagatatgtgagccagtcactagaccatccctatcatgtgagcctgatgcagtacaaggcaaggcaccatctgagttacctccaaaacttgccaactaggaacatggcaattgagaatctggcacttgcagagtttcagattaagaagttgcagcatcagagagaaattaaagaggttaagagatggtggatggatttaggattggctaaggaaataccggctgcaagggaccaagtacttaaatggtacatgtggcccatgactgtccttgagggtttgtccttccatagatatcaccttgagatcacaaagatcaggaacatatcaattgttaatcttgaaattgttgatcttcagattacacagaatgagctccctcttttcaatgaggcaatcaaaatgtgggatcctgctgctgctgttgattcactcccgagctacatgatatcatgttacaaggctctttacactgtcacaaatgatatagccgctatggttagaaaagagcatggactgaaccctatcactcatctcaagcaagcttgggcagctttgtttgatggattcatgatcgagagaaaatggttatatactaatcaggcccctacaccagatgactacctaagaaatggtatcgtcacttcaggagcaccactagtattcctgcatcttttcttcttgctagggcatgatttaacagagggcaacaacgaccacatgcttcggatcatctcctgcgctgcaaagatcatgaggctttgggacgacctgggcagtgcaaaggatgaatcacaagaagggctcgacggatcttacaaggagttgt

SEQ ID NO: 16776 - DNA, 1151 bp, Triticum aestivum
  unsure (1)..(1151): unsure at all n locations
  Clone ID: PAT_TA_16776
cccacgcgtccggggagagtgaggtcggtcgaagcggcaatggcgatggcgatgcgggcggcagcggccttcttctcgccctccgcctccccgagcccgaagcagcagcagacgcactccgtcttctccccccggcgcggctccacccgccgtatcgatccccgtcgcctccgcgccttcccagccaccgagctcaccctcgaggagctcaacccctccgtcgccctgctcaggaagaccgcggaggccgtcggcgatttcaggaagacgcccatctacatcgtcgggacggactgcaatgccaagcgcaacatcgccaagctgctcgccaactccatcatttaccgctacctctgcagcgaggacctgctcgaggacgtcctcggcggcaaggacgccctcgccgccttccgggagtccgacgagaaaggctacctcgaagtcgagaccgaggggctgaagcagctcacgtccatgggcagcctcgtgctttgctgtggcgatggcgccgtcatgaactccaccaacttagggctactgaggcatggagtctccatctggatcgatgtccctctcgaattagccgtgaacgatatgttgaagagcaagggagcacaagctatttcagaccctgattccttttctcaggcaatggcaaagctccgtcagcgttatgatgatctgaaagagcggtatgcagtttctgatgttactgtttcagtacagaacgtggcttctcagctaggctacagcagcatcgactctttgagcctggaggacatggtcattgagattgtgagtcggattgagaagctgatccaagcgaaggcgatgatggaagctgctgggaagcctgaatgattcgagcatcgactgatgtccgaggaatcaagttccgccgcttggtttcaatatttttgcgacatttcgtatacatagttcgaaccgatgaaggctttgggggcatgcgccaacgagtctttcacgacatcatagtaacatggtactcctcgctgcaagttattcatgtggccagttgtaaaatgtatatggctcaacggccgaacattaaacaggagattttttttcttccgatgagtaaggaagtagaagaggagcaccagttcactcttgaaaaaaaaaaaaaaaan

SEQ ID NO: 16777 - DNA, 880 bp, Triticum aestivum
  Clone ID: PAT_TA_16777
cggacgcgtgggcggcgagcggtggtgctggacgccaccgtcttccacccgcagggcggcggccagccggccgacacgggcgtcatcgtctccgcgtccggcggcgccaggttcctcgtcgaggacgtgcgcgtcaaggatggggtggtcttccactatggtagatttgaggatgctgctgctggagatggatgtggagcagagttcaccaaagggcagagtgttaccttggaagtcgatgcggaacggcgcaaactcaactccaggcttcactctgcagggcatttactggacagttgtatgaccaaccttggccttcatctggaacctgggaaaggatatcactttcctgatgggccttccgttgagtataagggagttgttccagcagatcagttacaggataagaaaatccagttggaaaaggaggcgaatgaactgattttgaaaggaagcaaggttttggtctctgtttttccttatgaggaggcggctaagttatgtggaggtgctctgcctagctacatttcacaagacagcactccccgcattgtgaaatttggtgactatcctggttgtccttgtggaggcactcatgtagctgatatcgcagacatcggcaacctaaaggtcacaaatatacgggtcaagaaaggcgtgactaaagtctcctacagcatcaacccgtaattttttctgcgcaactctcgcacccagaatttgtcagagtagaggaaggataattatctagagaatcagaaggctagcatcatcgtttttcgtaaatttagttttgtgcgacgacactaaatatctagaggacaaaatagatggttacattatactatttgaaaaggtactagtagatctataaatatat

SEQ ID NO: 16778 - DNA, 623 bp, Triticum aestivum
  unsure (1)..(623): unsure at all n locations
  Clone ID: PAT_TA_16778
atcgcatctccctattactactactcttcanagtcttcaccagacaaagtagctgctgttgcgatggcctgtgctccatctacggtgaaggtggccgccatctccctgctggtgatcctgtgcgccggaacacagctcacggccgtgcatggccgcggcccggccctcgacgtcgcggatggcgcggccctgctgcggctcgtgaagcctgcgtcggcggcgctggacgagctggccgagaggctgcgtcagggctggcttcagtgcaatgaatcgtgtcagacttgtaagttcgtttgcgcatgccagaactgtgagtgtgacggcccgccataggaggagaacgataagtgtgagcgggattgcatccgggcaaggggctgcgaacggaggacatgataatcctgctgttggcatgtgttcttgtgtgtgcaccgtgtattccaagtacttagctacttactaagttccaatctggttggttgtgtaataagcacccgtggcccggccctaggcaggcaggcgaacgtacgtgcatatgtgcgttgtggaggcatggtacagtgagtgccgtttcagttgtccctggtgtgaacgtattgtacacgtccgttgatctgtct

SEQ ID NO: 16779 - DNA, 717 bp, Triticum aestivum
  Clone ID: PAT_TA_16779
atacttgacatcgcatctctctattactactactcttcagagtcttcaccacacaaagtagctgctgttgcgatggcctgtgctccatctacggtgaaggtggccgccatctccctgctggtgatcctgtgcgccggaacacagctcacggccgtgcatggccgtggcccagccctcgacgttgcggatggcggtgaggaagacgtcggcacggccctgctgcggctcgtgaagcccacgtcggcggcgctggacgagctggcccagaagctgcgtcagggctggcttcagtgcagtgaatcgtgtcagacttgtatattcgtttgcgcatgccagaactgtgagtgtgacggcccgccatcggaggagaacaataagtgtgagcgggattgcatccagagaaggggctgcgaatcattgtgaacaagacatggtaatgctgctgctggtatgtgttcttgtgtgtgcaccgtgtatttcaatctggttggttgtgtaataagcacccgtggcccggccctaggcaggcaggcgtacgtacgtgcatgtgtgcgttgtggaggcatggtacagtgagtctcgtttcaattgtccctggtgtgcacgtactgtacacgtccgttgatctgtatatgttttccatcatgacgcgaacgccatgccggccgttgttctttcctcctaggcaggggtaagctgcggcaactactctgtttc

SEQ ID NO: 16780 - DNA, 695 bp, Triticum aestivum
  Clone ID: PAT_TA_16780
gctaccgcaaggccgtcgagtccttcacccgctaccgcctccagatctgccaggaggaggaggactggaagcgcatcgaggaccgcctcggctgcggccaggtcgaggagctcatcgaggaggccgaggacgagcttaagctcatcggcaagatgatcgagtgggatccctggggtgttcctgatgactacgaatgcgaggtgattgaagatgacacacctattcccaagcatgttccgcagcaccggcccgttgcactacctgaggagttcttcaagacattagatgccatcaaatcagatccagctctgcagggcgactctcctccgcaagtgaagtcatgaaacttgaactcttcaagatgcatcatttttcacctgccgcagtgtgtagttgagactagtctcatgggtcctttgcctgcagtttgcttgttgtcctgagcagaataaatttgtttctgtgaatgtgaatgcgtttttaacgcagtgcttcaacacagtaaaatactgtttctgttttctattaatcgatgttgacaaaagatcaaatgctggtttgttttatactttttcgattcatgtacttcaagaaccctgcacttctttaagtgtcattgcctagtgattacctgcaacctgtattaaggtctttaagcatttcaaaagcaccattttccatgtactgtatttgac

SEQ ID NO: 16781 - DNA, 950 bp, Triticum aestivum
  unsure (1)..(950): unsure at all n locations
  Clone ID: PAT_TA_16781
gtcccacgcgtccntaacccacacgcacggtctcacccgcacctcacctcatctcaccagagagaaagagagagaatagagagagtccgaataagaagacggccggcgcatgttgaacctcaccttcctaaccagagagaaagagagagagagagagagtccgaagaaggagacggcggcgggatgtttctgcggcggatcctgagcggtgggggcgggctggcggccctgcgctctgcgcgggcggtgaaggagacgacggggatccgtgggtctggacgtggtgcccgaggcgcggaatgtgctcatcgggctctacacgcgcaccctcaaggagatcgaggccgtccccaaggacgagggctaccgcaaggccgtcgagtccttcacccgccaccgcctccagatctgccaggaggaggaggactggaagcgcatcgaggaccgcctcggctgcggccaggtcgaggagctcatcgaggaggccgaggacgagctcaagctcatcggcaagatgatcgagtgggatccctggggtgttcctgatgactacgaatgcgaggtgattgaagatgacgcacctattcccaagcatgttccgcagcaccggcccgttgcactacctgaggagttcttcaagacattagatgccatcaaatcagatccagctctgcagggcgactctcctccgcaagtgaagtcatgaaacttgctcttcaagatgcatcatttttcacctgttgcagtgtgtagttgagactagtctcatgggtcctttgcctgcagtttgcttgttgtcccgagcagaataaatttgtttctgtgaatgtgaatgcgtttttaacgcagtgcttcaacacagtaaaatactgtttctggtttctattaatcgatggtgacnagatcaaatgctgggttgttttataaaaaaaaaaaaaaaaagggcccta

SEQ ID NO: 16782 - DNA, 1256 bp, Triticum aestivum
  unsure (1)..(1256): unsure at all n locations
  Clone ID: PAT_TA_16782
cgtccgcccacgcgtccgcgatttttcactttgctgctcgctcctacactaacccacacgcacggtcgcacccgcacctcacctcatctcaccagagagaaagagagagaagagagagagcgggatgtttctgcggcggatcctgagcgagagagtccgaagaagaagacggcggcgggatgtttctgcggcggatcctaagcggcgggggcgggctggcggcgatggagtctgcgcaggcgggaaggggcggaggggttctgcggtcgagacggagtcgccggggcgcggtggcggccctgcgctctgcgcgggcggtgaatcgagacgacggggatccgtgggtctggacggggggccccgaggggccggcagtgtcctcatcgggcttccaacacgcgcacccctcaaggaagatcgaggcccggtcccgcaaggacgagggctaccgcaaggccgtcgtagtccttcaccccggacaccggccgagcagaatcttaagaggaaggcgaaaggactggaagcgcatcgaggaccgcctcggctgcggccaggtcgaggagctcatcgaggaggccgaggacgagctcaagctcatcggcaaatgatgaccgagtgggatcccctggggtgttcctgatgactacgaatgcgaggtgattgaagatgacgcacctattcccaagcatgttccgcagcaccggcccgttgcactacctgaggagttcttcaagacattagatgccatcaaatcagatccagctctgcagggcgactctcctccgcaagtgaagtcatgaaacttgctcttcaagatgcatcatttttcacctgttgcagtgtgtagttgagactagtctcatgggtcctttgcctgcagtttgcttgttgtcccgagcagaataaatttgtttctgtgaatgtgaatgcgtttttaacgcagtgcttcaacacagtaaaatactgtttctgttttctattaatcgatgttgacaagatcaaatgctggtttgttttaaaacatgtataatgactctcttatagaaccctccctacagatgccaatgacaaagaactcggcacgctttacggcttagcattcannaaaaanaaaaaanccngggggggccgtaccaatncccaaaggnccnataaccnccacgcntctttaaaccnnanggaaactgggccannatcctggagaanccttncngcgggtaagaangncncgtccttcaaantcccnagnagggacn

SEQ ID NO: 16783 - DNA, 1135 bp, Triticum aestivum
  unsure (1)..(1135): unsure at all n locations
  Clone ID: PAT_TA_16783
cgcccctcgaggtccaagccgggcgccggggtttaccttaaaaaaatccaacacaaaaccaaacaggtcttacgcaacaaatggagagcacccagagcaacacaagcgtgatgaaccatttcatcctggtgcacggcctctgccacggggcctggtgttggtacaaggtggttgcggcgcttcaggcagcggggcaccgtgtcacggcggtcgacctggccgcgtccggcgctcacccggcgcgcatcgacgaggtgcactcgttcgaggagtactcccagcctctgcttgacgtagtggccgcggcgccagagggtgacggcgagaggctgattctggtcgggcacagccacggcgggctcagcttggcgctagccatggagaggttccccggcaaggtcgccgccgccgtgttcgcagccgccgggatgccgtgcgttggcaagcacatgggcgtcaccaccgaggagttcatgcgaaggacatcatcggaaggactcatggactgcaagatgctgccaatcaataacaaccacggtgcaggggttgcaatgataatgggcccaaacttcttagcacgcaagaactaccagcaaagttcacctgaggatttggccctggcaaaaatgttggtgagaccgggaaacctgttcatggaggatccggtgatgaaggatgcaagcctgctcaccgataccaactacgggtcggtgaagaaggtatatgtggtagcaaaggctgatggctccagcaccgaggagatgcagcgttggatggtgttgttgagccccggcacggaggccgaggagatcgcgggagctgaccacgccatcatgagctcgaggcctagggagctctgtgatgctctggtcaagatcgccgacagcttaaatacttgctaaattgtacgatatatatccctggaaatcaatgtaggtgtgtacttgattttcatctaaaaataaatatgttcagtgatactattaaatcaatggaaattaagtagtattaccttcatcctttagaaaaaaaggccctaggctcgagcgtactcgnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16784 - DNA, 785 bp, Triticum aestivum
  Clone ID: PAT_TA_16784
gccggccgggtctggaaaaccatattccactccagcaatgggacgcttagacggtaaagtcgcgattgttacaggcgcggcatctggctttggccaaggcattgcagaacattttgctgaagaaggggccaaagtcctgatctgtgacatcaatgaagaagccggggaaaaggtagcagcacactccgaggcctttgcgtttcaggccatgaatgtcacgaaagcagcagactggcaggccgcagttgcaaaggcagtgcagatctggggacatatcgatatcttggtcaacaatgcggggacaagctatgagaacaagagcaccaatctagtcaccgaggacgagtttgacaaggtcatgagcgtcaacgtcaaaagcgtttttctcggaagtaacgcctttaccacacaagtcaaaaagcaaggcaccaagggttccatgatcaacattgcctctgtaggtgcgcatcgcccgagacccggactggtgtggtacaacgcctccaaaggagccattacaaatgccacgatgggtctcgctgcagaatacggcccagatggcatacgtgtcaattcaatttgtccccttgccacaatgactggtcttcttcccaaatttattggcaaagaaatcacgcccgaggtgcagaaggcgctgggtaacgtcccacttggccggatgggagagatccgagatgttaccaaagctgcggtatttctggcgagcgaggaatcctcattcattactggtgtaaatctggatgttgatgggagccgtgcgattt

SEQ ID NO: 16785 - DNA, 798 bp, Triticum aestivum
  unsure (1)..(798): unsure at all n locations
  Clone ID: PAT_TA_16785
cggccgctcgagccggccgggcggttagcttatttgtcctccccgaagcgcagctccacgggcggcttcgcgatggccgccgccgactacgaccgcgcgtaccgcccctacgcgccctcctccgccgccgactacgaccgcccctaccgcaacgagatcgtgccctacggcgaccgccgcatcgacctcgtcgtcaagccgccgccgcccaccaggtccccgccgccgccgttgcccgtcaccaagagcggaggcggaggcgggataggctccgcctggtgcttcagcgacccggaggtgaagaggcggcgtcgggtggcgagctacaaggcgtactcggtggagggaaaagtcaaggcctccttccgccggggcttccgctggatcaaggacaagtgcacgggcttcatccatggctgaatccgtggtcttgggtgagttctattgggatcgaagaagacgctgcaacaatgtgcgagtaacggatgctgttgcctttgctaatttgctcccaaaacatggaaattttgtccatgaggttgtgatggtaacttttgggtcaggtttataggaaacaaaaatttaagagcttcctcatgagattgctttgattgcagatgctgttcttactgtctgctagttagctagttatttcaagaatgtctcaacaggagttgaatctttggaaaggaactgggttaatttccaggaaaaaaagacgatgcctcctccgtaaaggggataaaangngaangggnggnggagaganaggaaggggganaagagggggnangngan

SEQ ID NO: 16786 - DNA, 863 bp, Triticum aestivum
  Clone ID: PAT_TA_16786
atcaaacacaatagactagattctatagaagaaagttcaggcaggttggatgtccaagcatctgaagagagcagtgatcagagagatgtcggtaacaagatgagaattgatggagcacatggtgcagagcctagtgatgtcaagagtgagaaccatccgaagtgcgagaccggtgctgtcgaagatgaacatgacttcaacccaagagacatgggggatggcacaaagccaagggaggaaagcaacggcggcgatgagagctctacggtttcgcaaacggagtcggcggttcagcagaatggacctgatggcgcaaagttgacgactcggggcggcattcgcaacccctttgagtcgagcttctctggagcaaacatcacgctggacgcggtagcgccctctgctcacatcggcaacacttctcttcgttcggacagcagcacgacgagtactcggtccttcgcattcccagtgctacagacagagtggaacagcagcccggtgaggatggcgaaggcggaccgcaggcgtttcaggcgagaccggggctggggttacagggtcctctgctgtaaattctgagagcatttttttcctgtttgattgatgagtctagctcatggccggcggcctcgcgcctgagctagtgttagccagccaatgttaaattcattcaaatgttgatcgtttctcccccccttccttgctcttctccccccatatgccctgctcttttatttttatttacaaatagcaggaggttgatggccaaaaaaaaaaaaaaaaggcttgtaatttgcagagattgtgcgtgagaaatgaagaggtatagctttctttcaaaaaaaaaaaaaaaaaaaaaa

SEQ ID NO: 16787 - DNA, 771 bp, Triticum aestivum
  Clone ID: PAT_TA_16787
cgtgtcaccacttggctggaggcttttcgttgttattggtgctggtggtgcagggaaagcacttgcttacggtgcaaaagagaagggagcaagagttgtaatagcaaaccgcactttcgcacgtgctcaagaacttggtaacttaatcggtgggcctgctttgactctcacggagttagaaaactaccatccggaggaagggatgattcttgcaaacacaacagcaataggaatgcatccaaatgtcaatgaaactcctctatccaagcaagcgcttaaatcttatgctgttgtcttcgatgcggtctacacaccgaaagagacaagacttcttagggaagctgcagaatgtggagccacagttgttagcggtttggagatgttcataaggcaagcaatgggtcaatttgagcatttcacgggcatgccagcggttgacgataaattccgagcgctgtcaaattctttggacaaccctagcgctgtgaagggagacaggagcacatcactcaagcctcgcttgtgatagacacatccatgtctgtgggttttcgtacaagtttttggatttggaatcagcaatcagcttgagtagattgtgagatggcctcgcttgaaattttgcattgtattagcccaaatatatttgtttgaagttggtgcatcagaaaacagcaaggaggctttgcttgccggatagcatgagttttgtactagaatactagtaataataatgataaagtaatatacacctgtggaatcaggcatggc

SEQ ID NO: 16788 - DNA, 2009 bp, Triticum aestivum
  Clone ID: PAT_TA_16788
catcccggctcgggagcgcacgctctcccttctcacaaatgtcagccacgccgtgcggcccatcctctgacgacgacggccatggcggcggcgaggtcggtgttggccgtggtcccggtggcgacgtccgtggcgcgcgaacggatgctgctctgcatgcccgcaacgatgggagcgcctccaaaggtcagtgaggaggcgctctccgaggcagcgctcgaagccgacccggcggagctcgatgtggatcacctagccgagtaggccccactccgggggctgcccgcgctcctcggcaagccccgatcggtcgccgccctcgtcacatacaggcaagagtgggaaggtggtgaataggaaagcgatgatgaaacgcggttcgaggcagttcactgaacaatggaaatgggaggtgaataagtggatatagagcttcaggttgcaagcaaatgttttaaattcatgtccggaaagcaacctgggaatataagtcattctttcatcccattgttatgtaacatgccttcggcagaggaacttgtaagcctgttgtttcagatttaagcagccggagatgatataataaaaattgcgaccactgctacccaaattcaggatgtttcaagaatgttataattccttgtacactgccaataagagcaggtgcggaaaataccaagggctgacaaactactgtggatttccctagctgcgttaactgccccaaaattcggtggatacattatttttggtctctcttgaaaaagtaaaagaagcttcacctacaaatgtttgccgctgcagtcttgaacaaggtgtacaacattagacagataggccccatataccaaggtgtttggtattattggaaatcctgttggtcacagtaaaagcccggttttgcataatgaagctttcagatcagggtgtttcaatgctgtgtatgtgccatttttggtggatgacttggctaaatttctttcgaaatactcttcaccagactttgctggcttcagttgtacaattccccacaaggaagctgcagttaggtgctgtgatgaggttgatcctattgccagggacattggagctgttaatacaattattagaaagcctgatgggaaacttgtaggctacaatactgattatgtcggtgcaatttctgctattgagtagatggaataagagcaacacaacaaacgcattctaccgtgtcaccactggctggaaggcttttcgttgttattggtgctggtggtgcagggaaagcacttgcttacggtgcaaaagagaagggaagcaagagttgtaatagcaaaccgcactttcgcacgtgctcaagaacttggtaacttaatcggtgggcctgctttgactctcacggagttagaaaactaccatccggaggaagggatgattcttgcaaacacaacagcaataggaatgcatccaaatgtcaatgaaactcctctatccaagcaagcgcttaaatcttatgctgttgtcttcgatgcggtctacacaccgaaagagacaagacttcttagggaagctgcagaatgtggagccacagttgttagcggtttggagatgttcataaggcaagcaatgggtcaatttgagcatttcacgggcatgccagctccagatagcttgatgcgtgatattgttctgagaaagacatgataagcggttgacgataaattccgagcgctgtcaaattctttggacaaccctagcgctgtgaagggagacaggagcacatcactcaagcctcgcttgtgatagacacatccatgtctgtgggttttcgtacaagtttttggatttggaatcagcaatcagcttgagtagattgtgagatggcctcgcttgaaattttgcattgtattagcccaaatatatttgtttgaagttggtgcatcagaaaacagcaaggaggctttgcttgccggatagcatgagttttgtactagaatactagtaataataatgataaagtaatataa

SEQ ID NO: 16789 - DNA, 793 bp, Triticum aestivum
  Clone ID: PAT_TA_16789
gccggccgggttccgcactcagttgacgatcaacgagaagagcagtttgagcacctacggcgatcggtctatctcattctcgagagagcgaattttacttgttcaggtcttcaggatgtcgcagcagccagcacagggcccggcgccggtgaggctcatcacggcgttcggcagcccgttcgcgcaccgcgtggaggtggcgctcacgctcaagggggtgccatacgagctgctcgtggaggacctgaccaacaagagcgagctgctgctcgcccacaaccccgtccaccagtccgtgcccgtcctcctccacggcgaccgcgccatctgcgagtccctcgtcatcgttgagtacgtcgacgaggccttccacgacgacggcgacgggtcggcgccccggctccttccggcggacccctacgagcgcgccacggcccgcttctgggctgacttcatcgccaacaagtgcttgaagccgctgtggcaggcgatgtggacggacggcgcggagcaggcgcggctggcgagggagaccaaggagagcctgtgggtcctggacgcgcagctggaggggaagcggttcttcgggggcgacgcgctcggcttcgtcgacctcgccgcatgcacgctggctcactggctcggcgtgctggaggaagtcgccgggtgcggctgatgaaggacggcgagtaccctgctcttggccggtgggccagggagtacacctccgacgaggtggtgaggcggtcccctgccggacagggacgagctcatcgcctacttcaccaaaaac

SEQ ID NO: 16790 - DNA, 1058 bp, Triticum aestivum
  Clone ID: PAT_TA_16790
tgtgcggccgctcaggccggccgtccggggagcagtttaagttcatcctccaagaaaaaaaacctacggcgatcgatctatctcgttctcgagacagcgaatttgacttgatctcagccaggatgtcgctgcagccagcacaggctccggcgcaagcgccggtgagggtcatcacggcgttcggcagcccgtttgcgcaccgggtggaggtggcgctgacgctcaagggggtgccgtacgagctgctcgtggaggacctgaccaacaagagcgagctgctgctcgcccacaaccccatccaccagtcggtccccgtcctcctccacggcgaccgcgccgtctgcgagtccctcctcatcgtcgagtacatcgacgaggccttccatcacgaagcggcgccccggctcctccccacggacccgtacgaccgcgccacggcccgcttctgggccgacttcatcgccaacaagtgcttgaagccgctgtggcaggcgatgtggacggacggcgaggagcaggcgcggctggcgagggagaccaaggagagcctggggatcctggacgcgcagctcgaggggaagaggttcttcgggggcgacgcgctcggcttcgtcgacctcgccgcatgcacgctggctcactggctcggcgtgctggaggaagtcgtggaggtgcgcctgatggcggacggcgagtaccctgccctgcgccggtgggccaaggagtacacctccgacgaggtcgttaggcggtccctgccggacagggacgagctcgtcgcctacttcacaaaaaacaaggagaggtacctgtcgtccatggtcaaggcagcggcgaagtgaatcagtagcgtgtggcgcgatcgtcgcagcggcgcggtgaagaagcgaccacgtacacatcacagttgtgctagagtctctaaataagcaatgtatttttagatgtaataagcatgtattttgttcaacaccataatcgtgcatggtttgccaaactttcatcacggggaagattttgttttaaaaaaaaaaaaaaaaaactctagggggggcccg

SEQ ID NO: 16791 - DNA, 578 bp, Triticum aestivum
  Clone ID: PAT_TA_16791
gtttcttcctgcagccggagataatactacaagccaagcttcctgccgcagagaccgatcgtgccgagcggagcgatggagaagctgacgccgagcaacgcaaagaaggcgatggaggacagggaggagaagcccaaggtgccgtcgaccgacccggacgacagcctcgacgacctcgccgccgggcagcggcagccgcagctgcagcgggagcagcagcaccaggcgcccaacatctcggagatgaagccgatgacgcgggaggcgtacggcggcgggatgtacgcggcggaggagggccggagggagcccgggaggccgcgcgccacgcgccacgcagagcgccgacgggccggagcagcccgtggccaggcccaggcaccccccgccgccgtccaccggcgaccgcgacctcgacatcaccggcatgtcctacatccagtaggcggtagtagctagcttctcttcctccttttgcgtgtccgttgtgtttggacggtgtggcgcgggtagtactttgtgctttgtatacgtgcgtgcgcctgctagagctcccgttcttcgtcgtgttctcaaaa

SEQ ID NO: 16792 - DNA, 1766 bp, Triticum aestivum
  unsure (1)..(1766): unsure at all n locations
  Clone ID: PAT_TA_16792
cccccctcattattaaccactgctttattaattacctccgccgacgcacccctgccaccggctacgacgaggacccgccggcaccgatggtcgtgggcgcggtcctcaaggccatcaagctccccgcgccggcgccgaagcggagggcgccggggcggtggccggggacgacgaggcccaagcggaccgcgggcgccggccgccgccgcggggggtgggggcggcgggggggtggcgggctaagcacgggcgagggcgggtcgacggcggagcccggcgcctcggggggcgcggccggcgcggggggctcggaccgggggccggcgaggtgggctgggaaggcgactgaggggggggcggggccgactacggccacgccgacgtggagctcgggcgcgccggagttgctgggaagcacggcgacgacgtggtcgtcgagatcaagcccttattcgccgtcaaaaggtccctctcccaagatgacttaagcaccatgactactgctggttttgatggtcctgcacaaaggtcagcaaaaaggaagagaaagaacgagttcaggggtatccgccagcgcccctggggtaagtgggctgctgaaatcagagatcctagcaagggtgtccgtgtctggcttggtactttcaacagtgctgaagaagctgcaagagcttatgatgttgaagcacgaaggatccgtggcaagaaggccaaggttaactttccacagaggaaccaacagttcctcagaagcgccgtgcttgccctgctgctcctaaagttcccaagtcaagcgtagcacaggaacctaccgtcataccagcagtcaacaaccttgccaacccaaatgctttcgtctacccatctgctgactttgcatcaaagcagccgcttgttcagcctgacaacatgccatttgttcctgcaattaactctgctgcctctgttgaagctcctgttatgaatatgtactctgaccagggaagcaactcctttggctgctctgacttgggctgggagtatgacaccaagactccagatatatcatccattgctcccatttccaccattgctgaaggaacagagactgcagttctccagagtaaaacctacaacccagcggtgattgctgaaggagctgaatctgcgcctgtccagagcaacacctacaactcagtggtgcctcctgttatggagaacaatgctgttgattttgaaccttggatgaggtttcttttggatgatggcgtggatgagccgattgatagccttctgaattttgatgtgcctcaggatgtcgttggcaacatggacctttggagcttcgatgacatgcccatctgtggcaaaattttctgagggattcaaacccctgtacatcaggacaaagggaataagactatgggagattgggaagcaccccgttgtcacctttggttagtatatgcttatgtgcaagcttagatgcaaaaaagccgcatcctgagtctcttttgtagtcgaccctttccctagttgactgtcgatgaaccgttgtcatttatgagtccgatgaaccgttgtctttatcttttgtcaatttttatgtcgttgctaccatttctgaatgtgaacagcatggatctgtgtccagtttgctttaatctgtgcaaatgaaagttttttctatattttaccttnccgaacaantncccggnaatttnttgggtcggaattaaccaaanngtgngggacctaaaaaagtcctttttccanccgggggggtt

SEQ ID NO: 16793 - DNA, 1333 bp, Triticum aestivum
  unsure (1)..(1333): unsure at all n locations
  Clone ID: PAT_TA_16793
cggcacgaggctcagattttttcctccagctgcagcacatgctaatgatactgttggtcctgagatggctgaatttagattggccaatcctgtgcaagttgagtcttctggtgctgtacagcataattttgctgttccaccctcagattttctccatcaaggtgcagcacatgctaatgacgctgttgattctgagatggctgaatttagattgtctgagcctgtgcaagttgagtcttctcgtgctatacgggagatggattttctgaggcaacactctgcaactgtggatatgccaccagaaccacaaacatcaaacctggtggtaaatactgaggatatagctgtatcaggtcaaacactgccttttaaagcaaccatgggaagtgtgccatttgttcagaatacttcggagccgcgcgctaatggttctaccgaaacatacgtgacagggaatccaacacattttaatgaggggtcagtaaacatgcaagggtataattttcttacttctaatgtatctgtagagccataccctagtggttctaccgagccatgggtgacagggcaacaacaacaaagcttcttgtcccaagcaagttggggtaggcctagtggtcctaccgagccacacgtgacagggcatccaacacattttaatgagggatcaggaaatgtgcaagggtataatctgcatgctcctagcgcgtggctcggacataacttacaagaaatgccaccaggaatgacacacagtaatatatcaactgcagctttccaacagaacactggaacaataccgcaatacatgtcatataatgatagaccaaatgacatgttcacctcaaatttcccagaacgcgagagaatgctctcagctccatatattggattccaccagacaaatgacttggggcagttaactgcagagaaaggaatcactgaatctgatggaagtaacaaaataggtagccttagtagcagaaagcgtcacttggaggatagcatgccagctccagagagtaggactactgaaaatttgtccagcagaccacatggtcaaagaaccactgatgctattcctaacgatgatgatatactggcatccattttagttggtagaacccctggattggtgcttgattcaacaccattaccacctaatgcatcaacttcaaaacgccaaaggttgacaccgaagaccgcattgacacccaagaccnngacacccaagnnnagagtgaaaatggatgatgccatggttatacatgctgatattatacggcagcnnntgantagtactgnnnntatnnnnngcatccgtnnnnnnnnn

SEQ ID NO: 16794 - DNA, 682 bp, Triticum aestivum
  Clone ID: PAT_TA_16794
acctgaatctatctaccatcccatcccctcttctcatcggcttcttcggctccggcgaccggcggcggccgtctcaggggcacgggaaagcaaataagtgagtgaaacaaggtcgtgtgaaaaaacaggaagcccgtgttagtttcaatggcttcttcaaagcttcaagctttttggaaccatcctgctggccccaaaaccattcatttttgggctccaacatttaaatggggtatcagcattgcgaacattgccgatttcgccaagccacctgaaaagatatcctatcctcagcaagttgctgttgcttgcactggaatcatctggtcacgctacagcatggtcattacaccgaaaaactggaaccttttcagtgtaaacgttgcaatggctggcacaggcttgtatcagctttcccgtaaaataaggaaagactactttgcagatgagaaagaggttgccgcatcgctggaaggatagtgatgaacggattaatcgactgaaagccccactgcctcaaattcagtgtgccgcagcgatgtgtcgtttcatctgagacaggaatccatcatttctttccatgtccgaattggtttgtgtcgctcagttgcacccatgaaagaagcattgtgaaaatttacacaaacaagcaaatgtttgtttatggctttatgcactgtgc

SEQ ID NO: 16795 - DNA, 829 bp, Triticum aestivum
  Clone ID: PAT_TA_16795
gaagagacccatcccctctccatctgccctctcatcggctccggcgaccgcaacctcgacctcgaccggcgaccggcggcgggcgtctctcccaggtgtacaggacagagtgaataagcaggattctgcaagagagggaagtgcgcgtccatttgattgaatggcttcaaagattcaagccttcttgaaccatcctgctggccccaaaaccattcatttttgggctccaacatttaaatgggggatcagcattgcgaacattgccgactttgctaagcctccagaaaagatatcctatcctcagcaaattgcggttgcctgcactggagtcgtctggtcacgctacagcatggttatcacaccgaaaaactggaaccttttcagcgtcaacgttgcgatggccggcacaggcctgtaccagctttcccgtaaaataaggcaagactacttctctgacgatggaaaggaggtggctgctgcatcactggaagggtagcgaggaccgactggattaatagtcgactgcacagcctgcctgctgccccggaactctgggccgcgggctggcgcagtttccatgccgtccattctttcccatgtcgaaacttctttgtcaatcacgcccttgaacaaagcggagcagtatgaaaattccgtgcagattaataatctctgcgcaaaaaggtgtacagattgaatgcatagacgcggccttgcgtccaagaaagttatgccgtccttttttgagataaataattgacctgctacaacatggatatcacaccggacaatttaaaccatccaagcttacacactcctacgtgcgaca

SEQ ID NO: 16796 - DNA, 1152 bp, Triticum aestivum
  Clone ID: PAT_TA_16796
ccggctcgaggggccggccgggcccgggaaaaaaaaaaaaaaaaaaaaaaaaaaaacgccacctacctctgaagagacccaccgccggtcccctctcccgctcccctcttgacgccagcgactccggctccggcgaccgtcgacgggcgaccggcggcgggcgtccctcccacgccgatgtccacgacagagtgaagaggcagggccgtgccaacggaaaagaaagtgcgcgtccatctgattgaatggcttcaaagattcaagccttcgtgcactatcctgctagccccaaaaccattcaattttgcttgaacagcttcaaaggggcgatcagcattgataacattgctcccgacatttaaagcctccattaaagagctcctacaaataatgactgaactgtgccttgtcacccgtacgcatcgtgatcatccccacaagcatagttatcacaccgggaaaaactggattaccttgtgctcaagtcaacggtacgattgccggcacaggaatgaaccagaattaccgtaacataaggaaagttcacttcgccgatgacgggaaggaggtggctgctgcacgactggaaagaatagcgagaaccaactggtatgatgaatgggactgcacagcctgcctgccaccgcaaggaactctggggccgaggggccggcacaatttccaagaacatacattccttcctgacgtccgaaccttctttgtgaatcccgcgcccttgtaacatacgcaccagtcattcatgaaaattccgtgcagatttattaatacctcgctgcattataatgcagaaaagttgtaaagatcgaatgcatacatgcggtcttgcttttaagaaaaaaatggtgtactttttgtgtatccacgttaacctacagagaaaaaaaattaagccctcctttactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatat

SEQ ID NO: 16797 - DNA, 833 bp, Triticum aestivum
  Clone ID: PAT_TA_16797
caacagcccgaccctccgcgccccaatacccattcctacccagcggcagacacgcaacagcccggcgcgcatctcgctcggggagctccgccgccgctccgcccgcccgcccctcccctcgctcgcgcgctggagacgaagcaagggttgtggacaccagggatgggactatcgcagttgcttcagcgtttcccggtcatcaggaagcggtacaagatagggatcacaagttcttgtcgaaagcggtagaagaggcttacaaaggagttgactgtggccatggaggcccctttggcgcggttgtcgtccgcaacgacgaaataatagttgggtgccataacatggttttgaacaacaccgatccaactgcccatgctgaagtcactgcaataagagaggcttgcaaaaagcttgggaagattgagctgtcggattgcgaaatgtacgcgtcatttggagccttgcccaatgtgttttggggctgttcatctatcccggatcaagaggctggtgtacggagccaaggcggaagctgctattgccattggattcgacgacttcatggctgatgctctgagaggaaccgggttctaccagaaggccaacatggagatcaagcgagcagatgggaatggagccctgcttggctgaacaagtctttgagaacaccaaggagaaattccgaatgtactaatgtatagcaaagacatgttcgaatttcacagcatggaagaccctgatgctcagaaaaaaaaataatgtaattgtcaacattctgtcattggtgatggaccacaaactatcaatttaaatataccatttgattctcaaaa

SEQ ID NO: 16798 - DNA, 1517 bp, Triticum aestivum
  Clone ID: PAT_TA_16798
gcccgcgtgcgcggacgtacggcagcgagcctctcccggactccgattccttccttccttccggcggaggtgtcggcgcttctcactcctccctgcgagcggaaacccgggcgtagctgagccggccggacggagggattttggggcacagcagcacgcctgcgggcggaactggaggcggtgccggctccgctcccagtgctgcagccgggtgttcggctgccgggcttgccacaacgacgcggagaattcgctgcaggtggacctccacgacaggcaggagtgcccccgacgcgaactcagcaaggtcgtctgctctctctgcagccaagaacagaatgaggaacagaactgctccggttgcggggcatgcaagggaaaatacatctgtgaacaatgcaacttctttgatgacgatatcccaaagaagcaatatcactgcgatggatgcggcatctgcagaactggcggcatagacaacttcttccactgcgaaaaatgcgggtgttgctacagcaatgttttgaaggactctcatcattgtgtggaacgagcaatgcatcacaactgccctgtctgcttcgagtacctatttgactcgaccatggacatcagcgtactgcactgcgggcacacgatccatttggaatgcctgaacgagatgagggttcatcaccacttctcgtgcccggtctgctcacggtcggcctgcgacatgacggatgcgtggcagaagctcgaccaggaggtcgccgccacgccgatgccagagttctaccagaagaagatggtatggatcctctgcaacgactgcggggcgacgtcgagcgtgcgcttccacgtcctggcgcaaaagtgtcctgggtgcagctcctacaacaccagggagacgaggggcggcccagctacagcggcgtgctccagagtctgagcgccaggaggagacgacagtacaacagacactactcactcatagtcacagctgtgacactacccaggatctggtcaagatgatgggggcattagagctagcttgtaggttgaagctgcgagtgcttgctgcagtaggaagcacaggagagtgacgcgtctcctctgtgaacaagccaggaattgcttgccgtcgccgacagggaggccgccgcggttgctcatcgcaattcggagaacaacaaaactcgctgcgcttgcataaatccggaggaatgatttaccgcttgtcatggtgcgcttgatcatcccctctgatatgtatgagttgttgtgtggtacatgaccctgtctagggagctcctgtaaggctatgaaacaattacacaccagaaagaaaacttgttcttctttctgttagaactccattgctacttcgatgtctacaagcaccagattgcaccatgcactgatgcacaccaaaacatgcttctgtgatctgtctgatattctgattgctttgcatgaagcagaaatgtttgtaacagtatcgaacttcaaaaaataaatacgggccagttttctag

SEQ ID NO: 16799 - DNA, 1325 bp, Triticum aestivum
  Clone ID: PAT_TA_16799
agcaccaccacctgcgctccgtcgccgacgccgccgacgccgcccacaacgccaccgccgtcgccgtcgcggctccggcacccgcccccgtccaggctgcgtcgccgtacggggacctggaggaggtgctggcgcgggcggcgacggcggaccggacggtgatcatgacgcagatcaacgcggcgtggaccaagccggggtcgctgctggacctcttcttcgagagcttccggaccggggagggcggcgtggcgcggctgctcgaccacctcgtcatcgtcaccatggacccggcggcgtacgcggggtgcgagctcgtgcacccgcactgctacttcctgcgcaccaccggcgtcgactaccgcggcgagaagttcttcatgagcaaggactacctcgagatgatgtggggccgcaacaagttccagcagaccatcctccagctcggatacaacttcctcttcacggacgtggacgtgatgtggttccgcgacccgttcaagcacatctccatgggggcggacatcgccatctccagcgacgtcttcatgggcgacccctacagcctcggcaacttccccaacggcggcttcctcttcgtgcgcgcctgcaacaagaccatcgagttctaccgccactggcaggccggccgctaccgcttcttcggcaagcacgagcaggacgtgttcaacctcatcaagcacgagatgacggaccgcctcggcgtcgccatccagttcctcgacaccacctacatcagcggcttctgtcagctcagcagggacctcaacaagatctgcacgctgcatgccaactgctgcgtcgggctcggtgccaagctgcatgatttgaggaatgtgttggacgtgtggaggaactacacggcggcgccggtgcccgacaagagggccggcaagttccagtggaaggtacccgggatatgcatccactgatccaaccgatggatgagttgcatgctttccatgcatttggtacccattctttctgttcttcttgcttgtctccttctcgtggaaagagggaggggattgagaggggtagcatcgatcgattgattcattttgtgaaatcatttcagctagatgattattagtaagttattacactatatatgtacacaaacatacacagagtagtagtactccagtatgcgtgcagcacatgcatgcatgtatgctggtcctggccgactctcggtggcctgtaattaaagatgaatgagtaaagcagtagcctgtttatgcaaaaaaaaaaaaaaaaaaaatgtactaaaaaaaaaaaaaaaaaaaaaaaaactcgagacc

SEQ ID NO: 16800 - DNA, 655 bp, Triticum aestivum
  Clone ID: PAT_TA_16800
tctttcccacgcgtccgctcccacttgctagctagcagcagcagccatggccgctctctcctctgcagcggtgtccgtcccttccttcgccgccacccccatgcgcagcagcagcagcaggatggtggtgcgcgcgtcgctgggcaagaaggccgccagcgcggccgtggccatggccgcgagcgcgatgctgctgggcgggtcggcgatggcgcaggacgtgctcctgggcgccaacggcggcgtgctggtgttcgagcccaacgacttcagcgtcaaggccggcgagaccatcaccttcaagaacaacgccgggtacccgcacaacgtggtgttcgacgaggacgccgtgccctccggcgtggacgtctccaagatctcccaggaggagtacctcaacgcccccggcgagaccttctccgtcaccctcaccgtgcccggcacctacggcttctactgcgagccgcacgccggggccggcatggtcggaaaggtcaccgtcaactaattaagctagctccatatcgctgttcttgcgagtttgggttcattgttgatgggtcagaccggacgtgtcatgcatgcatattgattaattgtaccaacgtacgctatatgtatatgttttctactactataagatgagatgaggctc

SEQ ID NO: 16801 - DNA, 1014 bp, Triticum aestivum
  unsure (1)..(1014): unsure at all n locations
  Clone ID: PAT_TA_16801
attggtgtcttataattattccagagcaagaactgctgatggggcgagttgcggtacacggaaagaagagtacaaacactgatcagtcactgacaggacagtgccactgccggagaaccggagcttatagcagcggcgatggtgcagacggcgggagatcggtcagggacggcgctgcagggcgtcggagaggtgcttgagcgccttgtcgtaggagacgaagcccatgaaccagaactcgtggctgtcggtggtggccacctggatgtaccgctccgacggcctccacatgctggccgacgggctcaccgtcctcacctggttcagcggaagcaccaccttgtagtacatgggctcgggcggctgggtgggggagggggcgtggtaggagacgggcgagtcgctgcagaagtcgaggcgggcggtggagaggtagagcgtgccgatgacggggccggaggaggtggagaggtagcaggcgtaggccttgcggagctgctcccccggcacgccgccgaacacctggtggaacacccgctcgtgcccgccctccgcgtacaccttggtcccctgcgccagccgcgccaccgccgcgtccgccatgttcggcgccgtccggaggtggttccagatgttgccggtggtgtcggcggccttgcgggtgccgtcctccagcagcttgccgtaccgccccagcgccttcatgatggactggcaggtggacggggacgcgctggccggggtgacttgcacgtaggggttgccggcgccgttgctggccgccgtgacggcgacggccgtggactgcgggcgcgcggcctggccgccgtgcggcgggtaccccgccggcgccggcgcgggagcctgcatcgacgccatccggcacgcgatgagtttagtctggttctgcaatgaaacgggctggagctctgccttatgcggattggcgacggatgaggaggaatgatgcggtgcggtgggcggcgggcggtggcgggggagaatcatncggag

SEQ ID NO: 16802 - DNA, 690 bp, Triticum aestivum
  Clone ID: PAT_TA_16802
ctatctctatctacctacgtacgctgccactctttcccaaccacttacttagctagctagcagccatggccgccctctcctctgcagcggtgtccgtcccttccttcgccgccaaggctgccacccccatgcgcagcagcaggatggtggtgcgcgcctccctgggcaagaaggcggcgagcgccgcggtcgccgtggcggccagcgcgatgctgctgggcgggtcggcgatggcgcaggacgtgctcctgggcgccaacggcggcgtgctggtgttcgagcccaacgaattcagcgtcaagtccggcgagaccatcaccttcaagaacaacgccgggttcccgcacaacgtggtgttcgacgaggacgccgtgccgtccggcgtggacgtctccaagatctcccaggaggagtacctcaacgccccaggcgagaccttctcagtcacgctcaccgtccccggcacctacggcttctactgcgagccgcacgccggggccggcatggtcggaaaggtcaccgtcaactaagctatcttctagtagctccctgtcctgtccttgagaatttgggtccattgttgatcggtcagaccggaggtgtgtcatgcatgcatattgattaattgtacggacgtacgctatatgtatatgttttctataagatgagatgaggctcttgatgataagt

SEQ ID NO: 16803 - DNA, 667 bp, Triticum aestivum
  Clone ID: PAT_TA_16803
cccacgcgtccgacgtacgtacgctttcccagccaaccactcccacttagctagctagcagcaatggccgccctctcctctgcagcggtgtccgtcccttccttcgccgccaaggtggccgccacccccatgcgcagcagcaggatggtggtgcgcgcgtccctgggcaagaaggcggcgagcgcggccgtggccatggcggccagcgcgatgctgctgggcgggtcggcgatggcgcaggacgtgctcctgggcgccaacggcggcgtgctggtgttcgagcccaacgaattcagcgtcaagtccggcgagaccatcaccttcaagaacaacgccgggttcccgcacaacgtggtgttcgacgaggacgccgtgccgtccggcgtggacgtctccaagatctcccaggaggagtacctcaacgcccccggcgagaccttctccgtcaccctcaccgtgcccggcacctacggcttctactgcgagccccacgccggggccggcatggtcggcaaggtcaccgtcaactaagctagctccatatcgctgtctttgtccttgcgaatttgggtcgattattgacgtgtcatgcatgcatattgattaattgtacgaacgtacgctatatgtatatgttttctataagatgagatgaggctctaagtac

SEQ ID NO: 16804 - DNA, 737 bp, Triticum aestivum
  Clone ID: PAT_TA_16804
gccggccgggtgccggccgctctatctatctacctacgtactctttcccacttagctagctagcagccatggccgccctctcctctgcagccgtgtccgtcccttccttcgccgccggcgccaaggtggccgctccccggagcagcaggatggtggtgcgcgcgtccctgggcaagaaggccgccagcgcggccgtggccatggccgcgagcgcgatgctgctgggcgggtcggcgatggcgcaggacgtgctcctgggcgccaacggcggcgtgctggtgttcgagcccaacgacttcagcgtcaaggccggcgagaccatcaccttcaagaacaacgccgggtacccgcacaacgtggtgttcgacgaggacgcggtgccctccggcgtcgacgtctccaagatctcccaggaggagtacctcaacgcccccggggagaccttctccgtcacgctcaccgtccccggcacctacggcttctactgcgagccccacgccggagccggcatggtcggcaaggtcaccgtcaactaagctgtcatctagctcttgcgaattgttgcgggtcggttgatcgatcgggcgtgtcatgcatgcatattgattaattgtacgtacgtacgctatatgtatatgttttcaactataagatgagatgaggctcttgatgataagtaaaaaaaaaaaaatcttagctttgatttgattgatcatctatgcttaattatttttttc

SEQ ID NO: 16805 - DNA, 1095 bp, Triticum aestivum
  Clone ID: PAT_TA_16805
cggacgcgtgggatctattttttgtcgttttttctacgtacgtacgctttcccagccaaccactcccacttagctagcagcagcagccatggccgccctctcctctgcagccgtgtccgtcccttccttggccgcccaaggtggccgccacccccatgcgcagcagcagcagcaggatggtggtgcgcgcgtcgctgggcaagaaggccgcgagcgcggcggtggccgtggcggcgagcgcgatgctgctgggcgggtcggcgatggcgcaggacgtgctcctgggcgccaacggcggcgtgctggtgttcgagcccaacgacttcagcgtcaaggccggcgagaccatcaccttcaagaacaacgccgggttcccgcacaacgtggtgttcgacgaggacgcggtgccctccggcgtggacgtctccaaggatctcccaggaggagtacctcaacgcccccggcgaagaccttctccgtcaccctcaccgtgcccggcacctacggcttctactgcgagccgcacgccggggccggcatggtcggaaaggtcaccgtcaactaataagctgtcttatagctcttgcgaattgttgcgggtcggttgatcgatcgggcgtgtcatgcatgcatgcatattgattaattgtacgaacgtacgctatatgtatatgttttctactattatataagatgagatgaggctcttgctgataactagatgaggctcattaagatgaaggaaacggttgccgacgccgttgctggccgctgggaccgcgacggccgtggaccgcgggcgcgcggcctggccgccgtccgtcgggtaccccgccggcgccggcccgggagcctgcatcgacgccatggcacgcgatggggttagtctcgttctgcaatgaaacgggctggagctctgccttatgcggagtggcggtggcgggggagaattgatgcggggcggtggccggcgggcggtggcgggcgagaacccgttcgtgctccccctccggttcccttcggggggggcggacgcgggggtaaaaaaaaaaaaaaaaaaaaaaaaaaaaaaaaaataaaaccaacaaccccccc

SEQ ID NO: 16806 - DNA, 834 bp, Triticum aestivum
  Clone ID: PAT_TA_16806
actaactttgtgcggtcccacaaccacagaaaccaccgtgatcatcttggagcaaaggaaacgaaatggcgccggtgaaggtgttcgggcaggccatgtcgccgaacgtggcgcgggtgctggtgttcctggaggaggccggcaccgactacgagctcgtcgacgtcgacttccaggccaaggagcacaagaggcccgaccaccttgccagaaacccgttcgggcaaatccccgcgttccaggacggtgatctccttctcttcgagtcaagagcaatcgccaagtacgtggcgcgcaagtacaagacggacgaggccgacctgctgagagaaggcgacctttcagaagccgccatggtggacgtgtggacggaggtggaggcgcacacctacagcgccgccctctcgccgatcgtctacgagtgtctcatcttccctctcatgcacggcaagcccaccgacgagaagatcgtcgacgagagcctcgagaagctgaggaaggtgctcgaggtctacgaggagcggctgtccaagcaccgctacctggccggggatttcctcagcttcgctgacctcaaccatttcccctacaccttctacttcatggcgacgccgcatggggccctgtttgagtcgtacccgcgcgtcaaggcgtggtgggacagcatcatgtccaggccggcgattcagaagctcagtgcaaccatgacaccatgaattcacgtacgacgcaactgcccgtgaaattatgcatggttcattagaaattatgcatggttcattctacagtattcaattttattgtgtgcatgactgcatgagtataatattgtaa

SEQ ID NO: 16807 - DNA, 952 bp, Triticum aestivum
  Clone ID: PAT_TA_16807
ggccggccgggccggacacctttgtgcggtcccacaaccacagaaaccaccgtgatcatcttggagcaaaggaaacgcaatggcgccggtgaaggtgttcgggcaggccatgtcgccgaacgtggcgcgggtgctggtgttcctggaggaggccggcgccgactacgagctcgtcgacgtcgacttccaggccaaggagcacaagagccccgaccaccttgccagaaacccgttcgggcaaatccccgcgttccaggacggtgacctcgttctcttcgagtcacgagcggtcgcaaagtacgtggcgcgcaagtacaagacggacgaggccgacctgctgagggaaggcgaccattcagaagccgccatggtggacgtgtggacggaggtggaggcgcacacgtacagcgccgccctctcgccgatcgtctacgagtgtctcatcttccctctcatgcacggcaagcccaccgacgagaaggtcgtcgacgagagcctcgggaagctgaggaaggtgctcgaggtctatgaggagcggctgtccaagcacaggtacctggccggggatttcctcagcttcgcagacctcaaccatttcccctacaccttctacttcatggcgacgccgcatggggccctgtttgagtcgtacccgcgcgtgaaggcgtggtgggagagcatcatgttcaggccggcgattcagaagctcagtgcaaccatgacaccatgaacgtaccacgcaactgcctgcttaaagtatatagctactatggcagcttaattagtaattgatctgcatgcctcattctataatattcagttttattgtgtgcatgactgcatgcatgagtataatgtaatttgtactgtctaccagaattgtacaagtctgcagttctggtggttgtatctatctgtatgttccattttttgtgccacacttttctttttg

SEQ ID NO: 16808 - DNA, 603 bp, Triticum aestivum
  unsure (1)..(603): unsure at all n locations
  Clone ID: PAT_TA_16808
ccgagtccgtcgacagcgactgcccggtcgccggagaaaaatgacgtccaccctggccgccaccgccacctcccgccctctccgccttcccgcctccctcccctcgccgcctcccgtggcccgccctggcggcggccgccgccgccgcgcggtcctgcgctgcgcctcggtgtccgagatcgcgcccgcggtgtccgccgcctacggcgccctcctcgtgggcggcggcgctttcgcatatgcgcggtcggggagcaaaggctccgtccttggaggggcctccggatctgcgctcatgggcctcacatattatctgatgcagttttctgagacgaaggcactaggcgatgctgttggatttgggtccgcctttctgtttgcctctgtgtttggtatcaggttgtacaatacccggaaactggtgccatccggccttcttttagctctctccctaggtgccctgggagtcttttacgctgcttacttgcaagacaaggtgtgagctattcccctcacctcctcttgcgtcctctacgacgaaccgccgcagcgtcctccaaggtggcctctcgggcatggcaaggcgttcgcaacttgntcnaa

SEQ ID NO: 16809 - DNA, 1507 bp, Triticum aestivum
  Clone ID: PAT_TA_16809
gtagaaacgccgtgcgcacctcctcccgtgcccgccagccacagctacccagctagcatgccgttccctcggcggtccccgggagccctaggcgccagcgcgccaacacccgggcgcacaaaacccaggaagccgtgcattctcactgggggccctccgcgcccgcagccctagcggccctctctcgcggcgcagcaacccaagtactccgtgcaggcatccgcggggcccgcaccctcggcctttttgaccgtgctgcatctcgcactccccccctcccgcataaggtaaaagctggtcgtggcgcaagaatacgacgaaaacccaccgtcgtgcggtgccgaaccgccccagaagccgaagcggctgagtgagtcggaagtggtggaggcttagccgttcgggcagctggatccggaccctgtgtaggtggtcaagaacacgctcgagcatctcaaggcgtaggacggcatggatcctgccaagtccatcctcatcgccatccgcaggtcaggtctaacgacgtctcgcgcgggaggctgttttagtggaacctcattggaccttactccattgttttgctgggttagggatgctttctgcgggtccctaggcattgacgttaattttgaccttaatggaccagaccaggagaccttggaaggcctgagaccaaaaacgaactggtaggttttaaaagactggggcaaaataaatttaaacaacgctaacgtgtggtggttcatctcaaatacacacaacctaacagctgatgctcagagcgttcacgagggagataagacctaactctgtgtctgggttcttgtcccgttgcctgtaagttcttgtgtcttttactactgctggactgtgagcggtagagagatgtaatgcgctgacaggtgatgttgtttgtatgtatcgctgatgagtcggtgtggggcactggtgctcctcccttaccacccatccctccggctcgcctggcgagtcgccgggtgtgcgcggggagtgttggggagcagtcagaccttgacgctgaaggcccggccatcctgcgctcgccctccgctccttgggatgagctcgacgaggaggatgaatatgaggaagacccggagcctatgtcagatgaaggaatccaggaaccaaagcggaagagagagtcagcagtgggcgggagccaaaggcgcagggaggtggactcggacgaggattccccgccgaggaaacaggctgcgactgttcatcgccggaagggcgttgtttttgaaagcgacgacgaagacgagtgaaggagaaaatagaaattcgcaaacgtacattcgtctctgctgccaaaagtgttgttgaatattggatgggctatgtgtgaatgttgttcatttagaaacaaaaaaaaagaagttgtcagttgtccgttattcggtgcccaggtgcagatcatgaacagtaaattcaaataaaatagcagataattctattgatgtctacctccttaccattg

SEQ ID NO: 16810 - DNA, 1443 bp, Triticum aestivum
  unsure (1)..(1443): unsure at all n locations
  Clone ID: PAT_TA_16810
ccggcccccatccgccgccgcggcgggcccgccgcgcggccccgcctcaggcccgcgccgtccctgcccccgcggacgctgccgttcctcggccggctcatgcgcgtgctcgggacgtcgggcgtcttcggagccgacaaagaccccgagtgcggcggggagctctaccgcctcaccccgctgtcccgcatccttgtggacggcgtcgacgcggatgagcaccacagccaaaagtattttgtgcttgccgtgacctcgccacgtctcgcggaggcggcgttggggctggcggactggttcaagaaggaccttgagccaccagtgccgtctcccttcgaggacatgcatggcgcccctatctttgatgagagaacgcccctcatggacgaagagtttgacgccgttacaaaccaaggcttggctgcccacgacaacctggggattgccaccatactgcgagagtgcggtgacatcttcaaggggcttgagtctctcactgactgctgcggtggtgatggtatgacagcgagggctcttgtcaaggcttacccgcacatcaagtgcaccgtgttggaccttccgaaggcgtggctccccgccccaaccgggggtgtccttccctacgtcgcgggtgccctgtctccctccggcccctcgtctctcgctgtgacgcccgtgctggcgctgcttcgccggcgcgggctctcgtcaaggcttacccgcacatcaagtgcaccgtgctggaccttccgaaggtgatcgacaaagccccaactgatggcgtcgtttactatgttgcgggtgacctgttccacaccgtcccatcttctcaagccgtgatgctcaagcttgtgctacacttctggagcgacgaggattgtgtgaaaatcttgacccagtgcaagaaggccattcctccgcgcgacgagggaggaaaggtgattatcatagacaccgtcattggaccttccttggcgccaataatgtttgaagcccaactcctgatggatatgctcatgatggtgaacacaagaggggctccgcggggtgaaacgggctgccgcctgctactccgttggacctgggtgcaaggactgcaaaattgtgaagaaactcggagctcgatgcgttatcgaggtctacccataagatgacgtgctctaagaatatgaataaaggagaggtgtttgtttttccaaatgaatagcttcatggatcttggtaaagtagctagagcgtccggaattagctgccatatggtccatgtaaggttcatttagagaagtactaaaaacactgtgtgtgtgtggttagtttttaccatgtcggggggcttccaaacgtccaacaacacttccttgttttttgccgtccattttgtgtattgttgacacattatctttttatatcaataacgatattttcccttcatattaaaaaaan

SEQ ID NO: 16811 - DNA, 549 bp, Triticum aestivum
  Clone ID: PAT_TA_16811
ggccatcgcccacgcgtccggtggacgtgttgtcgatgtccttcggtgtcgacgagaactcgttcggcgtcctgcatgcggtccagaaggggatcaccgtcgtgtatgcggggggtaacgaggggccaaggccacagaccgtcaggaacggtgcgccgtgggctatcaccgttgcggcaagcaagattgatcggtcgttcccgacgatgatcacgctgggaaacaaacaacagatagtgggacaatctctctattgccgagggaagaattcgtcaaagagcagcagtggtttcaaaggtcttgtggttccagtgagttgtgccatggatattctcaatggcacggacgtgaaagggcagatcttgttctgcaccatgcagccaggggatcaagatgtgttccagcaggcggcacagtacgttcaagatggccgggggtctggcgtcatcttcgcccagtataccacggacctaagcttcacagcactagatgtctgccagggcatagcctgcgttctcgtggaccttgacatcggaaaagaaatcgcca

SEQ ID NO: 16812 - DNA, 1287 bp, Triticum aestivum
  unsure (1)..(1287): unsure at all n locations
  Clone ID: PAT_TA_16812
gaccgcggcatccatataagctaagcccatgaagcaccgcctaggactaatcaaacagacaatcggcaatgggaatactccattcgtcttcctccagctcgcgcgtagcctgggtgctgctcctgctgctgctttgcttctgcgagctgtcattcagagcacgcggaggaggatctcgcaagctctatatagcttacttaggtcatgtgaagcatgatgatcccaacgatgtcgttgcatcgcaccatgatcttctcaccaatcttctcgaaagcaaggaagaatctttggcctccgtggtgtacaactacaagcatggtttctcggggttcgccgccatgctcaccacagagcaagcgaaagaacttgcagagtttccggaagtaatcagtgtccaaccgagtaaaaggcacaccccaaccactacacgaagctgggactttcttgggctcaactaccagatgatgggcagtgatatgctccacggaagcaactctgaaggagaggacgtgatcatcggggtgattgacaccgggatctggcccgaggcgagaagcttcaacgacgcagggtacgggccggtgccatcaaggtggaaagggaagtgccaggtcggtcacgactggggcagcaaaaactgcagccgcaagatcatcggtgcacggttctatagcgcgggagttcctgaccagtttctcgagacagactcgctctcacccccggaccacaacggtcacggcacacanctgtgcgtccactgcggcggggttcggccctgggagggcggccagcttccacggcctaccccagggtgtcgctcgcggaggcgcaccgcgtgctcgcatccccgtgtacaagtccttctggggccttgcctttgggcccacaccccccctgccggcggccctccccgtcgcgatcctggaccgtgggcacgtcctggcgtcgtcctttcgtgtccgcctgccctccttcggcgtcccccccgcagtccagaaggggatcaccgtcgtgtatgcggggggtaacgaggggccaaggccacagacggtcaggaacggtgcgccgtgggctatcaccgttgcggcaagcaagattgatcggtcgttcccgacgatgatcatgctgggaaacaaacaagagatagtgggacagtctctctattaccgagggaagaattcgtcaatgagcagcagtggtttcaaaggtcttgtggttccagtgagttgtgacatggatattctcaatggcacggacgtgaaagggaagatcctgttctgcaccatg

SEQ ID NO: 16813 - DNA, 789 bp, Triticum aestivum
  Clone ID: PAT_TA_16813
gcacgaggcctcgtgccgaatgccgcgcggcgacccgacctgcactgcctcaagaacagaacatgggaatccaaagagtttgcgtcgtccttgcgctgctttgtatatgcctgagagagggtggagctgtgacattcacgttcctgaaccggtgcacggggacggtgtggccgggcatcctgtccaacgccgggacggcgaggatcgagcccacgggcttcgcgctcccgcccggcgcggcgcgcgcgctgccgttcccgaccggctggtccggccggatgtgggcgcgcacgggctgcgcgcaggacgcggccgggcggttcgcgtgcgccacgggcgactgcggcaccggcacgctggagtgctccggccgggacggggcgacgcccgcgacgctggcggagttcacgctcgacggcggcgggcacaacgacttctacgacgtgagcctggtggacggctacaacctgccgatcctggtggagcccgcggggagcagcgccaccggcacgacgtgcgcggccgcgggctgctcggcggacctgaacctgcggtgccccgcggagctgccgttcggcgggcggcggcgcgtgcccggagcgcgtgcgacgcgttcggcaagcccgagtactgctgcagcggcgcgttcgccaaccccaacacctcccgccccaccgcctactcgcaggcgttcaagctggcgtgcccgcgctcctacagctacgccttcgacgaccccaccagcaccttcacctgcgccggcggccgcgactacaccatcaccttctg

SEQ ID NO: 16814 - DNA, 966 bp, Triticum aestivum
  unsure (1)..(966): unsure at all n locations
  Clone ID: PAT_TA_16814
ttcggccgagggcgtgctcgagctcggcgccaccgaggtcatcttccagaccaacgatagcttggggaggatccgctcgctcttcaacctcaacggcggaggagggggctctggatcctggccgcccgtcgcgccgccgccgcaggaggcggagacggatccgtccgtgctctggctcgccgacgcgccggccggggacatgaaggagtcgccgccgtccgtcgagatctccgtctccaagccgccgccgccacagccgccgcagatccatcacttcgagaacgggagcaccagcacgctcacggagaaccccagcctctccgtgcacgcgcagcagcctccgccccagcaggcggctgcggcggcgcagaggcagaaccagcaccagcagcagctccagcatcagcaccagctccagctccagcaccagcacaaccagggccctttccgccgggagctcaatttctcagatttcgcgtccaacgcatccgtcacggtgaccccgcctttcttcaagcccgagtctggtgagatcctaaactttggcgctgacagcaccagccggaggaacccttcgccggcgccccccgccgcgacggccagcctcaccaccgcgccggggagcctcttctcccagcacacggcgactgtgacggccccatcaaacgacgccaagaacaacccgaagcggtccatggaggccacctcccgcgcgagcaacaccaaccaccaccaagaccgccacagccaacgaggggatgctgtccttctccgtcggcgccgacgacgcggccgtccaccggcacgggcgcaccaaccaatccggatcccgacactcaaactggagcgtcgnccgccaagtgggaaacaaccgcntttgtgcctccgcccgagganaaacggccgcgcaagnccggcgcaaacccggcgaacggngccnaagagccctgaacaacttggaggngg

SEQ ID NO: 16815 - DNA, 641 bp, Triticum aestivum
  Clone ID: PAT_TA_16815
tcggcacgaggcacgcgcgcccggcacaagtcccacagccacactgcactggacacacggtcgcgcacgcggcgtcgcggagaggcgaggagcgagagggagagacgtgggcggcagcgatggtagaaggcggcagcggcgcgggggctacgtcgacctgccggcgcggcggcggcggcggcatcgtcggcccggcggcccagcggtgctgcggcggcgggtgcgggctcggacgcctggtgcgccggctgcgtcgccaggggaggcaggcgctgtgcgcggccaggccggcggcgtcgtcgtcgtcttcgtcggcggccggggcgctccgggggtgccagtacgacccgctgagctacgcgcgcaacttcgaccagagcggcttcggcgaccccgacccggacgcggacgcggccagcctctactacagctacaccttctcgtcccgcttcgtgctcgcgccaggcagcgccacctcgtcctcaaccgccgtcgcggccgtcgtccccgcgccgaacggcctcgtcgtcgccagccggccaacgccgccagccattagccgtcccgtcgcaaggagcttccctttctccccccgcggcttccttttccccctccgctggaatggaaaggcagcagcttgt

SEQ ID NO: 16816 - DNA, 773 bp, Triticum aestivum
  Clone ID: PAT_TA_16816
gcacgagggcgtcgagctaaacctactcgtcccgagcggccgagccctccaccgccgccgccgccgccgcccgccgcccgccgccccgccccccccccgccccgccggcctccgcccccccccccccgcccgccccctcccctctcacctccgcccgcccccccctcccccggcgcccccgccgcccccccgacgcaagcggcccgtcaccacgcacggggcgctcttcctcgcgctctcccttgcgggcctggccggttccctcgcctgcacaccctggctcctcaccaaccacgatgccggccacctgctccgtccgtctccggcagagggtactccacctagctccagcacgccgtgcgcttggaccgccagggtccgcctccggcccctccctcccccatcaacggagaggggcatcccgcgccccctccctcgagtccgccgacggccccgtcctccagcagcagccgctgcagatcaaggtacaggctgactactaccgccatgagaactcggtgacatccatcatcggcagatggcgtaacgcaatcccggcttggaatcaattatcacccttaattcagctccgtttgttattacctctggacttcaagtgttgcttgtgcagaatatgtaagctgtcaagtgtaatatttgtgctgcacaatctgtgtttggtactagtacatgttatgaagctctcaagtgttcatcaatttaagtattggtagtgcagaatatgtaagctgttattaagctggtgctatgtt

SEQ ID NO: 16817 - DNA, 911 bp, Triticum aestivum
  Clone ID: PAT_TA_16817
gaggctcggcacgtgcagctcgctcgtggcgaccatgggcgaccagttcccggagctcgccatgacgagcgccgactgccagtcgatgacctggctccagtccatagccttcatcagcttctggaacagggacacgccggtggaggcgctcctgagccggaccaccagcctgagcacgtacaccaagagcaagtccgactacgtccagagcgccatctccaagggcgtctggaaggacatcttctcctggttcacgatgaacggcgccgggctcgtcatcctggagccccacggcgggttcatggggagcgtccccaccgacgcgacgccgtacccgcaccggagcggcgtgctgtacaacgtccagtacatcgtgttctggcagggagacggcggcgcggcggcgaacacctggctcgggcaacttctacgacttcagggggccgtaccggagcaagaacccgaggcaggcgtacgtgaactaccgggacctggacatcggccagaacgtggtggtggacgacgtcaccaccttcgacggcggcaaggtttggggcgagcagtacttcgcgagcaacttccagaggctcgcgtcggtgaaggcggccgtggatcctacggactacttcagaaacgagcagagcatcccgccattggcccaaggacgtaagtgagcaaggttgtatctaagcggtcaaattaattaattcgatgcttccgtactaatgactattggttgtgaaaacggaagttaggatgcaccaagaaaacttgtacttctgccatttcatgcatgaaagcaacgggagcaatcgtaggatgcagcaaccaagattgtaattctgcctctcagttcattcatgaaagcacggtggtttacctgtcaatggactgggtcgacgcggccgcga

SEQ ID NO: 16818 - DNA, 737 bp, Triticum aestivum
  Clone ID: PAT_TA_16818
ttcggcacgaggcttactactcgctactctagtgattgttgttgtggttccgcatcgctcgccatgtcagcgccatcgcaactgagcaaggacccgcgcaacaattacttcgactttggggcggcgcggcaggtgcccgaaacgcacatgtgggaggggctgtacgagcacccggtggtggacggcggcgtccaagccggggaggacgccgtgccggtggtggacatgcaggacccgcgcgcggccgaggcggtggcgcgtgcgtcggagcagtggggcgtgttcctgctcgagggccacggcattccgagcgagctgctcgcgcgcgtcgaggccggaatcgctggcatgttcgcgttgccggcgtcggagaagatgcgcgccgagcggcaggacggcgagccctatggctatgggttgccgcacatcgcgtcctactcctccaaggccacgtggtccgagggctacaccttgtccccggccagcctccgtgccgagctacccagggtctggccagaccccggcgaggactaccgccacttctgtgagcgtgatggaggagttccacaggcagatgcgagcggtggctgacaagctgacggtgctgttcctcgcggcgctcgggctcgccgccgtcgaggcggagcgcaagatcgtggagaccatgaccgagaccgtgaccatgcacctcaactggtacccaaagtgccctgacccgaagcgagcgctgggcatga

SEQ ID NO: 16819 - DNA, 1348 bp, Triticum aestivum
  Clone ID: PAT_TA_16819
gaggagctcccctccccggcccgcacccctcggctctgctccgggccgccccattgagggctgcccgcccatggcggaagaacctccggtgaagaggaccaagacggaggaggaccttggtgcggggtcagagccagacgccgcggcggcggcggcggcggaacgggagaggccgggcggcgaggtgaccgtcaagatacagtccaaagctctccgctgccggatctgctccgagcccctcaagccgcccatcttcaagtgtgcggctgggcacgttttgtgttctcagtgcccggaaaagctccgtgaggttgggcacgttttgaggctgggtacattctgcgctctgtgttgcaaaagcactagctattcccgctgcgtcgagctcgagcagttcatcgacgccatgaaagtgccatgctcgaaccaaacatacggctgcaacgagttcgtcggctaccagcagaaagagaagcatgagagttcatgcccacatgctccatgctactgcccagaggatgactgcgccttcaaagcgccggcatgttgcctgctggaccacttcgtcaccgcgcacggatggtcgccgaccaacttgggttacaacaagccactgaagatcctcttggcacgagaccgccggttcacgcttctggttggggaggacatgtccttgttcctcctgatcaacaccctgaccagcatcggcagtgctctcgccgtggtctgcgtcaggccccacgagtctgaaccgagctattcgtgcaacatctctgctgctgctcatggtgtcgctggtgggaaaaccgatgggaggctcgtgttccagaaggatcctcacgtgtcaagcagctcgctggcgggtggagttcagatgggcaacttcttcctgctggttcctctggaattcgccgagacctcatctggtgaactcactgtacacatccgcatcgacagagtggcgccatagggatggatctcagctggaagctaccatatgctgtcaatgactgcatatggtgaaacagctagctagatgttgtccaatgctctttaatcaccatcagctggaggaactaaaatgtgtttgtagtggcagtagaatttatctttgcttagcttgttgtcttgttatgtatcttatgtaactcagttgtcccaatggaagatcagtatcttgcaactcaaaattgtactcatttgtcaagtttgactatgtattagctagtaagatggacgttaccatagctacaccttttgacatggggaatgggtttgccaatgccactgctgctttggaccctgggctcatctttgattgcagttacggggcctccctcttattggt

SEQ ID NO: 16820 - DNA, 1186 bp, Triticum aestivum
  Clone ID: PAT_TA_16820
gccgctccgggcttcatcccaccaccaccgagcagattaccagatccaacttggttttattgccatttcatttcggtaacctccctcccgggctcctcactcgccacccgcccccctccccctcgccccaccggaggtcatcgccccgtgcggaagccgaccgggtcgctcgctcgctgaccggatcacgggcgaccgaggatctaccggcggccatggcggcgtgcagcgcgtgggccgccgcggcccgcgcggccgggcccccgtccagcggcccctgccccccccagctccgccacgccctgccgccgccgctggggcgccccggcgcgcgccaccgggcccgcgcccccccccccctccccccgcgcgccggccggtccccccccctccgctgccccaaccagctctcgccgcaggtggagcaccgccccttcaccccccacgggcacgaccccctccgccgccccgacccacgggtagccaaccgctgaaccgccagcgcccgccttcccccccgccgtccgcatcgccccctcaagacgcactcgccatccccgcccacgagcaacgacggcccctcatccggaccagcagccacggcaaccccggccccggctgcagcccccggggcaaacgacgatgaggaccgccggccgctgaagcggaccgccagcgacgggtacccccggctctgcttcagccccggccgcacgtgtaccgcccgccgccgcgtccccgcgggggggccctcctccccccggcggcgccccagcccccgctgccgtcgcctccctctccgccgccgccccctcctcctccggcgacgtcgctctcgctctccctctccctgcccggcctggatgcgcccgagccagccccggtggcgcagcctatgtccatgccgccgccacctgctcctgtacagcccgccgcagcgcctcagatgccgccgccgccgcccatgccgttccagctccagccgccgccgcagccccagccacggacggcggcgcccttcaacggggagttcctgtcgatgatgcaggagatgatccggatcgaggtccggaactacatgtccggcttcgacccccggtcgcccgccgacggcgtccacgccgccaagcgcatgatgaagcatgggcaagattgagtagcaagcaagcaagaaagctggtcgagg

SEQ ID NO: 16821 - DNA, 751 bp, Triticum aestivum
  Clone ID: PAT_TA_16821
ctcgtgccgaattcggcacgaggttaccagttccgtccgtctcctcccatttattaaggcgagagcccctcgctcgctcgtccaggaaaggaggccaaagggagcgcgggcggttcgttcagatcccggtctcgccatgccgaggacaaggaggttgcgcggcggattccggctgggccgcaagctgctgaccgcgtggcggtgggcgctctgcggccggagccggcgccggggcggctacctccgcctcgacacgccgtgcccggtggagggcagggaggccaagaagctggcgccggtgctgcggtgggggcagtcgctggcgcggctcctcagcctcggccgtacggaccgcggccagcgaacgctcggcggcggcggcggcgacgaggcggtgaagacccccaaggggcaggtggcggtgtacgtcggcggtggcgggcccggggagccgctgcggtacgtggtgccggtggtgtacttcaaccaccccatgttcggggagctgctgagggaggcggaggaggcgttcggcttccagcaccccggcggtacctcctgccccccccccgccccccgctcccaccgcgccccccccgtggccgccgaagggaagaaggggttcgccaggtggtagcatcgggcccgtaggcgtaggagtcccccggccctagctggcctgatcgcctccgctgctgcgtgcggtggaggcgaatggtgacatggtgtacagtgcatgtgtgtttccatc

SEQ ID NO: 16822 - DNA, 592 bp, Triticum aestivum
  Clone ID: PAT_TA_16822
cggcacgcggcggctctgtgcgaccgtgaaaactcaccatggttgcctcactcgcaagttgatggtgaggagtgaagtgaagccttctctaatttggcggtgatgatcgcttcttccacaggctggtgcgcgacctcgggcaggagaaggagcatatgaggtgggtgatcgcgctctggctctggttcgaggccgatgggaacgacaagttcatgcgccgcgcggccgcgcttccgggccccgtcgtgctgcgcttcgtcgacgaggcgctggcgtgcctcgcccgcctcgccggccgcgtgctccccggcgccagcaccctcctcccctgcaccaacgcgctcctcaacaagcccatcgacgacgtcacctacttcgacgagcaccgcgacaacatcatgccccgcgtcaagttactgtacaagaccgtctgccgcgtcgtcctcgtccacgcctgccccgcccccgccgccgtcttccctccctggtgccccgccgcctccgcgccgcccgccgtcgccccgcccgtgcgcgcccccgccgtctccccgcccccccccccgccaacgacgccgaggttcgccgacctgaa

SEQ ID NO: 16823 - DNA, 511 bp, Triticum aestivum
  Clone ID: PAT_TA_16823
agcactgcccatccatgacctcccttgcgtgcctcccgagcgtggctgggacggagtcgcgcggataagcaggtccagacggcggcgcgcggctgagtgggtccagacggtggcgcgacgagcaggaccgggaggcagcgggaccagcaggacagggaggtagagtggcgcggcgggcgtcgggctggaagtttgggcgagcaagccactccagcgaagaagaaggacccgattgcttttccattttatgttttagggtcctttgtgtaaattagggtcctttgtgtaaatttgaaggactattctctaactttagttctctggcggtcctatttacactttgtactcactaatgatgaatgaaaggcagttggtaaaaaaaaaaaaaaaaaaaaaaaaaaaaaaaaaaaaaaaaaagagaaaaaaaaaaaagagaaaaaaaagaaaaaaaaaaaaagaaaggaaaagaagaaggagaaaaaaaaaaaaaaaaggggccgcccaaaaggtt

SEQ ID NO: 16824 - DNA, 435 bp, Triticum aestivum
  Clone ID: PAT_TA_16824
gctgcacgcctgcggtccgtccggaattccggtcaccgcggcgggcgcacgcgtccgcccacgcgtaagatcgagcgagccaacaactcgcagccaccacaatttcgaaatacctcctgcctgcctgcaagaaacgagcgccgagaaagaaatggaggcggcggtcggcggcagctggacacgcgtccgcacgctcggccgcggcgcgtccggcgccgtggtgtccctcgccgccgacgacctctcgggcgcgctcttcgccgtcaagtcggcgcccgcggccgccgcggaccagctccggcgcgagggcgacatcctgtccggcctcagctcgccgcacgtcctgccctgcctcggcttccgcgccgctgccgtcgagtgtccactcttcctcgagttcgcgcccggaggctcggtcgccgacgtcgccgcgag

SEQ ID NO: 16825 - DNA, 890 bp, Triticum aestivum
  Clone ID: PAT_TA_16825
tacaagggaaaccaatcgagcgagcaaactactcgcagccaccacaaattcgaaacacctcctgcctcttgcctgcctgcaggaaccgagaaaagaaatggaggcggcggtcggcggcagctggacacgcgtccgcacgctcggccgcggcgcgtccggcgccgtggtgtccctcgccgccgacgacctcttgggcgcgctcttcgccgtcaagtcggcgcccgctgccgccgcggaccagctccggcgcgagggcgacatcctgtccggcctcagctcgccgcacgtcttgccctgcctcggcttccgcgccgccgccggcgagtgccagctcttcctcgagttcgcgccgggcggctccgtcgccgacgtcgccgagaggtgcggcggccggctcgaggagggcgctgtccgggcgtacgccgccgatgtggctagaggcctggcgtacctccacgggaggtccctcgtccacggggacgtgaaggcgagaaacgtcgtggtcggcgccgacggccgagcgaagatcgcggacttcgtgtgtgcgagggcggtgggttcttccgatcggcccatcgggggcacgccggcgttcatggcgccggaggtggcacggggcgaggagcagggccccgcggccgacgtctgggcgctgggctgcaccgtcgtcgagatggccaccggccgcgccccgtggagcgacatggacgacgtcctcaccgcgatgcaccggatcggctacacggacgccgtgccggaggtgccggcgtggctgtccgcggaggcgaagcacttcctcgccctgtgcttcgcgagagacgcccgcgaccggtgcacggcggcgcagctgctcgccgacccgtccctggcatcggccggttgcggcgtga

SEQ ID NO: 16826 - DNA, 797 bp, Triticum aestivum
  Clone ID: PAT_TA_16826
tgcgatcttcatcgatcttcttcttcggctgcgatctttctgttggtcattcgagatgacggtggccgtgtgccatgtcatgccggcgctggacgtccctcctcctcacactcgcctgccggcgccgatgccaccgccgcagcagctggacggctcgagcgccatccaggccccggccgacaacgactgcgccaccaagcccgagccgccggcggtgaaggccaaggccgcctgcccgatggcgacggtgcggcggtccatgagccacgagagccccagcctctgcaccgagagcctcggctgcgagaccggcacccgcggcgacttcctcgacctggcatcccggctctacgcgccgcccccgccccacacaaccgacgatgccgtcgccgccgacttcttctctccgccggcattggaagaccaagaggaggagaaggatgaggcagcgggcgagctgacactgaaggcggtgcagtaccaccgcgcccggccgcagcgcgcgttcccgccgccgctgccgtccatgtcgcgccggcgcggcgacgatgctgggccgtgcctgcgggtgcgcccgcaccgccgcgacgggcgcctcgtgctggaggccgtggccgcaaagccccaggggtacctccacgcccagcgccaggacggccgcctcaagctctgcttcgtcgactgctcctctgcctcggcctctgttctggaccatcagaagcagagcatggtggaacagccacagcatgaacaccagaagcagagcatggtgcaacagtctcagcatgacgtggaag

SEQ ID NO: 16827 - DNA, 1304 bp, Triticum aestivum
  unsure (1)..(1304): unsure at all n locations
  Clone ID: PAT_TA_16827
gggcccccccgcacgtactcccgcacgcggccgcaacactcccactgccccagccgaacacagtcccaatctcgacacccaaagggagcacaccaacgcgagtaggccggattgagcccatcccctccgccatggtcaacggcccgccgcccatgatggcactgacgccccccaatttcccatgctaacgcgtgcgaggcggcgccattggatcgatggcgcgcgtgcgccctaatggtagggcggcgtgcaggaggtcccccttctcctctctccccctgcgcgcgctggagcttgagctgggcgggacgctgagcgggagttcttgctggcagaggaagaagacgttcaggtagaaggcgtggacgttggggagtagctgtgtgggaggagggcgtcaacggtgggatgggtgctggctggctggtactcgtgaacatggtgaaaagggatcggtgctgcagcggtaggcgtctggtggctatgcagtggcagccgctacttagatacgtagccggcaatggtgagaagactttgatcttgatatattagatgtaagccccatacaccataggaggaccgccttttggtgatatcagccggatgataaaaaagaagaagaagatgattcagttatcaagaggatgtctgaactctgaacctgaaggacaggaaataaaacatgaggaggataatggaagagaagaagaagcagacattaagataatgaaagagaatgagtagataatgaggatggtactgaaagagaagacgagatgcaccttggctaagtaaagagttagacctgaaattgccaataaagggaatgaggtccctttctctatagaatatagaaggcagcttcgcagaggggtcactgacgagcaagagaaataagccctggagcatgtttcaatgaagactactgatctagaattgccgtatgttcatgaacaattttttgttgctgaaataagtcctagagcaggcttcggtgaggactactgatctagaagccatatgttcatgaacaattttttgttgctctgactgaacggactgtctctgtaattcttgtctgtttgggtggtccccagctgcgacaagatgtcttcttgctgaacaacgccacaattggatagttgtatgttatttaggattgcctctgttgcataccacctggagttacaagaggtcctgtactaattttgtgtatgtatctgttctatatacacatgatttcaaagcatcttttcctatacattttgtttctttgctcggtaaaaaaannnnnnnnnnannna

SEQ ID NO: 16828 - DNA, 645 bp, Triticum aestivum
  Clone ID: PAT_TA_16828
ggtggggaaagaagaaccggtagagaagaagaggatgacgacgacggagacggcgacggcgagggagccgcgcgaggcgtcccggcgggagggccgcgactcgcacgggaggcgcccgcactcctcgtccaggtcgcgccgggacgaccccagcccgaggaggcggagagacgacatgaggcatgagtccgacaggagccagcacaggcgtcgggccgaggagggcgccgatgatgcgggcgaccgtgatgaggggaggaacaggcacctgcaagacgttaaggcgcggagcgatggtcctgatccggggcgcggggaggggaagccgccgccgggcgacgcgaaggaggaccctcccgcgaggcacgagaggtctcccaggggaaccaagcggttctccgagacgagggaggcctggcggcctagatcttcgttctttcagcatgatgagcgtgaacgtgctgggcaaggtggtcgacactatggtcgccaagattatggaagacaaagggatcaaaatgagcatctcaatgatagagatagacacaagtctgagggacatggtttgcaggaaaaggttgggcaggctcaccaacagagtgatgttgattctacatgggagcacgatgggtttttcaagttgca

SEQ ID NO: 16829 - DNA, 1194 bp, Triticum aestivum
  Clone ID: PAT_TA_16829
agctcctggcctgcctgctggcgaaacaggttggatggtcacgcttcagcccaaccactgacggttataactcgcaacatccgcagcctcgggccggccggggcgggatatacaacaatcctaagaaaccaacactttcatcaaacaactatatccaacatgccttcttacatcattacttgcaaggacgacgcgtccgacgagcaggtccagtctgccaagcagcacgccaaggaccagggcggcaagatcacacacgagtacagcctcatcaagggctttgccgtcgagttccccgaggatagcatccaaactctcgagagccacgagcatattaagactgtcgaggccgacggcgagatgaggactcagtagatttcaggaatgcgttagaagagatgggcgacatccaatagattatctcgagctctgttgcactggcgttctggaatataattattattaaactgcccaaaaaaaaaaaaaaaaaaaccaaccgaccaagtcaatttttcgagatacctcatttccccgtctcgacttgagaatctcctcaaaacaccgcaaaaatggtccgcacttcagttctccacgatgcgcttaacgccatgaacaacgccgagaaggctggcaagcgtcaggtcttgatccgaccttcttccaaggtcatcatcaagttcctcactgtcatgcagcgacacggttacattggagagttcgaggagattgatgaccaccgatccggcaagatcgttgtccagctcaacggccgcctcaacaaggtcggcgtcatctctccccgctacaacgtccgtctcgccgagctcgagaagtgggttgtcaagctgctccctgctcgtcagttcggctacgtcatcctcaccacctctgccggtatcatggaccacgaggaggcccgccgcaagcacgtctccggcaagatcattggcttcttctactaaaacgggacgggaaaccaatcaaaaaagtgatttgaaaagaaacaggcattctcggcgttaagggaggaggatgatgactaggaccgatgcgattacatagccaagtcgcttgtcgcatacgcgagcataccaattgaaccttgacgagatgctcaaaaaaaaaaaaaaaaaaaaaaaaaaaaaaaaaaaaaaaaaaaaaccgaaaaaaaaaaaaaaaaaaggcccctggaaa

SEQ ID NO: 16830 - DNA, 671 bp, Triticum aestivum
  Clone ID: PAT_TA_16830
tttttttttttttttttttcattctaatttgtttgcacaccaaaatcgaaacatggatacagtacacggataactgattcagaaaagtggttcggaaaattttggatacattacacggataactgattcagaaaagtttggatacagtactgaattatattaacaatcaaaatccatcccttgtgaattaggcagtcattaccgttccatggatcataaaaagcattggtgacccgtgcctgcgcatcgtccagcaccccaacaactagccataaactgaacgcaaaccctttctagaagaagccaggttttacacaaaaatcagtctgctccttgcccttgacaaggggctagaagatgtctccgtgcacatgtaggcgggttcgtcgtcgccaccacaacatgtggagttttagcaagcatcgtcggtgactggtgcatccacccgctgcttgcgaaggctgagaggaggcggcagcggcgctagtggagatcgtcccgggggagcagagtcgcaggggtaaaaacattcagtggaaagaacctgcctgcgaccgcgtttccgtgtgggcgcgcccctcgccggccccccctcccccaccggggtcgccctttgcgtggtcccccgggctgccacaggctggcccgcgcgggccctcggcgcccgcgcg

SEQ ID NO: 16831 - DNA, 592 bp, Triticum aestivum
  unsure (1)..(592): unsure at all n locations
  Clone ID: PAT_TA_16831
ggctcccctgccgctgcctaatttcctcctcttccacaccaggctccgctcaaccgaacgactccgatggagtcgctgctggcggcgctcgccgcgagcagtggaggcacggtcgctgccgcagccgttggcgggctggccgcggctgccgcgctcgctgtacaggccggcaacggcgggacgggccccaaggaccgcaccaacgcgcccccagttgttcctggtttaccactgattggaaatctgcaccaattgaaagaaaagaaacctcacaagaccttttcaaaatggtctgagacttatggtccgatatacactataaagaccggggcttcgtcagtagctgtgctcaacacaagagaggtggctaaggaggcaatggttgcaaaatactcatcgatatctactcgaaagctacctaaatctttagatgtgttgggtcgcgataaagcgatggttgctatgagtgactatggcgacttctacaaaaaanggtgaagcgtttggttatggcgggcatgttgggttcttccactcagaaacaatttcgggagacaagagacctgatgatggataacatgctgagcagttt

SEQ ID NO: 16832 - DNA, 1202 bp, Triticum aestivum
  Clone ID: PAT_TA_16832
tcggccgggggccgcgccgcctcaggctgccgctccccgtttggcgcgtgagcgagcgagcagggaagtctttctctgctgtccccggcggcgtggggtgcctggtctttggttgtgctagctaactcgttagagcctagatgccgccggccgccgcgccgtggtcgtgggcgtgctgcggccgcaggaggaagagcgccgggggcggcgcgggggacggcgacggcgccggcgcgtcggggcgggacggtgaccagtggacgctcttcatcgacctgcccgtgctggaggccgccaccgccggcttctccgacggcaacctcctcggccgcggcggcttcggccccgtctacaagggcgtgatggagggcgggcaggagatcgcggtgaagcggctgtcgctggagtcgcggcaggggggtgcgggagttcctcaacgagggtgcggctgctgctcaaggtgcagcaccgcaacctggtctccctcctcggctgctgcgccgccgccggccaaaagatgctcgtctacccatacttccccaacggcagcctcgaccacatcctcttcgcccaggcagccccgatgcgccgctctccagcctgcccttgcactccatcgcacgctcttagacaggggggaagtgggtgcagccaggctggccaaaacggtaccaaatcatcctcggactagcgaggggcctcctgtacctccacgaagagtctccggtgaagatcatccacagagacatcaaggcgagcaacgtgctcctcgacgagaagctgaacccgaagatctcggatttcggcatggcgaggctcttcctcgaagacgccacgcacgtgaacacattcaggatctctggcacgtatggttatatggctccagagtacgcgatgaacgggtacctgtcgaccaagaccgacgttttcagcttcgggatgctcgtgctggagatcgtcagcgggaggaagaacatcgaccggcatctcggcgacgaaaaagtcgacctgttgaattacacatggaaactgtcagaggaagggcggtcactggagatcgtggacccgggcctgtccgggtgggacgccggcgaggtggcgatgtgcgtccagctcgggctgctgtgctgccaggccgtcgtgtcggaccggccggacatgtacagcgtgcacctcatgctgtccagcgactccttcacgct

SEQ ID NO: 16833 - DNA, 3004 bp, Triticum aestivum
  Clone ID: PAT_TA_16833
gcccaccgttctctgcatccactcggccgcagccgtcttcgggcgccgatgcgcctccgccgcgacgaagaactcgtacgatgaaatcctcacgggcctcgcctagccgggagggggagcagacgtcgaccagtaggtaagtctccccgccgccaccttttcgcggcttgaataaaccccagaggaagttttgcaacaataggataagaaattacatccttcggataagtgcatttggactacataattcgaggtttgacagctggtacaaggcactgaattagtagggaaatgtttgtgtgaaatcggactgatggcttttaactttcggactgctggaacagaacaaatgttgaatctcccagatgctgggcgttgcaggcaccgtgtcttcttcacaggaatggtggaagttcaaccgatcggcgagggaatctcggccgcgcgtccttcccttcgaatagcttcctcaagctcctatactggtccgggggccagttgggcgttacaggcgctccgaaacaaagagtgatgtcggccccccacgtcggggtcgacttcgcccaccaccgtgcttggtggcccacgtggatctggaacggttggttagatctgtgtagaatatttgcccgggggtgcctgcagctgaagaggaagccctgacggtgacagttaggcggcgctgcctggacggacaactatgagatctggtgcaggatgtggcagtagaagtttgggttctggcacacgtaccccgatgccgaacccgaatcttcatctgcaggtcactcacaggggtgtacagagggtggttgcagtagtaggcaatgtaggctccaaaggtccagtagtaggcgcagttcctgaagacgtttgacacgggggaagttgcgtggctgaagcggtggacgaagaaggtctccatgatcctcttgaagtagtggaagcagaagtagtacatggcgtaggtctggacagggtggatgacccgctctccctcatatccaaagtatttgtagacaggcaggtaatagaagatggggtagatgataagagggccgacgtattcccagaagaagagcgtgctgtagtagacctgcgggcctaaatctttgaagaccactgtcagggacccggaacccttctcgcagtattccgataggctggccttttgattgaggacaactggctttccagattttccaggttgtgcagggagggtgagccgttgcctggcaggataatacttcttagtcttggcgtggatggcctcctgcagatccgcgaccttggccgagtccttgagctcgatgccgcccttgacgacctcgcggccgctccgggacacgacggagaccttcatgctccctccgccggtgctccgggggtgagcaaagggaggggggcctagggccttgccggtgaacccatggtattaagacaagtcttgcgccaggttctggtgttgtgaagaagtacttggacaagagcggtctgcagaagtatcttaaccagcttggcttcaatattgttggctatgggtgtacaacctgcataggaaactctggagatcttgatgaatccgtagctgctgcaattactgacaatgatgttgtcgctgctgctgtgttgtctgggaacaggaatttcgaaggccgtgtacacgcattgacccgagcaaattatctcgcatctcctccattggttgtggcctatgccctcgctggcacggttaatattgattttgagaaagaaccagtaggcatctcaaaggatgggaaggaggtttacttcagggatatttggcctaccactgatgagattgctgaggttgttaaggcgagtgtgctcccagacatgttcaagggcacatatgaggcaatcaccaaaggaaatcctatgtggaatgagctgccagtatcagcaagcactctctacccatgggatccaaaatcaacatacatccatgagcctccttatttcaaggatatgacaatgacccctcctggcgcacggcctgtgaaggatgcgtattgtcttcttaacttcggtgacagtatcacaactgatcacatatccccagctggaagcatccacccagacagcccagctgccaaatatctaaaggagcgcaatgttgaaaggaaggacttcaactcatatggcagccgacgagggaacgatgagatcatggctaggggaacttttgccaacattcgtattgtgaacaagttcttgaagggagaggttggcccccaaaccatccatgtaccatcaggggagaagcttgctgtttttgatgctgctatgaaatacaagaacgaagggcatgacactatcatcctggctggtgctgagtatggcagtggaagctcaagggattgggctgcgaagggtccaatgcttcagggagtgaaggctgtgatagccaagagttttgagaggattcaccgtagcaatctcgctggaatgggcatcgtccctctatgcttcaaggctggggaggatgccgacactcttggcttaacaggccatgagcgctacaccatccagcttccgactgatgtgaatgaaatcaagcctggccaagatgttacggtcacaaccgacaacggcaagtcgttcacctgcacactccgctttgacactgaggtggagcttgcttactacacccatggtggtattctaccatatgtcatccgaaagatcgcagccgagcaatagagagatgattgcgacgacgaggcaaattgtaattgttgtaaacagtttgtttagcaagtcctgtttgaggagtaccccctcaaataacatctgagatgtctgcagagaactcggaaattttgagcgcgtaacacgctaggtttttgtttgaaggcactatgttaataatatgcctcacaactgatgagatgcttttgcatattgtaacggtctatgaacactgaggtggaatcagccgaaggaatgtccacattgttttcttaaaaaaaaaaaaaaaaaa

SEQ ID NO: 16834 - DNA, 772 bp, Triticum aestivum
  unsure (1)..(772): unsure at all n locations
  Clone ID: PAT_TA_16834
cgtgggtcgnacgcgtggggccgcccgtgtccgggggtcctacaacgcacgaacacacacaaacccaacaagcacatagtaacatcgaccgatcggcatggcgcacttccaggaggtggactactgctcggaggaggtgagggcggtgggcaacccggcccgccgcggcggcggcgtgcaggagcacatcgtcaaggagacgttcgtgcaggagttcgacacctccggccgccgccacggtcaccacggtcaccacggccgcggctctggtcacttcgaggtgcgcgagagcaggctcgaggaggacttcaacacccgcaccggcgagttccacgagcgcaaggagaacttcgtcgtcagggccgatgactgagcttacacgtaacggagcacactacgatgtgtgtatatgtatgcatgtcagcagtatatgtatgtgtgatgttgcgcacagtcgtatagcgtatgcaggcgtgcgtgcttggcggccatcagcccctatcgcgcgcgcgtgcagcgcttaaataagcgctaatcgtgaaccagaataaagcttctcgtgattagtagtaaaaaaaaaaaaaaaaaaaaaatcctagtcattatcactcaaaaagccccacgggacctcggtcgtaccaacccgccctncagaaaccccttccaactggggtatacaaaagccnacgttcctccaactaggagttagaacctgtcaatgatggcaacagatcacaaggggctgataccgagctagtattaaccgtagcat

SEQ ID NO: 16835 - DNA, 790 bp, Triticum aestivum
  Clone ID: PAT_TA_16835
tcggcacgagggatgtctccccgccgccggagcacctctccgccgccgcccgcctctctcccagacgacatgctcggggagatcctcctccgcctcccgccgcggccgtcctccctcccccgggcctccctcgtctccaagcgctggtacagcctcgtcgccgatccccaattccaacgccgcttccgcgaccaccacggcaagccccctctccttggcttcttcctccaggaatctccgtcctctgcgtttgttccaatactggatcgaccagatcgcatcccccgcggtcgcttctccatgcctctcagcgagggtacccacatcgtcgactgccgccacggacttgtcctttcgctcagccgaagcccgccgcaccgcctacttgtgtgggaccccgtcgcccgcgagcagcgccggctcgtctttccgccagagctggacaacgaccagatgctccgctcacaacggcgcggtgcttcgccctgcccgcagccaagggagccatttccaggtggccctgatagctcattataaagttggtaatccttgtacaagagttttcgcatgcctttactcatcggagaccgggatatggagcaaaatcaactcactgcagctgcaatcgtctatatctctgttaggaccaggacccagtactttgattgggaattccctttgctggttactttgggagccttctgacaattatgtcatacttgagtttgatctggatacgcagagcctaactgagacagagctgccaccacaagtagaagctccccttttg

SEQ ID NO: 16836 - DNA, 1237 bp, Triticum aestivum
  unsure (1)..(1237): unsure at all n locations
  Clone ID: PAT_TA_16836
ctttgcaatgactaaaatgtggctagtgntatttgagaagaacaacctgccaagtgcaatcttcacagctttttgtgggggtgctgaaattggccaagcaattgctcttgacacaaggatacctttggtttcattcacaggaagtacaaaggttggtcaaatggttcagcaacaggttagcgcgagatttggcaaatgccttcttgaacttagtgggaacaatgccattattgtcatggatgatgcagacattccactagctgtgcgttctgttttgtttgctgctgttggcacagcaggacaacgatgcactacatgtcgtaggctgcttcttcatgaaagcatatatcaaacatttcttgatcaacttgttgaggtttataaacaagtccgtattggggatcctatggaaaagggcaccttgctgggaccactgcacactactgcatcgaaagaaagctttttgaaaggcatccaaaatatcagatcccagggaggaaaaatccttctagggggatctgctattgaatcagaagggaactttgttcaaccaacaattgtggaaatctcacctgctgcgccagttgtgagggaagaattgtttggtcctgtcctttatgccatgaaatttcagactctgaaggaagcaattgaaatcaacaattctgttcctcaaggattgagcagttctatatttacaaggaaaccagatgctattttcaagtggatcgggcctcatggtagtgattgtggtatagtgaatgtaaatatacccactaatggtgctgaaattggcggagcttttggtggagaaaaagcaaccggtggtggacgagaagcaggaagtgattcctggaagcagtacatgaggagggccacttgtacaatcaactatggaagcgagctgcctctagcacaggggataaacttcggctagtttggtgctgaaggactgccagtgaaacgtcgtgctgcagcttggggataaggtgttgccgtgttgagatatctgcagagtgcagccatcatctacaggaaattctctatgtgtcgatcattgcacccaaattgcgacgctgctgctgagtacatataataagagatgtgttgatctcatgtatgcattgttcatgccttttggcatgtttagccatctgtgcctggacctagtctattaataaactggaaaaatagcatatcttccagtgagaataaaaaaaaaaaaaaaaagccccta

SEQ ID NO: 16837 - DNA, 880 bp, Triticum aestivum
  Clone ID: PAT_TA_16837
cccacgcgtccgaatccttttagggggatctgctattgaatcagaagggaactttgttcagccacaattgtggaaatttcacctgatgcgccagttgtgagggaagaattgtttggtcctgtcctttatgccatgaaatttctgacactgaaggaagcaattgaaatcaacaattctgttcctcaaggattgagcagttctatatttacaaggaaaccggatgctattttcaagtggattgggcctcatggcagtgattgtggtatagtgaatgtaaacatacccactaatggtgctgaaattggtggagcttttggtggagaaaaagcaaccggtggtgggcgagaagctggaagtgattcttggaagcagtacatgaggagggccacttgtacaatcaactatggaagcgagctgcctctagcacagggaattaactttggctagtttggtgctgaaggactgccagtgaaacgtcgtgctgcagcatggggattggggataatgtgttgagatatctggagcgtgcagccatcatcttcaggaaattctctgtgtcgatcattgcacccaaattgcgacgctgctgctgagtacatataataagagatgtgttgatctcatgtatgcattgttcatgccttttggcatgtttagccatctgtgccctggacctagtctattaataaactggaaaaatagcatatcttccggtgagagtaacattttacgcatgctaccttgagatcggactgctcgaaataaaaggagatcgtagccttcaggccgttgtgcaaaacgttaagatcttgatgaatgtccgtcaatctatacctttctcggccttttggctaagatcaagtgtagtatctgtttccct

SEQ ID NO: 16838 - DNA, 2929 bp, Triticum aestivum
  Clone ID: PAT_TA_16838
ggtttcctttcgtctcgtcccgttccgccgtcccgtgccggaccgccccacccaccacactccctcccggagcagttcacagtctccactccacctcccacctataaatctcctcatcgccgccgttcctcgtcccgtcctcactcctcctccccttccgcaatcccctcgcttcgcacggcgaagcagccagagccagagcccgccttccagaaccaacccgcccaccatggcgagcttcgcgaggcaggagcaccagttcctcgccgagctcggcctcgcgccgcgcaacccgggctccttcgcctgcggcgcctggggcggctcgggccccgtcgtcaccaccaccaaccctagcaacaacgaggtcattgctgaggtcgttgaggcgtccatggacgactacgagaagggcatgagcgcctgcttcgacgccgccaagacctggatggctgttccggcaccaaagcgaggagaaattgttaggcagattggtgatgcactgagagcaaagcttcatcaccttggcagacttctctcactcgagatggggaaaattctccctgaaggaattggggaggttcaggaaattattgacatgtgtgattatgctgtggggctaagtcgtcagctaaatggatccatcataccatctgaacgcccaaaccatatgatgatggaggtctggaatcccgaacagacccccctcactcccccccttccacaatcccctcgcttcgcacggcgaagcagccagagccagagcccgccttccagaaccagcccgcccgccatggcgcgcttcccgagcctcgagcagcggatgcacccagagctcggccccgccctccgcaatcaacccgcccgcgctggcggcgcccgcgagggaggaggacccggcttcacgccgaccatcgccctcgccccccgggacacggctgccgtcgccgaggccgccttgggcggcctacgagcccggcatgaaccgcctccaaccgtaggcgacaagagcggtcagttgcttcgggcacctaaaggggcagccatggtacgactacgaggaaggggcattgagcgcatgcttcgacgccctccgcagacatctgaaagtcctagacgggaatcctgaaaacggaaggaataacgttggttcaagggaagattggcatgatggattttgacgagggcaaaactttcttgaaagttggttacgactaacttatcacttggaaaaattggtgaggaaagattccctgatgctgttgtagggggtgggttttctgacattattgaaatgtcctgtatttatgccgtgggggcaaagttctcacctaaaaaggatccggcaaagcttatgaacgcattgacccatgtgattatggctgtgcgggtatccccttggagttagttggtgtcatcacagcattcaatttcccttgcgccgtgctcggttggaatgcttgcattgctttggtctgcggcaactgtgttgtctggaagggtgctccaactactccattgatcactattgcaatgactaaaatagtggctagtgtatttgagaagaacaacttgccaagtgcaatcttcacagctttttgtgggggtgctgaaattggccaagcaattgctcttgacacaaggatacctttggtttcattcacaggaagtacaaaggttggtcaaatggttcagcaacaggttagcgcgagatttggtaaatgccttcttgaacttagtgggaacaatgccattattgtcatggatgatgcagacattccactagctgtgcgctctgttttgtttgctgctgttggcacagcaggacaacgatgcactacatgtggtatgctgcctcttcatgacagcgtatgacaaacatttcttgaatgacgtggtctggtttttcaacaaggcctttatgaagcctctattgatcaacttgtcgaggtttgtaccaatgtccacaactgcattcatatggaaagtccttcatggctgggaaccactgccaattacggaagcgattgaaaaccattattctgtgcatcaaggattgaacagttcaaggtttacaaggaatccggatgcgattttcaagtgtatcaggcttcacggccgtttttgaggtaaagggaatgtgatcagatcccctaccggttatgaaattggaagtgtttgtgccggtgaaagagaagcaggttgtgaatcaacaagttgtatgcgtttaatggaaaaccgtttctgatgatggcaaggaatccaaatatttattgaaagtggatcgggcttcctcagggagattgtgctagatagaatttaatgatacacagtaatggtacttagatacgtcgagcttcagggagtagggaaagcggccggtgttggacggagaaacgggaagtgattcctaggcagcagtacatgaggagattcactggttcaatcaactatggccgagatttgcctgttgcagagggattcatctatgactagtttggtgctgaaggaatgtctgtgatattcatggctttatctttgggaaaaggtgtttccctgttgagatgtctacagagtgccgccgtcatatacaggaaattctcgatgagtcgatcattgtacgcaaattgcctcgctgtcgcagagttcatataaaaagagagatgctgcttctcgagtacatataataaagagatgtgttgatctcatgtatgcattgttcatgccttttggcatgtttagccatctgtgcctggacctagtctattaataaactggaaaaatagcatatcttccagtgagagtaacattttccgcgtgctaccttgagatcggactgctcgaaataaaaggagaccgtagccttcaggtcgttgtgcatcacgcaaacccccggttgtctctcctgaattcaaaaaaaaaaaaaaaa

SEQ ID NO: 16839 - DNA, 648 bp, Triticum aestivum
  Clone ID: PAT_TA_16839
gaggcttcctcctcctctctctcttcctcatccccttttttctgtttcatcccgatcctgaatacctcgccgccgtttgtacctcctgacgagctcttatccatggcgaggggagggggcgggtgtgatgttttgttgggcgacggtagggcgcgcactgcgagcagatggcgggggtggtggtccaaaggcactggacgacggcgcatcacgagcacgagtggcggcacggccggcaactgcaagctatgtggccgccggcgtggattggctcggcggtgctgcaaccgcagttccgcagagctgcaaccgtggtcggagaaagctggaaccacggtctagcggagctgcaaggttcctacatgctggtgagggggtgctacaaccatggatgagaaaagctggaagcgttgtccggcggagctacaaccagatccggtggagctgcgagtttttttgtaggacaacagatgcaagccgacgagccggaggcaatgacgtagatcagggggatgctgcaaccatggcgaatcgtgagctggaattaaccgggggaggggattagagctgcaatctgtcggtgaccgcgcgctaggggatccactggcggctgttatgcaatccccaagagcggccccggcgagcgcg

SEQ ID NO: 16840 - DNA, 1050 bp, Triticum aestivum
  Clone ID: PAT_TA_16840
cgcaagcgtgcccaggtgtaccacccgggcacgcacgcacgcacgcacgcatcactctcctctcaggagcaacggcggccgtgcctgccacgcgcgcgcgagcatacacatgggagaggtcgcctccaccgcagcggcggcgtcgctctcgtcgtcgtcctcgctgctgatggctgcgacggccgtcaagggggacgaggagcggtacgtcatggtggcgtcgaggttcttccgggtgaagccgggcgctgctgcccgccaccacttcctcgactcgtgcttcctctgcaagaggagcatctcccgccaccgcgacatcttcatgtacaagggtgacgcggcgttctgcggcgaggagtgcaggcaggaccagatggccatggacgaggcgctccacgcggcggcgcgccggcaccgcacagcaggccgcggccgagcaggctgccggcaccgcgcgccgcgaggcggcgggcgcgacgacggcgtcgatggtgcaccgcggccatggacgagccgctctaggcgcggtggcgcgggcacccgtggccggccgcggccgagcaggccgccggcaccgcgcgccgcgaggcggcgggcgcgacgacggcgtcgatgatgcaccgccggccgaccatcgccaacctcggcgcggtggcgcgcactcccgtggccgccagctagctccgtaggctcgtcggcgcgcgcgtgcacgtatcggctgcgcatgcaccatggatcgatcttccttggctatagatcgctaggtgggctaaaaaacgaactggatgtcataacagcggttccgtccgaatgctagcaaccagcaagaggggagagatgtatagtttaagagtcatggttcccaaaatgtttccctgcgtgttattccgcggtatcctaatgtggggcctccgctccacactgctctagctggagttcatcgatcaagcttagctttcgagtcttcttcgggacacgttaatctgagcgtgtgttcttcttctccaatgatatgataccctgctcaaaaaaaagtcgacgcggccgcga

SEQ ID NO: 16841 - DNA, 614 bp, Triticum aestivum
  Clone ID: PAT_TA_16841
ggccggcggcggttcgggaaatcaaatcaacacctcttctactcagacattcacatcagactcctggcccaaggaaaactctcccaagttcatcatctacattctacaacatgcagttctcaactatcgttcctctctttgttgccgccatgggcgtcgtagctacccccgtcaactctccagctcaagagcttgatgccagaggcaacctattccctcgtctggaatactggggaaaatgcaccaaggccgagaaccgatgcaagtacaagaacgacaaggtgtaccaaggatggtaacagctgcaagtgggacagtgcttcaaaagcgctcacctgctactaaactcctcatgacaatccaagactcctgaatgtctttatgccccactgtggttgcagcaagcgaggggtctctcatatctctcaaggccaacttgattgcgcagagtttgggctagggcatatcatgtttctggagatcgagtggaagaaaggttcgggttggaatgaagttgaattgagacactcatttgtatctagctagatattttactgatcagaatgcggattgtaacgtctcttgtaaaaaaaaaaaaaaaaaaaaggccccta

SEQ ID NO: 16842 - DNA, 694 bp, Triticum aestivum
  Clone ID: PAT_TA_16842
ggcccgcgccgcggccccttcgagggccggccgcggaaagggaaatcaaatcaacacctcttctactcagacattcacatcagactcctggcccaaggaaaactctcccaagttcatcatctacattctacaacatgcagttctcaactatcgttcctctctttgttgccgccatgggcgtcgtagctacccccgtcaactctccagctcaagagcttgatgccagaggcaacctattccctcgtctggaatactggggaaaatgcaccaaggccgagaaccgatgcaagtacaagaacgacaagggtaaagacgttcttcagaattgccccaagtttgacaacaaaaatgtaccaaggatggtaacagctgcaagtgggacagtgcttcaaaagcgctcacctgctactaaactcctcatgacaatccaagactcctgaatgtctttatgccccactgtggttgcagcaagcgaggggtctctcatatctctcaaggccaacttgattgcgcagagtttgggctagggcatatcatgtttctggagatcgagtggaagaaaggttcgggttggaatgaagttgaattgagacactcatttgtatctagctagatattttactgatcagaatgcggattgtaacgtctcttgtaaaaaaaaaaaaaaaaaaggcccctaaccactaggccccta

SEQ ID NO: 16843 - DNA, 630 bp, Triticum aestivum
  Clone ID: PAT_TA_16843
ttccggccccccgaccccgccccccggcgccggcgcccctccggtccccgccggtcgccccccttcccctcccgcctgccccggcccccgcccccagccgcgcccacgcgccgtggccatggccggcccgcgccggcgacctggccccggccgcggcggcgtcccgtccccaccggggcttctcccgccccccgcgcccctccgcctcctccacgtcctccccctcccccgcctccgcctcctccgcccgtctgctgccgctcgcggcggcggcgcgccttcttcgccccggcctcgccgcgcccgcagcccacgcccccctgcctctggcatcggctgcgcggcggcctcctcggcgatgcggggcccgcggcccggcctaccggggcctgctgcgcgtccgcccgcgccactgccgtcgccttcccggcctccgcctcggcgttgagcggccccccgcccgtggtccccgcgggtccggcctggccgggggccgccatgcgcgggccctccgcagcgcggccgcggtccgccgcggccccacggccatggtcgacgcggtaccggtcatgtcgagggacggcaatagcgtgcgcaccgcagtgcggccgctgtccgccgaggagctct

SEQ ID NO: 16844 - DNA, 911 bp, Triticum aestivum
  Clone ID: PAT_TA_16844
atccgctgctgcctgcctggtgcctgctgcagacgacggccaaacagtagtttccccggttcctccacgcatcatcctccggacacgccgctcagcccatcgtcaacaatccccaggcgggggatctagccatgatggcatgcgctctctccatcgcccagcctaccgccctcgcgccgtgcggcggcggcggaggcggcagcagcaagatcgtccccaggaatctcccgaagctgcgaagccccatggtttcaggcaggatgagaagtcgcggtgtcgtcgccagggctgcgcaggacagttcagaagcctcctccgggagcgtcgtcagatacgtcaagagttcgttcaacactactgaagacatatttgctctagcgggtatcggctttgcagcaattgcggcattctgggcttccatgatgcttattggggtcatcgacaagctccctgttctccctcttttcttcgaactaatcggaatagcagttgcatggtggtttatctacgggaacctcctcttcaagccagacagggaaaagtttctggagaacatcaaaagctcagcatctcgaatcttggggcagtaacttcaccgtgaagacagtacatcctgcctacgacatacattttctttgggcctgtcagaaaacatttagctgtgcgctcatgttaggcatctgcgtcaccgttgtccgttctagatgtaatacaccatctcctgtacaggttaaatcaagcattcttctggtggtaaaacttgagtgtttgttctccacttaataatttttcaacggcatgtttgaggcaacactgaagtgtaaagtcagagacccctggctcgtacattttggggctcctttgattcaaaggaattttataggatttctgaaaaaaaaaaaaaaaaaaaa

SEQ ID NO: 16845 - DNA, 619 bp, Triticum aestivum
  Clone ID: PAT_TA_16845
cccgccgccgccgccgtccgatctgccgccgaaaggcccccgcgcccctcctgcccgcctcagacccccaacgcggcgaggcgcgcccctcctccgagcagccccggctgcagcagctgcggacgctcccctcctccgcccccgccgccgccgccccctcatcgtcgcctcctccggcgcccccggtggccacccacacgcgcaccatcggcatcatccacccgccgcccacgctccgcgtcatcatcatccacccgcccaccttcgtcgccgtcatcgggccgaagatcgagcgccgcatcgtcgcccacaaccagggcaacgccaagttcaacttcctccagccctccgacccctaccacgcgtactaccagcaccgcgtctccgagatcgccgacgcgccgcccgcccccgacgccgccgccgccgccgaccccgacgccctcccctccgacgactccgccgccgacggcgcccccgccgaccactccgcgcccttccgcgtgggcccgcccgccaaggtgctcgtgccgcccaaggccgagctctacaccgtgcgcctccccgagggcatcaccaccgaggaggtggacatcgtcaagctcacggcgcagttcgt

SEQ ID NO: 16846 - DNA, 412 bp, Triticum aestivum
  Clone ID: PAT_TA_16846
gacccaagcgccccgccccgcagcaacaaaaaaatctactctacatcactcacgctcgccgcccgcatctctctaggctccgaccgcccgcatctctctaggctccgaccgctcgcacctccggcgatgtcggcggcggtgggcggcgccgagttccacggcttcggtggcgcggcgcagctcccgcggtcccggatgctcggcaggcccgtcagggtggcgccgccaggggcgacactcgccggcagctggccctcggcggccagcattcgcgccgtctccacgcctctgaagaaggatgcaaaagaagttaagcgaagcaaggtggagataatcaaggagaagagcaatttccttcggtacccgctgaacgaggagctggtctcagaggctcccattgtcggcgagactg

SEQ ID NO: 16847 - DNA, 812 bp, Triticum aestivum
  Clone ID: PAT_TA_16847
cggacgcgtgggcggacccgtgcgcgcagcagcaaaaatctatcgctcgctcgcccgcccgcactgacactcctcgccccgcatctccgaccggtccctgctccggcgatgtcggcggccgtgggcggcgccgagttccacggcttcggcggggcggcgcagctcccgcggtcgcggatgctcggcaggcccgtcagggtggcgccgcccggggcgacgccggctggcggcggcggcccctcggcggccagcattcgcgccgtctccacgcctctgaagaaggatgcaaaagaagttaagcgaagtaaggtggagataatcaaggagaagagcaatttccttcggtacccgctgaacgaggagctggtctcggatgctcccaatgtcaacgagactgccgtccagctgatcaagttccacggaatctaccagcagtgcgaccgagaagttcgagggcagaagaactactcgttcatgctccggacaaagaatccttccggaaaagttccaaaccagacttacttggccatggatacactggccgatgagttcgggatcggaacgctccgtctgacagccaggcaaacatttcagctgcacggcgttcttaagaagaacttgaagcatgtcatcagcactgtgataaagaatatgggatcaaccttaggtgcctgtggagacctcaacaggaatgtgcttgcgcctgcagcgccatatgcgagaaaagatatcctttttgctcaagaacagcagagaatattgcggcacttcttgcgccacagtcgggggcttattatgacctgtgggtggat

SEQ ID NO: 16848 - DNA, 784 bp, Triticum aestivum
  Clone ID: PAT_TA_16848
cggcacgaggcttaatttctctcattgagcagtcacgctatcttcagttccgtgattgtcctgtggagtggggatggtgcagggatttgcaatccttcatttttgtatttaaaagccataatagtcagtgccaatagaatggcagatccgaaggatggttactgctatgaagcttagtagctgtggcaggaccgctcttattgaaaacaggccactattgattggtgaagatttatcagaaggtgaggcgaaggttttgcaagaatatgcccggatacctggcactgggccccgcccgctgctggccgaccgcgggcgggtggttcagggtggttggcgcccgaggtacagcacagattggaggatgaagattggaaagcttcttaatgaatggttattcttgagggggaattgatcataactcatgttccgctgaattcagaagaaatcaagttggagaatccttgatgaggtctccactgtatacatgggcttggtggcgtccatagacaaccttcctcttggtgggtgttgtaaagttgtagtgttcaccatggatatgtcaagaacatgttgtgggtattcatgtgcacctgtatgtatgacatagtattcgtttaacaggcgctgcaaagatgtggttaggccagcagttgccatgtgaataaccttatgtcataggaacatggagaaggctgctagctagtacttagctggtctcatcgaactgaaatggtgtactgtagcgtttgggtcctggaataaatgacagtactgtaaaaaa

SEQ ID NO: 16849 - DNA, 707 bp, Triticum aestivum
  Clone ID: PAT_TA_16849
gaggcgtaccaggacacactctatacgcactccaaccgccagttctacgccgaggacggcatctccggcacggtggacttcatcttcggcaaccccgcagtggtcatccaaaactgcgatatccatccccgaaagccccgccagggccagaaggacacgatcacggcccagggccgaactgacccaaaccagagcaccggcatctccatccacaagtgccggatcgccgccgtgtcagatctaggtggcacgaaggtgtatctgggccgtccgtggaaggcgtactcacggactgtcgtgatggagagctctctcgaccgctcgatcaccccggccgggtggctggagtggtcgggccagttcgcactcagcacgttgtactacggggagtatgggaacaccggggctggcgctgggacaagcgggcgggtggagttgggggtggagtgcacacgtcactgtccaccgtggaggccacacggttcacggtgagggattttatcttgggagactcatggttgggtgacaccggagtgagctacacttcagggctatgagtaagatggtgtcatgttgtttgtgctctgctaattaacttggaacatggaaccagatcacatgtaaagactggattggtaacaataaagtggaagctagtgagctgcgatgctagcctagctacctgctaacacatgactttccaagct

SEQ ID NO: 16850 - DNA, 864 bp, Triticum aestivum
  Clone ID: PAT_TA_16850
ctgatctggtcgacttggaggcatggtttggccatctgcatcaccgttctggccggatctgttgatgccaggttgtgactttctaactcgtctggaccgcgctgcccggtatcctctagataacaggcggctcatcttcttctactgccacttgtcgctgggctacattagcacgcccttgggtggtagaagctaccctgcaggcttggcccattgcagcggtagcccttcccgtcgtcggcagcttccccagatcagagcttgttgctgctctttatccagcgtcatcgccagcccgtgcatatcaatatatcatcaccagctcccggaaccgtcctgctgatgctggtgtgtcgcagtcgctgccacacaccagaggaagagctgactgcaagttgcggcgctatcacttgtactgggtgtcgggccttgctgcgatgttgatgctggcatgttggtacctgcctgaacagcaatgccgaagccccaagctctaattattgaccttatgggtcatatcaggcgaatagagtccgtagatatccatgagtttcactggtagaacagaagttatctgatcctggatatactgatgccagtgggttgaggagatactagatcgcctcaggagtatcacatatatttgtgcaagtgcaaggggatgcaaattctttgcgatttccatggtgcgtcctgggaaatgcaacgtgttgaagtaaatagtatttttgaatttattatggaagactttgtagcttggttttggccttgtgtgattccagtatcacagaaataaatgcaaaaaagttcacaaaagacaaaaaaaaaaaaaaaaaaaaaaaaaaaaaaaaaactcgagactag

SEQ ID NO: 16851 - DNA, 700 bp, Triticum aestivum
  Clone ID: PAT_TA_16851
gccggccgttgctgggaactttccccagcccagcaaattaccatcaccaacccgtcgtcgatacacagacagatccgcaaaaatggctggaggcaaaccccgtggtcttaacgccgcccgtaagctgcgaacaaaccgaaaggaccagaaatgggccgatctcgcctacaagaagcgtgccctcggtaccgcttataagtcctctcctttcggtggttcttcgcacgcgaagggcatcgtcctcgagaaggtcggtgtcgaggccaagcagcccaactccgctatccgaaagtgtgtccgtgttcagctcatcaagaacggaaagaaggtcactgccttcgtccccaatgacggttgcttgaacttcgtggatgagaacgatgaggtcctcctggctggtttcggtcgcaagggcaaggccaagggtgatattcccggtgtgcgattcaaggtcgtcaaggtctccggtgtcggtctgcttgctctgtggaaggagaagaaggagaagccccgttcttaagcgaagagcgcgtggatggaaacaaagtcatatttcgacacgtggagtctattcggattgcttgcatcgacattacggttagggatctgatcatgggagacgggtctgcaaaaggaaaatagatcacaaagtcttcgacgaacaaaaaaaaaaaaaaaaaaggcccctaaaaggccccta

SEQ ID NO: 16852 - DNA, 984 bp, Triticum aestivum
  unsure (1)..(984): unsure at all n locations
  Clone ID: PAT_TA_16852
acactgctcccaggagcggaaccaacaaatccccaccaatctcgtctccgatcgactccaggctcgtcgaatccccaccgcctcaagatgcagatctttgtgaaaacactgacaggcaagaccatcacccttgaggttgagtcgtctgacaccatcgacaatgtcaaggccaagatccaggacaaggagggcattcctccggaccagcagcgtctcatcttcgctggcaagcagctggaggatggccgtaccctcgctgactacaacatccagaaggagtccaccctccaccttgtcctgcgtctgcgtggtggcatgcagatattcgtgaagaccctcactggcaagaccatcaccctggaggtcgagagctccgacaccattgacaacgtcaaggccaagatccaggacaaggagggcattcccccggaccagcagcgccttatctttgctggcaagcagctggaggatggtcgcaccctggccgactacaacatccaaaaggagtccaccctccacctggtgctgcgtctgcgtggtggcatgcagatcttcgtgaagaccctcactggcaagaccattacccttgaggttgagagctctgacaccattgacaatgtcaaggctaagatccaggacaaggagggcattcccccggaccagcagcgccttatcttcgctggcaagcagctggaggatggtcgcaccctagccgactacaacatccagaaggagtccacccttcacctggtgctccgcctccgtggtggtcagtaattgccctatcgttcgacctgctgctgctgctgctgtaccctgtgtcgcctttgttcaagtgatgtctcgtttgtgtgaagtcgtactgtgtctgctgctttaatggaccatcgagtcctgtggtttggtgcaaacagttgcaggtacatctgtaccgttaagtatgaataagtcaactttgaagtaaaaaanaaaaaaaggccccta

SEQ ID NO: 16853 - DNA, 481 bp, Triticum aestivum
  Clone ID: PAT_TA_16853
acggacacgggcgaccatcacaaccagaagacggagtggccggggttggtggggaagtcggtggaggaggccaagaaggtgattttgcaggacaagtcagaggcacagatcgtagttctgccggtggggacaattgtgaccatggaatatcggatcgaccgtgtccgcctctttgtcgacagactcgacacaattgcccaggtccccagggtcggctagcaagcttgagagctggcctgctgctggcatacatgtattgcagcttgatcatctcttctaggatatagcaagattgagatatatagatcatatacaataagagttgatgcatggtaggttaatggataatggaataagtcacagagtgtgtaatatggttaaggtttgtatgtaagcgtgcttccgttcaattagtttacacatgtacgatgccgtaccctgtgtaagaatccgtctgattatccaattaatttgccaattc

SEQ ID NO: 16854 - DNA, 1046 bp, Triticum aestivum
  Clone ID: PAT_TA_16854
gccacgcgagatatcatcaaactcaccaccgctcccaggaacggaaccaagaaatccccaccgaatctcgtcgccaatcgacccgcaggctcgtcgaatcctccttccccacagcctgaagatgcagatctttggtgaagacgactggacgggccaaagaccgatcacccttgaggtggagtcgtctgacaccattcgacaatgtcaaggccaaggatccaggacaaggagggcattcctccagaccacgcagcgtctcatcttcgctgggaagcagctggaggatggccgtaccctcgctgactacaacatccagaaggagtccaccctccaccttgtcctgcgtctgcgtggtggcatgcagatcttcgtgaagaccctcactggaaagactatcacccttgaggttgagagctctgacaccatcgacaatgtcaaggccaagatccaagacaaggagggcattcccccggaccagcagcgcctgatctttgctggcaagcagctggaggatggtcgcaccctcgccgactacaacatccagaaggagtccacccttcacctggtgctccgcctccgtggtggtcagtaattgccctctcactcgacctgctgctgctgctgtaccctgtgtcgtcctgtgggtgcgcctttgttcaagtgctgtctcgtttgtgtgaagtcgtactgtgtctggtttaatggaccatcgagtcctgtggtttggtgcaaacagttgcaggtacatctgcaccgttaagtatgaataagtcaactttgaagtaataatcctgttatcatttgacctgctgctgctgctgctgtaccctgtgtcgcctttgttcaagtgatgtctcgtttgtgtgaagtcgtactgtgtctgctgctttaatggaccatcgagtcctgtggtttggtgcaaacagttgcaggtacatctgtaccgttaagtatgaataagtcaactttgaagtaaaaaaaaaaaaaaaaaaaacgagaaaaaaaaaaaaacctcggccgcgaccacgctaatcactagtgaattc

SEQ ID NO: 16855 - DNA, 409 bp, Triticum aestivum
  Clone ID: PAT_TA_16855
cccacgcgtccgcccacgcgtccgtgcttgttggaggagttgaccggatgcagcaagtgttatccattgcaaaacgtccacatattgtggttggaactcctggccgtcttttggaccatttgaaagatacaaaaggttttagcctaactaaagtgaaatacctggtacttgatgaagctgataaattacttaatttggagttcaaggaatcacttgatgatattctgaaggtcattcctaaagaaaggagaacttaccttttttcagccacaatgaccaaaaaggtaagcaaactgcaacgtgcttgtctccgaaaccctgttaaggtggaagtatcctccaaatattctacagtcgacacacttaaacaagagtggtatttcgttcctgcagattacaaggattgtta

SEQ ID NO: 16856 - DNA, 1007 bp, Triticum aestivum
  Clone ID: PAT_TA_16856
cgattctgacctcgccgccggctgttgctcctccacgacgccagcggctaaactacctacttacctccatggccgccggagcgacggcctccgcttcacaataaactacgagcgagagtatccatacgatacgagggaactgtcgcagttcccagatgtaaggctatggtttgtgaggcttgatgcttcctacccctggtttccggtggtgcttgactggagagccggtgagctcgccaggtatgctgcaatgctggtccctcaccagatgagtatgcgtcacggcgtagtcttcaaccctgaggcgttggagctgtttgggatgaagaaagtgttcctcgtctactcgtggctgaagcagcagaaccatgccaagccaaggttgaagacgggcgacatggccaagatgctcggtttcggcatcggagatgagttgtttgatttgatcgagaagtaccctgttgatgagctctagatctttatactgaaacagttggtgaagaatagatatcatataatccacagttacttactggtgccatacttactggtgctatacatagtgtataccagtggttcttgtatacaggacatcaatgaatcaggatgtataagaaggtagtcacgcaagggatagtattttggagccgtaaagcctagaggattttcccgggcatgcagcatcaggatgctaagcacatgcgtgtatacccttttttgtcttttaacgaaatccgcgcttttaaaaggacgccggattgaccattgaagaaaaagcaaaaaacatcggttccgccttcggtgttccgtgctttgatttgatcggagaagtatcctgttgatgactctagatcctcatgcttgaaacagttggtgaagaatagatatcattaccctgcaaaaaaaaaggaaaagaaaagaaaaaagatatcatccacagttacttactggtgctatatatagtgtacacctgccgttcttgtatacagaccataagtgaatcagga

SEQ ID NO: 16857 - DNA, 897 bp, Triticum aestivum
  unsure (1)..(897): unsure at all n locations
  Clone ID: PAT_TA_16857
gattcggacgaggctggcggtggcggttgcatgtatgcgggaggggagagccaatggtggggtcgacggagagagaggcggcgctgatgccgccgccggtctcgtgggcgcgcttcggcggcagaggccgggccagtcccacccgtcctcgtccggctcggccgcgtcggcggaagggggagccaagaagcaggggaggcgcaagagcaagcggcgggagcaggtcgtgagggcgattcgggaccggctgcctcccccgcccgcttgctggggcaacgtctcggtggtccaggagaggaggggccggagggagaggcctgacgatcacggccgcggcgacgccgtccgcggtgaggaggaggggcgctctggcgcgggaaccgccgcgttgccggcgtggtgctgcctctgccccgaaggggactgctcgctggagcccaacccgagcgccaacggcaaggaggaccccggcctccgcgccctcatcgagcgcaacgacttctactccgacgactgcaacccgcacgccgccgccgccgccgccgccgccgccgaagaggacgacggcgacggcgcaagccccgccgccgattttgattaggtgcccgtcggccgatccgccgttcgttgctgcacattgctgtacaaaaagttttacatccggagaaagaaggtggtatacacaggtttcttatttttcctcgcgttgcgtggcgtccggtcgagttcaccttccccgtgccttttcaaccgtcggngtgtaaagcatccatctaccgcgtgagagcatgggacgcgttggtgccaagaggaaacgactgcgatggattccncttgcctttggaanctttggnccaacgcgtgcaatnantgcttggtttgactaaaaaaaaaaaa

SEQ ID NO: 16858 - DNA, 455 bp, Triticum aestivum
  unsure (1)..(455): unsure at all n locations
  Clone ID: PAT_TA_16858
ncttgataggaggggccattgangtgcttnaagttgttcnaanaatgtgagacagtgtcaaatctgcggcgcgaggctggcgggtccggtggcggcaagatccttcagcggtgcaggagattaagggttccataatcgattccgcgcctgttgctgtccccaattttcagaactatgcagaacagaaacaggagcaacgaacggatgtcattgttaacatcctcacatgcgtgcaaagctgcctgccgaggagtttgccgccgccgatgcgtagtccgtgagacagtcgcgtcagtgtgggcgacggcgtctgaaagatgcgtgcgaaggcgcgcgcccgtgctggcgccgcggtcgtcgccctgccggtcgcggtcgcctccgtcggcgccgcggcgcccgtcgtctggcgccgtcggcgccgccttggcaaganccgtcntgtggattcgcgg

SEQ ID NO: 16859 - DNA, 590 bp, Triticum aestivum
  Clone ID: PAT_TA_16859
gctacacggagaccgcacacggactccgcgctcacccagcacaagaagcgacaccgcacagcgcagctagcaagttgagttcgggttggaggtcgagtgggatcggatggcgtcggcgccggtggagttcctgggcgcgcgggagggcggggccggcggggaggcgctctactgcgccatcatcctctggctgtccgtcatgtcctggatcatcttcacctgcgtcggcggcgacgacggcggcaggcgcaggaagggccgccgcgacaccaaggtcttcgtcggcgccgagcgcatgtgcgacggcaccgggccccactgcagcggcgggtacggcctctgcggctcctgcgtcgactagccctgcccctccaaatcgttcgtctggttcgtttgtaatcgagagtcgaaagtgctggtagtatcatctatctatggtgtgatgcgatgaagaactcctctcctcttcttctccggggagctccgttcttctagcctgtaaatagtttcagcgatcgatgatcgccgagatgagcaagtatctggtagcagtatggttgtagacaataagagggagctagcgtctggtc

SEQ ID NO: 16860 - DNA, 770 bp, Triticum aestivum
  unsure (1)..(770): unsure at all n locations
  Clone ID: PAT_TA_16860
gncacgtgtgcctgccagcaacaacccccctcccagacagcctccagccgccgcgccctccctcccccccaatcctcgcaatggcggcggcgcccccccagcccgccgcgcccgcccccggccccgcgagcggcggcgacgcgttccgcctgggcttcgtcggcgcggggaacctggccgagagcatcgcgcgcggcgtcgcggcgtcgggcgtcctcccggcctccgccgtccgcaccgcgccccaccgccgccccgagcgcggcgccgccttcgcctccctcggcgccaccatcctcgcctccaacgcccaggttgtggacggcagcgatgtgatcgtcatctccgtcaagccccagattgtgaagcaggttctggttgagctcaagcccttgctgtctgaagaaaagcttctggtctccatcgctgctggcatcaagatgaaagatttgcaggattggtctggtcagcgcagaattattagagtaatgccaaacactccctctgctgtcggacaagcagcatcagtgatgtgtctgggagaagacaggctactgagaaagatgaaaaccgtgtcaaaagcttatttagtgccattggcaaagcttggacagctgaagacgaacaattagcttccggtgctggctttagtgggaatgggcccgcccttctttttccttgggaataagaggccatggcttgatgggtggaanttgctgctgggcttcctccgggaatcttgcnctgggccttgaagctcaaaaaagtgg

SEQ ID NO: 16861 - DNA, 652 bp, Triticum aestivum
  Clone ID: PAT_TA_16861
ctcgtggccaaaggaagcatttgaacttgtctctggagaggtctcaaagactttggaaaggcttgaacctggcgccactgcttcgcacgcgtttgtattggagagcaaaacacagggcaggttccaagcttcacctgctgttatcaagtaccgtgttgccacaaaggctgcactgcaggaggcctactcaactcccatcctccccctggacattcttgctgaaagacctccagtgaagaagtttgaatgggctaagaaacttattgcaaagtacggagcactggtgtctgtcgtttccttcgttctggggttcatctacctggtcgcgagcccatcgaaatctgccggctcaaagtctggcaagaagaggcgctgatctatcatccatggttcaccgtttttgtagctggccgtttgcctggagagagactcttggtagcagaggaagagaatctctgaagttacaacaccccatggactgtaatgtaatggagcgactagcagcaaagtgacactataattttggttatttccattttgtgttgtcagcgacttaacccggaggagtagatttggtgaaacatagaaacccttttgattctgtactgtgtggaggaccatgtggttgtgcatccaatcttagcccctggtt

SEQ ID NO: 16862 - DNA, 1195 bp, Triticum aestivum
  Clone ID: PAT_TA_16862
gctgtgcgacaggcacgcgaggcgatccgaacccgatcccgtcttcttcttcccgccagctgggcgagaagcacgagatccgatccgatccgatccgccggaaccctagccaggtccaccaccatggcggcgacccgcccgctcctcctctgcgccgccgtcctcctcgccgccctctcctgcaccttcgccgccgacgcgcccttcctcgtccgcgcacaagaaggtggccctctcccgccccaagcccggcgtcgagcgcctcgccgtctccctcgacctctacaaccagggatccgcaactgcatatgatgtggttcattaatgattgactcgtggccaaaggaagcatttggaacttggtctctggctgaggtctcaaagactttgggaaaggcttgaacctggtgcccactgcttcgcacgcgtttgtattggagagcaaaacacaggggcaaggttccaagcttcacctgctgttatcaagtacctgttgttgccaacaaagggctgcacttcagggaggcctactcaactcccatcctccccctggacattcttgctgaaagacctccagtgaagaagtttgaatgggctaagaaacttgttgcgaagtatggagcactgggtgtccgttgtttccttcgttcctggggttcatctacctggtcgcgagcccatcgaaatctgccggctccaaagtctggcaagaagaggcgctgatctatcatccatggattaaccggcttttggtagctaccgtttgcttggcagagacccttgatagtcggagcctgaggatacagcacccccatggactgtaatggaatggagcgacaacccgcaggattggcactgtaatttaggtaatagcagcatagtgacattataattttggtaccttgcggtttgggttgtcagcgacttaacccggaggagtagatttggtgaaacttagaaacccttttgattctgtactgtgtggaggaccaatgtggttgtgcgtccaaaaaaaaaaaaaaaaaaaaaactcgagacctgcccgggcggccgctcgaaatcactaatgaaatcaaaaggattatagcaacttgttggagcaaatagcaataagaatttagctgacccgtagtgaacaaattgtaggtttgatgtgtttttgttgtacactctgttttcacggtgaaaaaaaaaa

SEQ ID NO: 16863 - DNA, 707 bp, Triticum aestivum
  Clone ID: PAT_TA_16863
cagggacagacagagccgcagccaccgcctgaggcgagccaagaaaaagctcacagcttaaactgaaagctagctactagctaggattagctcaaacttccgcttccgccagacacagagctcgtcggcggcatggacgccatggagagaggcgagcgcgcgacgctcctgcccgagagtcatgggccaaaggttcaagaggatgacagtttgcaggtgccactcctcaagcataagaagcggggcggcagcaaggcaccagcagtaattctattgttcgaatgcctggagagcacggcgttcaacggcatctcgacaaacctggtggtgtacctggagaccgtcctccacggcaccaacctcgccagcgcctccaacgtcgccacctggttcggcaccagctacctcaccccggtcttcggcgccatcatcgccgactccttctggggcaactacaacaccatcctcgtctccctcgttgtctacctcctcggcatgatgctcgtcaccttctccgccttcgtccccaccaccacgccggcgctgtgcgtggcgggtgcctcgtgcaccggcaccgccggcacgtgggggctgagctcgcagatcgtggcttttgtggggctgtacctcgttgcgatcgggtgtggcggggtgcgatcgtcgctgctgccgttcggagcgggacagttcgacgacgacagcgcggc

SEQ ID NO: 16864 - DNA, 1194 bp, Triticum aestivum
  unsure (1)..(1194): unsure at all n locations
  Clone ID: PAT_TA_16864
acggcggcgacggcgactgcggcgccgttcagctcgccgccgagatcgaggagctctccttgggttccacgggcggtctacgggaccgtctcagcgcgctccccgacgatatcctccattccatcctcctgcgcctcccttccacccccgccgccgcccggacctgcgtcctctcacgccgctggcgcggaatctgggcccagctcccggagatccgattccccttcccctccgacccggccgccgtcggccccgcgctcgccgccagcgccgctggcccggccctccgcctcctccacgttgcgtgccgcgacgacaccggcgccaacgcttggctccgcaccgccgcgagccggctcatcgcaggcggagagctttacttctacaaaaggacgccggggngaggaagaaggggcagggcggaggcgcttgtcctggcagtgccgcaccttcgagctgccctgcttcgagacggctgccaaggtatggctccgcctagggttcgtcgacctggagctcccactgaccggcgtgttcttcaggctcactgagctgcgcttggaacacggaattttggagtgtggtttccagctcggcgacatggtctcgtcgccacggtgcccggcgctgcgggagctctgcatcgcgagggccccggggagtggtcagcctctgcatcatctcgcagacacttgagcgtcttgaattggatattctgcatggacttgaggagctcactgttgttgcgccaatgctcagagcgttgaatgtgcacgcttgctttgcttggaggaagccagttgctgccatttatgcatccaggctggaggttctctggtggagtgatgcatttgatccgagcttcgtgctgttcggcgaggtggagaatctccagcagctgaccaccttcgacattcatgtttatgggcgctttgattacgcactccttcaggattacgtgatgctcttacagcactttccaactgtctcctgcctgacctcaaactgaactatcaacgtgtgagtacacttctcttaagtggaaatacacagtactgtactagtaagactacatctggtgcaaaaatacttagagtaataatattttgaactgctgtagactactaccacaatggacaaggacacatattaacngtaataatccagtaannaantaggatacaatantcnaga

SEQ ID NO: 16865 - DNA, 973 bp, Triticum aestivum
  unsure (1)..(973): unsure at all n locations
  Clone ID: PAT_TA_16865
cccacgccgtccgaaagcacaagcgaacctgattcttcttcttccatatcaaccagtccaagaaaaaagcccgccgtggttttctagctaataattcaacttcctgagctagacatggaggcggtggagttgtcggcggtggtgagctgcgagtgctgcggcctgggggaggagtgcaccggcgagtacatagtccgcgtgagggcctacttcgggggccggtggctgtgcgggctgtgctccgagtccgtcaagtacgaggccggccgcagcaagcgcgcggcggcgatgggcgtggaggaggccgtgcgggcgcacatggccttctgccgcatgctcaggcgcggcggacccgcggagcgcgtcgccgagggcatgtgccagatgcttaggcggcgcaccgcgtgcggaaagtgccaggtggccatgccatcgtcctcatcgcggacgacgccggcgccggtggcgccgctgtcgatcggtttctgaatctctcatcgagcctttgtccaagaggacgcacgcacgggccggcggcgaccgcccgcctgcgttgatgtctggctctttattttcataagtgaatgcttcggcgtacgtcttcctcctcgcctcagagcgcaagctagctacctacatagtactccggaaactacgcacaagtgttggagttcatttctatgtgtaagtttcggtcgatcgatccgatgaaacttaagccgcgttcggactccctccgctccgcggctccacgccgggagcggagtggcttgctaagtataataacgcaagagctgctaaaaagggcgctcccgccnggctccgctccggcggggaacaaaccgaaanaggccccttaattaaccgttacgaaggtttaatttttgtaananacnaaagtttaaatcaaatttccaataaaccaaccncccganggnttttngttgaannaaaaaaaaaaaaaaaaaaaaaa

SEQ ID NO: 16866 - DNA, 1274 bp, Triticum aestivum
  Clone ID: PAT_TA_16866
gtcacctcgggccgccggcgaccgccgcgtggagcgagaccctaccaggtctccctctcgtcggtctcggccgccgcggcggaggtctcaaccttccccctcgacgccctcaagacgcgcctccagctccgccgcagcaccggtggtggtggtggtagcggcggtggcgtcttacgcgtcgcgggcgagctcgtccgcgacggggggttctaccggggcctctcccccgccgtcctccggcacctcttctacacgccgctccgcatcgtcggctacgagcacctccggtcctcccttgccagcgggggccgggaggtgggcctcctcgagaaagcgattgctgggggagcctccggcgtcgccgcgcaggtggtggcaagtccagctgatctcataaaggtaaggatgcaagcagacagcagattgttgacccaaggcattcgacctcggtatacaggaatcttagacgccttcacgaaaatcactcgtgcagaaggtttgttaggactttggaagggggttggtcctaatgcccagcgagcatttcttgtcaacatgggcgagttgacctgctacgaccaggcaaagcatttcatcatccgcaagcagatctgcgacgacaatctgtatgctcacacactggcctctgttgcctctggtctgtgtgcaactacattgagctgcccagcggatgcccgcgattcccggaccagggtcctggcccggctggcgggggccctgtacaggaattcttatgattgtttggtcaggaccgtcaaacttgagggcctaacagcattgtggaagggtttcttacccacatgggccaggcttggccccttggcagtttgtgttctgggtttcctacgaaaaactccgacaggcatcaggtatttcttcgttctgatagtgctgtgctggctgagttttcatacaagaggcatacagatcaaagatactgttatttcttgaacctttagcctgtggctacgtgttactgtgcccatgtgcatttacgtttaatttgggcctgaactctgtatatctgatggtgcagcagccagcgcatagatttgtcatcccttacatatcacattttctcacgctcttccttttggggagggaattgcacaaaccaccacttattggggctggtgttgcgcaaaacacctactatacgggtttgttgcggaaaacaccacatattggtgtaatacattgcagataggtctaatctagtatttggatgcattggcataaaaaaaaaaaaaaaa

SEQ ID NO: 16867 - DNA, 1013 bp, Triticum aestivum
  unsure (1)..(1013): unsure at all n locations
  Clone ID: PAT_TA_16867
ccccgcgtccgagctggtggaggaccgggaggcgttcggcatgttcgcggagaccaagttccggcagctcgacgccgacggggacggccggctgtccgtgcgggagctgcagcccgccgtggccgacatcggcgcgtcgctcggcctgcccgcgcagggctcctcgcccaacgccgaccacatctactccgaggctatgagcgagttcactcatggtcacgggaaccaagagggggtgagcagggcagagttccaggaggtcttgtccgacattctcctcggaatggcggccgggctcaagaaggatccgatcgtgatactgcgcatcgacggcgaggacctcagggacttcgtgtccagcccaaggtatgagccggcagtcgctgccatcttctcacaagttgggtctgaagatgcccctctccggcagtgcctgctagccgccgttcagcagctcggcgtcgaccacggcatgcccccagccgctgacccttgggtggtagagaacgtggtagagccggcattgcagcagctctccgccgatgagctcgagcaaccggcgtcccgggacgtcttcttcgagcagctgaagaagctgctgggcagcgtcgcggaacagcttcaggagcggcacgtcatcgttgcgcacaccgagaacaccttcgacgggagcggtgtcaggaggctgctgggaaacaagttcgagctggacaagctgctggattctgtgtggagggacgtgccggcggagctcaagaataangcgcccanggacaatgancacctgcgagtcccactcnataaagatgggccggtncaagcaaagcttaacaacccatgggctctgtttctcaagtgggaccccgttcgtgggaccaaggcgctcaaaggtggccggancncccggccaacgggnaangtggtccaanaaancggggttnaaanaaacntctgacgggaggttcntgggggccttaattccnccgggtngaccggcgaaaccatttttcttc

SEQ ID NO: 16868 - DNA, 962 bp, Triticum aestivum
  Clone ID: PAT_TA_16868
tttttcttcccacgcgtttgttcatcttcggtcagatgtcatattctgatgctatctagctacttattgggtccaacaagaaatccgagttcccggtaaagtgggggctggctccgcaaagcgagcatgaaagatatatcacagaagtcgcatttggcggcagtcctgcaataattagagattatccaaaggaaatcaaagctttctatatgcgacaaaatgatcggacgggaaaacagttgcggcaatggatctattggttcctcgggtaggtgaactcattggaggaagccaaagagaagaacgacttgattaccttgaagctcggctggatgaatcaaatcttaacaaagatagctattggtggtatttggatttgcggcgatatggatcagttcctcatgctggttttggccttggatttgaacggcttgtacagtttgcaaccggaatagacaacatcagagacgccattccatttcccagggttcctggttctgcggagttttagcacttgaagagtatccgtgtataatctctaaaagcattcttgcctgggacttgaagaaaaccttacgttgatttgtcattgtcaggagtttacctgactgatttctaatctgcaggagcgcactgtatcatcaacttcccttgcaaattcgtcgaatgctgggattttagtcgatgaattctttgtgtacgaccctattcagtaaataaacaattttgccttgggggctggcgtaaaaaaaaaaaaaaaaaaaaaaaaaaaaaaaaatgaagaaaaccttacattgatttgttcattgtaaagagtttaccctttgcaaattcgtcgaatgctgggattttagtcgatgaattctttgtgtacgtccccattcagtaaacagacaattttgccttggggacttgataccagactccttatgatagccactaaaaaaaaaaaaaaaaaaaaa

SEQ ID NO: 16869 - DNA, 587 bp, Triticum aestivum
  Clone ID: PAT_TA_16869
cctcgcctctcgcccctcatttctttctcattcccccccggggctctcacctcgccactcgtcgttgtacccaatccatggcggagattgttaaatccttgtcagtgtcctcccaacgcttgctccaccgtccgccgtcaaactccgctgccaaagctgcctacacaacggccactgctgtgcgagatctacaccccatcgattggatttcggtgggtgggaaccagaggcctgccgccaacgccgccttcacgatgcccgtgctctgccatatctaccaccccatcaatccgatcatggtggatgggagccggagggccaggaggtgccaggttgttcgtctaccatcccatcgaaaaagcagcaggagccgcccgatgtctcccacgttcgtgcaattttttcctgcaaggccttgtgatttgctcatggatggcgcgtgtgcttcgtggttctttcgttctggtccgtgttcgtgtccttggctttccgacttgccttgcctggaccttgggggcccgctccatgcgccgaggccgcggtgcgccgccatggcgtcgttaactctacggaaacctggtaccact

SEQ ID NO: 16870 - DNA, 747 bp, Triticum aestivum
  unsure (1)..(747): unsure at all n locations
  Clone ID: PAT_TA_16870
caccgccgccgccccagcatcgacagcccgctcccccgcccgtgacccagcgatggcgtggcgcggcgcggtgtcccgcgccgtcctcgtcgcggtgcgccgcccggcacactcccccgcgctcggcgggctccgcgccccccctcccttctcggccccgcgccgccggatcccttccccctttgccccctctcccactccctcccccctctgggcgccacggcccctggggccgacgttgtggtcgccgcgctgtgcgggggtggtgttcgagcggataacggcgcacccgtctgccagcgcccgcggctgctgcgcgctctctcagaggaaaggggaagttgcttggttttggcggctgcctttctagagagggaccttatcttcgattcgtatgtagttgagtttgccatgttgattcactttcctttttaaagaggtaacaaattttcgcttccaatattggtaatctcttcttgagtcgtctttttagtacatgagttattagtaatatgtctccatcaatatcacttctctacaaattactagcctagcctgaaaataatcttcctgttgataaggcggatttggttggcacgttttagctgcttccttaggtagcgaaatatcttccgtgttgcctgctaaagaggattgggtgggcacattttatatgattcctagcattggagggtatctctgttcccccagctttcctgggggcaaaccgtcatttaaatacaagtn

SEQ ID NO: 16871 - DNA, 1022 bp, Triticum aestivum
  Clone ID: PAT_TA_16871
gccggccgggtcggctgtgcggcgctcgaggcggcgggccgggatcagcctcacctcactcttcactctctctcttggataactcctacttcgtcacaatggtcaagttcacttccctcgttgccctcgcggcccctctggttgctgctgctcccaaccctcagaacagcccccagatcgttggcggaacttctgccagcgctggtgaattccccttcatcgtcagcatcaccaacaacggtggtccctggtgcggtggtactctcctcaacgccaacactgtcatgaccgcctcccactgtgtccagggccgatctgccagtgctttcgccatccgtgtcggatccaactctcgcacctctggcggtgtcacttctcgtgtctctagcatcagaatgcatcctagcttcagcggctctacccttaacaacgatgttgctctcctgaagctttccacttccatccctgccggtggctccattgcctacggtcgccttgccacctctggctctgaccccgctgctggatcttctcttaccgttgctggctggggagacacctctgagggtggtggcgtcagccccgtcaacctgctcaaggttaccgttcctgttgtctctcgtgctacctgccgatcccagtacggcacctctgccatcaccgacaacatgttctgtgctggtgtcaccggaggtggtaaggatgcttgccagggtgacagcggtggtcccattgtcgactcttccaagaccgttgttggtattgtctcttggggtgacggatgcgcccgacccaacgccgctggtgtctatgctcgcgtcggtaccctccgatcttggatcgacagcaacgcctaagcgtcgcaacatgactatggattggctgagttgaagagtcttctggggtgaaggagtgatgatttggatgctatgtttggaatgatgagagggattacattctgtaaatacttgattatcaaatacatatgttgatgcataaaaaaaaaaaaaaaaaggccccta

SEQ ID NO: 16872 - DNA, 1132 bp, Triticum aestivum
  Clone ID: PAT_TA_16872
ggacactggcatgcgacctcaaaacttcattagagaactagatcttacaagtgtagcggaggactatccaaaattgagagaactcatacagaggaaggatgaaattgttactaacgctgcttcaccaccgatgtattttaagtgtgatctacggcaacatgttctttctccagagtttttcggtacaaagtttgatgttattcttgtggatccaccatgggaagagtatgttcatcgtgcaccaggaataacagatcatattgaatattggaacgctgaggagattatgaatttgaagattgaggctatagctgatactccctcttttctcttcctttgggttggtgatggcgtaggtcttgaacagggacgtcaatgtttgaagaagtggggatttcgtaggtgtgaggatgtttgctgggtgaaaaccaacaagaaaaatgcatcatcaggtctgcggcatgattctcgtacattgttgcagcattcaaaggagcattgtttgatgggtataaaaggaacggtacgccgtagcactgatggtcatgtcatccacgcgaatattgatactgatataataatagctgaagaacccactgatggttcaacgaagaaacctgatgacatgtacaggatcattgagcattttgctcttggaaagaggcgccttgaactctttggcgaggatcataacattcggcctggctggcttactcttgggaaagacttatcatactccaacttcaacaaagaggcgtataacaagaactttgcggacagcgatgggaaggtgtggcagggaggcggcggtcggaaccctccccctggcgctccgcacctgatcgtgacgactccagagatcgaggggctcaggcccaagtcacccccgccgaagaactgacagcatctgcgctaatggcggaagacccctccatggagctcggtgaactgtgacctgttttcaagctgcaactgtggctacatttctttttccatatctgtagcttttattttgcaccttgtagggggggttgagccgctcgttcgtcggaaaaatgtactgtatgtcagtgtcatggatgttttgatgaaacggcagcaatcagaataagaagcttacctttcccccgcg

SEQ ID NO: 16873 - DNA, 1426 bp, Triticum aestivum
  unsure (1)..(1426): unsure at all n locations
  Clone ID: PAT_TA_16873
ggaaactgggtgaactagnagaagttcttacccaagnaaaagcaagttgcagaccctagcaggatttgttgcagacgagaatcctggatttctacaactcatgtctcatatgaaagaattgaaaaaggttaagatatggtgttgtgggtccactgatgcaaacaatgagagcatgcctcacatttcggaggcagttcagaagtttgctcaggatggtatggacacggcagacgtccgttctctgtcacttgattttggaaactccttgggggacttcttcggttctatacaagaatattgcttcctcagctcgctgaaactgcgtggcaggctgactcgactgcctcagtttgttacatccctgtgtggccttacagagctatgcctttcatcaactaatctgatggggaatgatctatcaaacctgtgtatgatgccctgcttgctttatcctcaactggttgaagctgaccttactggcttcatcataaaagataggggtttcccaagcctgttaagcttatgccttattatgcaaatgcccgtgctccctacaatcggagcaggtgctctgccgcgtcttgtctcgcttcagctgctgtgtaaagatcttgttggtctttcaggcatcaagatcgaacagcatcactgtctgcaggaagttgctctggattctatggtcagtgcaaaaacagtagacatgtgggaaactgcagcgaagaagcatcccaggagaccaaaagttctgtttctcaaaaggattggtccaagcgaaactaagtccaccgtgaaatatgtggcggcagacgaaccaatacgtgataaggcgtcctccgtcgagttcaatcaagttcagttaacgcagaatatgttgcaggacgaatgcatgatcagtttagatcaatccagttcaatgagcaaactcaattcagctatgaagaaaataatagtttcagacccccctccggctgcacccgagctgtccagttctgggaacagtgtgatgcctccttctgcaagcatatgctaaagcaccattgctggagtttaggaacttggccatgggttccaacctcatccagtgtacagaaactcatttttttctatgtatgcgtgaacggagacgcgaaggttttgcgttctctctgttgttggagttggccatttatttagcaggaggcggcaagacaagtcaccctttccatttcgactttcgaacagggctgtcttagggaataaagtgagcagttttttttagctgaaagtgagcaggggcttgtgtcgtcggaattgttagttgtaacatatcttggtgtatcatgtcatgttgtagcatatttggagtactcagtgtgtgtacagatatgtacttatctgtaatgttacatgaactggattttatcacgagnatagtatgtgttgccat

SEQ ID NO: 16874 - DNA, 947 bp, Triticum aestivum
  unsure (1)..(947): unsure at all n locations
  Clone ID: PAT_TA_16874
gcgcatgccgtttgttcctctgcagtgccacttcgctgcaaccactctgtcattcatgaagaatgtgaaggcaaggctccattcaagggagcgcggctagcaactaggccctctaggtggacgcgatcttgagcagcaaagagcagatggtccgacaaggcgagcgtgattgcaggcaactgttacacatgtcgagtttgctgacgagatttctgttcaaaaggcgagcgcgaggccaccacaaggtggactggcggattgctctaaaattgttgtacatgcaagaacagagcattcgcgttcctgtttgccgacggggccaacgacgagctgagcttgctgtaggcggtggaggcgcacacgttcccgcacctgtttgccgagatgaagaagaaagttgacctcgcgcccgctgccattatctctgcaaaggcctctgacagttcggtgctcaaatcaattgatgccaacagaccagtgaggcgcaaaaactgaatgcaggcgcaagaacactgacttcaggaacagagattcgcatttccgtttaccgacggtgccaacgacgagttgacctcgctgtaagcgatggaggngcacgcgttcccgcaccagttcgccgagatgaagaaagttggcctcgcgcccgctcccattatctctgcgagggcctctgacagttcggtgctcaaatcaattnacgcaaacagaccagtgaggaaacagagaagtggccggatgggcaatcaactcatctgttaattggattgggggtggcatgaacaaagtaaagatgaagaaagcaagcttggacgctaggtggcggcaccaacaggggaagtgtcaggcgtgaaccanncatctatggcttgttgctttgaatcttgctggtctaggcaaggttngctcttgtcacgatgcaatgntcaacctctanganantnttgcgt

SEQ ID NO: 16875 - DNA, 1073 bp, Triticum aestivum
  Clone ID: PAT_TA_16875
ctttccctttccccatcgcaaactccccccgcccgcagctagggttccgcggatccccgcccagctagggttccccgccggccccatccatggccgccgcggcggcggaggaggcggcgccgggcgccgacgcgatcatggacggcttcgcggagctggagcggcagcaggagctgctggccagctgcacgcgcctctaccagcagctcaccgagcacttcggctccctcgagcgcggcatcaagtcccgctccgactcgctccgcgccaggcgccgcgtcgtcgagctccgcgcctcccgccgtctcgacgcgctccgccgccgcgagctctccatcgacgcctccgtcaagctcgcgctctcccgcctcgacgccctcgccaaatcccccgcgcccaagcgcgaccgcgaggacggggacgggccaccgtccccgcccccgccgccgccgtcggacgacgtcgccgagggcctcgccgcgctctgcgccgccatggaccccgcgggcttcctcgccttcgtcgtcgagcgccgcaaggaggtggacgcgctccgcgccgagctgcccgccgcgctccagcgctgcgtcgacccggccaggttcgccatggacgccgtctccgaggtcttccccgtggaccgccgcgccgtccgctcccccaccgacctcgcctgggcctgcgtgctcatactggaggcggtcgtgcccgcgctggccgacccggacccggagatcggggcggcgcggcccatggtgccgcaggccgcgcgcgacagggcccgcggcatggccgccgagtggaaggaggtcgccgagcgcaagggcggggtggagggcgccaaaccgcccgacgcccatgccttcctgcagcacgtcgccaccttcgctcgtggcggagaacgaggacaaggagctgtacaagaggattgtcctcagcttctcctggcgcaagcagatgccacgccttgctctcacgcttgggctcgaggatgacatggaagaaatcattgaagaacttatcacaaaggggcaacaacttgatgccgtgaactttgcctatgaggctggtct

SEQ ID NO: 16876 - DNA, 666 bp, Triticum aestivum
  unsure (1)..(666): unsure at all n locations
  Clone ID: PAT_TA_16876
cctaggtaccggntctccctactcttatgataggtcagctgggcacgccctctactgtggccagagcccaatgagggagccatatgcatacccacctgctgtgccggtgcctaatgttggccttggaatgccataccaagcccctcccatgacctaccccatctacgccggttacaacagcggcccgggagcctatggcaatgccatggccccagcctttcaccaggcttactaccggtagaatcagtcggaaatgaccaaatgacaagagccgatgacggcggggcttcgtcaacggtgccctgttttgtagcgactgactacaacggtaggttgcgtacgtccttaatacatcactactagatgcttatgttacttcgttctgtccggttattagcactcatgtttacttccgcactgaaaactgaaagactgaatgtaaagtatggatgccgtgtatgtggaccttgtgttgtaattcagtttaatgcgctaggcgaaaaaaccaaaaaaatatattatgcatgtaatcctcgagcattgaaaaaaaaaaaaaaaaaaaaaaaaaaaaaaaaaaaaaaaaaaaaaaaaaaaaaaaaaaaaaaaaaaaanaaaaaaaaaaaaaaaaaaaaaaaaaaaaaaaaaaaaaggggcggccgttttaaa

SEQ ID NO: 16877 - DNA, 2659 bp, Triticum aestivum
  Clone ID: PAT_TA_16877
tcgcgatctagaaccccatcgcaaactcccccccgggccggctccagctagggttccgcggatccaagcctagctagctagggtttgctgccgccggcccgcgccacggccgcccgcgtccgctccatcgacgcctccgtcaagctcgcgctctcccgcctcgacgccctcgccaaatcccccgcgcccaagcgcgaccgggaggacggagacgggccaccgtccccgcccccgccgccgtcggacgacgtcgccgagggcctcgccgcgctctgcgccgccatggaccccgcgggcttcctcgccttcgtcgtcgagcgccgcaaggaggtggacgcgctccgcgccgagctgcccgccgcgctccagcgctgcgtcgacccggccaggttcgccatggacgccgtctccgaggtcttccccgtggaccgccgcgccgtccgctcccccaccgacctggcctgggcctgcgtgctcatactggaccgtcgtgcccgcgctgccgaccggacccggagaacaacttgatgccgtgaactttgcatatgaggctagcgtggtcgcggccgaggtaccggatctccctactcttatgataggtcagctgggcacgccctctactgtggccagagcccacttccaatgagggggccacaggcacacccgccggcggtgccggggcccaatgtgcgccttggattgccatcgcaagcccctccgatgacctaccccatctaccctggatacagcagcggcctgggagcccagggcactgccatgaccccaccggtcttctgggaaaattctcccgagtcacccttttgaaatcctacctggacgattctaggaagcggtattgcacttcagataacgtgagcaccagcagtggccaatctggggtaaatgcaaataagaaggatcagtctgcgcttcgggctgttataaagtgtgttgaggaccacaaactcgaagctgagtttccattggaggatctccggaagcggctggaagaattggagatggcaaagactgagaagaaaaaggcagcgtcgagttgttccagtggcggcccagcaagcaagcgcatcaaaggtagtgctgggggagcaatgtccccttccaagtctggtcgtctaagcgacaacaccggtgcaccatcttcgccctcgaccgccaccagcagcagcactgccaccgcattcatcggctctccagcctcccatgtctcctacggtaccggatctccctactcttatgataggtcagctgggcacgccctctactgtggccagagcccaatgagggagccatatgcatacccacctgctgtgccggtgcctaatgttggccttggaatgccataccaagcccctcccatgacctaccccatctacgccggttacaacagcggcccgggagcctatggcaatgccatggccccagcctttcaccaggcttactaccggtagaatcagtcggaaatgaccaaatgacaagagccgatgacggcggggcttcgtcaacggtgccctgttttgtagcgactgactaaattgttacgttgcggacgcccctagtacaccactactaggtgcttatggtacttcgttcggtccggtcattcccgtccatctttacttacccactgtaaactataatactgaatataatgcacggcgcagtatgtgagcaccagcagtggccaacctggggtcaatgtaaacaagaagacccaatctgcgtattgtgctgttatatcgtgtgttgaggaccacaaactcgaagctgagtttccattggaggatctccggaaacggctggaagatttggagatggcaaagactgagaagaaaaaggcagcgtcgagttgttccagtggcggcccagcaagcaagcgcatcaaagggagcaccgggggagcaatgtcccctcccaagtctggtcgtctaagcgacaacaccggtgcaccatcttcccccgccaccgccaccagcagcagcaccgccaccgcattcatcggctctccagcctcccatgtctcctacggtaccggatctccctactcttatgataggtcagctgggcacgccctctactgtggccagagcccacttccaatgagggagccatatgcatacccacctgcggtgccggtgcctaatgttggccttggaatgccataccaagcccctcccatgacctaccccatctaccctggatacaacagcggcctgggagcctatggcaatgccatggccccagcctttcaccaggcttactaccggtagaatcagtcggaaatgaccaaatgacaagagccgatggcgacgacggggcttcgtcaacggtgccctgttttgtagcgactgactacaatggtaggttgcgtacgtccttaatacatcactactaggtgcttatgttacttcgttctgtccggttattagcactcatgtttactttcgcactgagaactgaaaaactgaatgtaaatttagtatggatgccgtgtatgtggaccttgtgttgtaattccgtttaaagcactaggcgaaaaaccaaaaaaatatatattatgcatgtaatcctcgagcattgactattaatgtcttctgttagctatacttatgatggggcgttggtcacccacacccccaac

SEQ ID NO: 16878 - DNA, 1683 bp, Triticum aestivum
  unsure (1)..(1683): unsure at all n locations
  Clone ID: PAT_TA_16878
cattctccaaactaagcagcaaagcaagctagctaagtactaaatcaagctcttctgcttcttcttgctctccggcaccaaagctacctagctccacttcattaagccaagccttctttgtttcttccaccttttttccactcgtagttaagggttaaactacctaaaagggacgggcagcttgggcaccaacgccacgtccttctccgcccttcccgacgacaaggcggcgttccagccgctcaatcccgaggacgtccgtgcatacccacacaaggccgtcgacttcatctccgcctactacaccaacatcgagtccctgcccgttcttcctaacgggaggcaaggctacctgcaagacgaactcagcgcgtccccgccgacctactccgcgccattcgacgtcaccatgaaggagctcaggacctctgtcgtccctggcatgacgcactgggctagccccaacttcttcgccttcttcccctccaccaacagcgccgctgccatcgccggcgacctcatcgcctcagccatgaacaccgttggattcacgtggcaggcctcacccgcagccaccgagatggaggtccttgctcttgactggcttgcgcagctcctgcgcctacccaccaccttcatgaatcgcaccagcactggccgtggcacctggcggtggcgtcatcctcggcacgacgagtgaggcaatgctcgtcacgctagtcgccgcccgtgatgcagcgctgcgtcggagcggctcggtcggcgtgtccgacatcccacgcttggctgtgtatgctgccgaccagacccactccacgttcttcaaggcatgccgcctcgcaggctttgatcccgccaacatccgctccatccctaccgggccggaaaccaactatgggctcgacccggcaaagcttctcgaggtcatgcaagctgatgccgacgctggtcttgtgccaacatatgtctgcgccaccgtgggcaccacgtcttccaatgccgttgacccggtgggcgacgtcgccgattttgccgccatgttcagtgcatgggtccacgtcgatgctgcctacgctggcagtgcatgtatctgccctgagtttcgccaccatctcgacggcgtcgagcgcgtggactccattagcatgagcccacacaaatggcttctcacatgccttgattgcacatgtctctatgtccgtgatgctcaccgactgagtgactcattggagaccaacccggagtatctcaagaatgatgctaccgagtccggcgaggtcaccgatcttaaagacatgcaggtcggcgttggccggcgcttccgcgggctcaagctttgggatggtcatgcgtacctatggtaccgcaaagctccaaagagcacatccgtagtgatgttgccatggggccaagatgttttgaagattcgtccgttgcnatgacaggtttgaaattggcctaccgaggaacttgctcctgtttgctttcggtnaangcaagtggaccatgacggagaaggatctgacaagcaacncgttctaatggaaatctgaacaaaacggcaangntaacttgcaacacggtgtcgtgaaagtcctatacgttccnttggtctcctgaagagaaagatttaaatgctggaccacagaaacacgtatacaggntantgcaactacgtgcgaa

SEQ ID NO: 16879 - DNA, 608 bp, Triticum aestivum
  unsure (1)..(608): unsure at all n locations
  Clone ID: PAT_TA_16879
ccgcgagcaccaccgctcctcctccacctcgatccaaatcacacatcagctcaaaggaaggaagccgtcagccatgtccggccgcggcaagggagggaagggcctcggcaagggcggcgccaagcgccaccggaaggtgctgcgcgacaacatccagggcatcaccaagccggcgatccgccgtctggcgcggcggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtatacgcgctcaagcgacagggccgcaccctctacgggttcggcggctaggccgcgccggtccgggcaagaaggacccgtctcgcaccaccggatttgtgctagtagctacgcgttgtctgatggtggtgttcatgtcctcggtgtaatggccgcatctcgctgctgtttgccctggatttgtttgttgtttggatgtactaggatggaatggaaatcgcagcattttacccctgaaaaaaaaaataatctgtgggtcaaaaaaaaaaaaaan

SEQ ID NO: 16880 - DNA, 1964 bp, Triticum aestivum
  unsure (1)..(1964): unsure at all n locations
  Clone ID: PAT_TA_16880
gcaacaccaccaactgcacagcttgtccggtaccccgaactagcccgttcatgcccgaccacgtcagggttccgcaccaaacagtatattactggtagttggagacactcttagatcactactgcaacgcaacactatattaccacgcaagttggagcaactcttcaaacgcacaccggatgaaaagactaccacacaaaacagaaactccacaatgtgcccaaaaagcccacccgccttgaaatcttccatttgtccatcagttactctaaacacacactcggcagttttcaatgagaaaacaatttattcgagacgcaaagacggcctttagatgcccttctccagcatcgcgcggacccgggtggggaggccgtacagcctgatgaaactgtcggggtcatcccggtcgtagatctccccgttctcgaacgacgagatgtcctccctgtagagcctgtaggggcccttccgggacgcgaccgtcaccgacgccttgtgcaccttcagggtcacgtcgtcgcagcgccccgcggtaatggtgtccctgaaggcgtccatggacagccgcagcgggtcgaaccagcgccccgcgtagactagctgcgtcgtacttgagggccagcatgtccttccagctgcatcgtctcccctgtccagtgtcagggactcgagctcgccggaccgcggccgccatgatggtgccgcccggggtcccgtagactccgcggcttgacttcatccccaccagaggcggttctccaccatgtcgatgcgcccgatgccgtgctttccgccgatttcgttgagcttggtgaggagagttgctggcgagagatctttaccgttgatagaagtagggacgccagcaactatgccaatctccagatactcaggttttgaaggtgcattttctggagaaacagacatcatatacatatcttcttttggctcattcgctggatcttccaaaatgtcaccctcatggctaaggtgccacaaatttctatctcggctgtatattgatttctttgaaaccggaattggcacattgtgtttctttgcatactcaattgcatcttccacgtcctgtgatatcccactccctccagggtgccaccactttaagttccggatttaaggcataaaatgtaagctcaaagcgaacctgatcattgcccttcccagtgcacccatgagcaactgcatctgcgccaacttccttggcaacatcaaccattgccttagcaataacaggcctagccatggaagtcccaagcagatactttctttcgtaaactgcaccagcacgcaagcaggggtatatatattcaccaacaaattcttctgtcaagtccttcacaacaagctggcttgcaccgctagcttttgcctttttctccaatccttccaattcaatgtcaccctgaccaacatcagcagtgaaacagacgacttcacagccatagttctccctaagccatggaacaattactgatgtatccaagccaccgctgtaagctagaacaacttttttcagtttgccacgcagtccacctttcttttcatcaccactagtagttgctgcatgctcctttccacttgccatcacgcaactaacacctcgggccgtcgtcgtcgaggacctctccatcgacacccggccatgctgtcgccggagccgaacggagggcggcgcgggggagtcgtgcgggtgcacggctgggagggagggagcggcggcgaggcggcgcatcgggagcggcatggggggcgggcggctgggtggaagtggaaggcttgggtcagacgcggcggccacaagcgagctgccgaatgggggcggcccgggggatccactagttctagagcggccgccaccgcggtggagctccagcttttgttccctttagtgagggttaatttcgagcttggcggantcagaagagctnaacggntcnnaa

SEQ ID NO: 16881 - DNA, 989 bp, Triticum aestivum
  Clone ID: PAT_TA_16881
ccgccgcccccacaaactgcgtgggcgggtgagccatggctatggaggttctgtacccgttcttcctctgcctcgccgtgctcaccggcagagcagcctccgccccaccacactcgcagtgccacgacaacccgccggacatcacggccgccagggtcgaggcgggaaaggtcgtccatgactttgccggctacacggctctcgtaaccggcgccatccactccgaccgggccgtcgtcctggcctccgacgtctacggattcgaagcgccgttgctgaggatgaaaccagactactttgtcgtggctcgctgctttgttgtatgccccaacctttaacatgggcaccctggtacgggggtcacagatgggctcatcgcacaatcgccggtaagagcacttcccggtaaaaactgctcaagatgctaaaccaatatttgcaacctttagatcttggagttagcttagtcttggagttggaggatactgttggggtggaaagaacgcagtggagatagcgaaaatgaatgaggtgaaggcaattgtcatctcccatccttacttagtcattgttggtgacatgagagaggtcaagtgtcccattgaaatccttggaggtgaaaatgacctagctacaccacaaaagttcatatataagttcttgaatgtccttcgtaaaagaagtgataagataccttactttgggaagatctttcaaggagttgcacatggctttgcttgtaggtacaatatcaccaacccattcgaagtcaaaaccggtgaacaagctcttgccctaatggttggatggttccagaaacacctgaaatgagaaatgctaatcacaaaggtcacattgatccgacctatttagtttcatatccatgtaaatgtttccaacacaatatttatgtaattgcatatccatacactaggtacatgcacggaccatgatttgtgagtcctttgcactaaaaaaaaaaaaaaaaa

SEQ ID NO: 16882 - DNA, 449 bp, Triticum aestivum
  unsure (1)..(449): unsure at all n locations
  Clone ID: PAT_TA_16882
ataagttcctcacgccagagctccgcggacaagagagtgaccacacccgcgcgaacacgtaggcagagcgggacaagatgccaatggagaggtcggtgtcgctggctgagaggagcaccgccgccgccgcgccggccaacgacctccggtgccacagcgcctcctacgccgtctcctacgcgcccaccaaggtgcagcgcgacaggagcaccacctccctgtcccgccccgtggcggcgaccgccgtgcagcggagcggcagcacgaggaccgtctccggcgccggcgccggccccaccccggggctgaacctccggtgctacagcgcctcctacaagcctttctccgacggcaccgcccaggccaaggggcccaacgccgtcaccaccaccgnaggcacctggtcctccgccggccgccgttcccttaacctgaggagctacaccccc

SEQ ID NO: 16883 - DNA, 753 bp, Triticum aestivum
  unsure (1)..(753): unsure at all n locations
  Clone ID: PAT_TA_16883
aagcagtcatgagttcctcacgccagagctccgcggacaagagagtgaccacacccgcgcaacaagatgccaatggagaggtcggtgtcgctggccgagaggagcaccgccgccgccgccgcgccggccaacgacctccgctgccacagcgcctcctacgccgtctcctacgcgcccaccaaggtgcagcgcgccaggagcaccacctccctgtcgcgccccgcggcggcgaccgccgtgcagcggagcggcagcacgaggaccgtctccggcgccggccccggccccaccccggggctgaacctccggtgctacagcgcctcctacgccgcctcctacaagcctttctccgacggcgccgcccaggccaaggggcccaacgccgccaccaccaccgcagccacctggtcctccgccgggcgccgctccctcaacctgaggagctacaccccgtccttctccgcattggtcgacaacgaggccccggccccggccccggccaagacggatgacgcggacgcggagctgcagaggaagaagcggctggcggcctacaaggtgtacgacgtgcagggcaaggtgaaggggtcggagcgccgcaacgtcaagtggatcaaggtcaagtgctcccgcgccgtctacggatggtgatgagccggcgatccatccatccaggttgctctgcctccgactgctccccggtacgtagcgntgtgcagctgagctagtacagtagtacgcatgagcgcgcgc

SEQ ID NO: 16884 - DNA, 1074 bp, Triticum aestivum
  Clone ID: PAT_TA_16884
gcaccgacgtcacttcctcacgcccgcggtccacagacaagagaccacccccgcgcgagcaacaagatgccaagggagaggtcgctatcgctgggcgagaggagcacggccgccggcgccgcgccgcccaaccgcctcccctgccacagcgcctcctacgccgtctcctacgcgcccaccaaggtgcacgcgcgccaggagcaccacctccctgtcccgccccgcggcggcgaccgccgtgcagcggagcggcagcacgaggaccgtctccggcgccggccccggccccaccccggggctgaacctccggttgctacagcgccttctacgccctcctccgcaagcctttccccgcacggctcccgcccagccccaaggggccccaacgccgccaccaccaccgcagccacctgctcctcctcccgcccccgccgcccccaccctagaggggctacaccccccccttcctcctcattggtcgacaacgaggaggccgcccccggccccggccacgacggggaaggggcggagccggggctgcagaggaagaagcggctggtggcctacaaggtgtacgacgtgggagggcaaggtgaaggggtcggtgcggcgcagcgtcaagtggatcaaggtcaagtgctcccgcgccgtctacggctggtgatgagccggcgatccgtccatccaggttgctctgcctccgtctgctcccgggtacgacttgtgcagcatctgagctatacagtagtacagtacgtatgagcgcgcgcgtcttgatcttctttgcccttcttgcttcctcctttttctttctttttgacggaatttgatgtgtcatacatatgtacgctagtgagacctgcgcttctgctcgtgctgcccttgttggccaccgtcttgagcgccctctgaagaagctcgcctgtgttgtccttgtacatactgatcctttccttcccttgtataatcaactatgtgattatgtagaataaaatgaataaaaaataatgtcatatataaattacattaccttaatactgctacgactactaaaaaaaaaaaaaaaaaaaaaaa

SEQ ID NO: 16885 - DNA, 1091 bp, Triticum aestivum
  Clone ID: PAT_TA_16885
gtggctgcagctgcgcgcttgcgacggcatcggagatggcacctcctcggctgccttctcaggatgcctagccggcctgctcgagcttgagctccgcgcttgccgaaccgtcgccgaccgcgtcctcctcatcgccgctgaccggtgctgtgctctcaagtctctcctggtgtatgacggcggcagcagggaggccctcctccagttcatccgtcggcgcggcgccgcactgcacaccttggacctccgcctgcctctcgacctgcacaacgaccacctccttgcaatcggcgcacagcaaggctacgacacccggggcagtcttgccgtgcttcgccttcaaagctgtgtcctcgtcacgggggacgggcttcgttctctcgcgcgcacggccattggggcgggcatcaaagatgtcgccctggtgagctgcgatgtagttgaacgggagcctgggctgctcacgttcctcagccagagcatgcgtcacctccgccggcttgatctgtcttacaacgagaccctgaaggacaaggagattggagccatgctatcgtcttgccggaatctgattgacatcaggtttaggggttgccgcggcattaccggtgaatctttactctcgttgcttaggcactgtgggcagacagtggaggtcgtggacatctcccgctgccctgccattaaagtggccagtgtcgaactctttgcacagcgagccacccgtttgaatcatttggtcatcgaggtgagctcggtgtcggaggaactgaaggcgattgcacggacgaaaggcatgaaggttggcccattgccttgtgaaggatcattctgacgtatggtaaatcttcttcagatgaaactcatcgaagctggaatttaagaatcttatactgcatgttcaataaggaaagtgctttccttgtgtataataccctggtgggaatgtgtgtatgtatgtcttgttaactgtgaacttgtcatgaaaaagctcctcttgctgcctggcatgtaaattgagcagcaagaattgtgctattgtacatgtgtcaagaaataaaattggaattattacatgaaaaaaaaaaaaa

SEQ ID NO: 16886 - DNA, 988 bp, Triticum aestivum
  Clone ID: PAT_TA_16886
ccctagcccactcaccgcggcgcgactcacagggcagccgatctcgcgctccggtcggcggcggcggcggcggcgagatggtggtggtggggggcggcagcgggaatgcgtgggcgaaggagatgaccctccgccggaggatggccagcatattcaacaagacgcgggagcacttcccgtcgctgaaagactacaacgattacctggaggaggtggaggatatgacattcaacctcatcgaaggaatcgacgtcgaggcgatcgaggcgaggattgccaggtatcagcaggaaaatgctgagcagatatacttgtcgcgagctaaaagggctgaagatcttgccgcggcgcttaaagcgagcagaatggttgctgtaaaggctggccccagtgatacggctgctggaacctcccagggtattagtggtggagcaggagttcaaggccagtatgcacctgccgccgttcctggtgggttgaatcagcctcgtccgacaggtaacgccccgcagccaatcggtggttcatccgatcctctacatggatatgacgaggagaccatgcggctacgcgcggagagaggagctcgggcaggtggttggactgctgagttgggtaggcgaagagcactggaggaggcatttagcagcatattcgtataaaggttagggcgcagcaactgtcccagaggatgcatggttaacttattacgacccttataccacagcgcgtacttgtccagctataacctgttggttgtggcctacattttggacatcaagcagaagggattgaagtgtctgatcagcatcaagcggcccagtggtcgtccctttttgcgagtcgagaagttgcatattgatgtacctatgatcatgccaatgactgaaacttttgtcattgcccctctgtaatggcatgatttttgttgttcgtcaaacttcggctccttttgaaatataatatgagtgctatcagtatcattttt

SEQ ID NO: 16887 - DNA, 2037 bp, Triticum aestivum
  Clone ID: PAT_TA_16887
cccggtctgctggcaccggtccctctgtgtgttcgacccggaccccggggtcccagccattcgacgtctgagagggttgacgagttcttccgcaggaaccatccagaccactatcttggtcagcaggctgtttacaatgcaaaccggtatgctaaacttgtaaagcaaaaggagagacttcaaaactggctggattactaccagctaaagtttgaaaggcatcctgagaaaagaccaactggaaggacaggatgctttggtttctgtggtagacaagtggatcaaatcgactactaccgggctagaattagcgaacttgataagaggattgcatcagagcgtcacagagttctgaatgatccaaaagccgttatgccagtttcttttgtgacatttgactcaagatggggtgctgctgtatgtgcacagacacaacagtcaaagaatcccacacaatggctgactaactgggctcctgaaccacgtgacgtttactggcagaatcttgctattccatttttctctctgagcatacgcaagtttctcatatcaatcgcggtctttgctttggtgttcttctacatgatacctattgcatttgtgcaatcacttgccaatctcgagggtattgaaagagtcgcgcctttcttgaggccagtaatagaagtaaaggtggtgaagtccttcctacagggtttcctacccggtctgctttgaagctctttctctatatcctccctacggttcttatgatcatgtcaaaagttgaaggctatgtctctttgtcatctctggaaagaagaactgcttcgaaatattactacttcatgctggtgaatgtatttcttggaagcataattgctggcacagcttttgagcagctagattctttttttcacgatcctccttcacaaataccaaggaccattggagtggccgtaccaatgaaagcaacattcttcatgacatacataatggtcgatggctgggccggcatcgccaacgagattcttcgggtgaagccactggtcatctaccatctgaagaacatgttcatcgtgaaaaccgagcgggacagggagagggcgatggacccacgcagcatctctcttggagaaaaccttccatccctgcagttgtacttcctccttgggctcgtgtacgcggtggtcacccccattctcctccctttcataatcgtcttcttcgccttcgcttaccttgtctacaggcatcagatcatcaatgtgtacaatcaggagtacgaaagcgcggcggcgttctggcctcaggtccattcgcgcatcatagcgagcctgctcatctctcatgtgaccctctttgggctgatgagcacgatgaaagccgcctactccaccccgctgctcatcttcctgccagttgctgacaatatggttccacaagtactgcaagagtcggttcgagcccgctttccgcaagtatcctctagaggaagcgatggagaaggacaggatggagcacgcgtcggagccgagcctgaacctcaagacctacctggcaaatgcatacctgcaccccatcttccaaatgtttgagcaggaggatcagaaagaggaggccaccatagaggtgagaatcgacaaatcggagcatcagcagcagcagcagcagcagcatgtgagaagctcacactcacagtatgaggaggagacgagcgcacagacgcattaccaccatgaggagaggaccagcagccagtaccagtaccagtaccagcaccagtatcagtaccagcacgaggaaactcacatgaggagtgagcagtcgccgccacactttgtctaccaccctggagtcgagcattgatgctgcgaatttaccactccctaacttgaccttttgcctcgcattttagtgaaaatgattgcccctctagtccagtccagatgatgctgatgatttgatgtacatgccaatatgtagtcgtgtgatgataatcttatgagttgattgatttttcttctgaaaaaggagaaaccaattccctcgggtttt

SEQ ID NO: 16888 - DNA, 600 bp, Triticum aestivum
  Clone ID: PAT_TA_16888
ggtagaggcaggggacggaggtttgaaattgtgagggagaagcgaaacaaaagccccgaggggagcggggggagagagggagatagcgagagagcggagtaattgcgttttttgttggggttttcctcctgattcgggagtgggaggagagtggggggagaaatcatcctgtctctccggtgctgctcgcttttgatgcgtttcttggccgatttctgctgccgctgccgctgctagtgccttgattcggagcaggctttgctttggtttcgggttttttcgcctttcctttcgccatttgtcgccggcttttgccgctgcccaggcttcttggccgcgtcgtcccctcctcccttgaaaaatcgcggggagtctgggttcttttccaccccccgtccctcggtgcggcaccgccaaaatctgtccttggcgcctgagattggcgctgttttcggggcagggagcgtgagatttcgagagttttcttggggggatttcgaggtctcctggtgcctggtcgcgtaattcggggtttgggtggggtgtcgctttcgggcccttcccgagccaggggggttcatgcgcctggagttggcgctg

SEQ ID NO: 16889 - DNA, 767 bp, Triticum aestivum
  unsure (1)..(767): unsure at all n locations
  Clone ID: PAT_TA_16889
ccatcccagcagagagcaacacaatccaatcttctgccgtcccgtgctcgtagttggtagagtagggttttagccatggcgtggagcgccgccgccgccgtctccaggttcgccgcctccccggccgccgagatccgcctgcccttctcagcagccgccgccgcctccgtctccttcgccgggcgccgccgcttcggccccgtcgccgcgtccctcgccacctccgccaccgttcaaaaggaggctgttcagacggagaaggcgccagcagcactaggcccctactctcaggcgataaaagcaaacaatcttgtgtttgtctcgggcgttcttggcctaaatcctgagacagggaagtttgtctctgaaagcgtggaggagcaaactgagcaggttatgaagaacatgggtgaaatattgaaagcaagtggtgctagctactcatcagttgtcaagacaacaatcatgttagccgacctacaggatttcaagaacgtgaacgagatttatgctaaatattttccagcccctgcaccggcgcgctcgacctaccaagtcgcagctctgccactgaacgccaggattgagatcgagtgcattgctgccctctagttacctcgcggctgaccatcaaaaacctcaataagcgttccatgcccgttgcagctggccactactattctgtagtgcactacatgacactgtaatccaattaaggtcttgaactgcgtgtgatcaanaaaaaaaaaaaannnnnnaannannna

SEQ ID NO: 16890 - DNA, 854 bp, Triticum aestivum
  Clone ID: PAT_TA_16890
agcttctgccgtaccgcaatcatatgccgtccagtaatcgtagttcgtggaggaggattttagccatggcgtagagcgccgccgccgccgtccccagcttcgccacctccccgaccgccatgccatgttctgccgtcccgggactcgtcgctggcggcgtcgggtttgacccctggcgccgcgtgccgccgccgccctctccccacgcgccgcctccccggccgccgagatccgcctgcccttctcagcagcagccgccgcctccgtctcattcgccgggcgccgccgcttcggccccgtcgccgcgtccctcgccacctccgccaccgttcaaaaggaggctgttcaaacggagaaggcgccagcagcactaggcccctactctcagggcgataaaagcaaacaatcttgtgtttgtctcgggcgttcttggcctaaatcctgagacagggaagtttgtctctgaaagcgtggaggagcaaaccgagcaggttatgaagaacatgggtgaaatattgaaagcaagtggtgctagctactcatcagttgtcaagacaacaatcatgttagcggacctacaggatttcaagaacgtgaatgagatttacgctaaatattttccagcccctgcaccagcgcgctcgacctaccaagtcgcagctctgccactgaacgccaggattgagatcgaatgcattgctgccctctagttacctcgtggctggccaccaaaaacctcaataagcattccatgcccgttgcagctggccactactattctgtagtgcactacatgacactctaatcagaatacgtgaaataaaaatggtcaaattgagcgtacaacgaaaaaa

SEQ ID NO: 16891 - DNA, 1101 bp, Triticum aestivum
  unsure (1)..(1101): unsure at all n locations
  Clone ID: PAT_TA_16891
tcggcacgaggggcaggcttccagtctccgccaccgctcatcgcagctcgcccctccaccgccacgccacctacccttccgtcgccctcgtaggcttcactgcacgcccctgcccggctgcccctccgaccccaccccgcgctcaggacctagcaccatccgatctcccacctcccataggcgcgccgcctccgggacaccgggcggtagggcgcgagccgcgcggcaggaggaggaggagcatgaggaggcggccggggatcgccggcttgcagaacgcggcggcgactcgcgacaaattccgtcaggtcggggagaatgtggcgaaggtcaggacggatgtcatgcaggagcagctcgcgaccttcaggtcgcagctcgaagaattcgctcgcaagcataagagtgacatccgtaaaaattcggtatttagacagcagtctcatgaaatgtgtgcaaaagttggagtagatccattggcatccaataaaggagtttgggcagagctcctaggaatcggtgacttctactatgaattgggtgttcagatcgttgacatatgcatagcaacaagatcgcataatggtggtcttattgacttgctagaactccgcaaacttctctgccagaaaagaaaaactgatcttggttcattatcgtcagatgactgtttacgtgctataagtaagctgaaggtcctgggtagtggttttgaagtaattccggttgggaaagaaaaagcttgtgcgatccgttcctactgagtttaataaagattcatatggggatacttgaactagctcaggcgaaaggctatgtcaccccttgaacaagnttgagaaggacttcccatggtcaactggccgtgctatccatgcccctgtaactttgtctaaaggagggacttgctatgatcgatcccccgcgccggggtcgcaacccttgatactggcccccgggcgtccccctctgccccgccccccccggccccgcagcaacgtcatatcccgccccggctgtccgatttcctcccttctgttcatcccagcccccgccacccgggggcttctggagcttggccacaatactccggttaaaaan

SEQ ID NO: 16892 - DNA, 672 bp, Triticum aestivum
  Clone ID: PAT_TA_16892
gccggccggattacggagaatcagtagtacaacacaaagctctctatcaggaattcgatcaggatcatcgtcgtccatcagtcgagacgtacgtggttcagttcaacaggtcctcagtacgagaatgagctcctcggacgacacctgcggcaagaaggcgtcgtggccggagctggttgggaagtccatcgaggaggccaagaagatcatcatgaaggacaggccggatgtgaagatcatcgaggtcttcccggtcggcaccgccgtgaccggggacttcaggcccgaccgtgtccgcatcttcgtcgacaccgttgcggagatcccccgcattggctagcttttgttgatgccccaccgttttatgtgtgtgtgtctgtatgtgttatgttcctgaataaaccatagctagtgagtagtgaccatgtatgcatactactcctagctatgtcggtcgctctgtaagaattaaaataatcattaaacttttttatgggaaataattaaagttgatcgctggcttgcaaaaaaaaaaaaaaaagagaataaaagaaaaagaagaaaaggcccgaatgttttataaaaagaaaaaaagggcccctagggtttcttttgggcaccctaaatcagggccggggcgcttcaaaaacaaagggatcccccgggttgggg

SEQ ID NO: 16893 - DNA, 660 bp, Triticum aestivum
  unsure (1)..(660): unsure at all n locations
  Clone ID: PAT_TA_16893
cctctgcctcgccggcgctcgcgctcgtgccgcgcgcggcgtcagggaggtgacgaagatcaacacaaagctctctatcaggaattcgatcaggatcgtcgttcaccagtctgaggctcgagatacgagaatgagctcctcggacgacacctgcggcaagaaggcgtcgtggccggagctggttgggaagtccatcgaggaggccaagaagaccatcatgaaggacaggccggacgtgaagaacatcgaggtcttcccggtcggcacaccggtgaccggggacttcaggcccgaccgtgtccgcatcttcgtcgacaccgttgcggagaccccccgcattggctaactttgattgatgctccatcgtttatgtgtgtgtgtgtgttatattccagaataaaccatagctagtgagtagtggccatgtatgcatactgctcctagctatgtcggtcgatatgtaagatttaataattaagttttttatgggaaataattaaagttgatcccaaaaaaaaaaaaaaaaaaaaaacaaagaaacctaccggccgcaaacaccccaatcacgttctcagtccaccaactaacccntgagaancccttccactgctatacaanagccnacatgcctcanatnccactaannaangaccccgtcgg

SEQ ID NO: 16894 - DNA, 617 bp, Triticum aestivum
  Clone ID: PAT_TA_16894
tggagcatttaatgctctagaatattttgagttcaggtgtggcgtactgcgcctgatgtttgacgaaggagcaatgcccaatcttcagaggattaagctaggtttcaattctcacagaggagaacagtaccgtcgtttgcttgtgggcattgagcacctgtcaaacgtccacgagatttctggaataattgggtcaaccgtcggtgcagaggaatatgacttgcaagctgcagagtctgcattcaaggatgccactggcaaacatcatagtaacgtcagcataaaaagatcagatattgttgtggaagagtatggtcctctagaaaaacagcatttggtccgagggaaacacccatcgacatcaagtgaacatcctggaagtcgaaaacaagagtcccagcaagctataaagcaaaactcacataacaattctcagttgattagcaggagaagtgatggcaagaaacaagcaagtgtggagctaccgaatgacccgcgatcatcggtgcaggtgatcgtaatcaagatagtgggacattacagacaagcggtgggaagtccagtgccttcaaagtcctttcgaagctccatggggccaattcggtagcggcaaacga

SEQ ID NO: 16895 - DNA, 634 bp, Triticum aestivum
  Clone ID: PAT_TA_16895
tcggcacgaggacgacgcccgccgcctcgccatccaccacccggccctcctcgcccccatcctggagaaggtggtgctgggggtcgtgaagacgatgaagaacccgcgcagcgcggtgctcaagacctccgtcatggcctgcacggacgtcttcgcggccttcggcaacctcatctcctcggcctccgccgacgcgttcgacaagctgctgctgcagctgctgctcaaggcgtcgcaggacaagcggttcgtgtgcgaggaggccgagaaggcgatgcgcgccatggccacctccatgccgcccctgcccctgttgaggaagctcagggcctacgtccaccacgccaacctcagggtccgcgccaaggccgccgtcgccatggcgcactgcgccgccaggatggacgtggagacgatgaaggagttcggcctgccggcgctgctgcaggtggccgcggagctgctgaacgaccggctgccggaggcgcgcgaggccgcccgcagcatcgtcggctccacgcacgccgccttcttcttcttcgaggctgccgaaaaagagcaggagaagaaggagaatgagctaaaggagcaggagaaggggaagaaggagcaaaaggagcaggaggaggggaag

SEQ ID NO: 16896 - DNA, 531 bp, Triticum aestivum
  Clone ID: PAT_TA_16896
tgtgtaacatcactgctgtgcattaacgaatcgcaacatcagtcttacaaggtgctgtatacaggtaggctcgcattgtcagaggccaactccaaacaaatagacacataaataaaggatactaaacaagaaagaccgaaatactcttcactactacgtattgcgtacctattatatagaactgcaaggtttgctaccgcaccgcctgctgttcctcgtcgcatgtcaccggtgtaatagttgagctcgcgactgagaaagtgtctgcacatcttacacaccagacgagatgagatgagatcgatcgataaagctcagtatccatctttcttctttctaagtcgacttgtgcaggcaggcaggcagccttacatttacatagtaggagtagtaacgcttttcagacggtggcgttcttgccgttggcgatgttgtggtggtggtggtcgtcgtcgtccatgtacctcttccagaaccagtgctgcttccacaccttgtcggtcatctcctcgatgggcacgttcttggtct

SEQ ID NO: 16897 - DNA, 1742 bp, Triticum aestivum
  Clone ID: PAT_TA_16897
ctcgggctatgtcgccccgtgtttgcaggcccgcagcctcacattggcggggtccgggatttcggttggctgcgctcgtccgggccggtctgcaatcgtctcgactctttttttttgtttactttgtggaaaagtactagctgttcttcaccgcttcgcatcgcctgtctatcatggtgctctgcacgggttggctccccacggccgggagtccgtcgccgactgccacccatgtagacactgagatgacgattgtgaaactgaccgcgcatcttacacacacgacgagctgcgccgcgatcgatcgatagagctgactagccttctttgtcactgccgggccggctggtgccgccaggctggcgaccgtactgctcgctattaggcgtcgcatcgaaccccagatcgcccgcgacgaaggcccccgtaggtgcacaccatgaccaccaccaggatggcccacccgtggcccaggttgtccgacttgtccgtcaccttgatgcccagcaccacggcgatcgccacctgcgacaggaacatctgcacgccggcctccagcagcagcgcccgccgcccggcgcggtccacggcgtacaccgacaccagcgtggccagcacgttgacggcgcccgtgatcaccgccgagtagagcgacgcgtcgctcttgaacccgagcgtgttgaacagcacgggggcgtagaacatgatggcgttgatccccgtgaactgctggaagatctggagcagcacggcgatgaccagctgcgggcggttccggcgctggagcaggttccggaacgggtgcttcacctcctgcgcgatgcggctcgcctccacgatctcgttgaactccggctccacgttgtcggtgccgcggatccgcttgagcaccgccttgccctcctccaggtggccgcgctcgatgaggctgttgggggtgtcggtgacgaagagcgcgcccagggtgagcatcgccgccgggatgccggccagcgacagcgacagccgccagccccacgggtggatcttgctcgtgccgtagttcaccaggttcgcgaacaggatgccgatggtcacgttcagctggaacaggatgttgagcccgccgcggatcctcgtcggcgcgatctccgacaggaacaggggaacggcctggttggcgaagccgacgccgcagccgagcaggatcctgccgatgatgagcatggcgaggttctgtgcggccccgttgaagatgacgccgatgatgaaaaagacgccggcgatgagcatggtgaggcggcggccgaggcggcgggtggtgtaggaggcgaagaaggtggcggtgaggccggcgaggtagagcgacgacgtgaagagctgcaggccctggttgtcgtacttgcagtaattgctctccttgtcctggttcttccggcgcagcaccgccgggaagaactcgcgcaggaaatcgtccatcgacgtcactccgcctgagatgccgacgtcgtagccgaacatgaggccgccggtggccgccatgatgcaggagatgatgacgatgggcgtgatcttggcctcgaactccacgccggaaggcgccgacacggcgaaccctccgcccggcatcttcgcacgccggccggtcaagctacacgagggacgaaataatacaatggaggcgagacaagcagcgagtgtttctccagagagccacacgaggagaggcgaaggaaggggatggagatcccgacccggccggc

SEQ ID NO: 16898 - DNA, 741 bp, Triticum aestivum
  Clone ID: PAT_TA_16898
ccacgcgtccgcccacgcgtccgccggctgccgcgccacgagccgtggcggcggatccccaccacccgctcctcacccccctctccacgatcgccccaccggcatcggcaccgcgcgtccgcccccgcccccgccgggcgcggcgcccccatttgatcggcgattccgtgggaagtcaaatgggcacgagcgacccacttcaggggagagagagaggcgggggcagccggccgcggcgttggggagaaatggcggcggagagggacgtcgacgacctgccgcggaacgcggccaactacacggcgctcacgccgctctggttcctcgagcgcgccgcgctggcgcacccggcccgcgcgtccctcgtgcacggcgccctgcgctacacctgggccgacacctaccgccgctgccgccgcctcgcctccgccctcgcccgccgctccgtcgcccacgggagcacggtggctgtaatagctccaaatatcccagcaatttatgaagctcattttggagtccccatggctggagcagtggtcaactgtgtcaacattcgattaaatgctcccactgttgcatttctgttggagcactcgtcagctgaagttgtgatggttgaccaagaatttttctccctggcagaggattctttgaggattatagcagatcaaaagaaagttctttcaaaaagccacttgtaatagttattggtgatcatacctgtgatccttcagccctcca

SEQ ID NO: 16899 - DNA, 777 bp, Triticum aestivum
  unsure (1)..(777): unsure at all n locations
  Clone ID: PAT_TA_16899
aagtccgtcaagccggggaaaaaaccgggttgggcgcgtcccgcgaaaaggacccgcctttgcctgctcgccccataaatcacgccgccccgcccaagaccgacccaaaagactcgtcgagctcccgctactttccaacatggccatcgccgagacggcagcggtggtgacgacgacgacggcgtccgggacggcgcccatgtccccggccgcggcgaaggccggggcgacgatcgggccggcagcgaggcgcgggtggctgcgccggctcgtgccgcgggagtacctgccacggagccgccggtggaagccccgcgctggcgtcggtggcgctgcggaggccgcgggcgggggcggggtggcgggcccgtcgtcgtaccggaggctggcgtcgtcgctgtcgcggtcgctccggtggaagcggatgccggcgctgccgtccctcagcctgcgcgccgggtcggcgtcggcggcgctggacgaggtggcgttccgcgtcatgtacgtcgtggaggccgtcgtgctaggcctcgcgctctcctgcttcttcctctgctgcggctgccacatctagcctgccgctagcgctagctatgtactctgttactgtttgtttgacttgctctcggttctttggttagtaattttttcgttttcatcgatcgtctacttactctgctgtanattttccaccgtgaggaaaatccatggaaaaattcccaatctgctcaagatgatttccgtcgtttgggtaaaaaaaaaaaaaaaaaggcccct

SEQ ID NO: 16900 - DNA, 1433 bp, Triticum aestivum
  unsure (1)..(1433): unsure at all n locations
  Clone ID: PAT_TA_16900
gccggccgggtccggatgctgagcatctcaatctaaactcttcttcactttagttctccgttcagtctttctttctcgtcgccggccgacacctcaattcattttctaccaagccaactcacaatcactcaactctccttcaatcaatcaagatgaagttccaactcttcaccatcatcgctcttgtctctgccgcctctgccggcttgatcaagcgagttgacgtcgaagttcccgccatgacagacgcccagggcaacgttgtggtcttcaacgctgccgaggttcccaccaggaagcgacgagccatcgccgagcagcagaagcaacagcagcagcaaaagaagaagtactgatttaaaagactcttcgcccgggtacttggggtgattgagaatgcggtggacctcgtaatgaacagacggatggaccagacggttgcctcttcacaaagagacagaatccaacccaatccaatccgatggcttgagggatcccaagacaataatagcggttgattttttgggcttgtttagaataggatataaggttcgagaaatagaagcactgctcacttgagctattgtggaaccaaaaaaaaaaaaaaaaaagcccctannnnnnnnnnnnnnnnnnnnnnnnnnnntttccaaaaaaactgtgccgtactgcattgtacctgctctgccttaccttgctaccttgcctcgctcttgtcgtataaagctccacgctcgtctcctcttccaaaatgcggcctttctctcttgcatccatccctcgcgctactcgtatcactactcgaatcaacccgttttttactcaacctcgaaacttctcctttacacaagcaaccatgggcgttgaaaagactattatcacgcagggtagcggcccttccccccaggttggccagaaggtcaccatggagtacactggctggctccagaaggaggacggtaccaagggcgaccagttcgatacctctgtcggacgcggcgactttgttgtcaacattggcgttggccaggtcatcaagggttgggacgagggtgtcacccagatgaagcttggcgagaaggctactctccacatctcccctgactacggctacggtcctcgcggcttccccggtgccatcccccccaactctactctcatcttcgacgtcgagctcaagaagatcggttaagcgtgcccttcgtctcccgtcatctttcgatcgatctcggattatttaggctctgacgaacctgttgaaagccaacaatgtgcaccagtacctttcgaagatcaacccggtgttcctcataccccttcagacatacatcacttgggtgcaatgccaaacagacattgctatcgttacctagacggcgaaattaaaaaagcatcaaaccaaaaaaaaaaaaaaaaaaaaaccctagccccta

SEQ ID NO: 16901 - DNA, 1451 bp, Triticum aestivum
  unsure (1)..(1451): unsure at all n locations
  Clone ID: PAT_TA_16901
gcacgtgcgctcgtccgcccgccccgcccccgccgccggactggcttcccccgccgccgccgaccggcccgcggccggccgcgtccccgtccgccgcgcgttctgccgcggccgccgcgggcgcctgcgcggctccggcgccgggccggcctcccggcgcgcctccccgggcggggcggcccggcgcggccgcgccggcccgcccgccggcgccgccccccgcctcccccccccgccggccgcggccgcggccggccgccgaggcgtggggccgccccgccgcgtgcacttctcgggccgcgggttcatggtcgagacggcggcctccccgacgtaccaccgctacctcaacgcgctcgccgcccgcgcgggcgtcctcgcggtgtccgtcgagtaccgccgcgtgccggagcacccgctccccgcggcctacgacgactcgtgggcggccctcgcgtgggcggtcgccggctccgccccgggaggccccgagccgtggctcgcggcgcacggggacgcgtcccgcgtgttcctggccggcgacagcgcgggcgccaacatcgcgcacaacgtcgccctgcgcgccgccgccgaggggctcccgcgcccgtgcgcggccatcgtcggcgtgctgctggtgcacccctacttctgggacccgaccaacgccatggcgccggcgctcgaggtcaggatccgcaacgagtggcggttcatgtgcgcgcgccccgacgccggggtcgacgacccgaggttctgcccgacgtgcgccgaggcggcgccgcggctcgcggcgctgccgtgcgagagggcggcgcgggccggggcgggcgacgacttcctggcggtgaaggggcgggcgtaccacgcggcgctgctcgcgagcgggtggcgcggcgaggccgagctggtggacacgccggggcaggaccacgtgttccatctcatgcggccggggacggaggcggccgcagacatgttggaccgcgtcgcggggttcatttctcgtgcttgaactcacctgctccccgttgaagttgaaccgtgcgcggttcctgtcgtcgtgcgttagggcggctaataaatgaagcagactcgctatctcccaagagcaacggatttgaagtcttctctcgtttgctatacatctgtgctgcatccatcggcgtgcgttgaaattagtatgtttcgtgtctatgtcagtaacaatattttctttgaattttgaaaaacttgataggctcccaaaaaaaaaaaaaaaaaaaaaaaaaaaaaaaaaaaaactcgagggggggcccggtacccaattcgccctatagngagtcgtattacaattcactggccgtcgttttacaacgtcgtgactgggaaaaccctggcgttacccaacttaatcgccttgcagcaaatccccctttttgccagctggcgtaatagccnaaaaggccccg

SEQ ID NO: 16902 - DNA, 741 bp, Triticum aestivum
  Clone ID: PAT_TA_16902
attcggacgagggacacacccacccacctccctcgactttgatttagatcgggaagccccggccgcccgcctcttcctctccctcctgaccacggcgagctcccttcccactccctcacaccagatccagggcatggagccgtggtgagctccttccccaaccctcctcaccggatccagaggagagaaggtgaccacgtcctccggcgacggcgttgctccggggtgtggaggccgccgagctgcaggaggaggagctccctgccaccccaaggccccagatccagccgccacggacaaggagcccgcggccatggcgacctagcaggcaccacaggaggaggccggccatggcgacaccggatctggcatctccggggtcctctacaagtgggtcaactacggccgcgggtggcggccccgctggttcgcgctcagcgacggcgtgctctcctactacaagatccacgggcccgaccgcatcgacctctcccgcgacaccgaccgcggcgccaaggtcatcggcgaggactcgctccgccgcctcgcgcgcccctccttcgcctccgccccccactccaacggccacggccaccaccagacgccccgcaagcccctcggcgaaatccacctcaaggtgtcgaccgtcagagagagaagatcggacgacaggaggttctccatcttctcggggaccaagaggctgcacctgcgggccgagacgagggaggacagggccgc

SEQ ID NO: 16903 - DNA, 790 bp, Triticum aestivum
  Clone ID: PAT_TA_16903
gcggccgcgtcgacctaagctcagatcggcggcggagagctagggttcaggcgagattcgccacgggcctcagtcgcagctcggcggaggcaggagctggcggcggagggccagcggcacctcgaggagacgatagcctccgctttccagatcctttcctccatgaacgacgagctctgcaaccccgcgctctggtcctcctccgccaccgccaccgccgcttccgccgcttccgccgcctcccagcatccccaccaccaaaacgcagctcccccaccaccccactccgccgactccgacgctgatgccatggggggagccgcggggggctctggctggttcgctcgacgaggcgaggcaccggtacaagatcgccgtggcggctttgcgcgcgtccattgccgcggtgtcgccctctactcaaggagatggggccaacagaatccaaaggtgatcaacccgagattgagagatgggaagagcgtgcacctccttggagaaaggaaattgaaagcaaaaacaaacagctgaaactcctcatcgatcaactccgtggatctaatatcaagatatatcaatgtggcaaagcccttgctcagtgtgagttgttgccgctaatcaattcctacaagtctcaagggatctgacagtttgatggggcccaaggccaaactgcgtacggcgctctctttaattggagagtgaatgggatatgaccaaagtagatgcgatatgacctgatcactgttacaaaattgtgaaattgtgctgtattgcccttaaggatttg

SEQ ID NO: 16904 - DNA, 1122 bp, Triticum aestivum
  Clone ID: PAT_TA_16904
tcggcacgagggtcgcgtgtgccttgttcgttcatctcgctcgcccgttctcaatccctagctgccccctccctccatccaaccagaacgcacgaccgccgcccgccaccggcaacgaaaccctaagcgcagcgatgttatcagccgaggtgccacaccttcccagagtccgccatccccatgatccggccaactgcgcatacgcccccgacctatttggccccacgctccagcgtctgcacgatcctagcgagcagcaggaggatgtggcggcggcggcgggggataagcaagggatcgcctccatcttctcctgtatcgacaaacatggtgatccggcgctcaaggccgaggcttcagagccgcctattcttcactgggacgacgtctgcctatccgacagcgacgatgatttagttgaccagctcgacttggccgacttggccggcttggccctgggcgcactctgacgagcggggggaagtggtgacagacgatgaggagacaaattgctctgggaaattttttcccagggacaaagccaaactgatacagcgggtgtgggtaaggagtgacatcaaacagaacgaagaacacagagagctgtgtaagatgcttctagatctgggacatgagtggtctgcccttcctccttttcctatgaaagtattccctcaggcaacaggcgcatgcgttttgcggggctactgtcaccaccgtatatacaaaacccatgatacttccaccactagatcaactcttggataccgcgaaccaaatcggatgctacaggcattctcgctgcgtttgtcaagctctgcatcatatcctgttagtgtctatggaataatcgccgttcgggattccttggagcctctgaggaattacgtctttaatcgtccctgcagagatgatgctatcaccattgaccaggattcctttatcctacctctctgtagcccttgtcgaggaatgtacttacggcaggatgcattactagaagttgatctgtgggtaaaggaggaaggggatggatcggctgacaaacaaatactttctgcatatgctgagattgagagctgcccagcttatgatgaaatgctatatggacagattcgtagt

SEQ ID NO: 16905 - DNA, 1609 bp, Triticum aestivum
  Clone ID: PAT_TA_16905
actcggcactcgctcccctgactggaacaccaaagccgagaaaacagagacatggacagcgcgacctcgtcgtccggcgatgagcgcggcggtgtgcacgtcctgctggtgccgctgccggcgcagggccacatgaacccgatgctccagctcggccggcgcctcgtgtaccacggcctgcgccccacgctcgtcgccacgcggtacgtgctctccacgggcccgccccccggcgaccccttccgcgtggccgccttctcagacgggttcgacgacggcggcatggcctcctgcccggaccccgtcgagtactgccgcagggccgaggccgtggggtccgagacgctggcgcaggtcatcgccgccgaggcgcgcgccgggaggacgccgtccgtgatggtctacgacccacacatggcgtgggcgccgcttgtggcgcgggccgctggcgtgccgaccgccgcgttcatgtcgcagtcgtgcgccgtggacctgatctacggggaggcgtgcgcggggcgcgcgccgctgccgatggcgcacgggcgcgcgctgcattgccggggcgcggtgagcgtgtaattcgggccccaggacctgccgccgttcgtggtgtcgccggggctataccccaggtccccggacgtgtcgatccggcagttccagggccttgagcacgccggcgacgtgctcgtcaactccttccgtgacctcgaaccgcaggaggcggagtacatggagtccagatggcgcgccaagacggtcggcccgacgctgccgtccttcttcctcgacgacggccgcctgccgtcgaacaaggcctacggcgtcaacttcttcagcagcgccgcgccgtgcatgtcatggctggatcggcagcctccttgctcagtagtcctcgcatcttatgggacggtctacaacctcgacgccggtgagcttgacgagcttggaaatgggctctgcgattccggcaagccatttctctgggtcgtgaggtccaacgaggcacggaagatatctcattaaaaacttggcaggtgcgaggaaaatggattaattgtgccttggtgcccccagcttgaggttctcgcgcatcccacgcgtccgtgtttcttgactcattgcggatggaactcaacgacagaagcacttgttgccggtgtgccaatggtggcgatgccgaggtcggccgaccagccaaccacggcaaagtacgtggagagtgcatgggaaaccggcgtgcgaatgcggacagatgagaaaggcttggtgaggagggaggaggtagagaggtgcatcaggaaggtgatggatgaggagggaaaggttgaataccgcaaaaatgcgacaaaatggatgaggatggccaaagaggcaatgcagaaaggagggagttccgacaagaatattgctgaatttgcggctaagtatttatcatgatgaatttaggtccaattatccacaaccactcaatagtcatcgcatactatgtatgcacatgttgatagagtattatttctcttcaccaatgtcaacgcattcaccgagaagcctatagctaagctcaagttttcttgtatgagtgaccttaacacaaattcgtttt

SEQ ID NO: 16906 - DNA, 711 bp, Triticum aestivum
  unsure (1)..(711): unsure at all n locations
  Clone ID: PAT_TA_16906
acagacccgcgcgtggcgatcccttcccccgcgcgactccacctaccgtcctcctgccgccggtcggcggctctcaccaacctccaatccgttgacaggtctacggcggcatgccggtggcgggggcgccttctccccgtggccgctgctccgctccgcctccgcgccgtgcatgccgcggccgctgcgcggcagccgttcgacaacgggtccggcgtcattgaagcggagggggaggaggacgacgacgacgagcatccgcgcctgaagatcgccatcgtggggttcggcaacttcgggcagttcctggcgcggacgctggtgcggcaggggcacacggtgctggcgcactcccgctccgaccactcggccgccgcggcggacctcggcgcgtccttctacgccgacccgcacgacctctgcgactgccagcccgccgtggtcctcctggccacctccatcctctccaccgaggccgtgctccgctcgctccccgtccaccgcttccgccgcagcacgctcttcgccgacgtgctctccgtcaaggagttccccaggaagcagctcctgagccgcctccccgaggacttcgacatcatctgcacgcaccccatgtccggcccggagtcggcgcgcgacngctgggccggcctcccgttcgtgttcgacggggtccgcgtcggcgactccccggcccgccgtgcgcgcgcc

SEQ ID NO: 16907 - DNA, 437 bp, Triticum aestivum
  Clone ID: PAT_TA_16907
aatccacgcgtccgaaagaaaatggcggccacaagagcagcagtgatgaagttggcgatcgtcctcctggcgatgagccagctcgtccacatggcgacgccaacggcggatccaatgactactacatcatcgtccctactggtcacgagcgtttccggcccttctagcgggggagtcaatcctcaacccagtcatggcatcagggaagagaaggtgctgctcgatgcggccaagcccagcatccctgttccgccccctccccacctcatcctaccgtgcaagggaagagcctgttgacctcaaggccggggacggtcaaagtcaagtgcagctggagctccaagtgccgagagcaatagaatgcccccagcttcctctgtattgtactcgatcgtttatgatcgactcatggaataaaataagcgcaaccttgtttt

SEQ ID NO: 16908 - DNA, 560 bp, Triticum aestivum
  Clone ID: PAT_TA_16908
gccgctcgagggccggccgggtccgggggcagttgaacaaccgagaaggaaaatggcgggcacaaaagcagcagtgatgaagctggcggtcgtcctcctggccatgagccagctcgtccacatggcgacgccaacggccgatccaacgactgcatcgtctctgctggttaccagcgtttccccttctgggggagtcatttctaaacccagccatggcatcagggaagagaaggtgctgctcgatgcggccaagcccagcatccctgttccgcctcctccccacctcatcctaccatgcaagggaagagggtgctaacctcaccgcacgtggagcaccaagtgaagtgcagctggagctcgaagtgacgaaagcaataaaaatgtccctagcttcctctgtattgtagtactcgatcgttatgatcgactgatggaataaaataagagcaaccttgtttatatttcgttcgcctgtaacaggtgttcaaattgtggatttgaaactactaaaccagtttccagacctgaaaaaagaaaaaaaaaaaaaaaaaaggccccta

SEQ ID NO: 16909 - DNA, 643 bp, Triticum aestivum
  Clone ID: PAT_TA_16909
aagagtcaaccgagaaggaaaaggccgggcacaagagcagcagcgatgaagctggcggtcgtcctcctggccatgagccagctcgtccacatggcgaccccaacggcggatccaaggacatactgcgacctcatcggtacctgctacgaccgtatcgggcccgtccgttgggaaccattcccccacccagggaatcagggaggagaaggtgtatgtcaacaggcccaacatcgccctccgttccgccccctccccccccagccctaccctgcatgggaagagcgtgttgatcccacgcagaggatgacgagaccaaatgcacgcaaagggacgcacgtgtgccaagacaataaaaacccaagttgttctaaataattcatgtgctccttgtttacgatctattgatggactagatagacagaaccttgttttggaacaagataaaataaaacttgatatttgaagaaaaaatgaagtaactaatatattacctcgcctggaaaaggtggtcaaagtgtggaagtgaaagtacctcacaaatttctggacctgccaaattacttgtcaagtttatgagctcgaataaacattatattccaaaaaatggcaataaaaaatatttgcctgctttacgtgttcgaaa

SEQ ID NO: 16910 - DNA, 582 bp, Triticum aestivum
  Clone ID: PAT_TA_16910
cgtccgcccacgcgtccgcttcatccccccgcgccgccgctccactcccccgcaaaaccctcgccgccgccggccgcccactccgccgcaccgtcgtccccaggtaaggaggagcgagatggtgaagcacaacaacgtcatccccaacggccacttcaagaagcactggcagaactatgtcaagacgtggttcaaccagcccgcccgcaagcagaggcgccgcatcgctcgccagaagaaggctgtgaagatcttcccccgtcctacctctggacctcttcgccccattgtgcaatgccagacccgcaagtacaacatgaaggccagggctggcaggggatttacccttgaggagcttaagtccgctggcatcccaaagaagctcgctccgaccattggcatttctgtggaccaccgccgcaggaacaggtcgcttgagggtatgcagtccaatatccagaggcttaagacctacaaggccaagcttgttatcttccaaggcgtgctcgcaaggtcaaggctggtgactctccctcggaggagcttgcccacgcccacaggtccagggcgactacatgccca

SEQ ID NO: 16911 - DNA, 1024 bp, Triticum aestivum
  Clone ID: PAT_TA_16911
cgtccgctgcaggaaaacacaccttcactcccccgcaaaaccctagcctttcccccgcggacgcgtgcctcttcgtcctcccgtccgccgcagtgcaggtaagaaggggtcgaaatggtgaagcacaacaatgttatccctaacggccacttcaagaagcattggcagaactatgtcaagacctggttcaaccagcctgcccgcaagcagaggcgccgcattgctcgtcaaaagaaggctgtgaagatcttccctcgcccaacatctggtcctcttcgtcccatcgtgcaatgccagactcggaagtacaacatgaaggcaagggctgggagaggctttacccttgaggagctgaagtcagcgggcatcccgaagaagctagctcctaccattggcatttctgtggaccaccgccgtaaaaaccggtcacttgagggtatgcagtctaacattcagagactcaagacttacaaggccaagctggttatcttcccaaggcgtgctcgcaaggttaaggctggtgattctacccctgaggaacttgccacagccacccaggtccagggtgactacatgcctattactcgtggtgagaagcgctcggttgagctcatgaaggtcaccgaggagatgaaggcgttcaaggcctacggcaagctacgtgtcgagaggatgaaccagcgccagcttggcgcccgcacgaagaaagccgccgaggcagagaaggaagaaaagaagtgataagatatgttgtttcattctgcagctagtgaatgttatcatcgggaacttgttctaaattttgttttggggctggaaatagagaccagccgatggctttgatacctggtacttgtttgcatgatatgctgttcagtgttacccttgttggcataattcgtggaggtcaaccagtattattctctgatttaaaaaaaaaaaaaaaaaaaaaaaaggaaaaaaaaaatgaaaaaaaaataattaaaaaaaaaaaaaataaaacgaaatagatgttatatagtgt

SEQ ID NO: 16912 - DNA, 1249 bp, Triticum aestivum
  Clone ID: PAT_TA_16912
ccgccgcgccgccgctccactccccccccccgccacaccccctcccccgccgcgcgccgccgccgcaccgtcgtctccaggtaaggaggaggagaggagggcgagatggtgaagcacaacaacgtaatcccaaaccaagacgtacaggcagcactgccaggagacatgtcaagacgtggttcaaccgcacgcagccgcaagcagaggcgtcgccacgctcgccagatgaaggccgtcccgagcttcccccgccctacctctgcacctcctcgccccattggccagagccgccaggcaaagatgcaggacgagggccgggagcaggcataaggcttgaccaacgaaagaccttatgtccgcctgcaacacacagtacctaggcttggcccaactggcaagcctcgcaaccagagccgcccaatcgcacggtaggaagagggctgtgaacatccagccacgcagagcttcaagccccatagtcgctatctcccatgatagcgccctgcgcgtacaacacgaaggccagggcttggcagggcatttacccgtgtgggagcttcagtccgctgcacatcccaaagaaggctactctccggcgccattggcattcctgtggcgccaccgccggaagaacaggtcgcttgagggttatgcagtccaaacatccaagaggctcaagacctacaaaggcgcaagcttgtcactcttcccaaagggcgtgctcgcaagggtcaaggctggtgactctactccggaggagcttgccaatggccacacaggtccagggcgactacatgcccattgcccgtggcgagaagcgctcagtcgaggtcatgaaggtcacagaggagatgaaggagttcaaggcctatggcaagctccgcgtcgagaggatgaaccagcgccagttgggagccaggcagaagaaggctgccgaggcggagaaggaggagaagaagtgatgagatatgcttaaggcagctagtgggttctgttgttatcaagtgctagtttctaaatttgtgttttggccttctcggacatcttgtttgatacctgatatacttatttgcatgatctgctatcaaatcttatcctatgagtgtccttggatttttatccttgtatctctgatcagtttctgtgtatgattgcctgtgttttggggttaatgctatgttaagcttgctcctgagaaatcaaataaatcgaatgtagctcatatgataatgaaattgatgcatggcag

SEQ ID NO: 16913 - DNA, 577 bp, Triticum aestivum
  Clone ID: PAT_TA_16913
gcaccgcgcacacacgccttttccccattccctcggccccgcgccttccagatcccactccttccgtccccatggccttctcgcgccttctcccctcccgccgcctcctctccgccctcctccacaccccgaccccgatccccgccgcgcgcgtcaccggcgccgccgccgccaccgccaccctgtccgcccacaccctccatcccgcgcgcttcttctccgcgacgaggcggctcgggccgggcgccccgcggcagcgtgcggcggacatcggcgcgcgggcgcggcagctgcagagccggcgcctctggacctacgcgctcaccttcggctgcgcggccgggttcgtggtcaccgtgctcgccacgttccaggaccagctcgtcttctacctcacccccaccgacgcgctcgcgcgcttcgccaccgacccctccaagacccgctgccggctcggcgggctcgtcctcgagggctccgtcgcccatccctcttcctcctcctccgagatcgagttcgtcgtcaccgacctcgtcaccgacgtcctcgtccgctacgagggcgccctccccgacct

SEQ ID NO: 16914 - DNA, 673 bp, Triticum aestivum
  Clone ID: PAT_TA_16914
ctcgtgccgaattcggcacgaggccggcacgagctagaggcaagcacacacagaagcacgcacgcgaaccgtgcgaatggctgacacggcctccgccccgctcctaacaagccacaaaacaaggccggccaaggcgccgtcgatcgatgacaccatcgagacgtacatgggcgccaccggcgccctgcagctcctcaaggccgtcttgctggccttcgcgtgggccttcgacgcgcagcaggtgttcatctcggtgttcaccgacgccgagccgcagtggcactgcaccggcgccgacgcgtcctgctcggccgccgcggcctctccgtgcgcgctcccgtccggcgcgtgggcgtgggaccgccctgccgtgacgtcggtggtctccggagtggtcactcaagtgcgccggcccggcgctcgtctccctcccggcgtcctcgttctttgccggctgcctcgccggcggcttcctcctcacaacgctcgccgactcgctcctgggccgcaggaagatgctgctcgtgtccattgtgtccatgtccgtccctggggtgctcgccgcgttctccccgagacgtgtgggtgtacgccgccctgcgtttcatgtccgggttcggcaggcctgggggtcgcccccgcacgctggtcctctccacggagctcgtcggca

SEQ ID NO: 16915 - DNA, 908 bp, Triticum aestivum
  unsure (1)..(908): unsure at all n locations
  Clone ID: PAT_TA_16915
acatcgctaatgtgaatttctcaggaaatggtcacacacagagccctancatcaacggtgatgcagaggccgcagttaatcctaacatagaatctgtcaaatcattcttcaaggaaaggcttgatgtggactcgaaagaggaaagcagggcattcttaacgtttgtcatcccccatgagaaagaaccacttctgacgaggttctttggggaactccaagacagagaaagggaatttgggatatcagacattcaactcggtctcacgacacttgaagaagtcttcctgaacattgcaaagcaagccgagctggagagctctaccgccgaggggacactagtgactcttaacctgtcatccggagcatcaattcagatacccaaggggcgcgtttcgtgggcattcctggaaccgagacggaggagcatccgagaggagtcatggtggaggtgttctgggaccaggatgacagcggaacgctctgcgtctctggccactctgatgaaacccctgtgccggcaaatgtggagctgacaaggcctccttcactttcgcgcagggggtcggtcggccgcggaggccctgtagggtacgtcattgacgaaaaccaggtccccacagcaagatgatgagcttgaacgcaggaggtcgatcgattttcgtgtgaactatctcaggggtggttgtaagtatagaaaggctggtaatgtacattatgtttgtactagagcattgtggtatcctgtttgccgtggttaattaatggcttggtaattaatagatggaagatgatgtcgtttttgtcttgtggcaagtgtgatgaccccggttgtaacgtcggttgaaaagtgcggtttcgtttacaacgagttccatttctaaaaaaatgtttacaacgagtaaaaccac

SEQ ID NO: 16916 - DNA, 879 bp, Triticum aestivum
  unsure (1)..(879): unsure at all n locations
  Clone ID: PAT_TA_16916
gtgccaaggaagacggagaggacctccagcgaggagtcgccgtccgtctgcccgcaccaaggctccggccggcggcggggcagcctccaccgcacagcgtcacctccgaatacatcgagatgcccccatccccgtggaacggcgcgcctaggaacaagccccggatcaatcggagcagcaatggaccagcacaaggagctggaggtggatgtggagggagagccgacggagcagcgcaatgaggaggaggtggccggcaagcctgaagaatcagcgggtcagcgcaaggaggaggaggaggagcgggaggagggagacagtctcagagagccaacggatcagagcaaggaggaagagaaggaggacaagtctgaagagctgacggaacagcacaaggcggaggcggtggcggttgcggtggtggtggcggagctggacaagcctgaagagctcaccgaccagcgcaaggaggaggcgggggcggttgcggtggacaagtctgaagagctcaccgaccagcgcaaggaggaggcgggggcggttgcggtggacaagtctgaagagctcaccgaccagcgcaaggaggaggcaggggaggagaaggacaaggagacggagaggagctccggcgaggagtcgccgtcgcttttcatgcacccgtgctcgctgctgctgcggtacctcggccgtgcctacgcgtggtgcatgggcctggccgactggttcggcggcggcacaaggccgagcgccgctcctgccgcatctcttaactcgtcacgggaagaagcaggcgaggcggcggacatcggtaccagggagatctccaagaccacctctggcagagggttctacatngcgggaggtgatcatgcgcgtgag

SEQ ID NO: 16917 - DNA, 542 bp, Triticum aestivum
  Clone ID: PAT_TA_16917
tcggcacgaggtacgacgacaaggtcagcggcatcgcgctcctgcactcgtacttctggggaaaccccccggtcggcggggagctcacggacgccgccatccgcggcggcattgaccaggtatggcatgtcgcctgcggcggtaagctcggcctcgaccacccgtacatcaaccccggggcgtcgccggaggagttgagccagctcgggtgcgaccgtgtgctggtcgccacggcggaacactgctggttcgtggagaggtcgcgcgcctacgcggcgggcgtcaaggcgtgcgggtggggcggcgagctcgagttctacgagaccaagggcgacgggcatgtctacttcttgctcaagcccgactgcgacaacgccgccaaggagctcgccgtcgtggccgacttcgtcaggcgctgttgagtctgttttctctagttcgccggcgaatgattcagtaacagaggctggggatcaaaaaatcttgccctttattttcatggttctgaattcacaaaataagtgtgtttctgagttctgatt

SEQ ID NO: 16918 - DNA, 1231 bp, Triticum aestivum
  unsure (1)..(1231): unsure at all n locations
  Clone ID: PAT_TA_16918
cggcacgagcgggtcctagcctccttccccccgacctccttcccccttccttgcgcgtcgccgggctgccatgaccctgccgccgcagcaccccaccccaccattacctgccgccgcccaccaccacctaccgggatctggcccgcaaccacggtatcgatcccgaccaccatggctccccaccacaccaccacctccacctcccgtcccgcacacccaaaaatccggccactatcgccccgcctcctcctcctgctgcccggcgcggccctcctcccacccgccgcccccccgcctcctcctcccgcccggcaaggccccgcctcatcctcctcccgcctggcgcggccctccttccacctggcgccgcaccgcctcctcctcccggccggcgcacctccgtcccgcaatgccgcccaggcgatggccccggccccgctccactccagccacggcagttttttctactactgtgtgtgtgtgtgtgtgcagtccaccggccccctcctctgcttcagatcccgtgcaaccttccgatgcagttcgtcacaccaaccccctgcagctctctcctccccaatccatggatcccgcgccggatccgggttcttccctcgtgcatcgtactcttctcacacggatcgagagagtttgaggtgtgccacccccatcgtggtcctgcctacttctcctccttccctgctacaccaacagggtgttgggcacaggatctgcctcccccctatttgcagctcctttgtttcttttttgcagcttgctgagcattattttgaagttcagcaagatccatgtgcgccggatcatgcattgccgaaccccctgcatgcctcctcgcacgcgaggtgctacggtgtgtagggaggcgtctacaccagcgtcggggcccgttccaccaaggtgagttgctaccacacgcggctccacgccgccctccctccactcctctccacggcagcaagcaatcccccctgagcaatgcgttgcagctcaagacgctctaactatgcactgtttgcttgtgtttcctgatagatgcaagtgaaatcaagggagaaaagctcgtantttttgatngntcaaanctnatgattccttttaagnaatatagtanaattgagcctgtgccaactccnacatacacaaggccancgattccattacagcgttgattttaaaaaagnatacttgtgtttcccgtccgttttggcgg

SEQ ID NO: 16919 - DNA, 661 bp, Triticum aestivum
  unsure (1)..(661): unsure at all n locations
  Clone ID: PAT_TA_16919
ggccggccggccgggaagaagaaccacacatcaaacttcagacccacacacacaccagagcaagaacaagcttcttcgcctgcctcatcgatcgaaacacagcgggatcatcgtctcgatcaggaccagcctcggccgtaccttatacctcatgggttcgtccacgacgcgcgttctcctcgcggtggctctcgccatccttctaacgtcgacgtcccatgtcgctgatgccgcaaggcccgcgccggcggcggaccaggcgcagctgctcgacggcggcgtcgtccaggcggtgacgctggcggacaaggcgaggcatacggtggagctgctcatggccaggttgccggccggtcccagccccaagggacccggccactagatagacgagaaaatgacttctcctgtgattccgttcttttgttcatgtttcttttctggggaaaagagaccctgattctttctactttattacagattcatttttgagggggaaaaactttcttctctgttgttacatgtattatactgtaccggtactgttgatgtgagatagtagtgaactaatcaatacaaagatcaataattacaattctttaatatcacaaataaaaaaaaaaaaggcccctagattcatgaactggttcaacnnnnnnnnnng

SEQ ID NO: 16920 - DNA, 1118 bp, Triticum aestivum
  Clone ID: PAT_TA_16920
cccgcgcgtccagcaaacgctgctccaagcagcggcttcaccgaccggcagcaatggcgaggacgaccaacgggtgggcacgaggggtggtggcgttcgcggcggtggcagtcgcggtatcagcggggcggcggtacagttgggatgtggaggcggcggtcgcggtgttcaggcgcgggaggggtgcgctggggccctgggcggcacccgctcacgtcgccgcccacgcgctcacgctcgcgctatgcccaccctacgccatcttcttcgagggcgccgctgcgctcttcttcgggttcctccctggcgttgtttgcgtcttctgcgccaaaatccttggcgcgtcgctctccttctggatcggcagggcaattttcaaatattttacttcagcaatggaatggttacaaagaaataagtacttccatgttgtggttaaaggtgttgagaaggatggctggaaatttgtgttactcgctagattctctcctcttccttcatacatcatcaactacgctctatctgccactgatgttgaatttttcagagattttctccttcctacaattgttggctgctttaccaatgatcctacagaatgtttccattgtaagccttgctgatgcagcggtggcctctactacaggatctaagaaatctcatatctattcttatttgttcccaatatttggaattgtgtccagcattctcatttctttgaggattaagcaatactcttctgcccttgcaattccggaagagcttacaaacccacccactaatggaaacatcaatgaagatacctcttctgagaaaactacgaaaagaagatgattgttcaagcagtagtcagatttgagcctttgttgttttccgagaattattgtaaggtaatacttgatggaagctactgtagatgttaaaccagagttagaggtgatgtggtggtttgcggttgtcttgttgaagtgcatccacttgtactgaatctgacaccatattgtaaaatttagacatgctctctggatcaactttgtttgctgttgtaagtagaacattctgtggcattctctatgagcagttacttacatccacaatccaaagcaaattcttaagtg

SEQ ID NO: 16921 - DNA, 1008 bp, Triticum aestivum
  Clone ID: PAT_TA_16921
attcggcaacgaggacaacgctctcactgtggagtggacgatggccgagctacttcggcacccggccgtcatgtcaaaggttcgcgccaagctgcaggaagtggtcggtgcagagcagtatcccgacgaatctaacatcagcaggctgccgtatctccaggccgtgctgatggagagcatgcgtctacacccgccaagcccgctcctgataccgcaccaggccatggctgaaggcgcggaggtcgggggcttcgtggtgcccaagggcgccatggtgatcgtcaacctgtgggccatcatgcgtgacccggcgacgtggacgcagcccgaggagttcatgccggagaggttcatcggggcggacatggacttccggggcaaggaccggttcgagttcatgccgttcggggcggggcgaagggcctgccctgggatgcccatggcgacaagggttgtgaccctcatcctcgcgtccctgctgcacaggtttgagtggaggctgcccgaggggatgcagccctgcgacgtggatgttcgggaccggtataggatgtctctcaacatggtcacgccaatcaaggccgtgccactgccattggttctcgtgatggattgttatccttgattgtccgtgtagatgtagcacgcgtgcactgttagtttacgtatgtggtatcagcagtttgtgttggaatgaacaagggagacgttcagatcacaagtgtagtagtaatgaataggtaagtgatgataatgaataaatgtacaagtgctttgtgtaaactatcaagcattgaagttaaagaacagctgtggtgtcgtcgctctaaaggaaggagcggtgctggaagcttcatcgccagaagaacaattgtgggctttcttctggaattggaagttgaaggaggtaccgaaggtacgcttgttgtgttggaaggttgtactggaagtcatgtcctggtattcaacggttattttcttcacacaaatccactattcaatgctcaa

SEQ ID NO: 16922 - DNA, 1744 bp, Triticum aestivum
  Clone ID: PAT_TA_16922
cgacccacgcgtccgctcctccgaaaattcacgcgcgctcagcaccggcgacgacgcagacgacgacgaagacgaggaggaggaaggcagaaccgcaggggcatacgcgtggattcgcgagccgcgggaaccccgatcctaactcatagccggtgggttgagggcgaggtcgagcgggacgcggcgagggggggagggcggcgccgcggaggagtggggcgcggctcgcggccttcctcgcgctgctgctgcatctcgcggcggtgatcgaggggaagagcttctacgacgtgctgcaagtccccaagggcgcgtcggaggatcagatcaagaggtcgtatcgcaagctcgcgctcaagtaccaccccgacaagaaccccgataatgaggaggccaccaagcgattcgccgagatcaataatgcgtacgaggtcttgacggatcaggagaagaggaagatctatgaccggtatggcgaggaggggctgaagcagttccaaagcgggagaggaggcggtggcggtgggatgaacatgcaggacatcttcagcagcttttttggaggaggaggtggtggtatggaagaggaggaagaacagatcataaaaggtgatgatgtgattgttgaactggatgcttcactagaggacctgtacatgggtggttcattaaaggtttggagagaaaaaaacatcataaaaccagcaccaggaaagagacgatgcaactgcaggaatgaagtttaccaccgtcaaattggtcctggaatgtatcaacaaatgaccgagcaggtctgcgaccagtgtccaaatgtgaagtatgtacgagaaggtgattttttaactgttgatattgagaagggtatgcaagatggacaggaggtttcatttttcgaggaaggagagcctaagattgatggagaacctggagacttgaagttcaggattaggacagcaccacatgaccgcttcagaagagaaggcaatgacctgcatgcaacagttacaatctccctgctccaagctctggttggatttgagaagaacctcaagcatcttgacaaccatcttgtccaaatcggctcccagggtgtcactaagcccaaggaggtaaggaaattcaaaggagagggcatgccattgcaccaaagcaacaagaaaggcgatctgtatgtgacgttcgaggtgttgttcccgaaaaccctgacggacgaccagaaggccaagctgaaggaggttcttgcataagaactgcccatttttcactttgtgctgcagctagttgtttgaggtgtacctcaaggaaattttccaagtagcttgcataggaagaagcaccaatggtgttgcctttctggtgggtgtatgtgattttccgttggtaatattagcagctcattttttcagctccttttccgttttgatgctctttaacagatctgtagtattagaaagtcaaaatgaacttgcaccagaatatttgtactcctggaatacagtgtctatagaattgtagcttatactcaccaaattatttgctgattttacaactcacttgggcgggctttaatgtgtactgagactagccacaacgggtatgggtagtaacatagagtagtaacatgctcatgttactactttatgttactacctctatagtggggagtaacatatgtgtggtaacatgcaatactttatttattatgctatagaccaaccgcgcacctgcccgggcggccgctcga

SEQ ID NO: 16923 - DNA, 870 bp, Triticum aestivum
  unsure (1)..(870): unsure at all n locations
  Clone ID: PAT_TA_16923
tcggcacgaggacgtgccggggcctgcagctgctcatccgccacttctccctgtgcaagagccgcgccagctgcccccggtgccagcgaatgtggcagctgctccgcctccacgccgcgctctgccgcctcccccacggccgctgcaacacccctctctgcacgcagttcaagctcaaggagcagcagaaggaggcggtgtcggcgaaggccggcgacggcagcgacggcaggtgggcgcttcttgtgaagaaggtgaaggctgtcagtgtcatgtcttctctcggcaagagaagcccacctccgtgccagtgctgagtaaacggaatgtatgttagcgaggatcccctctctagggttgtgcttcaagcgcggcgagcgttgggggcgtgatcacacgtgctctaccacggtctagctccatgtcgtggaggaactgctggagctcttaggcatcgacgcggtgttcgacgaccagccagccgccatcgcccacaaccgctgtctgtgacgcggcgatgtccatctcccggcaagctttcaccggcggtgtctccgtcgcgtggatttctgctgcacccgtggttgcaaggccacgaaatccccatcctgggtgggattccggctagttcactctttcgtcgattaacaactcgctgtagagcttgtggcatcctccctctgcttcaactggggcgcgtgaaattgcaagcggagcgggatcacatgttacttaattagagaatgttataaccgaacctcctatattattttanaggangatatggcaanatactttttagaggacatattgcccctcctaagatcgcgggcgggggcccggtacctgcccgcctatatgatcctatan

SEQ ID NO: 16924 - DNA, 907 bp, Triticum aestivum
  unsure (1)..(907): unsure at all n locations
  Clone ID: PAT_TA_16924
cgtccggggagctaattttagagaccttccgggagtcatagttggtcctgacaatgtggctaaactggatccaacaaaggaaagagtacttttaccatctggtcgtcctctggtgcttgattgtgtactgacatacgaggatggtagatgcttaagaccttttggtcgactatggtgggatgaggtagtcggaactgtgctgacgtgtccaaatatttgtatgcaggccttgatacatcctgcgcaggacagactgctcactgttcgtgaaagtgctcgattgcaaggttttcctgatagctacaggtttcgtggaacagtcaaagacaggtatcgccagattggaaatgctgtggccgtacccgttggccgtgcacttgggtatgccttggccatggccaacctgaacaagactggaaatgatcccctcatggagctaccacccaagtttgcattctctcatatagaaggcactccttagtcagactggcaaaacctaacggttgacttttccacctgggtttaagtctcgtcatctccgttcattctccgctagaaaagctgggtacctcatggtcgtgaatatcattaggactcgtgaatatcgttagggcatgcgcattttaacataagtcttgattcattttattgccatgttgtaccttgtaacatcttagtttcttagaagttcccgtaggcaggtgtaagttgctcagtatggtttctcctgtgagaaccttgtgttgtactgtaaaagaatgtaggtatcataactttgtcacatacatttgttagaagctcacatgggcaggtgtaggtggctgcagtggagctcctctgcctttgttgtactataaacgacagtatgtatgtatgtatgtatgtatgtctagccagggncagggga

SEQ ID NO: 16925 - DNA, 803 bp, Triticum aestivum
  Clone ID: PAT_TA_16925
cccaaggatctccttgtccttcgtcttcgctccacaacaccacaaccgatactagtaagtaagaaaataatggctccggtgaaggtgtacgggctgcccatgaacggaagcgtggcgcgcgttctggcatgcctagaggaagtgggagccgagtatgaggtcgtggccgtcgacctacacaccggcgagcacaagaggctgccacatcttgctcgtaatcccttcggccaggtccccgcgttccaggatggagacctggtcctctttgaatcacggggcaatctcaaagtatatactccgggaaaggatcaccagatttactgagggaaaacaacctctctgagtccgcaatggttgatgtgtggcttgacgtcgaatcccagaaatttgacagcgtcatgctgccaatcatctttcaaggtctcgtcatcccggtttacatgggtgggactagcgatctcaaagttcttgaagaaaacctagagaaactgaaggaaatcatggaagtctatgaggaacgcttgtccaagtacaagtacttggcaggagatttcattagcttagcggacattagtcatttcccaatggttcacctattgcatgaaactccctatgcggcggtgcttgattcatatccacatgtgaaagcatggattgctggcgtaatggatcggcctactgtgaagaaggtcatggggcttatgaagacatttggttgacaaataactatatggtaatttgtgtgcattaaagatgaatgttgttggaaacatgatgtggttgtggtttcaaatactatgatt

SEQ ID NO: 16926 - DNA, 1147 bp, Triticum aestivum
  Clone ID: PAT_TA_16926
gaacccggcggctacctccttcccctggctccgaaccctagtcctccccttcgccattttgtgtatcgaatcaagcttgtatcccagataattgccacagcttaatagatccgcgagcagtacctatcagggaagccctagacggagccagagcccgacggatcaagatccccggcccccgcccccagcgccgcccgctgaagcgtagccaaccgaaaatctcttgcccctgcttcgccctgcccatccgacgctgggatgcagaaccctagcagcaatcaccctgccccggccgcggcggcggcggggaaatccaagtcctcggggcaggccgcggcaacggcctcgggccagggccatcagccctccccaaccacgcctgcggctgccaagtccaagtcctcggccgcggcaggggcctcgggccacggccacaactcctccccggccacgccggcggccggcaagtccaaggtctcggcgcatgccgtggcaccgggccaggcgtcctcctccaaccaaccccacgccgtcggcggcgctgacgcagccgcatcgagccttaagcgcaagcgcggcgtcttccagaaggacctgcagcacatgatgtatgggtttggggacgatccaaatccacttccagaaacagttgcacttgtagaggacattgttgtggaatatgttactgacctcgtccacaaggctcagaatgtggcttcaaagagggggaagctcttgacagaggattttctttaccttatccgaaaggatatgcggaaactgcaccgcgctaccgagctactctccatgaatgaagagctcaagcaagcaaggaaagcttttgatgtgaatgaagaaacactagtagtaaccaatgagtgatatatgcgtccttgagcagcatcggagactaccatgttatctgcaatatttcactaactggtcagacaatgcatattgctccagttggatgctcactggcatccatttgtatatggagtactattaccatgcgacacatgtggtaagcaatccaaactattcaaaaaagaagaacaggaaggagaagagtttgtttcctgtcaagttggcgtcatgtagcactttccactgtgatgaatggatgcttgtacgctttgctcaaaaa

SEQ ID NO: 16927 - DNA, 929 bp, Triticum aestivum
  Clone ID: PAT_TA_16927
gcaactccatcgacaactccaagctgtccagggcgtccaagagattctccccgggaagcgcccgggtcgcccggaagcccagcgcggccgagaccggaggcatgtcgtcgtcgcgccggagcctgagcccgctgttcgacccggagctcctcgcgtccatcgagcgcgagctgtcggaggaaggcgcgcacatcaagcgggtgattggatccgagaagcccaagcagccgaaggtgattccggcgatcgtggcggagggcaagtgcccgcccggcggcgcggacgcggtcgtgctctacaccaccaccctccgcggcatccgcaagacgttcgaggagtgcaacgcggtgcgcgccgcgatcgaggcccacgacgtgaaggtcatcgagcgggacgtgtccatggactcgggctaccgggaggagctgcggctgctgtctgggtgggcgggagctgcgcgtgcccgccgtgttcgtccggggcaagcacgtgggcggcgcggccgaggtgactgaggatggaggaggaggggaagctcaaggccctgctccaggggctgccgcgggcgcgggtctggtgcgcgggatgcgccggcgtgaggttcgtcatgtgcagggactgcaacggcagccgcaaggtgcgcgtcgacggcgagcggaaggagatggtccagtgcggtgagtgcaacgagaacggcctcgtccggtgccccatctgctcgtgatgaggcggcagctgtggattggattgtttggtgttacattgggttgatttgcttgtctacccgtcgtctggtgtttgagcctcagagtcaagaggctctgattttgcgatgtgcttgttgcgctctgcaacctacgagtactaatttaaacacctgtaatgcgttgcccgttcatagtgcggtgcgccccgtatctaattaaatt

SEQ ID NO: 16928 - DNA, 1143 bp, Triticum aestivum
  Clone ID: PAT_TA_16928
cactttgtgagagttgggaaagacataaaagatcacgaggatttctttcagaagaaaacgagcgcagatcttgcaccaatgcaagatggcaaatcttatctggattggtcaagaccggctaggccatctgcagccaaatcaaatggagcggatattaggttatccatcaaaccatacaaatctgtttggcctaaacccaccggacaggattgctgctatgaaatacgcttttcaaacggacaccattgcttatcttttgtcagttctaaaagacatctatccagatggtttgagggtactatccatctatagtggagttgggggtgcagaaattgcgcttcatcgtctcggtattccactaaagtgtgtagtgtctgttgaagagtctgatgtgaacaggaaaattctgaaaaaatggtgggcaaaaacagagcagagcggagttctgagacaactaaatggcatatggaagctaaagaccgatgcacttgaggacctatttaaggaatttggtggctttgacttggttgttggcggaaattacagttcatatagaggtgggacaacagtaaacgcaactatggggatggactccggtaaatactttgagtacgttcgtgttcttcaaagagtgagaagtatgcagcacttttataagtagttgttgcctgacataatcatgtccttcaccatctatcttcgacaagggatggcgcagcgttatgagacttgtaaatggtaggatggagacgtacgctttgttgacagctagagaactttgtgctgtctctttatctagctagagaactttctactgtctctttatcactgcatgatgggttcaactatccttctgttcctggttaattagctgcatattactgtaactattaatcggtgcacacgagttatcctacttgcttggttggttagtttggacaagtccaacccgttcgtggacatagttctctgtgctgttttcagtttgtgtgttgatgattggctgaagtagaggcagcagcacatgcaggttgaaaacttgcatatgagcgagtgatttgttagaaaacatcacatgtgcactttaacaggtatatgattttcccattaagtctaaggaatgtttagctgcctacacgttat

SEQ ID NO: 16929 - DNA, 543 bp, Triticum aestivum
  unsure (1)..(543): unsure at all n locations
  Clone ID: PAT_TA_16929
aacaggaaggccaaaatttctcccccccngaataaagcatccaatggccatggagagcggcgctgaggcggcggcggcggcggcggcgggctactacggcggcaactgcgggtgggagacgccgaagcgggaggagtgccgcatcccggcgacgctgccctgccccgcggcgccgaggaaggcggcagcggacttcggcacgccccggcgcccgcccaagaacggctacttccagccaccggacctcgaggccctcttcgcgctcgccccgcgccggcaggcgtcttgcgcgtgattctgcccgcttcggcggcggcacgcggcggccggccgcggagggctctgttttgggtcgattttgggaagtgtagatacttagccagtttctcctctgttgtactagtagcggtagcggattaggtgtgttctagggagtggtagtatgtagctaggtaggtgggcagaggaactgatgagcggggagctgatgagcatatggtttttgtatcggctggaatgagaaatccttatttgtttcttggc

SEQ ID NO: 16930 - DNA, 577 bp, Triticum aestivum
  Clone ID: PAT_TA_16930
gccggccgggtccggaaattcccctttgaaaacaaggaagcccaaaatttctccccccgaaataaaagcatccaatggccatggagagcggctcggaggcggcggcggcggcgggctactacggcggcacctgcgggtgggagacgccgaagcgggaggagtgccgcatcctggcgacgctgccctgccccgcggcgccgaggaaggccgcggccgacttcggcacgccccggcgcccgcccaagaacggctacttccagccgccggacctcgaggccctcttcgcgctcgccccgcgccggcaggcctcgtgcgcgtgattcggcccgctccgaaggcatgcggcggagagctgtgttttggattgattttgggaagtgtagatactcagccggtttctcctcttgtactattagcggtagcggattagggggtgttctagggggtagtagtatgtagctaggtaggcgggcagaggaactgatatgggctgggagctgatgagcatatggtttttgtatcggctggaatgagaaatccttatttgtttccaaaaaaaaaaaaaaaaaagccccta

SEQ ID NO: 16931 - DNA, 1278 bp, Triticum aestivum
  Clone ID: PAT_TA_16931
accaccttccagcagcagcagcataacaagtacagcggtgatcgagcacttcgagtagtaagtggatcacctagagcagcagcgagcaatggcaatggccgtggcgtcgtcgaccatggaggtcgatcaggacctccccggcttccgcttccaccccacggaggaggagctcctcggcttctacctctcccgcgtcgccctcggcaagaagctccactttgacatcatcggcaccctcaacatctaccgccacgatccctgggatcttcctgggatggcaaaaatcggggagagggagtggtacttcttcgtgccgcgtgaccggaaggcggggagcggtgggcggccgaaccggacgacggagcggggtttctggaaggcgacgggctccgacagggccatccggagcagcggtgaccccaagcgggtcttcgggctcaagaagacgctcgtcttctaccagggccgcgcgccgcggggcaccaagacggactgggtcatgaacgagtaccgcctccccgacaccggcgcgccgccgccccaggaggacacggtgctgtgcaaggtgtaccggaaggccaccccgctaaaggagcgcgtcctcggacccttggcgacgctggtcttctaccagggccgcgccccccgcggcgcgtaggccgacggcggcgcggccggggcccgccccccccccgccgccgccgccccccccctgtcggcccccggcgccgtccaaggcgtccccctgggccccgccgcccccgccgcctcggcggcgcgccctggcagctccaggagtcatgacgcacccagcgaagctaagaaggaagcagacgtggccacggtgactctggcgtcgacgtcgtctctgccggaagcggggaacgcgcccttcgttctgcagctcccagccgcaaacccaccctgcggtctgcagctcccgccggcgaaccatgggatgtcaaacatgtccagcctgcagctaccggcggcgagccacggggaactgcaactgccagcggcgaccaaccacggagtgttcgactggctgcaggacccgttcctgacgcagctgcgcagcccgtggcaggatcagcattgcatgtccccatacgcccatctgctatattaaccagatgcaaattcagttgtgcatagtactacgaacctagacgtcagtctctttttctcttttgtttagcatagagtcaattacactggtgatgctacaacttgatgtaaacggtcactttggtgctagaagttgtggtgtacatt

SEQ ID NO: 16932 - DNA, 1542 bp, Triticum aestivum
  Clone ID: PAT_TA_16932
gggcggcacatgctaggtgtcgtgcaagcaatcagctcgccccgtccgtcctctcgccgcttcccgtcttcagttctttatgccgctcggtgccagcggtgcggcggtgcgcgccccgagcagagctagctaggtgatttattcggcgcgggaatggtgcccggggcgagggctccggcggcgtccgtgctgtgtgggctcgtggcgctcgccggcgcggccgtcttgtggttctccggcgccgccgaggcccgcgtcctactcacgctcgacgacttcggcgccgtcggcgacggcattgccaacgacacgcaggcgttcgtggacgcgtggacggcggcgtgcggctcggaggagcaggccgtgctcgccgtgcccgtcgccaaggcctaccagatctggccggtgcagctctccggcccctgcaagaagaagctcaagctgctgatcgccgggacgatcgtggcgccggcaagccccgacgagtgggcggggagggacccgatgaagtggctctacatctacggcgtggacggcctgtccgtgagcggcggcggcaccatcgacggcgtcgggcaggagtggtgggcgcgctcctgcaagcgcaagaagacccagccctgcaacacgcggcctcctcctagggcgttgcatttcgaggagtgcaggggggtgagcgtgcagggcgtgacgctgcagaacgggccgcagttccacctgtccttcacgcggtgcgtggacgtgaaggccaacttcctccggctggtggcgccggcggacagccccaacaccgacggcatccacctcaacgactcctcccgcgtccagatcacggacaacctcatctccacgggggacgactgcgtgtcgatggtcggcaactgctcggacgtccgcgtaagagacatctcgtgcgggcccggccacggtatcagcatcgggagcctgggcaagaaccggaccacggacagggtcgagaacgtgagggtggacacctgcttgctcaccaacaccaccaacggcgtccggatcaagagctcgcagggtggggatgggctctgcccgcgatctgaggttcgagagcatcgtgatgaagaacgtgtccaaccccatcatcatcgaccagtactactgcgaccagcctacgccctgcgcgaaccagacagaggctgtggaggtgcgcaaggtggagttcgtggacgtgaggggcacgtcggcgacggcgcaggcgatcaagatcgcgtgcagcgacaccttgccgtgccgggtgctggagctgaggaacgtcaacctcaccatggtgggcgggggcgcggccacggcctcctgctacagggcgtccggcaaggccgttggagccgtcgccccggcgtcctgcctcgccaagggtgacccgtgatggtcgttgaatgatgtttccaccgtctgtttgcgtacttggccggtgttttcaacatatagcttggtaaatatttatacaatattgggctctgttttcaacaatatgaaacattatgcaaatggtttttgggcaacacttaa

SEQ ID NO: 16933 - DNA, 739 bp, Triticum aestivum
  Clone ID: PAT_TA_16933
atcctcccgttaatcgaacccaaatacagtagtacttgtcttcctccggccatggccaccgccgcggtcctcatcctgctcgcatcgctcctcccggcgctagccgccggaaccgattgccgctcgcccgccgctgactacggcttggccctcacgcccagtcacgagtgcggcgtcgtcctgcccgtagccgtgggcacctacgacatgggcacgtacgctccgggcagcgcgtacgaggcctccctgcgccatctcgtcgccaccattcccgccaaggcgaacgcggaatccagcggctcctcttattacagcgactcctaccgcgacgacgccggcgcggacgggcgctttttcgtcggcgacgcccgcgcgtgcgggcgctcttacggcgacgtcgccggcgagagccccaaccggattgtggcctccgccgactgctcagggcacccggacgccaggtcgccggactgcggcgcttgcatcgcgctggccttccaggaggcgcagaggctgtgcccgttccagaggatggccgaggccgcggttggcggcggcgcgtgcaactgcagcgcacacttccacgactacgacatcatggagcagttccatcacggcgaccgcagcagtgatcctcggtgggccccggcccacctcgtgggcgtgggtgctgttgcggaaaatgaggagaacatcacgagactgaaatgggcatgccgtaccttggagaccacaatca

SEQ ID NO: 16934 - DNA, 907 bp, Triticum aestivum
  unsure (1)..(907): unsure at all n locations
  Clone ID: PAT_TA_16934
cccgcatgaaagcgtcagctagttagcttagctgcttggcgcgggctggtcgggctcgtgcttacttcttccgtgttattttgctcacagcggggcaatccaggggggaaggttggggccgaagagggtaaccgagatcaggatgagccctaggaagggcaattccaaagctttcaaggtgcttcttgggtccaccggcgttgagtctgtaccaatcgccggcgaaggacaagaacctgctgctggttgatcggcgccggggtccactccaacagcctccccaagaagctgcggcggcaggtggggggccctgaggtggtggtattagcgcaccctccgcgaacaagaactcgctggcgggtaatccccgccgcgctcccaccccacgcccccacccgtgcaacccccacggccgggggcaccccctgacggggaggggccgcgctaccacgacgccgccgccttcccgggagtggcccaaccccccccctaccacccgagcccggagccccgtacaaccacgcgccccgcgcaccgacgggtactacaccggggagctacccgccgcagccgcacgccgcgggcggtcgggacctctcccgcaacgccggctccgtacctccgcacgacgggcgggcgagactactacagctacggcggcggcggtggcggtnggcggctaccccgcgcagttacagcaagcagggttactactacccgcagcatccggcggcgaacatgcacacggggggcgcacggcggcggccaccctgccccgtcattggtcggcatgtacnggnagaagncaatggcgtcnagctttagggtccgtttgaaaccatgtngttgtcgcaattattccgntccatgtattangtcaaatgtgcgttctctctttcttcttttc

SEQ ID NO: 16935 - DNA, 477 bp, Triticum aestivum
  unsure (1)..(477): unsure at all n locations
  Clone ID: PAT_TA_16935
ccaaccccggcccngttggggnggaagcctcttctgggcccgccgccgtgcccgcgcccgcgccggcctactcggcgcagagcgtggaggagatcatgaagatcgtgcaggaggcgcagacggtgcccaagccggacaagccggtgtccgggtacgggtggggcaccggcgacggcgaggcgtccgacgaggaggacggcaaccaggagggggaggaggaggaggagtacggcgaggacgagtatgaccggacggtgcgggaggtgcacgccagcggggacttcggcatgagcaagctccaaatctgacgtcgatctcttctcaccacatggcgccgccggccattgctcctccacgtcgtctctagtccactctggttaattatctgttataagattgattgaatttttctttttgccaattgtaacaaattagctaattaacactaagttttttgttcaaacccctttttgtcgt

SEQ ID NO: 16936 - DNA, 1210 bp, Triticum aestivum
  unsure (1)..(1210): unsure at all n locations
  Clone ID: PAT_TA_16936
acaccttctgaatggaatataatggatggcttctcagagtttggtagcagcccactgattgtcggtgtaatgcttagcttgttggagaagagttatcgtcttgtcgatattggtccaaaccctgaaaatcgtgatgaggctattaaatttaggaaattctggggagagaaagctgaacttaggagatttaaagatggggctattgctgaaagcacagtgtgggaaacggagacttgggagaggcatacaatcatcaaaagaattgctgattatgtgcttaccaagcatttgctggcgcggcgggaagatctgactcatgttgttgatcagcttgacttttgtctcttggttggtggccaagatccagtgtcatcttctggagctttgcttgaagcctttgatactttagctaagcagttgcgtctattggatgatgttcctcttaaaatatctactgtgcaacctctagactcagcctttaggcacacttctgtgttcccccctgaacctcatccgttggcatatgaaaagagttctcagaggctgcccaattttgcagcaacttgtgttcggtctttggaagtcatgattcagctagagggatctggtaactggcccttggatcctgtagccatggagaagacaaagtctgcatttcttttaagaattggtgaaagtctggaggatcgaggaatgtttgttacagccagtgaagacgaggtcaatgttcttacatctggatattcgtttttgctcaaaatatttcatgagggaggtttggtggtacaaaagcaagctggagacagtaacatacaaagtgctccatcagaagataaggagctcttttttcgtagtcagcactcaagtatgatcaatggtctgcatggtatttaccaagcgtatgggccggtagtgaggctagcaaaaaggtggatttccgcacatctattctcttcatttatctcagaggaggcggttgaattggtggctgcctacctatttttgaggccgtttccattccatgccccctcttcacgggttactgggttccttaggttcttgcggttgctatctagttttgactggaccttttcacccatgattgtggacataaataatgacttcaacctgaaggatgagaaagaaatcaatgaaaactttatgctgagcagaagatcttatgaacanaatcctcatgatatagagcctg

SEQ ID NO: 16937 - DNA, 701 bp, Triticum aestivum
  Clone ID: PAT_TA_16937
gcgcgggcgccgggccggccggccttggacagcagacttcaatcaactcaccaccccacgccaacagtccaataccgccaaaatgggtcgcgttcgtaccaagaccgtcaagaagtccgccaaggtcatcattgagcgatactaccccagattgaccctggacttcgagaccaacaagcgcatctgtgatgagatcgccatcatcgcttccaagcgtctccgcaacaagattgctggttacaccacccacttgatgaagcgaattcagcgtggccctgtccgtggtatctccttcaagcttcaggaggaggagcgtgagcgcaaggatcagttcgttcctgaggtctccgctctggacttcacccagaactccgagagcggccagctcgacgtcgacaccgagaccaaggatctcctcaagcaccttggctttgagtctattcccgtcaatgtcatccctgtcactcagcagcagattcccgagcgtggacagcgatacggcaaccgccctcgccgcgactaaaaaattgggtttgggatttttatgggtgtctagcatttgcagggtttcactatggcgtctttaggacagtgagtgcatagtctcaaagaaagactttacgacccccaaaaaaaaaaaaaaaaaaggcccctaaaaaaaccacaaaaaaaaggaaaaaaaaaaaaaaaaaaggccccta

SEQ ID NO: 16938 - DNA, 1126 bp, Triticum aestivum
  unsure (1)..(1126): unsure at all n locations
  Clone ID: PAT_TA_16938
ggcaaaagaaaaaaaggtacacctaccactgcaacgctcccagcggagagaaagaagcggcgccggcgaccggcgaccggagcccagccccggctacggccaccgacttcttattccctcccgccgattcaattcagctcagtcgtgggggagatttaatgatggatgccgccgccgaggttccccagacgatctgtcctgagaagagaccacacgcggatgtcgatggcgaggcaggccagcattccctggcggccgtggaccctgtctccaaggtgcttggggacaacaacctccttgcggagatcctcctccgcgccggcttccccactaccctcgttcgcgctgccctcgtgtgcaggtgttggtaccatctcgcctcgaaccggggcttcctccgccggttcccgtgagctccacccgcccctccctacttggcttctacattggcagcatcttgatccggccggaattggtagccttcctgtgctttgtcccgatgctgccccagcccccggagctcaacactgttgtccgccgcatggcgaaccacaacttcgatgaccccaagaatctatggatcatggactcccgaaacggcagcatcttcacccgacgtcgtgaaggaagagaactagcatatggagtgcaccgcagagaactagcatatggattgcaccgcccgctttgccctgagagaggcattaacgtcgtcccagcactcccaagagcccaaggattacaatcgccaatattttgatgctattctctccaaaagaaggaatggcttgtcctacttnangtgttgacggantgactaatcaagaccagaaattcactttacgcgtgtaatgttacaagcaatgttggggctgcatactcggcanngccaactccatcttcngctacccaaagaaaantgtgctgtgacanaaatctaatggggtcccccgcaaacanattattgtctgggtttacacccantttgnnaaatcacaccactgggtnatagaatttcaactcctgtcgggaatatctcgggncagcaccagnanggttaattgacggccangggaaanggtncggnaacatncngnaaattgnaacgggtaaaancctggggnng

SEQ ID NO: 16939 - DNA, 1695 bp, Triticum aestivum
  Clone ID: PAT_TA_16939
cgacccacgcgtccgcaccgtcgcccacctcccccgcccccgcccccccccccgcccccgccccgcgttctcgaaggcctgcctccggcccctgcgtcgtgccatcccggcggaggcgaggcgaccaacccccaccaactcccgccagaccccccctaccgccgccgccgctgctcctcgcgcgcgatgcaagccctcctcgcctcgcctgcgctcagggcctccccctccccctcccccgtcgcccgctaccctcctccgtcgcgggggctcgccgccttccccgcccgcgcccgcgcactttaaatacgtcccatggaatctatggaggcgctggagcgggaccagatgctcaacgcggttgagctggagcagtgggagagcggcaagtccgtcaacgacatcgcggcctgccaggggatccgcatccgccgccactgccgccccgccgcctccatggcggaaatcgaggccgagatgggcgccccccgcaacatcctcgagaagatcatctgggacaaggagatcggaataatccaggggcttccaaggagtcctctgaacgaggtgattgagtccgcagggaaggctcgttttggacgggccatctattggtgaagcaaggcggccctgggccggcatggggtgccagcattgatcgcggaggtcaagaaggcatcaccaagtaggggcgtactcagggagaacttggatcctgttgaaattgctcaagcttatgaaaagcatggagctgcgtgcttgagcatcttgactgatgagaagtacttccagggaagttttgagaatcttcagaaggtgcgcaaagcaggagtgaagtgcccccttctgtgcaaagagttcgtcgttgataaatggcagatctattatgcccgtgcgatgggtgctgatgcagttctgttaattgccgccgtgctaactgatctcgacataaaatactttcttcggatatgcaaggagttgggattgacagctcttattgaggttcatgatgaaagagagatggagcgtgtcctcgcgataaatggtgttcagcttattggcatcaacaaccgtagccttgagacatttatagtggatacttcgaacacgaagacattgctggagaagcatggcgatgccatcagggagaaaggaatattggttgttggcgaatcagggctgttcaacccagatgatgttgcttatgtacagaatgctggagtttctgctgttttggtaggcgaatccttggtgaagcaagcagaccctgggcgagccatcgctgggctcttcgggaaagaactggtgcactgaaacaacaagatcagacttgtttgtggtagactagtagtagtagctgccagaccaccgcatgatgaataataatggtctctttttcttttggatgagcaacaagatttgatcttttttatgcgggaaataaacatattctttatttatggggaataaatttatgatctacaaaattaatcaaatgacgactacaattctccgtcaccaagtccataaatctttttgatttttggtttgggtggggtgcttcagtccaaggctatagtgcaagaccatggcgacgcttgagggccccagcagctagctgctatggtgggccctccgcccaaaaaattaaattaatatcctaggatggatcccaagattctcctatccgatatt

SEQ ID NO: 16940 - DNA, 1983 bp, Triticum aestivum
  Clone ID: PAT_TA_16940
cccacgcgtccgcccacgcgtccgcccacgcgtccggccaggaccttagacacaaagccatatgatggccatgatgtcactcctctcctcgttccttttggtaatggcagtttggggaggtcatcacacaaatttggcgagtgctgaagggatagtaatctcaagttcggaaactgcgcttactgagtattggcaaacaatggttcccaactctcccatgccacttgccatacttgagctccttctcacatctaccggtcatgatgatcacatgggcaaacaagacaccaacaacatccacacaccaaataaatggaccggagagaaatacgttggggcatcccttctcaaatcacgaaaaaatggtctacatcctaccattgatgcaaatgcaagaacagaaaccgacaaccagaagaatcaaatttggttttatggatggggcccacagaaaatcaacaacgagaagaccattaaaggtttagtaagggagccggtgaaagatatctacgacaagaagaaagaagtttggttttatgggtggggcccactaaaaattagcgacgagaagacaagaaatgaattagtaagggaaccaatcagaaaaatctacgataagaagaatcaaatttggttttatggatggggcccacaaaaaatcaaaaatgagaagaacatgagaggtttggtaagggagcaggtgaaaaatatccacgacaagaaaaaacaagtttggttttatggatggggccaactaaacattagcgacaagaagacaagaaaagaattagtaagggaaccggtcagaaaaatatacgataagaagaatcaaatttggttttatggatggggccaagtacaaaacagcaatgagaagatggcgaaacatttggtaatggaaccggtcaaacaagtctatgaagagaagaatcaatttcggggtccacaagccaaggatgacggtgcccgcgagtcaggcatgcaagaagatgatgggcaccaaggaggaagccatatccatggagaatctactgtgtcaaacatcatcttcttcgaagaatcccttaaaccgggatccacgatcacaccctacatccaaccatcagctacatcaggcgctcccttgctgcaacgtgacgtcgccaacaccatacccatgtccacggagaacttcactgatatcctggcgatgttcgcaccggtgtccagcgccatggccgacgacgtgtgggtgatgctggatctgtgcgagcgccccagcctagtcaagggcgagaagaagacatgcgctacctccgtggagtcaatggtagagttcgccgcgtccgtgctcactggaggcaacactcgtggcctccgcgctttctcctccccagacgtgcctgcagagggtgtcacgtcgagcaggaagtataaggtggtggcggcgcggagggccacagagtcgagcaagaccatgacatgccacgggatgagcttccccttcgtggtgttcatgtgccacgcggtgaaccctaccaggacgtacgaggtgacgctcgagagcgaggacctcacatcgaggatggtgctgcttgccgtgtgccacctcgacacgtctgagttcgaccccatgaagatgcctggacacgccaagccaggggatgctccggcttgccacttcatccccagggacagcgtcctctgggctccggttgcacccgccgccgccaccgctgcttaactacgtaatagctgtgaaaagataataacagtccgtataactgcgtagggcgcgggcatgcatgggtgctgtgtttgtttacgtccgtccgttgttggacttggtttgtgtgtacgtacgtttgctgttgttgttgtatgtacgctctttgcaatgcatggcactgcgctatgtcattgccatatacagtattacatacaaataaattccctagagcatgtattctctattaaaaaaaaaaaaaaaaaaaaaaaaaaaaa

SEQ ID NO: 16941 - DNA, 1972 bp, Triticum aestivum
  Clone ID: PAT_TA_16941
gcgggggggccggccggtcatagggatatgggtgggaaatcttgggtggctgcagtcctctgatccttctcattctggaggcgtgggtggctgcagcccattgagttttgaaggaaatcttgggtggctgcagtcctctgatccttctcattctggaggcgtattcagtacaaaccaatattctggttggtgattgtcagcatggagatggcaagtagcgccaagtggtttgctgtggctcttgttttcatcactgtgatcctactcagggtcataagaggaaggaggatggccgctgctccagccagtgagaaaccacctccacctgtggtgaatggttttgctttactaggacttctacctaggcttcttacaatggaccttcgaactaagataaattgcctgcacgataagtatggcagtgtgttcacagttagtccttttggactaactaatgtaacctttctgatcggcccggaggtccaatcccatttctttcaagggttggagtcagagattaaccatggcaatcttcttgagttccttgtgccgatgtttggacaagagataggtcaaggtgtcgatgcagccactcggactgagcagtcccgcttttatctcgatgcattaaagcaatccaagttgaggagacatcttgatccaatgcttcaagaggtcgagagctactttggcaaatggggcctggaaggagaagttgatttaaaacatgagtttgaagagttgctcatgttgatatcgagccgatgtctactaggaaaagaggttcgggagaagatgtttgatgagttctataaactatttcgtgatgtcgaaaatggagtgaacatgatcagtgtcttcttcccatatattccaattcctgcaaaccgtaggcgtgacaaagcacgtcttaagctcatcgaattactttctggaactgtgaggtcacgtaagagctccccctcagtggaggaagatgtgctacaaagattgatagattccaagtataaagacggccgctccacaacggaaacagaggtaaccgggatgatcattgcattgatctttggtggaaagcacacaagttccctcgctagtacctggaccggagcttgcctactcacccatccaaagttcttagcggctgcatcccaggagcaaaaggaaatcatgatgaaatacgaggacaaaatagaatatgatgccttgttagagatgaatacccttcataattgtatcaaagaggcacttcggttgaacccaccaacaacaatgttggttcgcaaggcacttaaacatttcacagtgcggacaagacaaggccaagagtatggcattcccaaggggcatactcttgcaagtcccataatacaaaacaattacttgccttacatttataaggaccccgaggtatatgatccagatcggtttggtcccgtaaggcaggaggacgtggttggcggcaagttttcttatacatcctttggtggtggaaggcatttttgcagtggggatgcctatgcttacatgcaagttaaagttatatggagccacttgctcaacaactttgatctcaaattattatctccttatcccaagactgactggagtaagttaatcccagagcctcaagggaatatgatggtcagctacaagagacgccagctgctaggctagcttgctatatatatcatttgcatgaggagcaccggcttgcatgcttgtgtttgtatgggtgcatcacttattacttgtacttgtgtatgtttttatgattgtaataattttcagtaacccttggatgagctatatatggtcttttcacagtgtgtatcactagtaaacatttggttggtctccattaactcagtggattcacccattagctggtctttttccatttttcccttttctgtaaatactatgaaactttataaaagattaatagaagtacatgcagtaggaagttcct

SEQ ID NO: 16942 - DNA, 623 bp, Triticum aestivum
  unsure (1)..(623): unsure at all n locations
  Clone ID: PAT_TA_16942
ttttttttttttcgtctaataaacnagctgctactttactantttcgttcctggctacaaaataatgctttcccatgaacaggaagccatcaagcaagtcttacccgggcgaggccccatgcctggtgctcgagtccactgccaacggcagcggtcggcgtcgccttggcgcacgacgtcggaggcggctccctgcggggcagcgccctccggcgcgcgccacccagcctggtgatgcatctcgtccctccaacgctaggcacgacgacgctcccatcggcgcggctccaatcgacggaacctgcgcatggcggtgcccgcgaccacggcttatggcacacgccgctgcaccctcgatctgtagagaggcgcggagcagtggaccatggcgcggatgtagggcttcaactccccgacgagcggcgccctccggcgtggctgctcggggccacggcccctcccgtgaaggagatgggacggccagatagcgatgccctcaggcgcgcgcgacgtggcctggccctccagcgcggtaccctctgcggcgtcgacagagcggttccgtatatactggcgatgcggcgctgctagcgcatggcacggcggcgcacagtgccgagcgt

SEQ ID NO: 16943 - DNA, 672 bp, Triticum aestivum
  Clone ID: PAT_TA_16943
agacatctcatagtcccttcgcagtaaaccatctgagagaaactctagctaggagctaggcatggcctccaccacgagcttcttagccatgatcatggcgtgcacgctcctcgccagcacgacgtgccatgccgctcgccacttggccgacaccaccccggcggctgccccacccgctgccgttggattgtccctgggcctcccggccgtgccgaccatgccgaccctgccaccgatgcccggctgtcccgacggtttcctcctttgaccactgcgacctactgccgactggtccacccgccccgcatgccggcagtgccgccggtcccgctggtgccgatgcccccaatgccggccatccccccgcctgcccgccctctgccacccttgcccgccgccgtggtgcctaacccgccgctgccgcccttgcccgccattccttccgtgcccaagatgacgctgccgccgatgccttctatcccgacctgtcaacgtcccaatgccgttcctggcgccgcctccatcaactttggtgcgcctcgtgcgtgctgacgcatgcgccatgtccccggtcacgggctctcatgttccagtggctacatcacttgttgctcattgaagtatttgttttcgtattgtatgctttacatttcaattcaggtgttatttatt

SEQ ID NO: 16944 - DNA, 1362 bp, Triticum aestivum
  Clone ID: PAT_TA_16944
gccggccgggccccacgcgtccgcgtcgcccgataaaaagaaagatgggatcctattcaccaacttcgcggtttaaggaccttgacactatccctcttgacccccattatgcgctcaaagaaacctttcaagccgatccagacccaagaaaggtaatccttgggtcgggtttatatcgcgacgacgattcaaagccttgggtgctcccagtagtcaaaaaggccgaagttttaatcaagcagacgcaagattcgggacgttatgaatatctacctatttcaggatatcctgcttttgtctcttccgctcggcaggtactctttggtccacaaagcctcaatgaaagtcgtctggtctcaatccaaaccatctcaggaacgggagccaactttcttggggcacgcttcctggctgaaaccctgaagccatctgctgtgtggctttcagaccccagctgggtcaatcatgccaacatttgggggctcgttaatgtcaacgttaaacgatacccttactggaatgcaaagaccaagagtctagacttcaataacatgattgagaagcttcagactgacgctattgctggagatgttatactgctccacgcttgtgctcacaaccccactggtgtcgatcctaacaaggagcaatggagaaagattgctgacgtttgtgaacgaaaacaactttttccgctcttcgactgtgcctaccagggattcgcgacaggaaatcttgatgatgacgcatgggcaattcgccattttattgaccgtggtaccatggaactcgccgtttgccagtctttctccaagaacatgggcttatacggggagcgtgttggcgcattgcacatgttttgcgcaacatctacagacgctgaaaaggttcgtggccatctctgtcgtctccagcgaggtcagatctctcagcctcccacaaacggagcgagaattgcagcaaccatactctcagactccaagttgttccaagattgggtcacagaccttggagaaatgagcagccggatcaaggagatgcgaaaatctctctatgataacctcatgattcttgacacgccaggaaaatgggatcatatcgtttcgcagattggcatgttttcatacacgggattgactccagagcaagttgcttttattcaacaagatagccacgtttacattttgaaatcaggccgtatctcggtcgcaggactcaactctaagaatgttgagtatgtggcaaaggcattggatatggctgtgaggggacttccatagatacatctttgtttgactatcttttgaatgtataacgctttagctttgctttactacagaaatattagcaaatcagttgtcg

SEQ ID NO: 16945 - DNA, 1457 bp, Triticum aestivum
  unsure (1)..(1457): unsure at all n locations
  Clone ID: PAT_TA_16945
cccgtcccccgtctctcgattcttccgaaggcttccattccccgtcgccggtttcgaattctttggaggccagggttggggattcgtgggagatcgaatcgtctcctcgggcggatctgtcgttcgagtccatggccacctccggcgatcagtcgggcgcctgcgggtctgcgagcggcgacgggctccaagctgcggtacccgctgcgttcgcacagccgggggaagttggagccggcgacgggggacggtgctcctagaagatctgcttggaggcagtgaagttctgccgcttgacgcagataaagaatctcttgatatctttctggcgttaagaataaatcatcagaacctccgcggaggtactcaatacggacatagctaggtgttagtccaaagcctactcctactggaactattactccagtctcaggggttcggtctaggaggtcagacagcctcgggaggtgtgataccccgacatcagaagcatccatgtccactgcaaggcgcaagttcagtacactctcctcagtctcatattggatgacacagattaggcttgcagaggctgcttccaagcactctatctctctgtgcttcttcaagctcgcccttgagtcagaatgcgagcctctggataggatgagagaagaactcaaggcttatgtggccaggcatggccttgcaacagaattggaggagccggtgaaggagattcttcaggtttatgatatcgtggaagattttgagaagctaaagatctctctggactcctcacaggagccaaaaaagtcagacaagtctgctgttagtgccgccaatgtgactccaaagggtaatctgaaacctaggtctctgaactctgttgcaactcagagtaaagatggcaagaaagagaacattcagaaggagaaacctgatgcaaagatcagaggttcctataacaagaatccagccaaaaatgctcctgcaaaagaaggtgccaaaaatactgtcaagaaaaccaagaagcaggctaaggagcagcaagaagattgtaatggaggcagtgaggtttcgccagttgaggcagaccaagaatctgttgatgtggtgaaggagatcacatacgaagataaggagaacatgggggatgctgagatggcaatagatgctggcaacgccgtagcccatggtggtctagaacagatggaccgacttcagattcaaaccttttgtttgctgaatatgaagtattgagtgtgtggtgcttgttttctttctccgttgttgatatgtcactagcacttgtctatccggttgtcaaaccgtaacatgtctttaccagcgtgtattatggtttgctgggtgagactgctcgcttgtattctctttgttaagtcagtttgcctgtccgtgtccagcttctgaatatagctgaattctttatttgtgtgatcccccttngagcagag

SEQ ID NO: 16946 - DNA, 660 bp, Triticum aestivum
  unsure (1)..(660): unsure at all n locations
  Clone ID: PAT_TA_16946
cgcccgtccgcgggcccgaggtgatcaatgtgtgggagctcatggagggcctcgacgacaacaagcacgaggagcgcgatgcggccgagggcgccgaggatgagcgcggggagcagtcgccgccggggtcgccggagttcgatccggaagtcatttcggagttccgcaaggcgctcggcgaggcttcgccgccgcgggactacgagggcaacggcgagtgcgtcaagaagcgcgaaatccagaggttccctggcatcgtgcgcgcgcgggtcagcgcgttccagcagaggatcgacgcgaagctcgccaagttggcgcgcccacccacgcccacgcccacacccacgtccccgcctccttctccgcctcagccgccgcagccgcagctgcctcccccgccgggacagccagcggaaggtggtgctgtacctgaccagcctgcgcggcatccgcaagacgtttgaggactgctgggccaccaagtccatcctccacggctacggcgtgcgcatcgacgagcgcgacctgtcgctgcacggcgggttcaaggacgagctccacgcctcgctgggctccgcggggaggctgccccaggtgttcgtggacggtgcgccccgcggccccgccgtcgccgctccgncgntttgcacgaggccgggt

SEQ ID NO: 16947 - DNA, 1629 bp, Triticum aestivum
  Clone ID: PAT_TA_16947
cggacgagtccacgcccgcccgctcacaatccccgccccccgcctcccctccgaccacctcccgcatcccccgccatggcgttttccacccccaacgccctctccgcttccggccccgcctccccgttccacctccgcctccagccgcagcccttcctccgcctccccgccctccccttccaccgctccctcccgctccacctcccctccctccgcctcacccggcccctcctccctcccctcccgctcgcctcctcgggcggcggcagcaacatcgggtccggcggcggaggcggtggtggcgatgacgacctgcgcccctccggcggcggaggagacgaggacgagggcgagggcggcgacgacgcggccgtcaacaggagggaggcgctgttcgtgctggcgcagctgggccggaagctcgagagcctcccggcggacatggccgcggccgtggaaggcgggcgcccccccggcgagatcgtgcgccggttcgccgatctcgagaagtcgcccatgttccgctggactgctccagttcggcggcttcagggagcgcctcctcgccgacgagcctcttcctcgccaaggtcgccatggagtgcggcgtcggcatcttcaccaagactgcggcagaaaatatgagcgaaggagggagaactttgtcaaggagcttgactttgtgattgccgatgtggtcatggcaatagttgcagacttcatgcttgtttggcttcctgctccaactgtgtctctgcaaccagcactatcagtgaatgctggggctattgctaaattcttccacaactgcccggataatgcattccaggttgctttggctggaagatcatacacatttttgcagagatttggagctattatgaggaacggcgcaaaactttttgcagtaggaacgagtgcatctttgattggcacgggtgtgaccaacgcaattataaaggcaagaaagactgttaacaaggatgatgctggcgaagttgaggatatcccaattgtttcaactagtattgcctatggtgtatacatggcagtttctagtaacctcaggtaccaggttctggctggagtgatcgaacagcggatgctcgagccgttactacaccgccacaaactagcattgagtgcgctgtgctttgcggttcggacggggaacacattcttgggttctctactgtgggttgactatgccaagtttataggcatacaataagttgaagacagacctagaattgcacaaatcattcgcaatgttgattcgtcgctacgccatatcccatatccttaccgtgcttcctatcctgactcatctgccttcataggagacactaacgacagaggtcgattgcttttgctggaaacgaaagatgcgtgcagagaaatggtaatttgtcgaattcccaagaacaagcgcttggattctatttggtggcttgtgagttttgtccaaaactcgattcgtttcagacgatggttttgcagtcgtttctgttgcgcaagtatgttcctgtgctctggcttgttctgtttaaaatttgcgcagataacagagatcatctgggttctgcatgacgcacgtcttgacgtgtggttatgagacttcattcttcc

SEQ ID NO: 16948 - DNA, 991 bp, Triticum aestivum
  unsure (1)..(991): unsure at all n locations
  Clone ID: PAT_TA_16948
nnnnnngattagcgtggtcgcggccgaggtacacgttcgacaagctaggtgcactgcttggtgaggatggagcttcagtagcggaagcaaggcctactgctgtcactgacctgtcaggaattagcatttctgatcttcaagagggacagctatcctcagcaaagacagcctcaagcattaaggaattgaaggaagatggtctgagggagtatgctgatctcaagcaatccttgctgctttacgacatatctattgttataacaggtttctctgccttcactctggcttcgaatgatggagccgcctactcgttcctcgtcggcgggattggagggttcctgtatctattgctgctccaaagatctgtggacgggttaccggcaattagttctccttcagaagcgagcagttcagagcccactatgaacttcagcggcgtaagaaggccatggttgatattgtcgattgtaatggttgctggggctgttgcactgaagtaccggcccgggcggccccgcgtcgagctgactccgactgagctatttgttggcgccgcagggttcttggcgaacaaggttgctgttcttctggcagcattcaaacccttgcaaagtaatttggagagcgacgatggatctgtggactgagcttcttgaggacattgctctgaatatactagcataatgttaaaaaagggggtaaaatttaacagatgtagcctttcatagtagctcgacagcattcaagatcttaagctaagtatggaaagtgcaggggatcagcccagaggcagaattgaagagcgtgtgcttgtaacttgagcctactagtaacttcattccatcagcatgcacaaccacagaaattcatcccttagcattcttttgagtcagtcaagaacagatggtctggttgataaaatcataaaatacatttctggccgtgacacctggagataccagatacctcaaatggttcaaatgttcattct

SEQ ID NO: 16949 - DNA, 793 bp, Triticum aestivum
  Clone ID: PAT_TA_16949
gccggccgggtcgggatccccccttctattgcgtgcagcctccttcctcttcagaagcacaatccatcgcagcctcccccctcctccgctgaagcctcatacctcccccgacgagctcgtccgactggccggccggagagtctctcgtggtccgtcagttgccttcgcggggtctgaacttcacgtacgatccctgcgcctacaaggatggagaggagagcggcgaggggcacctctgatcaccgtcggcgaatgcagatgccgccggcgcaggtggagcagaagccgcagcgccgcggggggccgaagagctgccagagaacgccgccgccgccgggctgcttcaccatccagctgctcatggtgttcctctgggtggccgcgtcgctcgccttcctgccgctcgtgctgccgccgctgcccccgccgccgctctcgctgctgctcgtgcccgtttgcctgctcgccgtcctcgccgcgctcgccttcgtcccgctggacgcccacaacaacgtcgtcggcggcggctcgtcttgtttgtagagaggctgcattttttctttcttttccgtgtcggtcagagctagctgtttcagatctagcctgtagtacaaactgtgaacctttttttctagattagattagaaattaggattgattaacagaggactactttttggctttgtaatcacttgaattccggcaatgtcaattgagatctcacggtatttatgcatatcaagcctaatccataaatcatttgttgaataaaaaaaaaaaaaaaaagccccta

SEQ ID NO: 16950 - DNA, 672 bp, Triticum aestivum
  Clone ID: PAT_TA_16950
agatgatgaaccgggcaatgcacgccgcggcgaggggcgacgacctgaagatcctcaaggagctcctgcagggttgctccattgctggtgcgtaccaggacgcccagggcgccaccatctttcatgttgctgcttcaagggggccaagttgaggattgctgctataagttggtcttatgaacattcaacatgccatccaggttgtaattctgcttgtaccctccccttcttcctacatctcaattccctctcccatgcttcttttctctaagagctctctctttcttcaattttttctgcagagagatggccatggttgcccgatgcccgagcgtcgccggccaaggacccgtcggcgtctagaccccctcctcgccagccccgtctcgccgaaccccgccacccacgccccgccggggcccgcccccccctcggcccccgccccgctcctccacggcccctccgctgctgccgcctcccaccccgcccagggcgcccgggccccctccctcgtgcctcccgcgccctcgcgggcccccagtccggccccgccgccttcgcgcccccctccccctgcctcgccccccacgcgcccgccggcgcctcccccccctccacgccatcccatctcgccgaagacctgcaccaagtcccgtccagagcctgcgccat

SEQ ID NO: 16951 - DNA, 1275 bp, Triticum aestivum
  Clone ID: PAT_TA_16951
cgggtgctgcatccggctgtggcccatgggcaactgcccgccgcagccgcgctccaaggtcgacacctccaccagcagcgccagcacgcacggcgcagaaaagtcagcagaaaatggtagcaggaaccaacctgttgtgtcagtagtctcaggctcgacatctactagtaatgctgagagcagttcatcagcatctaaagctggagaggaaataaaggtttcctctaagttgcgcaagtttggattcagtgatctaaaatgtgccacacggaacttccgacccgagagtcttctcggtgaagggggttttggatgtgtgtttaaagggtggatcgaagagaatggaactgcgcctgtgaaacctggtacaggtcttacagttgctgtcaagacgctcaatcatcggcgcctgcaagggcacaaggaatgggtggcagaagttgacttccttggtaaccttcaccatcccaatttggtcaaattaattggatactgtgttgaagatgaccaaagattgctggtatatgaatttatgccgcgcggaagtttggataatcatctattcagaaggtctcttcctctcccatggtccatcagaatgaaagttgctcttggggcagcacagggtctttccttccttcatgaagaagcagaaagaccagtcatttatcgtgattttaaaacatctaatatactgctagattcggaatacaatgcaaagctctcagattttgggcttgccaaagatggtcctgtaggtgacaaaactcatgtgtctactcgagtaatgggaacctatggttatgcagctccagagtatgtcatgacaggtcatttgacatcaaagagtgacgtctatagcttcggtgtggtgctgcttgagatgatgtcaggacgaaggtcaatggacaagaaccgcccaaacggcgagcacaaccttgtggagtgggcgcgccccctcctaggagagagacagcgtttctacaagctagtcgaccctcggctggagggcaatttctcggtcaaaggtgcccagaaggcagcacaattggcacgcgcatgtctgagccgggaccccaaagcccggccgctgatgagccaagtggttgaagctctcaagccactgctgaacctcaaggacatggccagctcctcctacttctaccagacgatgcaagcggagaggatggcacattcgagcagcatgaacggcaggaacagccatagcctcaaggtgcatggggtcttttgcccgcgcaagcgcaaacgggcacc

SEQ ID NO: 16952 - DNA, 774 bp, Triticum aestivum
  Clone ID: PAT_TA_16952
attcggcacgaggcgccattcactttgccattgctttagcctttctgctgtggcttgcaaggaacgtcggaggagcaaggactgagcgctaccactgcttgcccgccggcggacagacaccgcaccggggctcgtttgcttgcgggcggcggcggcggcggccaacgatcgcatcgcgtcgcggcgagatcgatggcaaccaggtgcttcttccccagggacgcggtggccgggcggcaccagtccaaggcggccgcggaggcgctcgagcacctgcaccacggggggcgcgtcctgtcccgggaggaggtgggcggcgcggtgcgcgtcaagatcgtggtcaacaagcgcgagctcaagaagatggtggccgccctcggcaccggcggcgaagtggcggccgctgcggcgtctgctgatcgccgcacccgccagcgcccggcgggccgcggcacggacgccccgccggggcggcagccgcgccggccgcgcaccgcgcgcagcgcggcgggggccgcctcgcggacccgggcgtcccggggagtgggagcccgacctccagagcatccccgaggaggtctactgagttaccgctagtggtctagtagatgatggccccgtcggtgatggttaatcactttactaattataaggttgggttttgatcacctgctgctaaatgctactcgtagtagatgtatgtgtacagtgctcttgattggttcctgttccttaactatgagggttaaacttgtgctggttaaaaaaaaaaaa

SEQ ID NO: 16953 - DNA, 338 bp, Triticum aestivum
  Clone ID: PAT_TA_16953
cggacgcgtgggtacggcggtcgagcggctggagaggaacgacgtgagataccgcttcgtcatcgacgtcgccggcagccagctgggcgccgccgcttagtgcttccgaacacaccatacgcgtgtcgtttggttacctacaagcttccagcgacgtgaagtcgtgatttgttgtttatttccacaaatgggttggtgcgtgcacttccagaattgcttttgaaataataggtgccatctttagagaatcttctgttgcatttcagatatgtaaaacaaggtgttgtataatttacttcatgaaaaatgcatttttacaataaaaaagagacaactcc

SEQ ID NO: 16954 - DNA, 562 bp, Triticum aestivum
  Clone ID: PAT_TA_16954
gggttgggacttggacttggagtagactatgtgagcatgtgtttgccgtttgataccgcaccgctgtagctggagtacatagtagctgacgtccatgccctacacacgtagtgtctgacgttcgatccaactcgtcagctcgcctatttatccccaacctcgtggcccgtccgtgtcatccggatatttttgagcaggaaatcgaagtgccaggaccgaagaagcagagcaagcagtcatcaatggcgaaaggcacgcctgcgaccggttgggccgcgaaggacccgtccggtgtcctctccccctacagcttctcacgaagggctctgaaggacgacgatgtcaccatcaaggtgctcttctgcgggatctgccacaccgacctccacatcgccaagaacgagtggggaaacgccctctaccccgtcgtccccgggcatgagattgttggcgtcgtcaccgacgctggccccggcgtcaagaacttcaaggccggggacacggtgggcgtgggctacttcgtcgactcctgccgctcctgcgtgagctgcggcagccggca

SEQ ID NO: 16955 - DNA, 557 bp, Triticum aestivum
  Clone ID: PAT_TA_16955
gccggccgggtcctccgtccggcacgatggacggcatcatcgacacggtgtcggtccggcacccggtgggcgcgctcgtggggctgctaaagccgagggggcagctggtggtggtgggcgcgcccagcacgccgctggagcttccggcctacgccatcatcggcggcggcaagcgggtggccgggaacctcgtgggcagcgtcgccagctgccaggcgatgctggacttcgcagggaagcacggcatcaccgccgacgtcgaggtcgtcaagatggactacgtcaatacggcggtcgagcggctggagaggaacgacgtgagataccgcttcgtcatcgacgtcgccggcagccagctgggcgccgccgcttagtgcttccgaacacaccatacgcgtgtcgtcctctttggttacctaccagcttccagccacgtgaagtcgtgatttgttgttttattctcacaaatgggttggtgcgtgcaattgcttttgaaataataggtgccatctttagagcatcttctattgcaaaaaaaaaaaaaaaaaaggccccta

SEQ ID NO: 16956 - DNA, 1567 bp, Triticum aestivum
  Clone ID: PAT_TA_16956
gcggcgagaggaactcgatgtactccagctcgaagtctaggcgaaggtgatcagcaacgaaagacatatcgactagcgcatgcgtggtgaggaggaaatcgaaggagtccagctcggcgcataggcgaataagcagagcaagcaatcagcaatggagaaaggcacgcctgcgataggttgggccgcgagggacgactcgggtctcctctccccttacagcttctcgcgaagggttccgaaggacgacgatgtgacgatcaaggtgctcttctgcgggatctgccacaccgacctccacatcgccaagaacgagtggggcaacgccctctaccccatcgttccagggcatgagatcgttggcatcgtcaccgacgtcggccctggcgtcaagagcttcaaggccggggacacggtgggcgtgggctacttcctcgactcctgccgctcctgcgacacctgcagcaaggggtacgagaactactgccccacactcgtgctcacctccaacggcgtggactacgacggcgccaccacccagggggggttctccgacgtgctcgtcgtcaaccaggattacgtcctccgtgtcccggagagcctgtctctcgccggggcggcgccgctgctctgcgccggcgtcacggtgtacagcccgatgatgcagtacggcctcaacgccccggggaagcacctcggcgtcgtcggcctcgggggcctcggccacatggccgtcaagttcggcaaggcgttcgggatgaccgtcaccgtgatcagctcgtcgccgaggaagcgcgaggaggcgctcgagcggctcggcgccgacgcgttcttggtcagccgggacgccgagcaaatgaaggcggcggcgggcacgatggacggcatcatcgacacggtgtcggcggggcacccgctggtgccactgctggagctgctgaagccgatggggcagatggtggtggtcggcgcgccgagcgagccgctggcgctgccggcctacgccatcatcggaggcggcaagcgcgtcgccgggaacggcgtgggcagcgtcagcagctgccaggcgatgctggacttcgcggggaagcacggcatcaccgcggacgtcgaggtcgtcaagatggactacgtcaacacggcggtggagcggctggagaagaacgacgtgaggtaccgcttcgtcatcgacgttgccggcagccagctggactccgccgcttagtgctccgacacgtaggctctcggcggtcaccggccacgtgaggtcgtgatttgtggtgttgttatttccatgggttgatgtgtgcatttccagattttcaggtgaaataattgcttcgtgtgttgtttgttctggccatgttccgttctcgaatattacctataactgtagaacatccatgtgttgccacgggccttataatcttttcctaattattgtataaaactcgatgaatttgcagcctctttcaatgcagatttgctatttcacatctagatgtaaaatagctatatcacatctaacttgtctgccgttggataaaaaaaaaaaaaaaaaaggccccta

SEQ ID NO: 16957 - DNA, 1293 bp, Triticum aestivum
  Clone ID: PAT_TA_16957
gcctctttctagaagtggtggtaaaaaccattggcgcatgtgacagaacccttaatcttgatgctgcaaagaagaaagtgcttgattttgtagagggtaaaatgggttacatcgcaccaaacctatctgcaattgttggcagtgctgttgctgcaaaattgatgggaattgctggtggtttgggagcacttgcaaaaatgcctgcttgcaatgttcagctacttggagcaaagaagaaaaatcttgctggattttctagtgccacgtctcagtttcgtgttggctatcttgaacaagccgaagtatttcatgagaacctctcctgccctgaggacccgtgcttgcagggttataggctgcaaaggcaactcctagctgcaaggaattgattcaactagaggtgatccaactggtaaaagctggtcgcaacttgttagaagaaattcgcaaggaagatagagaagtggcaacgaacgaccccctgcacaagttcggcatttacaccattttacgggaatacaactgtcaaaacccacaggcacagggcgaccgccttcggaaaaatggaaagaaaaatatgcggtgactgatatgatgaagcttgcaaaccgactgcagtttgggataccagaggagagctcattaggtgatggtttgggggaaggttatggaatgcttgggcaggccggaatgtgggaaactacgtgtctcagctgcgcaaaacaaacttgctgctaaagtggcaaagaaattcaaggagaggagttatggtagtggcggtgcaacatctggactgacatctagtttggcctttacaccagttcagggaatagagctgtcaaacccacatgcccacggcaaccatcttggaagtggaacccagagcacctatttctctgagacgggcacattttcccggatcaataataggccatgaccgagcttggaatctgaagatgaaaagtgcctgaggtaagaagagggaatcgttccttggtcccagcgattccatctcattctgcacacaacgctcaagagtttcctgggattcatgcacttgcacaagatcagcttgtattctcagttgtatcgtggggttttgtaatgtaagtacagaaagcgcactacaacatcacaaggtctgaagtcaggcagtacccaacgttacctatgcttcgagtgtcgataatctttctagaaaacccgctggaagtgaattgttgaaatgtcttgcctgaatcatccgccatgctggatcattccataccccagtgcgagttgagcttttgaatg

SEQ ID NO: 16958 - DNA, 602 bp, Triticum aestivum
  Clone ID: PAT_TA_16958
tcggcacgaggctcaccttccctcctcctctgtcaccccggcgtgaaccccgagggtcgccaatggcgcacgcggcggagggggacaaaccacgggaggaggagcaggagcacgaggaggaggtgatcatcgtcggggcgggcccgtcgggcctggcggccgccgcgtgcctgtccctgcgcggggtgcggagcctcgtcctggagcgcgacgactgcgtggggtcgctgtggcggcaccgcacctacgaccgcatccgcctccacctcgccaagcagcactcggcgctgccgcacgcgccgcacggccccgcggccccgacctacctcccgcgcgacgacttcgtgcgctacctcgacgactacgccgcccgcttcggcgtccgcgtccggctccgccgcgaggtccgcgaggcccgcttcgacgaggcgctggggtgcgtgggtcgtcgaggccgtcgaccacgccaccgggctggtggagcgctacgccgcgaggtacctggtggccgccgctggggagaacgacgagaaggtgctgccggaggtgccggggctggacggcttccccgggaatgtgatgcacgcctgcgagtaccggac

SEQ ID NO: 16959 - DNA, 649 bp, Triticum aestivum
  Clone ID: PAT_TA_16959
gcaaagaaaaacttagggcagaaaaaagtctcacgccgccgccgccatcgtttgcctgcgccgccgccgccgccaccgtttgcccgcgccaccgcccttcccgcgacgccccaccaggctaccacaacaggacctgcccaggcgtgctcttgattcaccggtcttccctgctggccctccccttggccccatatttgtcttcgattcgcctctgctcgatgaaggacgacatcagcctcgaccaaggactgtagaggtggatccatgatctaccagccccggtaaggacgtatgaggatggtgggcgccgtgatgtgggatgaggttcaagggccgggcacctatgaggatggtggggctcgtcctgctgccgacgcaagtcgagaccatacagccggtggccgttcggccgcgccgatcgtccccacggccccgtcccggtgccggccgtcttccccgcgcggttccgcgttgccttgagcggagaccggtccgagtgggcgcctcaagcatcggcaatggcccttgtaggcctggtcccgcaccgctcctcctgccctgtcctgacctggcaacaaccttctttggtacgttatttctccatcggtaggccttgaagaaggatggatacaacagatgcagagatcta

SEQ ID NO: 16960 - DNA, 1397 bp, Triticum aestivum
  Clone ID: PAT_TA_16960
gaattcggcacgagcccgacagcgtccagggtcctgcgccagtccccgccacctcccacctaccgtcccgtcatcatcatccatcctcatcctcctccaagaacccggcagaatcatcgcgagagcaccatgtccaatcacgacgccgcgtggccctcattttgattgatcttaagctgcagctcggggattggctcgctgttagcctgtcggaccacccctccatggcgcccgaagtgaaggtgccgctgctggaggggaggggcgcgacgcccgcgcagacgttggggaacatcgtcgtgtccatcgtcggcaccggcgtgctcggcctgccctacgccttccgggcggcaacttcgctcctacgggcactcgtgggcgagcgaggcttcggccccacgtcggtaggtacgttcaccctggggcatcatcatcatcggccgggagcggcgaacagcgtgggacggacctcgtcttcagcagggccgccaacctcagctccgtgcctccccgccctcgtcgccgcccgcgcgtagtcctggcaccgtcctgctgccggccacggggtcgcgcatctcccttcgtccgctccctgctccgcgctggcgccccgtccagcatcctcgccgacgcctgcaccgtgctggccgtggccgccgtcgtcaaggaggacgtccagctcctggccaagcgcgggcggccgttcgccggccggagcgcgttcgcgggcctctggggcgtgccgttcgcgtgcggcgtcgccgtgttctgcttcgaggggttctgcctcacgctggcgctggaggcgtccatgtcgaacaggggcaggttccggccggtgctcttccaggccatcgtcggggtcactattgtctacatcagcttcggcgtctgcggctaccttgcctacggcgacgacacccgggacatcgtcaccctcaacctcccggacaactggtccaccgccgccgtgaaggtggtgctgtgcgtcgggctggcgctgacgttcgcggtgatgatgtacccgatccacgagatcgtggaggcgcggctgctggcgccgggcgggtgggtgcggaggcgctgcggcggcgtggtccagcgggcggcgctgcacctgagccgcgtggcggtggtggcggcgctggccgcgatagcgtgcttcgtgccggcgttcggggacttcgtcgcgttcgtcgggagcacggtgtgcgcgctgctctccttcgtgctgccggcgctcttccacctcagcttcgtggggccgacggcgagcccgtgggcgcgggcggtggactactttttgttgctcgccggtctggtgtttgccggccacgggatgtacacggtcttggcacccatttataatttgaaaatggacatcactttcgtaaaaa

SEQ ID NO: 16961 - DNA, 898 bp, Triticum aestivum
  Clone ID: PAT_TA_16961
tgcgcgcccggcgcttcgaggccctcgcccgctcgcgccgcgccgcctcgctcgcgctctccaaccgcaaggaaatcacgaccccgcacctcggcgccgtcaactccctccaggttgatttgacagaggggaggtacctgctctcgggggcgtcggacgggtcggccgccgtcttcgatttgaaggacgcgacggaatacgaggccgggttcatagccaagcacaggagcattctgcttgtggacaagcagcatcagcatggccacaagttcaccgtctccaaggccatctggtatcctgtggacaccgggctgttcgtcacggcctccttcgataactatgtcaaagtgtgggataccaattcgactcaaatggtcatggattttgcgtggccccggccggggtacagtgctgcaatgtctccgattgcaacaacgcatatgctcatcgctaccggaagcgcagacgttcaggtccgtttgtgtgatattgcttccggggcctttactcacacgttgtccggtcatcttgatggtatcatgtctttggagtggtctacctcaagcgagtggatcctaatgagtggtggctgcgacggggcgatacgtttttgggacataagacgagctggatgcttccttgtccttgatcagttacggtctcagctaggaagacggcctcccattcttgatggcaccaccgacaacgtatgcttgccatcaccctttactttttatctgcttctgggtttggttatttcttcagaatatatttgctcgcagggctaatacagaactgcttgctattattctggctactgttccaaaactgttaggtctccaagtaggagtggatttttcccgcaagaaaagggtacctgcccgggcggccgcctcga

SEQ ID NO: 16962 - DNA, 990 bp, Triticum aestivum
  unsure (1)..(990): unsure at all n locations
  Clone ID: PAT_TA_16962
gagggcacttgaacagctatttgtaatttccatgcgaaagaagcccaggtggattatctgacaatgtttcaaccaccagcactgaggactgcttcaccagtggagaaacaagcaggtttagtattttctaggaaagtgtttgatatatttcaggaacaatttgcggagtcctttgggtaccatgcagagaggctcgaggataggatgctacacaagtaccgcctgacagtagatgatggtgacgaggaggcacatatcgtctctttcagtccagatcaaagtacagtgtgctgtagttgttgcttattcgagagctgtggaatcttgtgcaggcatgctcttcgagttttcatcatcgaaggagtgcgtttccttccaaaggcctatgtcttgaaacgctggacaaagcatgcaaaaagtactgtcaccctggataactacattgaactaaggggatactgtgaggacccttcgacttcaaggtacaatgatctttgctatgatgcaaacaaatgtgcaaaagagggctcaacatccactgagcgctataaaattgctaaagaggcactgtgcaaggctcttgatgaaataatgcctacaaggaatattagagagcaaaattcacaaaactgtacaacatcattaagaagtccagtcaagaaacttgggacatctaaaggtacctctggcaagagcataaagaggccagcattcaaaaattcccctcgtggagagcaatggcagtagatgaccagatattgtgaatttgaacataatgcgatttcacctgttctgaccttgtatagttgtagtatcattcaatctagtactagtctcttacgctgtggctggttacggcttttccctgtcagcgcatctagtaacagcaagggtgctaatgaacgtttgagacattactcttcaaaatgaatgtaggaacatatgcccttcngtggggatttttcatgaatggcactgtaggaagggcaa

SEQ ID NO: 16963 - DNA, 637 bp, Triticum aestivum
  Clone ID: PAT_TA_16963
aacgcaccaccagccgacgactgcggcatcgacggcgacggcggcgccaacaacaggaaccccgcggcgaccccctccggccgcccctctgctccgcgccgcatcgggaaacccagccgcgatcctccagccacgccgccccccgcgtggccgctcggctcgttcggccaaatccagtccaccgcccgcggggtcccgatttgcggctagccccgcggattgcgcggcgcccaccctggagagagagagacgggcgttgacggacggttgcggcgcgcagtggtgccaccaccatgttgcagtgcctggagggggtgaggcacctgggcggcgtgctcctcaagtgctgcgacatcgacctcaagcagcccaagggcctggaggatcccgaagtcctcgccagggagaccgtgttcagcgtcagtgaggtcgaagcgctgtacgagctgttcaagaagatcagcagtgctgtgatagacgacgggctgatcaacaaggaggagtttcagttggcgcttttcaagaccagtaagaaggagagtttgtttgctggatcgtgtctttgatttgtttgacaccaaacacaacggaattctaggatttgaagaatttgcccgtgcgttatcagtatttcatc

SEQ ID NO: 16964 - DNA, 817 bp, Triticum aestivum
  Clone ID: PAT_TA_16964
gcacgagggtgaggttttggttcttgaatcttgagaggcgaaagagaaagaaaggaagagagagcgacgccttgagagcaccagactgcgcagcaatggcgatgaaggcgaggttgttggcggcggcggcgacgtgcgtctgcctggcggcggcggcctccgccttcgacgtgccgaccgtggccttcgaggaagggttctcgccgctgttcggggacggcaaccttgtccgcgcgcgggatgacagggccgcccgcctcttgctcgatcgccgctccggttcgggattcatctcctcggattactacctgcacggcttcttcagcgcgtccatcaagctgcccagggactacacggccggcgtcgtcgtcgccttctacctgtcgaacggggacgtgtacgagaagacgcacgacgagctggacctcgagttcctgggcagccggtggggcgggcagtggcgggtgcagaccaacgtctacggcaacggcagcaccagccgcggccgggaggagcgctacctcctccccttcgaccccaccctcgaggcccaccgctactccatcctctgggcccccacccacatcatattctacgtggacgacacgccgatccactgggacttccggcaccccggcatgggcggggacttcccggccaagcccatggcggtgtacgccaccatctgggacggctcagcctgggccacggagggcggcaagtacaaggtgaactacaagtacgcgcccttcgcctccgatttctccgacctgtccctccgaggatgccgcgtcgccgacccggcggcgctgcgcct

SEQ ID NO: 16965 - DNA, 894 bp, Triticum aestivum
  unsure (1)..(894): unsure at all n locations
  Clone ID: PAT_TA_16965
tcggcacgagggtcgcttgcacagaaatcgcggcgccgcgccggggagagagagagagagagagagagagaaccctagcgacagccgtacaccgtcgtccaccccgatccaccacccatggcgctccgtaccctggcggcgagggtgcggactacagccgatgcggtccgcgtccagacgacggcccctcgcctctcccctccgcccggtggccgccccgacttccactccgccgccgccgcccgccgccacccgccggcccctcgcctctccgctccgcccgccggccgtccctgcctcatctccaacaggactttgcgtacgaaaattaacttgcaatcagctagtctagaagaattagagcgagaggcggggtccttaaggggacgattgtatgaggggtgtggagtctattagcaaggaggaaggagaggtccgatctcatcatgaaggacatctggggtaccatgaagctgatggcatgttcaggctgttgtggtggaaatcattgcattcaccatttctccagttgaggaacccaaggagattgcatgatcatcagttccctcccagtcatatgaacgttttgtttaagtcatcgtgttatgtactgcaatttgtgattgctataccggcataacttaagatgtggtaactgttgtggctgagtcttgttgggttcgtcacttacttcaggagctccatcgacctatcagcactgctacagttgttttttgtnacaatgtgagcgtggtaaatcctgctcaaaaccccggtacaacatcnacgaaccaaacaaattggagcttgacatttnatttgtcccgcgaagaaagttgcccttgggggttgttccagttctgcaagttcccttcctcnncaaantacgcgggg

SEQ ID NO: 16966 - DNA, 1430 bp, Triticum aestivum
  Clone ID: PAT_TA_16966
accgcgccctcctctttcaccccctcaaagacaccacagtgcgaggcttggagattcaggtgaggaagctctactgcatcagcagggccgccccgaggctaccgatcagcgtggaggatgccggccacagtcccatggcgtttgcagggtcgggctggagagaggtgccacttccctgcgttggtcaggcaacacgcttctggcatcgagttattgacctgcgcacggcggcgggtcaagccgttttccgtgtacagcatcaagttgaaaacaaattcagggaatatctgtcgtcaaaccttcttattagcatccacactccacctttgatttcagggtcaagtgaaggtggagcagcagtattcaaacttgaatataagaatggcaagtgtgcctgtttagcacaatcgcctcagctgcacaaggaagttgctatctgattggggttcgatcgtgtcttgaagattgggtctgtgtttagagcagaagactccaacacacataggcatctgtgtgagtttgttggtttggacgctgaaatggagattatgaggcactactttgaggtttgcgatattgtggatggattatttatacaaattttcagacacttgaatgaaaattgcaagagggaacttgaggcaattaataggcagtatccatttgaaccactgaagtacctagagagaaccttgaggctcagttacgaggaaggaatacaaatgctgaaggaagctggaacagaaatcgagcctatggctgacctcaacactgaagctgagaaaaaacttggtcagcttgttagggagaagtatgacactgagtttttcattctctatcaatatcctttggcggcacgccccttctacaccatgccttgctatgaaaacccagcgtacagcaactcttttgatgtcttccttcgaggtgaggaaataatttccggagcacaaagaatacatgaacccaagctgctggccaagcgtgcggcggagcatggaatcggtatgagttccatcaagtcatacatcgactcattcagctacggcacgcctcctcatggcgggttcggggtcgggctggagagagtggtcatgctgttctgcggactgcacaacgtccggttggcatcgcttttccctcgtgacccgcagcggctgagcccatgatccctcttcctcttaagagcgagtctgatccatgcttattctagctatgatgaaccttctcggtgcttagttacctctaccttttaagcaatgttctgctgttagtggttatgaaactgtcaccttgatgtgcgtagtagtaggcgagtttcggtagcagatcgaacacttgagcagggagaagtttgcagatgattgagaatcggtagttaactgaaaaaggtttgcagtaattcattcagtccacatgttgaagttgcc

SEQ ID NO: 16967 - DNA, 810 bp, Triticum aestivum
  Clone ID: PAT_TA_16967
gccggcgcctgtcatcttatccattccgcctgcggcaacggcgacggactttctcagacagacagacggagtaggtagccgttggcgacgtgaggcgccgacgtagacatcgcccgtcgtcgcagcctcggagcggaagaccggaagagaagaggcgggggcgcgggcgtctcgcgctcgacggcgttggtggagcccgggtccgggcgggcggtggccacgccgagggtggtgggcctagacggctcctcggcgcagttcgcggcgtccgtcacggcgggcgaggcactgggggacgccgcccgcgcgcccacctgtccgcgcagcgcagacaggatggcgttggacgcgcccgcccgcgcgctggcggacgagcgtgctctccatcaagttcgcctttgcttcgctctgcccaaggccatcctccgccggccgctctccgggcaggaagacgatcccctatcgctcaagcctagctccgcgcatgtcgtcgccagcggcaaggggcggatcatggctcgggtggcgccgctcgttatcgctgacgacataggtaccggaaccagtagactacatttgactgacaagcaacacataatgccatcctacatatatggattctgtttgtacttgatagcagcagactaaatttttgtttcagctagtgcttaagaaatcaacacgagacgtccggcagtggtgcaaaggttaatgataattttggacacatatgactgaaacacttgctgatattagcaaacgttaaatttatatatagttgagaaaaaaaaaaaataggtacttgattca

SEQ ID NO: 16968 - DNA, 1821 bp, Triticum aestivum
  unsure (1)..(1821): unsure at all n locations
  Clone ID: PAT_TA_16968
gnttttctgtacgctgttcagattcgacggtggtgtgttctctttgattcaggatgttgtgccatccgaagagtgcttcctgtggtgactctccagtagatgtctatcccttgatccaagttcgtctgaggttttctggcggtccgcttgtgacgcctgaatcagttgatgcgccagatccgtcagtttatgttgtatccgggcacgccggcggttcatgttcatcgtctgggcgaagaaggctcctaggtgcttgctgctgttcacaagatgcccgaggtcatccaatttatggttcatgttcgtggttccttttgctgaccacatgatgctttgcccgtctccaaacaaacatcacagaaaggtaattgtgttggtaagctgattgacgcgcatgtgtgtacgtgcgtgcctattgtattattacctgttgtattacattggtagcataggacggcctttgccatgtcgggtgcgctcgcttggcaggccacgagacaataaaaggaatattttgctggtgtccgcggggtggagatcgacacgggaactatcaatttgttctattttgcccgggttctccaccctgccatggtgtctctgtccttctcctttcatgtgttgttgattctgcgatatcctcgtggtacaccacgatcctacatagtaacaaatatatcgataggccctgggtgccgcgataactatgtactgaagatcaatgataactgaacttttgctggctgcccgcgtgtggccccccagtgaactaacgcgccggtctcgttagcccgggttctccccccgcccgccgtcgcttcgtcttccccatctgttcgtaggacgctccttgccgcttcacgtgcacccccctcgtacatcaaccaggcatgggtgcggcgatatttatatactgaagagcaaggaacaaaccagggtacatcccactgcttctatcgggcaaggcactttgctatttcaatttaaatttgcatatgcccgtcatcccaactcaaagcatacatggtggtttacccttcgtcatcgaacaaccttattttggcttcatgcgagatttatcctgcatgtacgtattgtactcttgcacgccaacaatactgatctgccctcgggcgatcatcgcgctcttgttcaatgttacaatgtcttcttttagaaaaaaatccgttgttaacttttttcatacttgggtttgacaagaaatttaggttacgctgcagtgtttctatcgtacaatgttcggaggtttgttcctttggtcgtaactaactatttcctgttcattctcatcccgtgtgtgcgtaggtgtgttcatttgttctacctcctgggtgtacatattttttatcaaggtctctaaattcctttgaagggcttgtttcctcctttgtatactccgtcagtcttccaaatttgatgcctcgttaatggccgtgaggactcgagcttgtccatatgttcttcatcatactccggtggatcatgctgggattccagttgagggttactggcatgtatagcctggcatatcatgaaaaattaacgattatgaacgcctttttttaacaacaacctcgccccgggtgcttcggtcccccagtccctccctgttcgccccgcgatccgtcatcgtcattgcatccactgccctgcgtgcgccgatggctccgttctgaagatcagtgcaaacgaaggtacatctagctgcttctagcgggatctagctgcttcgctacatcaatttaaatttgcatatgcacgtcatcccaactcttcgtcaatgaacagccttattttggc

SEQ ID NO: 16969 - DNA, 605 bp, Triticum aestivum
  Clone ID: PAT_TA_16969
attcggcacgaggctgctttgcaatgaaggcagccccatcatttgaggctgtcaagggtttagtcgaggggttggtcaagggagggtcggctccaggggccaagggtgttgttgctaagatgagctttcttgtgaaaggggatgctaaagttgcttgggagaagattgctggtgaattatctcttgaagagggagcacccaagttcagatccatgatttgttggaggcatgcaagtcagttctgatttattcaagtgttttggcctttgaataacgttgatgaagaagaagggcattcacatgggttctagtattgtcttcatgttatcatgggcctatctttcaaggtccaatagttagatcagagtgtaatgtctctataaggcagaatggtcagtgccatttcataatcccttttctgcaagagcttcttctattttgttgccttttggcaatacttaaaaagatattacatttgttaaagtgctaaggggatcttgatactatctactatctatcactgtaaccgtttgtttagtataattcagaatagttttatataatggtatgtttcaagcctcaaaaaaaaaaaaaaaaaaaaaaaa

SEQ ID NO: 16970 - DNA, 1701 bp, Triticum aestivum
  Clone ID: PAT_TA_16970
gaattcggcacgagctctcctccgtctgccgcgagctcctcccaccaccaccgcaccggcgccccgatgctcctcccggtgcgccgcccgcacgcggccccgtcccgcccggcctccccccggcacgtctcctcctcccttggtccccgatccagacaggtcgaccgggtcctccggggctcgaccgtggcgcgggccagcccggcggcgacggacgcctctgcctccgccggccttggccgccgcgcagtcgtggggatggcgctcgccgtctccctgtccgctcccgcctactgcagggcgccgcccccatcgtccgcgctcacggaggagaacctgctgttcctggaggcgtggcgcgcggtggaccgcgcctactacgacaagtccttcaacgggcagagctggttcaggtaccgcgagcgcgccctccgcgacgaccccatgaacacgcggcaggagacatatgcggcgattaagaaaatgcttgcaaccttggatgatccgttcactcggttattggaacccgagaaattcaagagtttgcggtctggcacgcaaggtgccctcacgggtgtaggtttatccatcggctacccgttggcccttaaaggatcacctgcagggctctccgtaatgtcagcagccccagggggtcctgcagaaaaggcgggcattgtgtctggagacgttattttggcaattgacgacacaagcgcacaagacatggacatatatgacgcagcagatcgcttacagggtcctgaaggaagctcaatagatttgactattctcagtggagctgataccagacatgttgttttgaagcgagaaagatatactttaaacccggtgaggtcaaggatgtgtgagattccaggttcagaggatagctcaaagattggttacatcaaactaacaacatttaaccaaaatgctgcagggtctgttaaggaagccattaagaaattaagggagaaaaacgtaaaggcctttgtgttggatctgcggaataacagcggtggtctttttcccgaagggattgagattgcgaagatttggatggacaagggtgtcattgtgtatatatgtgatagccgtggtgtccgtgacatttatgaggcagatggagctagcacgattgctgcatcagaacctttagttgtcctggtaaacaaaggaaccgcaagtgcaagtgagatccttgcaggagcactgaaagacaacaagagggcagtggtgtatggggaaccaacatatggaaaaggcaagatccagtcggtgtttgcactgtccgatggctcagggttggccgtgacggtggcgcgctacgaaacccctgcgcatactgacatagataaggtcggtgtgactccggaccgtccattgccggcatcattcccgaccgacgaggatggcttctgcagctgcctcagggacccagcttcttgcaaccttaatgctgcccggctgtttgtgagatcgtgatatggtcccaagtatgtgttgctgcgagcagctgcctctgcacattttgggtttttggccagttgggggggcttctgttgatatggtagtttttcttacctggggtgggtggctgatcctattcgttttgttaacatcttgatatcttgaaggagaaatctgttcacatctgtacaaagttccaatttcaccatgccggaaaggaaaaaaaaa

SEQ ID NO: 16971 - DNA, 1574 bp, Triticum aestivum
  Clone ID: PAT_TA_16971
gccccgtgcaccttttctctaccccgccccgcctggctcccgtaccccgcgaccgcagcctccgccgcagcaacgccaaacccccacgcgtacacagcccgcggcccggccccgtgggcagcagcaaaggtcgctttcgactccccccctcaaggacccttccccccccctcgtccacgccctcagcccacgctcccccctccgccgacgaccgaccgcccgcccgcccatgtcgatccagggcctgctcctcgaggtcagagtgacggggtgccggaagctgcgggacaccgagttcttctcgcgccaggacccctacgtcatcgtcgagtacgccaacaccaagctgcgcacccgcacctgcaccgatgggggaaggaacccgtccttcgacgagaagtttcatataccactcatcgaggggctccgtgagctgagtatcaacgtgtggaacagcaacacaatcaacaccgatgacttcattggcagctgcagggtgccgctgaacaaggtgctcacgagtggctacgatgattcctcatggcccctccagacacgccatatgaagtctgctggggaagttaagcttatcatgcactttgatgtctcagcaatgaagaacaagatggcaggtaaaacttctggccagtacgctccttcgccatacggtgcctcctcagcttcgtacccagcgccttcagcatatgctgcagcacccccaccgcaccaagcttatccagctcctagccacgcaccatatcctgctccttctgcgtactcaactccgcctcctcagcagccatacccaactccgcctcctcagcagccatacccgcagcagggaggtcctcctacaagtcacccaccacagccatatggacaaccgtacccaccgcagccatacgggcaaccgtacccaccacagccatatgggcagcaaccttacccgccacagccatatgggcaaccctacccaccaccttcagcagcacaatccccttatccacctgcgccgtaccctggagcttatccaccgcggccatattgatacacccagcttcagtgacctgacgtggcggcaccgaaacgaagaaatgatgatcagttgtggccgctgagctgtttcaaatggagtacaattcacaagcctactgaaggtgtgttagataactgaaacagcatgtaaatcgtctcctttgcgctagtgttgcgaacagcctagcaaatcatcagaaacgtttactctctctggtatgcactatataagtagcttgcagaacgcgtgatcaagtcagttctatattgtggttagaaaccttctgttttgaagccattatcgacctttctacccgcaagtctgtaactatagttctagctgcttggatgccagcgaatgcgtggcaactgcaaagcctgcagcgtcttgcagccgacctgaaacctgaagtgttttgtgatgctcaataaatttgccttgtttgatatacgccatggtgtgtggtgaatagaatgtgatttcgaatgagatttgtgcggatttgccaatcccaagatcattgatgctaaaaaaaaaa

SEQ ID NO: 16972 - DNA, 737 bp, Triticum aestivum
  unsure (1)..(737): unsure at all n locations
  Clone ID: PAT_TA_16972
gctttcctccctgcctcctcgtgctcccctccacctccaaccaacccaaaccaaaccctagatcgatcctaagcccccgacccaaattccccgccgaccggtcgatcactggatccgatggccggctcgccgccgccagcagaggaggtgccgatggcgccgggcttccgcttccacccgacggacgaggagctcgtctcctactacctgcgccgccgcgtcctcggccgccgcctccggatcgacgccatcgccgaggtcgacctctaccggctcgagccctgggacctgccccccctcccgcgcccccccagccgcgacgcgcagtggtacttctntcgcgcgccntcgaccgncaaggtggcccggcgcccggccccggcggccgcgggggcccccgggcaaccgcaccaaccgcgccaccccngcgcgggtactggaagaccaccggcaaggaccgcgaggtgttccaccgcggccgcgccgtcggcatgaagaagacgctcgtcttccacgccggccgcgcccccaagggcgaccgcaccaactgggtcatgcacgagtaccgcctcctcgacaacgacgggccccaggatatgcatgtggtgtgtagaatcttccagaaggttggatctgggcctcagaatggagcacagtatggtgcaccatacatggaggaggaatgggaagacgaggatgatgcaattgagaatacacctaccagtggtacatccact

SEQ ID NO: 16973 - DNA, 730 bp, Triticum aestivum
  Clone ID: PAT_TA_16973
gagaacatagttagcaagatggccaaagcagctcagaaatttggtatgcagagagcattggttgttcattcaaagggtctggacgaaataagcccacttgggcctggatatattcttgatgtcactccaggaaagattgaaaaaatgctcttcgatccattggattttggcattccgcgctgcacattattagatcttaaaggaggcgatcctgcgttcaacgcaaaagttctccaggatgttctcgctggacaaagaggctcaattgcagatgctcttgttttgaacgccgcggcgtccctccttgttagcggcaaagtcaaaactctgcaagagggtgtcgcgctagcacaggagacgcagcgctccggagtggccatcaacacgctcgagtcgtggataaaggtttccaatagctgctgagaccggggttgcttggcgagcagcagagctctccgcaataagacgcaaggaatgatgccaaataaggattcttttagtccatccattctccatcatatatatgtctgctcttcttgttccttttgttcgtctttgtcacaagcgtacgtagatgccgcctggtctggtttggtttgttcatccagcaatgttgtagtgtagagagaaaccccatgtggacgagattgtaaggttatggacggaacagaacaggcgcatgcatgcttatcttgttggctaaggtggattggttgatcattttgatctc

SEQ ID NO: 16974 - DNA, 1520 bp, Triticum aestivum
  Clone ID: PAT_TA_16974
gatggccgcccccctccctccggctctgcgcgaccgcctcgctcaagctctgctcccccaaaccccttgcccccggggccccgtcccccctcctccgccgcccgagcaccgcgcggcccgtcgcccggcgcctcccgccggcccgcgtcgccgtgcagcccgccgccgcgccggcccccgccgcctcccccggcaccgccaccttcgagcaggtgctggagcagctgatcggcggggccgacttcacggaggacgaggcggaggcgacgctgcagctgctgctcaacgagaagaacgaggcgcggatcgccgccttcctcgtgctcctccgggccaagggcgagacctacgacgagatcgtcgggctggccaaggcgatgatgagcaactgcgtccttgtcgaggggctccacgacgccgtcgacattgtcggcaccggcggcgacggcgcggacaccgtcaacatctccaccggctccaccatcctcgccgccgcggccggcgccaaggtcgccaagcaagggagcagggcgagctcgtcggcctgcggcagcgccgatgtgctggaggcgctgggtgtcaacatcgagttgggacccgagggtattaaacggtgcgtcaatgaggtgggtgttggtttcatgatgtctgcaaattaccatccggcaatgaaaattgtcagacctgtgaggaagaagctgaagataaagacagttttcaatatccttggtcctctgttgaatccagcaagggtaccttacgctgttattggtgtttaccatgagaacatagttaccaagatggctaaagcagctcagaaatttggaatgcagagagcattggttgtccattcgaagggtttggacgaaataagcccacttgggcctggatatatccttgatgtcactccaggaaagattgaaaaaatgctcttcgatccattggattttggcattcctcgctgcacattattagatcttaaaggaggcgatcctgcgttcaacgcaaaagttctccaggatgttcttgctggacaaagaggcccaattgcagatgcccttgttctgaacgccgcggcctccctccttgttagcggcaaagtgaaaactctgcaagagggtgttgcgctaccacaggagacgcagcgctccggggtggccatcaacacgctcgagtcatggattaaggtttccaatagctgctgagactgaggttgattggcaagcagcgggagctccgtaataagacgcgaggaatggtgttaaataaaggaaggattcttgtagtccgtccgtccgttcttcgtcatgtccctgtctgtctgtctgttcttcttgttccctttgttcgcctttctttccacaagcgtacgtagtagatgccgtctggtctggtttgatttgttgttcatctagcaatgctgcggagtagggaaaatctgatatgggcgagattgtaaggttgtggccggaacgggcgctgcttatcttgttggctgaggtggaggggacgccattttg

SEQ ID NO: 16975 - DNA, 700 bp, Triticum aestivum
  unsure (1)..(700): unsure at all n locations
  Clone ID: PAT_TA_16975
ccgacgaggagagggcgtcctcgacccccgacggcgccagccggccgcgccaggggctccgcccccgggaggcgctcgcccgcccccccggcgtcgcccggcgtcccccgcccgccgccaggagcgccgcggccgccaagaagagcgacaaggtcgtcgccgtcgacgccgacgccaagatagccaccgacatggccgcgcccaagcaggagccatgagaggtgaccggccgatggggacgaccgccacatgagccgtcgctcgcgccatgttcaccggtcttctctcatcgtgcatcgtccatcgctcgttttgggtggcccgattgcctgcgtgctagctggcttccctacatgcgcagtgtccatgtccatgtgtgtgcatgtgttgaagagcaaacaattcttgtagtgccacctcttctgtaacttctctctttttgcctccccctctcgctctcgtgctcccctctcgccccctcccctacatgctgccccgtcacctcgcttcgatcccctcctcctcgctctgctctttcctccaccaccatccggctctgcctgcccgcccatggccggcctgtacataacgcnttgtgtgtagatgggaaatttatggtgcaatgattagccctcgccaggcggccagatctgtggcgacacgagctgagcccttgctggcctttgttgtagggatcaaa

SEQ ID NO: 16976 - DNA, 489 bp, Triticum aestivum
  Clone ID: PAT_TA_16976
cccgggcctgaaataccatttcacataagaagaggcctgtgttaaggcaataggagttttatgcttcctagtctttgtggccctctcttcatatccacaccgtgcacaagcagatcactgcgtcgcggataaaagtaaggtgatgagggaatgctggaggaacattgggaagaatgttggcgagcacccccttctacacgggagcgtctgttgccaggtgataagggcagcaacagacatccactgcgtctgtgataaattcacaactgatgaactggctaggatcagtctagccaaatttgccatggctacacatgtatgcggcaatgggttgcgtgcacacactcactgtgcaggttacacagttcctgttataacgctacctgcacccccacctccgggcagtacctagagctaattcattgtaagggctgtctggtaatgtggagaaataagtgaataaaaaaaggaatgatgtgtcatttgctt

SEQ ID NO: 16977 - DNA, 702 bp, Triticum aestivum
  Clone ID: PAT_TA_16977
gaagatcggcatggagccttatggctacacaacataagatcaaggaacaacactaaagtagctggagtgttatgcttcctagtccttgtggctctctcttcttgttcgctccatgcacgagcagccaacgacatagatcactgcctccttgataaaaaaaaggtgatgcgagactgttggcatcacatcgaaaagaaacttggtgaccagtacccgccactccgtagcgcatgttgcaatacaataagagctgcaatagacatccactgcgtctgtgatcggttcaccgctcaagaactgagtttgctcagtctagccaagcttgccatggctatacatgtttccggcaatgggttgcacacatgcactcactgtgcaggttatcatgttccagaaataaagctatcacctccacccgcggcaagtaactaggccttaagtgtaagaccattttcaaaatggagaaataattaaataaagcaaagaatgatgtcagatgaatggaataaccttactacctccacccgcaagtacctatgaataaagtgtaggactattttcataatggagaaataattaaataaagcaaacgaatgatgtcagatgaatggcatttgctgtgtatttgacccttttttgtgtgtattaaaaaaattgggcatagcctcgtcacttgttgtttgcattggtatgataacccgt

SEQ ID NO: 16978 - DNA, 564 bp, Triticum aestivum
  Clone ID: PAT_TA_16978
ccggctgtcgcctccgtctcttcctcgccttgtttgctccgccttgctccgccgtcgcctccgatctcgcccagaggccaaccacagcatggagactgccgatgcatgcttccgtctctccgcgcaggtggaagggaatgatgatgacatccccaagaccgatgacgttgacgtctcatcgccacgctacatatcagacggcaaggcattcaattggggttgaatcttatagaagtatgtacgtcttttgtgcggtcggggtatagttgatatttgtaaagttactcatggtggatgctttgaacttttttcattcactgtgaagatatttgtgatacatgtttgttgatttattcggaccccttttgcactctgtaatatattgctcatgccattagtctatttctgttaggcctgggcccgggaccgtggattccagaggattgacccttgtaagtcaaaatacctcccaatcctcaccaatcccctatgggagaggattaaccgaacaagaccttgtatattttttcctcgttgctgactgtcaaaaaaaaaaaaaaaaaa

SEQ ID NO: 16979 - DNA, 1305 bp, Triticum aestivum
  Clone ID: PAT_TA_16979
atacattgcagtaaccagatgctttattccatatatatatgaaagacttgtaacatggaaggtgcacacagttcactacatgatggggttctttatgccatgtacgatggattatggtaccatggaagctacgtacacacagtccatcacatcacatgatggtgcatgcatctgggctctgatcgccgaaagtctgtggcggatagtgctgcggacacggcccgtaatacgttgcgggattggccgcatatgggtattggtggtactgctgataagcatagtgcgggtacgcataagggtaggctgctgggtggtagttgtactggtagaggccgttcatggccgtcatcttctccgcctccggcgccaccgcaacaagtgaagccggcacaggcagcttgaataggtgttccttcccttgggtctcctctacaaccgtctccttctcaaccccgtctccgtcccctttgcctggcttctccgtttcagccccttcttctcctgtcttcacctcttgtttggtctcttcttctgctcctccatttttgttttccagattatcagatggttcttgcttctcgggattggcatccgctgcaggcgcatcctcagccatggctgctgctggcgtatcctcatgcagtggctcagctcttaggatggcagccttcctccccgtgcacttgtggatgaatcctactagggtcgctggctcgaccgtccctttcaccatcatctgtgaagatttgatgtgcggcacggcctcctccactccttttatcttgagtatcctcctcttcatctcctcactgcaatcttcacagtgcaattcgatcttaagcactacaaccatttccatgtcgaactccgctgcatcctttttcatgtctggcgcccctgcaccggtgtttcttggtatcctcacttttcaccggcggtggaagcttctccggcgatgggctcagcagcaccgccttcttcccggtcttcatcttgaccgcttcgaccaccatgatcgggttctccagcgccttctggccagttaccaccaccgtgttggtcgagtgatccacgatcacctcctcaaccccatcgaggcgcagcagagaccggcgcaccttcctggcgcagccatcgcagtggaccggcacgcttaccaccaccccgtccgccggcgcatcgctgcctcccttcgccggcgccttgtccccttccttcccagtgctccgggcatcaccggccgccaacgccgccttcttcgccctcgtctggccatagtgtgtgctaggttcctcgatcgtaatt

SEQ ID NO: 16980 - DNA, 674 bp, Triticum aestivum
  Clone ID: PAT_TA_16980
cacactccttccactgtccacacctacaatcaccacagcggtggtgaaggaaccagagggtgagcccagctgcagccgtggggaggagaggtcaatcagcgagtcctgtagcaggcagctaaggggcatggcggactgggcgccggtgttcatcgggctggtgctcttcatcctcctctcgccggggctgctcttccagatccccggcaagggcaggatggtggagttcggcaacttccagacaagcggcatctccatcctcgtccacgccgtcatctacttcgccctcatcgccatcctcatcctcgccgtcaacgtccacgtcttcctcggctgaccacaggacgccgctagctgcttcctcctcatcgctcagcagttaggtgtcgtggtcgtggaggatcgagaggaatacccagtcactgccgcgttcatcttcaggcttcctgatggttcagcttctaggaggcacagtatgatgttcattgggcaatttagttgatgatttgatattttatgaggaatgtatagctccaactcttatatgcgctgtttcgtcttgtggtaactgagaatcaattgcaaactgaactatgtttaggaatctcatcttcagagagaaagcgtatatgagcattccacatgatgaacttcaatcattgatcaatgctcgt

SEQ ID NO: 16981 - DNA, 1171 bp, Triticum aestivum
  unsure (1)..(1171): unsure at all n locations
  Clone ID: PAT_TA_16981
cactcggcagcgggaggatgtggacagagtgttcgagacgaagagcagaggtgagggtcagatatctgaggggtcggaggagcagatacgggagctgagcaggtcgtgctccaggggaggacgcggcggtggcggcgggtcgggttccgagaaggaggacatccagccgcgcagcctcaccggcgagaagccccgctactcgaacaagcacggcaggttccaccagatcaccggcgaccagtgccaccacctccgcaagctcgacatggatgtcaccctcgtcaacattacccggggctcgatgacggcgctgaggtacaccacccggtcgaccaggatctacatcgtcgtggaggggcgcgacggctacttcgagatggcgtgcccgcacgtctccagctccggccgttctgaacgccgggagcacgagcaggagcgcgagcgcgaacacggacacggcaggagaagcgaggagcgcgggcaggagcacggcaggaggagcgaggaggaggagcacggccacggcggcgagcaggagaaatcgaggggctacaggcaggtgagggcccagatcaaggtggggtcggtgatcgtgctccccgcgggccacccggcgacgttcgtggccgggaacgaggggaacctcgccctgctgtccttcggcgtgggcgccaacaacgacgaggaggtgttcgtgaccggcgggaacagcgtgctgaagcagctggacgaggcggccaaggcgctggcgttcccccagcaggcgagggagctggcggacagggtcatccgcgcgcagccggagtccgtgttcgtccccggcccgcagcagcagcgccgcgtcgccgacatgtgagcgacgatctccagcgcgcgcatgcggtccctggagctgcatgcatgcatgagtgtacatgtgagtgtgacgggaataaatagctagcacggtactgcgtactacagtacgtgcgtgtagcagaggagaggagaggagagacgatgcttgtgttcgtgcgcggttatgcatgaatgcatgcatgcacgtgagttttctatgcatgtagtagtacgtgagttttccggtaataaaagacgtgaccttgcccgtcggctcgttggaacaaaaaaaaaaaaaaaaaaaaaaaaaaaaaaaaaaaacgannagnnnngg

SEQ ID NO: 16982 - DNA, 1939 bp, Triticum aestivum
  Clone ID: PAT_TA_16982
gcgagcggccgctcgcgatctagaacaataagccaactcgtcaccgggccagttagctgatcacgaacatcgatcacgatgaagtccacagtagaagatcgccatggctagtgcgtagccctcgtcctctccctgtgcctctccctctcgttcgcgtcgtgggatgccgaggacgtaggtaggggtagtaggaggtggcaagaagggggcggacgaagggcggtccggcggaaggtggccggccgtaccacttcggccagggagagcttccgggagtgggccaagtcgcggcacggccacttcaaggtgctggagcggttcgaccacgagctgctccggggttccatcggcgactaccgcgtcgcgtgcctggacgcggcgccggcgacgcgttcctgcagcccagccaccacgacgccgacgagagctcgccttcgtcagggaaggcgagggcgtgctcgtgttcgctgagggaacgggaaggcgggagtcgttctgcgtcagggagggcgacgtgatcgtgatccccggccgggtccatcgtgtactccgccaacacgcacccggtccaaatggcttccgggtcgtcatgctcctcaaccccgtctccacgccgggccgcttccaggagttctcccctattgggtctggaggcgagcacccgcagtccttcttcagcgtcttcagcgacgaggttatccaggcggcatttaacactcggcggggagcgatggtggacagagtgttctgagagcaaaagcaaaggtgagggtgagatatatgagggcgtcggagagagcagatacgggagctgagcaggtcgtgctccaggggaggacgcgggcggcggcgggtcgggttccgagaaggaggacatccagccgcgcagcctcaccggcgagaagccccgctactcgaacaagcacggcaggttccaccagatcaccggcgaccagtgccaccacctccgcaagctcgacatggatgtcaccctcgtcaacatcacccggggctcgatgacggcactgaagtacaccacccggtcgaccaggatctacgtcgtcgtggaggggcgcgacggctacttcgagatggcgtgcccgcacgtctccagctccggccgttctgaacgccgggagcacgagcaagagcgcgagcgcgagcacgggcagggcaggaggagcgaggagcgcgagcgtgagcaggggcggggcaggaggagcgaggagcgcgaggaggagcagggaaggcaggaggaggagcagggccacggccgggagcaggagaaatcgaggggctacaggcaggtgagggcccagatcaaggtggggtcggtgatcgtgctccccgcgggccacccggcgacgttcgtggccgggaacgacgggaacctcgccctgctgtccttcggcgtgggcgccaacaacgacgaggaggtgttcgtgaccggcgggaacagcgtcctgaagcagctggacgaggcggccaaggcgctgtcgttcccccagcaggcgagggagctggcggacagggtcatccgcgcgcagccggagtccgtgttcgtcgccggcccgcagcagcagcgccgcgtcgccgacatgtgagcgacgatctcgagcgtgccgtgtgcagttcgtggagctgcatgcatgagtgtacatgtgacgggaataaatagctagcacgtacggcactgcctactacagtactacgtgcgtgtagcagaggagaggagagacgatgctctgtgtacgggatgtgcatgcttgtgttcgtgtgcgtttatgcatgcatgcacgtgagttttctatgtatgtatagtacgtgagttttccggtaataaaagacgtgaccttgcccgtctgctaaaaaaaaaaaaaaaaaaaaaaaaaaaaaaaaaaaaaatgtcagttggtactactactattttactccgtac

SEQ ID NO: 16983 - DNA, 674 bp, Triticum aestivum
  Clone ID: PAT_TA_16983
cggcacggtggaattaacaccaaaatgttgaagcccaaggcctcgtctttgaagcccgtggcatcgtcttcctcgtcggtccggtgctgggcggtcatcgccgctgcactgatcttgtgtgcggccaacgttgagcttgtccatggaggtgggaggcctgtgccgagacctccggctccggtagggcatgtggctcccaaggagcactgccctgactgcagcgacaacccgccaccatcgccgccgcttcctcctactcctccggcggctgcagcagaagcacctcctgctagcagccatgtgtgatgtaggctgtgtgcgctccctcgttgggcagcaggccacttttgacatttcgacgtttactacagtctgtttgacttgctacagtggtactagttctttttctcttttagccgacactggtatgtgtgtttgtttggttttgctatgtctcaatcgacggttcaattgagtgtaaattagttcagaaagaacacaaataagtcgcggtctataaaactaagctataaactgtacactggatacacaattattgcaaattgccaaattgtgcgccagccaccaatctatccatggttgctgttaactgggcccatatattggtcaattagtaagtcagcatgtgtgcgtgaaaaaaaaaaaaaaaaaaa

SEQ ID NO: 16984 - DNA, 1059 bp, Triticum aestivum
  unsure (1)..(1059): unsure at all n locations
  Clone ID: PAT_TA_16984
ccgcggccgcctcggccccctaccaactagccgcagcctcccagagagaccagccccagccacctggagagaccgagagacaagcagagacccaacccagtgccttccgccacatagcatcacaccacccccagcacacatacataagcacgcatggcgcgctgggccattgccatccacggcggcgcgggcgtggaccccaacctgccggagcaccgccaggaggaggccaagcgggtgctggcccggtgcctgcaggtcggcgtggacctgctgcgggccggcgcgaccgcgctggacgtcgtggaggccgtggtgcgcgagctggagacggacccctgcttcaactcgggccgcggctccgcgctcacccgcgccggcaccgtcgagatggaggccagcatcatggacggccgcggccgccgctgcggcgccgtctccggcgtgtccaccgtgtcaaacccagtgtccctcgcccggcgcgtcatggacacggccccgagcacttcccccgcgagcagggcctcgaggttgtggacaacagctacttcatcacggaggagaacgtgggcatgctcaagctcgccaaggaggccaacaccatcctgttcgactaccgcatcccgctcgccggcgccgacacttgcagcgcgctggcggccgcggcggagggccacggcagcaacggcatggtgatgaacgggctgcccatcagcatctacgcgccggagacggtgggctgcgcggtggtggactccaacggcttcacggcggccgccacctccacgggcgggctgatgaacaagatgacgggccgcatcggcgactcgccgctcatcggcgccggcacctacgcgtgcgggcactgcgccgtgtcgtgcaccggcgagggcgaggccatcatccgctccacgctggcgcgcgccggcgccctnatgattanaagggctgctctgaagaagcctggactcgcctcaaggacggtcacaaggttgccggtaccctgtcggaacgcaaggggtacggtnaangatggagtccgggtggcacaacaggtaa

SEQ ID NO: 16985 - DNA, 545 bp, Triticum aestivum
  Clone ID: PAT_TA_16985
gagcagcacatcctcgaccagggcttgctggatgcccagctcgagctttggcaccacaccctcggctacgtcaagtccatggcgctcaagtccgccctggacctcggcatcgccgacgccatccaccgccaaggcggcgccgccaccctctcccagattgccgccacggccacgctccacccgtccaagatctcctgcctgcgccgcctcatgcgtgtgctcgccgtctccggcgtcttcggcgtcgaccaccccggggacggcggcgttgagggcgaggccgtctacgcgctgacgccggcgtcccgtctcctcgtcggctcggcctcggcgaacatggtccacgtcacgaagatgctcctccaccccatcctcgtctccccgttctccgacctcgggacttggttccagcacgagctgccggagccggacctcttcaagctgaagcacggcaagaccttctgggagctggccgaccacgacccggcgtacaacgcactcgtcaacgacggcatggtctccgacagcagcttcctcatggacat

SEQ ID NO: 16986 - DNA, 1017 bp, Triticum aestivum
  unsure (1)..(1017): unsure at all n locations
  Clone ID: PAT_TA_16986
cggattctgcattacacagtgcaggccaaggtggtacgaacgcacgcaaagtacactgcgactttggactacctaccctaaccggccggcgagagatcaagtccagactcaagagccatgagcaagagaggcagggatgtgtgggacatggagcttggaggcctggacacggcccgcctgctcatgctcctcgcgcagcagcaccagcagcatcaacaccagcgcgccgtcgccggggcggcgcaggcgatgggcggcgggcgcgtgttcgagtgcaagacgtgcaaccggcagttccccacgttccaggcgctcggagggcaccgcgccagccacaagcgacccaggcttcaacagcacccgcagaagccgcacgcgatcgacagcatcgacgacggcgcggcgctctgcctcggccgccgggcgccccaggcgccgccgctgccggccaagccgagggcgcacgagtgccccgtctgcgggctcgagttcgccgtcggccaggcgctgggcgggcacatgcgccggcaccgcgtcgaggccgaggccgccaccaacgcccctagcggcaaggcggcggagcccgagatggtggtcgcctcgtgcgacgccggcgggatctgcctggacctgaacctgacgccgtcggagaactgcgccaagtgcaggagcgcggcggggctcggcgccgctgccgggcagggcgtgcacaaggcgctcgccatgttagactgctccctctgatcattcagattgctcgtgccccctgatgttcctcgcgcgcatggcggtggctgctgattgctttcctgctaaactgttctattggtttgtttattttatactttattttacacctttcacatttttttgtaattttttagatgtaaatgttcataggctggtacgacggcgtagttctgaaacagatcaaacatgaacttttgcatttccttgctgtaaataatacttcatgnnnnnnaccacttattgtcgcccttttgaatcattacatgt

SEQ ID NO: 16987 - DNA, 1737 bp, Triticum aestivum
  Clone ID: PAT_TA_16987
ccccgcgtccgcccccgccgcttcatcattctttaatcccctccgatctcatccctgccttatttcttctctctgccggccgccgcaaaccctagccgccccgccgccgtcgccgcgcccctgccctcccgcgcggtgctgcggatggtgacgccgtcggcccggagaggtgcgtccgtcgtggcgtccgcgtcaatgcgccgtcccaaggcggtcgcggcggaggcgccctcccccgttgccgagagagtgaacggggccgaggtggcgggggcgggcatcgcgaggcccgacgcgctccgtaggttcggggagttccggggcaagtacgtgccggagaccctcatgcacgccctcaccggacaccatcacgcactccccgcgctagccgacgacgaggacttccagaaacaacttgacggcatcctcaaggattacgtgggccgcgagagcccgctatactttgcggagcgcttgacggagcactacaagcgtgctgatggcactggcccactgatttacctcaagcagggaggatctgaaccacaccggtgctcacaagtcctacaatgctgtggcacaagctctgcttgccaagaagcttgggaagcagcgtattattgctgagactggcgctggccagcatggggttgccactgccacagtgtgtgctcggtttggggggtgccacagcctctacatgggtgcacaagatatggagaggcaggcgcttaacgttttcaggatgaagcttcttggggcagaggtaaggccagtacattctgggactgcaacgctgaaggatgctacctcagaggccatccgtgactgggtcaccaacgtagagaccacacactacattttgggctcagttgcgggtccacacccatacccgatgatggtgagggagttccataaggtgatcggcaaggagacccgtagacaggcgatggacaagtggggtggcaagcctgacgtgctggttgcttgcgttggtggtggatcaaatgccatgggtctcttccatgagtttgttgatgatcaggatgtaagactgattggagtggaggctgctggtcatggtgtagacactgacaagcacgctgcaacattaacgaagggggaagtcggagttctccatggatctctgagttatgtattgcaggatgctgatggacaagtgattgagccccactccatcagtgctgggttggattacccaggtgttggacctgagcatagtttcttgagggatattggacgtgctgaatatgatagtgtgacagatcaggaggcattggacgctttcaagcgcacctctcggctggagggcatcatccctgccctggagacatcccacgcgctggcttacctggagaagctctgcccaacactaccggatggtgtgagggtggttctcaactgcagtggaagaggagacaaggatgtccacacagccagcaagtaccttgaagtctagaactccggaaagactaaacaatggtggctttcgtatgagcagttttgaaagcgaaaaaagaaagcaattgcttagtgttgttctttggggtacaatatgagggtacaaataatcctggaagtcggttggtctatagctaatttagcttggtttgttgaattttatctaaataaaaatatgttgtatgctaaacttggtaaataaaggctcgttttgtgccaaaggctgtttgtgtgccatgcattactttcaaaccc

SEQ ID NO: 16988 - DNA, 661 bp, Triticum aestivum
  unsure (1)..(661): unsure at all n locations
  Clone ID: PAT_TA_16988
aacccattctccatccccacctccacctcctccgatcccatccacccccaccctcaccgccaccaagtcaaagatccaacctttacctccatcgacatgacgaacccatcgccggcgccagccaagggggcgtcgctctggggcagccagctgaagcagctgcgctccctcttcgaccgcttcgacatggacggcgacggcagcctcacccagctcgagctggcggccctcctccgctccctcggcctacgccccacgggcgacgagtcgcgcgcgctgctcctcgccatcgacgccgacggcagcggcaccgtggagttcgacgagctggcgcgcgccatcgcgccggtcctcaccgccccacgcgccgcggctcgtcgaccaggcgcagctgctcgaggtcttccgcgccttcgaccgcgacggcaacggctacatctccgccggccgangctcgcgcgctccatgggccaaggcttggggccagccgctcacctttcgaggaggctgcggaccaatgatgccgggacgccggaccccggacggggacnggcgtgattagcttccgggggttcgccgccgtcatggcccggtccgcgctcgacttcctcggagtccccgccgcctaagatgtgagatgacgaccgggcgggctccggct

SEQ ID NO: 16989 - DNA, 1623 bp, Triticum aestivum
  unsure (1)..(1623): unsure at all n locations
  Clone ID: PAT_TA_16989
nttgaaaatcgntttgatcggangataatcgtnattnaagtnaccganaanagccggcctttgctcgccccgaaacagcccgacctcctcagcgtcgcgtggtgggaagacgagaacctcccaaaggccaaagcccaccccataacccctaacctagggtttcgccgccatgggatccgccgcctccgccgcctccgacgcagcgccgccaccgccttctccagcgcaaccacacggggccgcgccgccgtatggggttgggctcgccggcatcctccctcagaagccggatggggatgataagaaggaggagaaggtggactacctcaacctcccttgccccgtgccgtacgaggagatccagcgcgaggccctcatgtctctgaagcctgaactttttgaaggtttgaggtttgacttcacaaagatgttaacccagaagttcgctcttagccatagtgtccttatgggctccctggaagttccgtctcagtcagctgatgttataaaagtcccaacatcacagtatgaatttggtgccaattttttagatccaaagttaatgcttatcggaaggttgatgactgatggaaggctgaatgctcgtgtgaaatgtgatctgacagagaatctcgcgctgaaaataaatgcgcagcttactagtgagcctcattactctcaagggatgttcaactttgactacaagggcacagactatcgagcacagtttcaaattggaaacaatgcgttctatggggcaaattatatccagagtgttacgccaaatttgtcgatgggaacagagatattctggcttggtcagcaaaggaagtcaggaattggatttaattctcgctacaatacagataagatggtgggtactctacaggttgctagcactggtattgttgcgttaagttatgtccagaaagtttctgaaaaggtgtctcttgctactgactttatgtataaccacatgtccagagatgtgacttccagcgttggttacgattatatccttaggcagtgccgtctaaggggcaaagttgactcaaatggtgtcgttgctgcatacttggaggagagattgaacatgggtgtcaactttcttctgtctgcagagattgaccatccaaagaagaactacaagtttggttttggaatgactgtaggagagtagatatgctcacagcaattactgtgagaggactacagatgtctcctcagttcgttataagtgcaggtttaccatatggtctcggttcaagtgttcgggacctacagattcgctcctcaagcgttgcaggctttttcggtgtacttgcggttgtctcatttcagctgctttagatagcatgggcatttgggcgtccatgattctttgtttatctaaaacaagctgaaacgttgttgtaataatgttcacttggttgttggagatttttgacccttaggttcccagcaataggcttctgtgaaatgaccgtactccacaagctacagattatacattgagaattcatgtgcaatctttgctctcatatcagttatatgttcttgccaaaaaaaaaaaaaaaaagaaaaaaggtggaaaaaagagggaaaaaggaaaaaaagggaagg

SEQ ID NO: 16990 - DNA, 1287 bp, Triticum aestivum
  unsure (1)..(1287): unsure at all n locations
  Clone ID: PAT_TA_16990
gctaggnagcttttgattggtgctggcaaaaggggaggttagtggccaagcatttggctgcaaaaggatgcacgaaggttgttattgtgaaccgctcggttgaaagggtggatgccatccgtgaagagatgaaaggcatcgagattgtgtacaggcctctgacagagatgtatgaagctgccgccgatgcagatgtcgtgttcacgagcacctcatctgaatctccattgttcaccaaggagcgcgcagaagcacttcctcctgtttctggtgcccttggcggtgttaggcttttcgttgacatatccgtcccgaggaatgtcagcgcctgcgtgtctgatgttggccatgcgcgagtgtacaatgttgatgacctgaaagaggtggtggaagccaacaaggaagaccggctaaggaaagcaatggaggcccaaacaatcatttcagaagaactgaaacggttcgaggcttggagggactcgatggagaccgttccaaccatcaagaagctgagatcatatgccgataggatcagggcttcagagcttgacaagtgcctgcagaagatcggagaagatgctctcaccaagaaaatgagaaaatccatcgagcagctcagtaccggcatagtgaacagacttctccatggcccattgcagcacctgagatgtgatggcactgacagccgcacccttgatgaaacactcgagaacatgcacgccctcaacaggatgtttggcctcgacaccgagaaggcggtcatggagcagaagatcaagacaaaggtggagaaacagcaaacccaaaactgagatcagcggtctagttcctgcctgtagatctacatatactcccaatctgtcctgactctaattccaattttgtttaaccatctcttactgggccctccttggtgagttcgtccattgtatagtgaattagcgcctgccattgcaggcgccaaatatgttgagacagcaaaatgtttgtactccacaacagcttttgtgcattatcatggatattgtggcctggggcatggctatttgattcacaggaaaagtgaaccaaaaaacatttgaaataaaaaaaaaaaaaaaactcgagagtcttntagagcggccgngggccctcgtttttcnccggtggggtcccaggtagtgtcccaattcgcctatagngagncgnatacaattcnctggncggggttttnaacgtcgggntnggaaaaccctgnggttncccacttaatcnccttggnganatccccttttngccgtngggggn

SEQ ID NO: 16991 - DNA, 867 bp, Triticum aestivum
  unsure (1)..(867): unsure at all n locations
  Clone ID: PAT_TA_16991
ctcctgccggatgccgcccctgcttcgtcctgctgcaggcggcgggggtggtggtccaccagcaccgcggtgcttcttctacttcgctgctgctgctggtgctgccccccctacgtcgggcgccacctgcttgcttcttcggggggaggttgttgccgccgatgatgggggcggcgtcatcctactacccgcctgcggtgctccccgcatcgttgttgggggaagggggtgggggaagaaatatgtttacttgatgaacttaccggaggtgaaggagcacacacaaaaattaaggtctgccaactgttcatgctcctatttggctcagatcctttcattcctggaatttgggggaatgggaaacgtccgcaaacttccttgccttccggaccttttcgaagacgataaaaatgtcactcctaaaatttgctgaatgtgttgaccctttcatccgagttaatgaagggattgtaggaaagcgtgtccccatgcagattggtctccgaaagtccaaagcgggcacaccactaacggtgatcgccgcaccaactaccctacccgggcccgcacgggccccgcagccaccccttttgctctgtcaatctaagaaggcacacaaagcaagggtttgggtttccaagaagancaaanggaatactattgatcaagggaaccctgctccgacggatctcnangataacaattcacaatgacaaaattccggatgatanancnatcatatggaatgaccccgggtgataaagcggntaaatggaatgacatggantatactcacaaacatgtatctcccgtaatcccctcnctaagtacncnacaaatcggcatcgtggaaaantcagagtancc

SEQ ID NO: 16992 - DNA, 798 bp, Triticum aestivum
  Clone ID: PAT_TA_16992
cccacgcgtccggatggatcaacaattcctgtttatgacactccacttggaaagattggagcccttatttgctgggaaaataagatgccactcttgaggacagcactgtatggtaaaggtattgagatatactgcgctcccacggccgattcaaggccagtgtggcaagcttccatgacacacatcgccatggaggggggatgctttgtgctgtcggcgaaccagttctgccgcagacaggactaccctccgccgtccgagtacgcctttgccggtttaggagaagagccttccccagacaccgtcgtttgccctggaggcagcgttatcatttcgccgtcaggcgaagtcctggcaggtcccaactacgacggagaggcgctgatcacagccgaccttgacatgggagagatcgtccgggccaagtttgattttgacgtggtgggccactactctcggcctgaggtgctgagcttggtggtggatgaccacccgcaccgcccggtgtccttcacctctgccgctgaaaaggctccggctgccaaaagcgacgaccccgcaaagccctgacgcccttcagctcagtcgcaagcagttgatttctatcgagggtttttttttttgtgtgaactgcgaaaaaatttttgtcgatagcttaataaacccgattaaatgtaggctcgggtcgcccgcatgtttgacccacgcccctgtaactttggctgcttgtaaaaaaaaatcccttccggaacaatcacccgaggcccgttcatcgtgtgatgcatctgatatctatat

SEQ ID NO: 16993 - DNA, 680 bp, Triticum aestivum
  Clone ID: PAT_TA_16993
cggacgcgtgggcggacgcgtgggcggacgcgtgggcggacgcgtgggcggacgcgtgggcggacgcgtgggcggacgcgtgggagaggcgctcatcacagccgaccttgacatgggagagatcgttagggccaagtttgattttgacgtggtgggccactactctcggcctgaggtgctgagcttggtagtggatgaccagccgcaccgcccggtgtcattcacctctgctgcggagaaggctccggctgccaagagcgacggcaccgcaaagccctgatgaccatcggctcagtcacaagcagttgattatcatcgatagttttctttttgtgtgaaacgacctctatcgatcgatagcttaataagccgatgaaatgtaggcttggatcacccgcatgtctgacgcagtgacgcttgtgacgggacaatcagctgaggtctgttcaccgtgtgatgcatctgatatccactgcctactgctgcccactgaaacagacgcagtgttaaaggcgtgtgatgctggagaaatgctcacaacgccctcacagccatccagttgcaagcctgcagcaatgtgcggtgctgtccaatgttttctctctactccgactccaatgtgcgtgtgatggcgatttttcgaacgtccggacaattttgatgacagctgttgaatggct

SEQ ID NO: 16994 - DNA, 1848 bp, Triticum aestivum
  Clone ID: PAT_TA_16994
cacccacccttcccgccgcaccccgctcccccgcctccccgcgttcccctccaatgcccacctctgcttccaatccgacttcgacatcaagctcccagttcgtccgtaagcctcagcggcggaagtaccgcgatcgagcgagcgagtttcccgggcccacactgatggctctggttccctcgggctcaggcggcgcgccggtgatcgccgaggtggagatgaacggcggcgccgaccagagcgccaccaccgtgcgagccaccgtcgtgcaggcctccaccgtcttctacgacacccccgccactctcgataaagcagagagattaatagcagaggctgctggatatggttcacagttggtggtgttcccggaagcttttgttggtggttatcctcgcggatccacctttggctttgggatcagtattagtatcactaatccaaaagacaaaggaaagcgtgaattccagaagtattatgcagccgccatagacgtgcctggtccagaggtgacacgtttagctgctatggctgggaaatataaggtctttctggtaatgggtgtgattgagagagaaggttacacactgtattgttcagtgctcttctttgaccctctaggtcggtacctgggtaagcaccgcaagctcatgccgacggcattagaacggataatatggggatttggagatggatcaacaattcctgtgtatgacactccacttggaaagattggagcccttatttgctgggaaaataagatgccacttttgaggacagcactgtatggtaaagggattgagatatactgcgctcccacggctgattcaaggccagtttggcaagcttccatgacacacatcgccatggaggggggatgcttcgtgttgtcggcaaaccagttctgccgcagacaggactaccctccgccgtccgagtacgcctttgccggtttgggagaagagccttctccggacaccgttgtttgccctggaggcagtgttatcatttcgccgtcaggcgaagtcctggcaggtcccaactacgatggagaggcgctcatcacagccgaccttgacatgggagagatcgtccgggccaagtttgattttgacgtggtgggccactactctcggcctgagttgctgagcttggtagtgaatgaccagccgcaccgcccggtgtcattcacctctgctgccgagaaggctccggctgccaagagcaacggcatggcaatgccctgacgtctatcagctcagtcacacgcagttaatatcatcgatagttttctttttgtgtgaaacgacctctatcgattgatagcttaataagccgatgaaatgtaggcttggatcacccgcacgcccctataagttttgctgcttgtgacgggactatcagctgaggtccggtcaccgtgtacagacgcagtgttaaaggcgtgtgatgctggagaaatgctcacaacgccctcacagccatccagttgcaagcctgcagcaatgtgcggtgctgtccaatgttttctctctactccgactccaatgtgcgtgtgatggcgatttttcgaacgtccggacaattttgatgacagctgttgaatggctaaaattgttcgaacgttccggtctggataatttggtgacctgcttggagtttccctaagtttagcacttttattttccgaaaaatcccatatgcttattagtgcagctgcactaattgggttaatcgagcgtacgcgctacacaacaaaaaattcacacaacatggggtgcatccgagcagacctgtcataaagggtaattagcatcatgtgtcatcattacactacaaaatagaaac

SEQ ID NO: 16995 - DNA, 320 bp, Triticum aestivum
  Clone ID: PAT_TA_16995
gagtgagcggcgagcgcaaccgatggcgggatcctccgccgtgtacacctcctgcaggccgcacgcgcgcgccttccaccaccacccggccgaccaggcccagcggggcggcgggctgcccggcctgctccccgccgcggcgtggaggaggggcggcgcggccgtgccgagggccagcctggtggcggcgcggtcggcgacggaggaggcggtgtacgaggtggtgctgcggcaggccgcgctggtggaggacctgcaggggcggcgggaggccgacgccggccggcgccgccgctggcgggacgagcaggtggagcagg

SEQ ID NO: 16996 - DNA, 547 bp, Triticum aestivum
  unsure (1)..(547): unsure at all n locations
  Clone ID: PAT_TA_16996
gtccggtgaggctgggctccctggatgcatccaagctcatcgtccagcaggagtgatgaactcaatgatgtgcagggcaagtgatcatagtatgctctttacttgttcattattttacagtaccacatgtactactaaaagaagaaaaacaatatataaataacagagatgcttttctatttactggcagcttaaggttagcttgttctttatatattgtttttcttcttttagtagtcttcttcttttttgttcgtaatacattatcatggctcacgctaacgtttggaactctcaccccaagaccttcggcaagggatctcgtcaatgtcgtgtctgtgcccaccgtgctggtttgattcgcaagtacaacttgaacatctgccgtcaatgtttccgtgaatatgccagcgatattggtttcaacaagttccgctaaacatttttgtttctgttatttgatgcgcataacatcacttttgtattaaaagacatggggcgtaaacaaaaaaaaactttaataaagacaaaaatttaacaaaanaaa

SEQ ID NO: 16997 - DNA, 1396 bp, Triticum aestivum
  Clone ID: PAT_TA_16997
ggagctcctcctcctcacttcagagcaggttcatctccaccccgtcagtcagtcaggcggcagcaatggcggaagaggggaacagcgcgggcagcggcgggcgcggcgtccgggtgtgcgtcaccggcggcgccgggttcatcggctcctggctcgtcaggaagctgctccaggccggctacaccgtccacgccaccctgcggagcatcggggacgaggggaaagcggggctgctgcggcggctcgtccccggcggcgcgccgccggagcggctggtgctgttcgaggccgacctcttcgacgccgccagcttcgcgccggccatcgccggctgccagttcgtcttcctcgtcgccaacccctccgcgcacgaggccgccgcctccaagtaccaagacatcggcggaagccgccacggatggggtgcgcatcatcctccggctatgcgcggaatctatgacggtgaagcgcgtcatccacaccgcatcggtgacggccgcttcgccgctgacaaagtcctccagcgccgcggccgctgtgtacagcgatttcatctctgaatcttgttggactctgttggatgtcgattaccctctccggagcgtgcacttcgataagtacatagagtccaaggtcctgtcagagaaggagctcctcagctacaacgacggcgagagcccggcgttcgaggtggtcaccctgtcgttgggccttgtcgggggcgacacagtgctcagccacctcccagagacggtggagagcatggtggccccggtaacaaagcaagagccctacttcatgctgccgaggatcctgcagaggttgctgggctcgctgccgctggtgcacgtcgacgacgtgtgctccgcgctcatcttctgcatcgagcaacctgccctctcaggtcggttcctctgtgccgctgcctacccgacaatccacgacatcctggaccactacagcagcaagtacccccatctggatctcctcagagaggctgatgaggtagcgagggtgcaacccgagaagaacaagcttgtggagctgggcttcaggtacaagtatggggtggaggagatactagacgaaagcattgactgtgctgtgaggctgggctccctggatgcatccaagctcatcgtccagcaggagtgatgaactcaatgatgtcgagggcaagtgatcacagtatcctctttacttgttcagcatttacagtaacacatgtattaaaagaagaaaaacggtacataaataacagagctgctttgttatttactggcagcttaacgttagcttgttcttcgaattttgctctggaaatcggtacacattcatatcatccctgaaatccttgggttttccatgtaatctaatacacgagtttataatagat

SEQ ID NO: 16998 - DNA, 661 bp, Triticum aestivum
  Clone ID: PAT_TA_16998
gtcgacgacgagtaccgcagcgcctacttccccttcgaccccgtcgacggcgagacccacactggccccttcgagttctccaccgagcgccgcatggacctcgacgtctacttcacctacatcaagtcctggtccgcgtaccagaccgccaaggacaatggcgtcgagctgctcgacgacgagactgtgcgggagttcgccgacgcgtggggcggcgaccgccaggaggtcaagacggtgacgtaccccatcttcctcaggatcggcaaggtgaggccttgagaatcacctacagatgcggcatgatgatgcaagtggccttgagaaagccacgctttcaagtcttcacgtgacgaagtgaagatggtgcaaaatgccgaccagcgtacgtgtgccgccgctggaccattttatttgcattccacgctcttttttacaggacgaagtgatttttggcatcctgctactaccatcccctcctattcatattccaaattcagcgtgtaacaaatggtattcctagtatccatcccattttctagacaaataattgtaagctgtggatgttaccttggtctatcgtatatgaatgttatttttgccagtttagctatatgtaagttgcctgaatattgaattaaggccagtcgatttttctgac

SEQ ID NO: 16999 - DNA, 1192 bp, Triticum aestivum
  Clone ID: PAT_TA_16999
cccacgcgtccgcccacgcgtccgcccacgcgtccgtccatctcctcggttcagcccacaggcaacgaacgcacacgagcgtgcgtacgagcgagcgagagagataaagatggcgaacctgttcctgaagcaggcgaagcactacgcggcggcgcggcctgactacccggcggagctcttccagttcatcgcgtccaagacggcgcgccacgacctcgcgtgggacgtcggcaccggcagcggccaggccgcagtctcgctggcgaagctgtacaagaacgtggtgggcacggacacgagcgcgcagcagctgtcctacgcgccggccctccccaacgtgcgctacgcccacaccccggcggacctgccgctcgacggcatccacgcggccgtcgcgccgccgggctcggttgacgtggtcaccgtggcgcaggccttccactggctcgacctgccgcgcttctacgcgcaggcacgctccctcctgcgcgcgcacggcgtcctcgccgcatggtgctacacggagccccgcgtgggcgccgcggtcgacgccgtcttctggcgcctctacgacggctcgcagccgcactgggcgcccaaccggaagatggtcgacgacgagtaccgcagcgccgacttccccttcgaccccgtcgacggcgagacccacacgggccccttcgagttctccacggagcgatgcatgaacctcgacgactacttcacctacatcaagtcctggtccgcgtaccagaccgccaaggacaatggcgtcgagctgctcgacgccgagactgtgctggacttcgccgacgcgtggggcggcgaccgcgaggaggtcaagacggtgaggtaccccatcttcctcaggatcggcaaggtgaggccttaagaatcagatgcagcatgatgcaatgcaagtggccttgagaaagggacgctttcatgtctgcacgtcacgatcgaagtgacgatggtgcaaaatgccgagcagcgtacgtgtgccgccgctggaccattttatttgtattcccctcctattcctattccaaattcagcgtgtaacaaatggtattcctagtatccaccccattttagacaaataattgtaagttgtggatgttacctttgtctatcatatatgaatgttatttttgcggtgttgctaaaaaaaaaaaaaaaaaggccccta

SEQ ID NO: 17000 - DNA, 1270 bp, Triticum aestivum
  Clone ID: PAT_TA_17000
cggccgctcgacgcggccggccgcgccggccgatcatatcatagaaaaacaagcatccatctcctcggttcagcccacaggcaacgaacacacacgagcgcgcgaatgagcgagcgagagagagaaagatggcgaacctgttcctgaagcaggcgaagcactacgcggcggcgcggccggactacccggcggagctcttccagttcatcgcgtccaagacggcgcgccacgacctcgcgtgggacgtcggcaccggcagcggccaggccgcagtctcgctggcgaagctgtacaagaacgtggtgggcacggacacgagcgcgcagcagctggcctacgcgccggcgctccccaacgtgcgctacgcccacaccccggcggacctgccgctcgacggcatccacgcggccgtcgcgccgccgggctcggtcgacgtggtcaccgtggcgcaggccttccactggctcgacctgccgcgcttctacgcgcaggtccgctccctcctgcgcgcgcacggcgtcctcgccgcatggtgctacacggagccccgcgtgggcgccgccgtcgacgccgtcttctggcgcctctacgacggctcgcagccccactgggcgcccaaccggaagatggtcgacgacgagtaccgcagcgccgacttccccttcgaccccgtcgacggcgagacccacacgggccccttcgagttctccacggagcgatgcatgaacctcgacgactacttcacctacatcaagtccctggtccgcgtaccagaccgccaaggacaatggcgtcgagctgctcgaccgtggggcggcgctcgccaggaggtccacacggtgaggggccccgtcgtcgttcgaccccgcctgccgcggcctcggcaagctccggccgtggcggcctgcggatgcagctggccgcgagtggccctcgctttcgggtcgcctcctggcctgctcgtgacggtccaagtggccgtcctgcgtacggccgccccccctgcgcctgccgccgcgcgtccctcgctcttgctttccgcgcgctgtgttctgggccatccgacttctgccatccccccccttccatccccctccttctccgtgtcccaattcggcgtcctactatccatcccattttctcctcgtatccttcccagctgcgggtcttaccttggtctgtcgtggatgtttcctttgtctatcgtatagtatatgaatatatttttgcggtgttgcaaaaaaaaaaaaaaaaaaaaaaaaaaaaaaaa

SEQ ID NO: 17001 - DNA, 900 bp, Triticum aestivum
  Clone ID: PAT_TA_17001
tattctgcaccaaacacgtacgcaccaacaatctcatcggctctttgaaaagaaaacgtctcgttggcaatggcgcgctccagagtctcgatcatgtcatcgcgggtgctcctgttgatcgtggccgtcgccgcgctcgtgtccgcgtgcgcggcggacccggagccggtgcaggacttctgcgtggcggcggccaccaacggctcggccgaccacccgtcgtacccggggttcccgtgcaagccagcgtcggcggtggtctccgacgacttcttcttcgcggggctggcgcgctcgggcgccgccgacgcggccgagagcccgttcgggtccagcgtgacgtcgggcaacgtggcggccttcccggggctcaacacgctcggcgtctccatcaaccgcgtcgacctcgcccccggcggcgtcaacccgctgcacagccacccgcgcgccgccgagctcgtgcacgtcgtctccggccagatgctcgtgggcttcgtcagcaccgccggcactttctactccaaggtggtgcgggagggggagagcttcgtcattccgcgcggcatggtgcacttccagttcaacaccggcaaggagtccgccagggccgtcaccgtgttcaacagccagctccccggagttgtcctcgccgcgccgtcgctcttcggcgctgacccggagatccccgacgccgtcctctccaagagcttccaggtcgacggcgagatcatcaagctcctcaagtccaagttccggacttaaaaaacgacgcacgagtaattttgattggtttattgttcatatatatatactgtacaccagtaaatacggacacctaaagtgttcactgtttcatgtaattttgattggatatttaatgcgtcaataaaatttaagttc

SEQ ID NO: 17002 - DNA, 629 bp, Triticum aestivum
  Clone ID: PAT_TA_17002
cgccctcctcggccgtccgggctcccgccccccccccgggcggcggcccgccgcgctctccagcggccggccagcgacgccgcggcggggcccccgcccccgctcccggctcccgccgcggtcccccgcggcccgccggtcccccgccggtcctccgcccggtgccccgccccgcccgccgcctcccggggggcctcctcaccgccctgccccgcccgcggcggcgctccgcgccgccgccccccccgccccgccccgcctgggccggccccgccctccgccgccccggcctccgaccccccgtcccccgccccgcgcccgcccccgcccccccgggccgccgcccccccctcctcgctcgcccgggcccgcgctggcgcccgcgcccccctactcttgcgcctcggcctccgcctcctctcgctgtcctcatggcttccgcctcatcctccacctcaacttggcagtccgcttgcttcctcctgtccccgcgtcttctgcccttcgctcagcgtgcccccacgcctcccgggcgagcatttggggcagaccaatttgatgagaacgatcctgaagaatttgcctcgagaagttccttcttcaattggtggtattttgggacgtatgca

SEQ ID NO: 17003 - DNA, 1209 bp, Triticum aestivum
  Clone ID: PAT_TA_17003
ctggagcgggctcaacatttctaaatcttttggctcatcaaagaaatttttctcagcgtcggttcctggatcaagaattgcttctagggcaacgtcacctgtctcaagaagaacaagccctcctcgatctacaactccaacacctaccttgggtggtctaacatctcctagagttgttgtagatggtgcaaagccaataaaggatagtgtaagccaagaggttatacatttgagatcgcaggtggaaaatcttacccggaagtcccatctactggaagttgaattggagagaacaactaaacagttaaaggaagctatttccattgcaggggaggaaactgcgaagtgcaaagctgcaaaagaagtaatcaagtcgctcactgcacaattgaagggtatggcagagaagctacctgaaggagcaggagcaggagcaggggcaggggcaggggcaggggcagttaagcacagtagactgccaccactttctggagtgcctgttaatgacatatcaatggcaactgagaatttaggtagcccaagaaattcaggagagccatatttgaacgggtctaatgggttgattgtttctaatggaccaagttcagttagaaataagactcacctggaagttggcaagaatggaaccaaacagcccgattcagactctaagcctgagtctgaatgggtagagcaagatgaaccaggggtctacatcacccttactgccctacctggaggggctagagatcttaggagggtacggttcagccggaagcgtttcagcgagacgcaagcagagcaatggtggcaagagaaccgggcaagggtatacgagctgtataacgttcgtgtggtggacaaatcagtcaccagtattgatagtgatgtacctcactgacatagagcatgcgattggttgcgaggttatttagggcctgaaagaaagagggctgctgtttggaaaatgtgggcttgcccaaggagaagtgatgtaaatggttcgtggcagccggctaatctgccctgtaaatgcataagcaagcacaccaatttagagtttgttcttcctaattttccattgatccacgaatatataggtccaacagccgagccagagataacgggtgcagaacattttggatgctaattgtagattgagatgcgaagcagccatgcaagagttaagctttattttcattgtgctgc

SEQ ID NO: 17004 - DNA, 762 bp, Triticum aestivum
  unsure (1)..(762): unsure at all n locations
  Clone ID: PAT_TA_17004
tgtcgtagtggagagcaaggtcttcatggcggggtggagctgcaacggagggaaggatgctggacggatccggcgcctgtaggctgaagcagcaggagttggtggattcggcggatgcggacggggccgcgcgcccgggctgggagctcgggggcgccacgaggaatggaaggttgagttcgttcgacggccggtgcagcaggagcaaggagccaactgtggtcaatggctaacctctatctcctctctctctctatggttgagaagaaggccaaatagacgaagaagaatttggctcgaaagtcttgccaagggtacgataaaattaggcacaatggcaagatctgtagcatctactgtgaacacaaagcggagaaaagggattgcttcctcgtccggtaacccaattgtgttgctttctttcgttttattcctccatacatgcaaattagtttattctggagcttctccataataagaggtaccgtgcaacctgcttatgatatcatagaagtaacatttgcctgcatccctcctgaactctacaatatttcagtttgatataggctgtagttagactttctgcttcttgaaatgaataatggtaaagcaccatgttggttacattagatttgtttgccagccttctctagagaaattaatactaatgaactacttgcatgtttacataaatagtcaaacagaatttagctgaaatggagagatagttatttgagaaaactggagcagtaatgaagcnnn

SEQ ID NO: 17005 - DNA, 851 bp, Triticum aestivum
  Clone ID: PAT_TA_17005
tcctcctgcgtcctcgctgccgccgcagcctcgggcgcaccctctccttcaaccccatgtgaaatcgagcatcctggcggtgccttgactgatccactgatgatggctagcgcaggtgagcgccacgcatggtgcagcaggcttggcaggcagcgggcgcggcggtcaaggccaagggcacgtcgagcgacgatgacctcatccgccaccaacaacgaggtgccattctccctcgctctctcccggcctctcgccttccccccccctcccctcggcccccgccccgtcggtgagagatgccttcccccaaagtcatcatggttgaggttgatagtatatctgctggtgatagcggtggagctgctgctcttattgcaagattcctatactttgcatttgtaatgccagttatagcaggaagctcaagagcactataaattacctatttggtactcaacttcaggaacccaacaaactggctgcttcaagtccgcttgctacttctcggagtattctcgcgtccgttgggttcttcccgccggtgtgtccctgataccctggctcctcctacatggctcttcagggttatggatggagtgcgttatttcgacggtcctctactctatttttttgttgcgtgtgccttcaggtccatcaggtataattgtgcttcccctccaaacgtggttttatgctatcttggtgttttctcttttgtttaattcattgttgtatcgctcaagggcatcttgattagtttgaattatgcttttttagctaggatgaatttatgaatggttgcccttttctgttgattaagtatttgtgtgcaaaaaaaaaaaaaaaaaaaa

SEQ ID NO: 17006 - DNA, 394 bp, Triticum aestivum
  Clone ID: PAT_TA_17006
cggtcctcggccccgtgcggctccccagggcaccccccgcgcaggtcctctcccgcatccccgcccgccgccccccccccgtcgccctccccgccgcccgggtggcccagtgcccgccgcctgcccgccccctcccgctgccccccccccgcgaggccgtcgcgccgcccgcctccttgcccgcgccgccggcggcccgctccgccgtgggctcgcgccgccgccggttccggtccctgctccgcttcccggcgctcctgctgccgcccccctcgcccgcccgcgccttcccgctggccgccgtcgccgccgccggcgggccgcgcggctccccgccgccggtccgcccccccgccccccgcggtgccccgcccggcgcccatgcacatcatgc

SEQ ID NO: 17007 - DNA, 1112 bp, Triticum aestivum
  Clone ID: PAT_TA_17007
aacagtaaataggcatttctcgccatcgtatgcaaaatcctttccagcaagctcagaactgtatgtttgcaacattttatcgatgaccttccggccaatgcccttgccttcaaccacctgatcgtcatcagatttgatggactcccggtgtgggtccatcacccaagccatcccgcgctgcgtccctgctgactgggtcgtccgccacccagtccgcggtcgctcacggccgattcctcctaagagaagccaccggcggcagcagcagctaacccacaaaatcaccattgggacgttgaactccaatttcgagtgggaggtgcattgtgagatcaacctggattgtctctgggcacaacctagttacccaaggtctgggcttacctcggcgtcttcctgagttcccagtcatcagcatggatgacccgggtgttctgtgctgcctgctgagggcgaaggaatttgctggcaaggagtggatgatcatggttgacatgaaccatgcggatctgcagtcatgtactgatgtgaatgtagaagacaagttctctaataccacccaactttcaactgtcttctccaaataccttcaaaaggcgaacagggatggcatgggacaacattgagctaacttcattgaaatgcaagtctgcaatatgaagacctgtaatctggtgactgaaggtgaacactttgcggatgctcaaatcaaagatgttgtttgtcaatgacgcggtgcaggcagaacagtttgatgatgtactgatgaatatctattggagtaacgctacatgttctggatcatttaatcatatgttttagcgttaaaagtatgagattgaatatcttttctttcatgaaaattgaattgagggcaagcacaaggaaaaaaaatagtgctagacattatttttgtttttcttatcgaggccaaaatgtcttaattacagagatcttccaatatttttctagtgggggttcttccattccttttttttgaggaattatgacagtgagggaagctccccactgacctttatatttctcattccttttattgagcacaatgatgtgaatcaggctttaataagttactaatacgcagcggcaca

SEQ ID NO: 17008 - DNA, 990 bp, Triticum aestivum
  unsure (1)..(990): unsure at all n locations
  Clone ID: PAT_TA_17008
cacgnttttgatttgcgtgtaactatttgtgtatattctctctctctgctgcacgtngggcgggctgtccttttactcctgtgaggggtnccgctgcgatttggggtcgcgtgttttttttttttttttcccgcagcaacattaattcattctcttacatttcacagtacaacatcgctatccgtcccctgttcccaaagccccatttccttgttaccctgagtctccaggatgcagaattataggttttttttccaagaggatctagaacggacgaaccaaataaacgtgggaagtagtgtactatagttatcatgtagtagtctttgagggccttgaacgctgggtggagcaacccgtaatcatccttcatatcaagagggtcactggtctcattcctgatcctcttgatcctcctgctcgcaagagacttgtgctcaaacccatacatgtgcaacacctggttatccccgaaattgaaggcccggtccatctgcttgaggcaccgctcaacagggtaatccccaaacttggagcatggcttgcacccgacaaagtgagtgaccagtggccaccgatgatcgccgagccccggctggtaattctcaagcatctcctcgtacctgtccaccaagatgccccaatagccatggaggtagtagccattctcgagatacaccttgttaccccatttctcacgctgggtagcgaggatatacaccatggcggactgatcgtcggcttcaaagaccggtcggtccttgaggtacttggtgagcaccttcccagcctcaatacgaacagggcccttcggccccatgggcgcccaggtgtcgaggtaatcgagcgaccattggcagttgcgcagcaagaagctgccggtgttgagaccaatccagttcttgtcgtcgtagaccatctcgtcccagccgtgcaggatgaagttgtaggggccgtagcgctcccacggcagctcgaaggccatgtcgg

SEQ ID NO: 17009 - DNA, 698 bp, Triticum aestivum
  Clone ID: PAT_TA_17009
cctgaacgaaagcggcgcacgcgacgcctgaaacggggagaggagagagagccggtgaagcgcgcggcgagcggaggcagaggggcgccgcgttcgcccggtgagctagagacgatgtcgtccatcggctcctctaacatcggcttccagctgctgaagaaatccgggtggaaggagggcaccggcctcggtgcgcaggagcaggggcggttggaaccagtagaaactcgtgtcaagaacaacaaacgcggtttaggttccaaagaaccaaagccaaagccaaaggtcgaggatgatgttgaaacagctcctaataaaagacccaagcaggacgcgccggcaacgaagaaggcaaagttggccgcaaagaggatacgaaagatacaggaagaggagaagagagcacaagagagggaattcgaaattgctttcttcagggaattttggcctgataatgtgtaaaccacaaacctgacagcgttgcacccgttggcatcagctgataatgccattgtacatcttatcgatgcttctgcagtttgcaactgctgttcactgtttctgtctttgttctggtccaagtgttgcatttattcagctgtagatgtttgtgccctgcagagatatgttgtagtaacttgtaacagacgttctttgattgtagaaaatgtcacttggatttttttaaaaaaaaaaaa

SEQ ID NO: 17010 - DNA, 796 bp, Triticum aestivum
  Clone ID: PAT_TA_17010
ccattccaatgttgtcggattcatcttctgtgtgtgcaagacaaggagctgggatgcttttgagccttcttgttcagggtttggctgtggagttggttccttatgctcctttccttgttgtacccctcccgcgcggccggagcgaccctgatggatctgttaggcagtccgtcactcacagtttcgctgctttggtccctttgctgccattagcgaagggagttccgctaccaagtggactaagtgagcgcttatatagcagcacagaagatgcgcagtttctggaacaactccttgacaactctcaaatcgatgatcacaagctcaacattcatctcagtgttgagttgcgcaggtaccagcaagaaggaatcaactggttagcattccttagacggtttaagttacatggaattttatgtgatgacatggggcttggcaagacactccaggcgtctgctatcgtagcaagtgatattgccgagtcccgtgcacggaatgatgacaaagatccaaaatctttgattatctgtccttctacattagtggcacactgggaatacgaagtggagaaatacatagacagctctatcatgaaacctcttcagtacattggctcgtcacaagacaggatgacgctccgtgctcaattcgataaattcaatgtcatcataacatcgtatgatattatacggaaggatatcgattttctcgagagtgtcatttggaactattgtgttctggatgaagggcacataataaagaactcaagatctaaaataacgtctgctgtgaa

SEQ ID NO: 17011 - DNA, 625 bp, Triticum aestivum
  Clone ID: PAT_TA_17011
tttgtctccagtgatgcacagcttcagcctggtttcatcgtgggtgaggccccgaccctgcagtcgcatccggccgccgcgaggacgctgtcaaggacctatccctgcagtcgcctccagccatcgcgcaaggcctcgaagttggtgtggatccccggtctccagatctggtagctcgtggtgctggcaatgtctgcatccaggagatggcaccacagtcgcccgcagctgctgaggagggctcctatcgtagtgttgctcgcgtgtggtcgagcgattccgcgccgcttccttgtgatccggcagagacggtggacatgctaccaggggatggtccctggatcttcgtggtgcggaagcgtcacctctgtgaccgtgagcactgcagccaagcttccggtgtcttggccaggagtggtgtgaggcttgtgcaagctactgacttcaggcgtcgaactcacggccgctgtttccgttgtttggctccagaccacaaggctgcctcttgtcgtgatccgatttgatgcctcgcctgcccgcgctctgggcaccgtgagagggactgtcgtcgtcgccgcatttcctccgtcagagctcccccccccccccgagctccgccttctcc

SEQ ID NO: 17012 - DNA, 2052 bp, Triticum aestivum
  unsure (1)..(2052): unsure at all n locations
  Clone ID: PAT_TA_17012
atagcccatcatcccctttaattggttgtccttctgttttccatactgcttcctttcttcctcgccggtcgatttccatctcatcacataaaaccggaataatgtctactgctggcaagactattacctgtaaggccgccgtcgcctgggaggccggcaagcctctgtccattgaggatatcgaggttgctcctccaaaggccaacgaggtccgaatccagatctactacactggtgtttgccacacagatgcctacacactctctggcaaggaccccgagggtgctttccccattgtccttggacacgagggtgccggtattgtcgagtccattggtgagggcgtcaccaacgtcaaggttggtgaccacgtcgtcgctctctacacccccgaatgcaaggagtgcaagttctgcaagtccggaaagaccaacctttgcggtaagatccgagccacccagggcaagggtctgatgcccgacggcacctctcgattcaagtgcaagggcaaggatctgcttcacttcatgggcacttccaccttctcccagtacaccgtcgtcgccgatatctccgtcgttgccattgagcacgacgctcccatggaccgaacctgtctgctcggctgcggtatcaccaccggttacggtgctgccaccatcaccgccaacgtccaggctggcgacaacgttgccatcttcggtgccggctgtgtcggtctctcagttgtccagggtgctgccgctcgcaaggctggcaagatcatcgttgttgacgtcaacccttccaagaaggagtggggtgagaagttcggtgctactgacttcgtgaaccccaccgagctcggtgaccagtccatccaggacaagcttatcgagatgaccgacggtggttgtgactacacctttgactgcactggtaatgttggtgtcatgcgcgctgccctcgaggcctgccacaagggttggggtgagtccatcgttatcggtgttgccgctgctggccaagagatttccacacgaccattccagcttgttactggccgagtgtggcgaggatgtgctttcggcggtgtcaagggctgttctcagctgaacgatctcgttgccgactacaagaagggtgacctcaaggttgacgagttcatcacccaccgcaagaccctcggcgagattaacaacgctttcgacacaatgaagcagggtgactgcatccgtgctgtcgtcgacatgcaaaagctcgagcctaagatttaatgacccaaaatgtagtataaacaaatgataatcaaaattttatgtggaatgacagaccggcagctgccggacccattcgcaccatctgaggattgcttaggaaggcaataagctttattgtcgaggcatcatgcagattttcgtcaagaccctcacggggaagacgatcacccttgaggtggagtcttccgacaccattgacaacgtcaagtccaagatccaggacaaggagggtatccccccggaccagcagcgacttatctttgctggtaagcagctcgaggatggccgcaccctgagcgactacaacatccagaaggagtccacccttcacttggtcctccgccttcgtggtggtatggccaagaagcgcaagaagaaggtctacaccacccccaagaagatcaagcacaagcgcaagaagaccaagctggctgtcctcaagtactacaaggtcgactctgatggcaagatcgagcgacttcgacgcgagtgccccagcgacacttgcggcgctggtgtcttcatggctgccatgcaggaccgccagtactgcggtcgctgccacctgacctacgtcttcgacaagcaataaatgcattcaacacgggattgggattgatgacggaacggatagggtgccaaaaatgggcgttaaaaggctgtagcacaaagcacatccggtttctgaaataatgcattcacgctaagaagacaaaaaagttgataccaaaaaaaaaaaaaaaaaaggcccctaaaaaaaaaaacccctaccccctannnnnnnnnnnnnnnn

SEQ ID NO: 17013 - DNA, 621 bp, Triticum aestivum
  Clone ID: PAT_TA_17013
gggtccacctcctccagcctccacctgtgactgttcatccacgggctcctgttcatcgagcctccaccgcgcgctactccaccggctactgttcaaccagccctctccacgggctcctattcaaccaccccttcatgggctattgttcatcctgccctctaccgtctactgttcatccagccctccacggggtggtcctgttcatcctgccctccacggggtcctgttcatccagccccaaccggctcgatcgatcggggtcctgttcatccagaggcaacaccacggggtcctgttcatccacccccaccaggaactgttcatccaacccccccgcaacgctcactgttcatccaaaggcagcatcgatcggcttcagttagcagcagtagcgaaggaatcgctcgatcgggttcagttaacagccatcgatcgatcgctcgggttcagtaacgcgtagcctgcagtgcaatcgctcgggttcagttagagcccaacgccttgctcgggttcagttagagccaactcctcgcacacatcgcgcgtatgtggtatgagagaaacgcgcatcactcggcctccggccacccatccgtaactgggaacaccccgatattttcc

SEQ ID NO: 17014 - DNA, 2219 bp, Triticum aestivum
  Clone ID: PAT_TA_17014
tacaagagcaagagactgatgacccagagaaaggggaaagagaagctgaacagagtcatttgcctgtctcccattttctgatgaacctgataatgggaaaagagagcaatgagccagatcgaaattcggaatttaaggctgcttggagcctcgtggcatccccagcccatggctgtcccttgagcacccactcgacggggggatagctggccgccagccccagccgttacctgggtggagaatgaccgcatctttgaacaggcaaaacatattgtagaaggctctgaagaagcacatgatatcgagctggaaaaggatgaagagctcaataggaacactcatgatttggaagcaccagtatgccaaaacaatgtccatggcgaaacttctagtgaaatggtacctggtactggagacctgactacagaaagaaaaactagagacatcaagctgggtgaaaaggcaaccaattctgtttgtcaggaacatatggaagcgacaacacagattgaagaaggaagcttgaagagcaaccttcatgacataacaagcccaaaggtttctcaagaggacacattagaggaaggaagaacagaccttcagcacgagcctttacctgaaaaaagaagttctgatgcagagtccgggcaaacactcttgttgacagaaccaaatatgggtgatgaaaagaatttgcctaatgacactgatgatcttcaaagtcctctgagcacaaaaagagaagagtccaatgaatcttccatcactgaggccgaaagtactgtagaggcagcactggagattggatttgcagaagaagcaggaaacggaaagtccacaagaacctcctgaagaatctgatgaaagagataaaattagcatgatatctcgagagcctgcgcagaagcaatatcagatgagcaaaactgttaaaagccagatgcaaacagtggacacgcaatcacagggagagcaaaaaacaggatttttgcaggctcagaatgcaaggacgaaaatcaaagcaccaagttctcaaacagtgaactagacaactctgagaaagctttagaaattcagttagatggttccagcttgcatatagaccaagattaagcaagatgaatctgcaggcgaccaaattgtgatggagaagaacaacctgcaggacaatccaggagaatctgatgtgccgaagacccaggttgtggaagtagcacaagaatctcctgaagcatctgatgaaggtgatcagatttctttgcccataagagagcctgtgatcaaagaagtgaatgtaaacaaaactgtcgataaccatgtgcaaacagtggacacacaatcacaggaagagcaagatgcatttaattcacaggttcagcagcgtgatctcgatgtggcttcacctgacgaggctcctgaggctgaagaaaaaattgcggagtcaaagccagaattcagcacagatgaagaacaaagtccaaagaaagatgaatcaaatatggcaggagagaaaacttatgatgagaagaaaaagggtgcacaggaagctaagagtctccctgatgaagcgaaaaccaaagttgaagaacaaggagtagtacagaaggcgtcacacaatcagaaacgtgatctcgatgtggtttcaccaacagaagctcctgggactgaagaaaatgttgtggatataaaagagccagagttcagcacagatgaagaacaaagtccaaagaaagatgtatcaaacatggcagaagagaagagttatgaaaagaagacaaatggtgacgacgaagctaagaatttcactgatgacgcaccaacgaaaattgaagaacgagaggcagggcagaaggcatcacctaaaaagcataatatcttatctggtgtcggatcaaaggtaaagcaccaactagcaaaagtgaagaaagctatcataggcaagcctgggcacacaaaatctgaattaccaaaagcttgagactgcattcaccttagtgtgtgtatatttttgttactatttgtacatttgtatgctgtttacttgaggtgtagtatgaccgtgatggtactagtaaacatcaaggtttcgctatggccattgcattgaaatgttgtgtgattgaagaacgatttgtaaatacagatagtgtgtaaatcaaggtttggtaattgtgagtttgaggcataactgagtgcaatatgagaaagtcaggttgctt

SEQ ID NO: 17015 - DNA, 1310 bp, Triticum aestivum
  unsure (1)..(1310): unsure at all n locations
  Clone ID: PAT_TA_17015
ccgccgcccgcctcccccctccccccgcccccgctccgcccccgcgcccgcagccagcgcgcgccctcccgccctgcgccccccccccaccaccgcgcgccacccctcggcggccgccacccccccgctcccgcgagccgccgacccccgccacccgctcccccccgcttccctcctcctccctgtgcccgtgcccgcgcgcgtctgcgtcgcgccctccacccgccccccccggaagcccccggcgctcgaccggtcgtgttcttttggtgtactggccagggagagcttgagccttgagctccacgataacctcagggatccagccagcattgggcgggcgcaacgcaatggcggagctgctgcgagcggccggtttctttgacctgcgcgcggcagcgccgttcgtggcggcggcggtggcgctctacttcctggccgagcagctgtcctacctccgcaagaaaggccccctgccaggcccgtcgctcgtcgtgccgttcctcggcagcgccgtgcgcatgatccgcgaccccacggggttctgggacgtgcaggccgcgcgggccagggagtccggcgccgggctcgccgcggacttcctcttcggccgcttcatcgtcttcatccgcgactccgagctgtcccaccgcgtcttcgccaacgtccgtcccgacgccttccacctcatcggccaccccttcggcaagaagctcttcggcgaccacaacctcatctacatgttcggcgaggaccacaaggacctgcgccgccggatcacgcccaacttcacgccgcgcgcgctctccacctacgccgccatccagcagcgcgtcatcctggctcacctccggaggtggctcgaccagagcgccgccaccggcgaggccatgcccatacgggtgncctngcccgaaaattgaaacntnganaactttctnaaaacgggggtttnggggttcttaccttaccnnanaaggcgaagggaaagggttcgccaaggactacgccctntttcaacctcggcctcatgaccgtccccgttgacctgcccgggttcgcgtttcggcgcgcgaggctggccgtggcgcggcttgtgcgcacgctcggagagtgcgcgcggaagancaaggcgcgcatgcctcgcccggcggcgagcccggagtgcttgggtggactactgggatncangaaaacgctgcgggaagatngacganggccgnaaacggcggggcgggccgntcgagcattcatttagaggggccgattatgtaantaggtatgtaacgcttacattcacgccttccccg

SEQ ID NO: 17016 - DNA, 769 bp, Triticum aestivum
  Clone ID: PAT_TA_17016
gagacctactctgcagaaagcccaagaattgaaacaaatcaaagatctggacctaccaaaaaaaggtgagctgaatgatatttggaagaaagaagagatcaaagctagacagtggtctagggagagggagatcctagaaggtgaccttaatactgggtatttcaaagcggtggcaagccaaaaaaggaggaagaagcagatcctgatgcttgaaagtgatgaagatattatggcgaaaaacagcttccattttggcctcgtgggagatcaggtgcgcggaccccgccaaaaggagatgtcatctcctggtgcaacatctggaacaaatggcgcgagcaccgcccctccttctgtggccagaccctggctagggttgaaccaatgctctggagcgacaagaccttgcttcaggcctggagtctcgctctgacgacctcaagaaagatgcgccgtctgcaaaaagttccttatatttaaaactagcttcgtgtgggtgtatgttgtactcggtactatctttcgctctcttgctcttttgctctttatcttctccctggcctgcttcccctgggagctgtccaaggggagaggagcatagattgcttagagttcctgctggggcagcattttgctgtttatttcccccgcgcgccttgtagctttgaacaatgttctgtggtttcgttcttgcaatggaaccggggcgtgagcccttttcctctaaaaaaaaaaaaaaaaaaaaaaaaaaaaaaaaaaaaaaaaaaaaaaa

SEQ ID NO: 17017 - DNA, 807 bp, Triticum aestivum
  unsure (1)..(807): unsure at all n locations
  Clone ID: PAT_TA_17017
tcggcacggcccacgtacggccggcagggccgggcagggcacactccgttatccaatccggcgtccgtgcacgcagcgcacaccatgtaggccacaagatctcagatagcttatgtcacggtggtggcataagctaccagtaccagctgcatgcctgtgctcttcttcacttggaggcttggagtgtgccctcggccatggcccatgggcgcgtaagtagcacccgatggatccggcgttggctagccatctccatcctccatcaagctgcagctagctaggctacttgggttcttgaggaagatctgggtgaaacggccatggccggccggcagggcctcgtccacggcggcggcggcggcaacttttcacctctactaaggtagggcaacttctatcctttggcaattgtaacttcttgatcgggggcgtgatgatctctctcctgtgagtaccggtgacagatcatagcatggtgcgagtcttcagcgtcgtgtaactactagtagctagctataccaaattgatatgaagctagctagtggtaactagcatgggtgtgtgtgtatgattctgcttgaatacttcgattctgctatctatgggcagtttacttgttgagttttgtatctggtaatatatctctttcgttaaccccgatattagcaagttgtcgactagtgtacagtcgataaatcaatataatttgatgtgtgtgcacagaagattgtgtttgtaaaatactgattcttnctccgtggacgttgatgtacaacagtggtcagcgtcgatcgaggatgcaggttc

SEQ ID NO: 17018 - DNA, 1301 bp, Triticum aestivum
  Clone ID: PAT_TA_17018
tcagtactatgggagggtcggggcgccccggccgctgttcaccacagccattagggacatcaaggctgtgtttgtgggttctagcgccgtcatgtcagccgcaccagctgggaagcctcttattgccgcggaccgtgagaagctcgtcatcttggggctcggggacggttacatcgccatctaccgttccaacttcccggtgtacaagccggagagcaatgctgttgtgtggagtggcccggcgctgcttttcctcctgttcttgattggcatctggcaagtctatgtgaagaagaaggattcgttgggatggacaccggaggagacgtttaacacctcggtcacagctcctacagggagcatcttgaatcatccagccagtgagcgagcattcgcagatagcacgacaagagctgctgatcgaagctatgtggatggcacgaccagagccagcgacagaagctatgtggacgccactgcgagatctactgaccgagcctatgctgaggctaccagggctgtggacctacgcggcggggcgttgagaagtgctccgagaaggtatgtgtcccctaccaggtatgcaggggcagccggtattccgtatcgacctgtttcggccgagcccgggcttagaggagccactccagagctgaagtaccgaggcccaggtatggagccccctggtttccccaagaaaagggagacattgttctcgaacaaccaagccgtagtagatgatcacgtcgaatgaggtcgccggactgtcggtgcagacagccgcccctaaattttggtctggcttgaagttcccgcacctaagagggatatatgccgctgatccacccgcctgttgttgtaagttgtaaaactcaggaaatgtttgtatggtacgagtacattatggccattaggatacccggctgcaaatggtggaataacgcgaagactatgggttgcatctgtgcattttacaactatctatgggtataaccgtccaggcatgtttactttgcttttcacctttagcaatgtaaggcaagcactctagtctcaagttttacaatggagacattgttctcgaacaaccaagccgtagtagacgatcacgttgaatgagcccgccggactgtcggtgcagacagccgcccctaaattttggtctggcttgaagtttctgcacctaagagggatatatgccgctgatccacccgcctgttgttgtaagttgtaaaactcaggaaatgtttgtatggtacgagtacattattaggatatctggctgcaaatggtggaataac

SEQ ID NO: 17019 - DNA, 1286 bp, Triticum aestivum
  Clone ID: PAT_TA_17019
accagcccgcccatccccgccggtggcagacggagcgcaccatgccgacgcgcgctgagggaaatgccggcagcgggaacgacggtgtgcgtcaccggcgcccgccgggtacatcgcctcgtggctcgtgaagctcctcctctcccgcggctacgccgtccacggcaccgtccgccacctcggcgaggagaagaccggccatctgaggcggctagagaacgcttccgaaaacctcaggctcttcaaggctgacctccttgattacgacgcaatggcagctgccatcgtgggatgccagggagttttccatgtcgccactcccgttccttcgggaatcctaaccgatccagagctacaaatgttgggccctgctgttactggcaccacgaatgtgctcaaggccgcctctgccgccgatgccgagagagtggtcgtcgtgtcgtccatggtcgccgtcgagatcaaccccaaagactggccccaaggtaaaatcagagatgagagctgctggtcagacaaagaattttgcaggagcaacgagagctggtaccctgttgctaagatcgcggcggaggcggcggcactcgagtacgggcgggaaaccgggctccgcgtggtgactctgaatccggcgctggtgttcggtcccctgctccagccgaccatcaacacgagcagccagttcctcatctacttcctcaaaggaggccctgacgagacgagggacaagctgtggcacatcgtggacgtccgcgacgtcgccgacgcgctgctcctgctctacgaggcgcccgaggccacgggcaggcacatctgcgcgcctcacttcatcaccgcccgggagctgctgggcttgctcaagagcatgtaccctgggtacccctgcatagccgaggagagcatacgtgacatggatcacccggctccgatgacctccgggaagctggagaagctggggtggagctcccggccactgagggagacgatcacggacaccgtcgagttctgccgggaggccgggtttcttgaggacgcggatggtgatgatacgccctgccgcttcccccctcttctcaacaaagtctagatcacaactttcccaagaagtttgggggtcgccactcgcgaacaaataaggatacgaataaaagacggcaaattctctgttcaagcaccccgagtgttaaccctcgccttgctaactagctcatgagccacacggctggtttcacacgcacaatgctcaagaggaacatgcccgaaattattaatttttgggactgttt

SEQ ID NO: 17020 - DNA, 807 bp, Triticum aestivum
  unsure (1)..(807): unsure at all n locations
  Clone ID: PAT_TA_17020
ccagcttgggtgaattcactcttgctcctatccccccctgcgcgccggtgaggccgtcctcgagtgtgtcttcgaggtcgacgtcaacggtatcctcaaggtcaccgctactgagaagacctctggtcgcagtgccaacatcaccatctccaactccgtcggaaagctcaccaccgacgagatcgagaagatggtcaacgaggctgagcagttcaagagcaacgatgatgctttccagaagaagtttgaggctaagcagcagctcgagtcctacattggccgtgttgaggagatcgtctccgaccccactctttcccttaagcttaagcgtaaccagaaggagaagatcgagagcaccatctccgacgccatggctactcttgagatctctgagagcactgctgaggacctcaagaagcaggagcttgccctcaagcgtcttgtcaccaaggccatgtcctcccgataaatgcattacactgtctgagattgcagtggtgtagatatcccggagtactgatattggagctttaagaaccaagcaccctagacgcctcgcgaggggcgatggggtttacgaccggcctgggtggaatttccttttgtcattaacggtaattggacaagggagatgaccaaggcatatngaaaagttctgcatgtttcatgggtatgccgctccaggacgtgggcggctatgactactaaaatgagagccgatggaaaacaaaaaagggtccaagatgattgttaactcgttggccagagtttacaaggggtggacaacggcctgtgaatttaagcata

SEQ ID NO: 17021 - DNA, 1974 bp, Triticum aestivum
  Clone ID: PAT_TA_17021
cggatgcgccgtctccctgctctccccctccgtacaacaaccgcctcaacggtgtcctccctcaccttcggctcgaaccgcagaggatggttcacctgccgcacatggggaagctgcggcgggggctgaaggaggaggcggtggacgacgacggcgacgccgcgggggctgccggggctgaggcgtcgccggtccataagaggtcccgctccgcttaccagaagcagccgccacagcaatggagcacaggcggtgctagtgtgtccaatcagcagtcatcgcaacatgatttccttgaggagcctagtccacttggcttgcggcttaagaagagcccctctctcgtggatttgatccaaatgaagcttgtgcaggctggcaaggccaaagacgccccgcatggtggcactgctagtgcctcggagaaattaaaagccaccaacttccctggctcttttctcagaatcggatcttgggagtgggtatctaggcacgacggtgatctggttgtggaatgctatttggcaaaccgcaaactcgtgtgggaagtcctggacggtggtctcactagtgagattgagatacagtcgtctgatatctgtctgcgctagttggtccacccagattcaggcactggcccggtgaacattgcggttcacaggtgataatattgcgattgaggagaggaacccccaagcttatgcgcacttcgtggtaggaaagttgtgcatttacaactggcccggcaagcatgcacaggcaagaatttattcagtgtgcgcccgaatcattgaataagcatgtggcatcatttcttcattttttgtgagtttggttcctagggagtgaaaatgtgcagtggggcctgtaggttgatgaactgttgtgtgcagaaatttttgccgggaatcgacatgactcctttatttcttcttttttgaatgtattttgtcgcataataaaaatgtatgacgatcagttaaccccccaaaggatttagggaactattacagcatcattctgcatccggtaggatagatgctgaagagagacaggaagctggaacatcagatggcttgcctcaaggtttctctaattcagttgctgacagtcaagtgattaaacaagacgatggttccagtgtgggtgaaccacatacaaacatccttagttggaacggttttaagttgccagggatccggcgctccatgtccaagagtgagatagcaaaccacattgggcaccacatctacagacatatgtattcagggaacctacccgcagctgatggtggtgctggcacatcaggtaaactggccatagacgacattacccggtacctcctaaacgactctcagatcctcgatggtggcaatgactcaacgggtaaactagcatttgatgagctgacccggcaacttctgaacgactcccaaatcactattgctgctgatgagaggatgctcatgtcaagggtcaattctctgtgttcattgatccagagagattcaggcacaggccaggtaaactctggtgttcacagtgataataatgagattcatgagagaaagccccaagcttatgcgcctcttgttgaaggagacagtggcaatggctcattgcctccaaggcaagaaccatttggggacctgcttacgcatctgccgcgcatctcatcatttcctcatttcttgtgagtttggttccgagggaaacaaaatgtgcagtggggcctgcaggttgatgaactgttgtgtgtagaaatttttgccgggaatcaacatgactcttttgtttcttctttcttgtatgtacagtatcaggtaggataattttaggcaggctcgtttggctccataacacgactgtcctatgttctatgctgtggttttggttgtttgaagtgtctatattgatccaagtttgtataaaacatcctgttattcttactcgtatactacaaattagtgttcc

SEQ ID NO: 17022 - DNA, 1689 bp, Triticum aestivum
  Clone ID: PAT_TA_17022
cagggcggcgtgccgccggcacgcttgccgttcgtccgttccgcagccgccaccccgcgactccttcgcctgatctccccagccgtgccaactagccaaccaacctacccccacccaccgccgatcccccgccccggcgagtcgtacaaatatggagctccgcctccgcgccccggcgtcccccgcttccgcctctccgcgcggcacgtcggtctcccccagccccaggccgcatccgcgcctgccctcacaacccattcagaagcgattgtccggcagcgccgtctccgtctccaggcgaggcaccgcggcaaggagcagcctgtgttccgccctgatggcggcatcatacaacacaggaactccggacctagtcgacttcgactgggagactcttggatttcaactggtcccgacggactttatgtatataatgaaatgttcgtcagatggagtgttcaccaagggtgaattggttccgtatgggccaatcgagctgaaccctgctgctgcagttttaaattacggccagggattgctcgaaggtcttagagcacacagaaaggaggatggttcggtaattgtttttcgccccgaggaaaacgcgttgcggatgaggataggtgcagatcggctatgcatgcctgcaccaagcgttgagcagttcctatcaggtgtcaagcaaactatattggcaaacaagcgttgggtaccccccactggcaaaggttctttatatatcaggccgctgctgattggaagtggagctatgctaggtgtagcacctgccccggagtatacatttgtcgtgtatgtttgcccagttggtcactatttcaaggatggcctgtctcctattagcttattgactgaggaagaatatcaccgcgctgcacctggtggaactggtgatattaagacaattggaaattatgcttcggttgttagtgctcagagaagagccaaggcgaaaggtcattctgatgttctttacttggatcccgtgcataagaagtttgtggaggaagtttcttcctgtaatatattcatggtgaaggataatgttatttctactccactattaacgggaacaattcttcctggaatcacaagaagaagtataattgaaattgcccgaaatcttggaatccaggtcgaagagcgccttattgcgatagatgagttgcttgacgctgatgaagtcttctgtacagggactgccgttgtactatcacctgttggttccatagtgtaccacggaagaagagtggagtatgggggcgggaaggtcggagcggtgtcccagcaactgtattcggcacttacagctatccagaaaggccttgtggaggacagtatgggatggagtgtgcaattgaattagcagctttatcatctggatggtctctgcaagctcctcggcaagaaaacaatgcaaaatcacttgaccctctgtcaggaaattttgcagaatgtactagaacagaacaatttccctgtgaagatagcaagaggtacacacacaacatagcatcaagctggatcagaagattaataatgattaaatagctgttgtttcttctcattctgttccccaggaggactgattacactttgagtgtaaataactctaccatgcttgcaattgcaacccatgagacataaatatttgttgcaccaactgggttc

SEQ ID NO: 17023 - DNA, 763 bp, Triticum aestivum
  unsure (1)..(763): unsure at all n locations
  Clone ID: PAT_TA_17023
ctcacaaatcaatcacaatggcctcttctcgtgtctttgcctctcgcctggcctcccagatggccgtcaaggccgctcgccctgctgtccgcgccaacgtcgctgctgccagcaagcgaaccatctctggcgtcagccccctccaggccatgaagcgtcagactcttctccaggccaccacccgcaacgccttccaggtccagcgccgtgcctactcctccgagatcgcccaggccatggttgaggtctccaagaacttgggtatgggtgccgccgccatcggtcttaccggtgccggtattggtatcggtcttgtcttcgccgctctcctcaacggtgttgcccgcaaccctgccctccgtggtcagctcttctcttacgccattctgggtttcgctttcgtcgaggccatcggtcttttcgatctgatggttgccctcatggccaagttcacttaagttattacccaacccattgggtagactcgtgccgaatgatcgagtcaacgacacggaggaggctgctgagcgttgtgcattaaactgtgtcttgaaaaattcgacacgggtgcacctgacgccagcttgcacgatagaggggaggttgtcttgtaatagacgggagagagaactgggatggacattgatcatagacacttgctatgattagagttggggaaattctgcataattcctcccagggatcgacttgtaanataaaaagcctcattcatcccgaaaaaaaaaaaaaaaaaaggccccta

SEQ ID NO: 17024 - DNA, 273 bp, Triticum aestivum
  Clone ID: PAT_TA_17024
gccggccgggccgggccagtgatccaccaccagaaaatgacaacgtgcgtaattcgacacgggtgcacctgacgccagcttgcacgatagaggggaggttgtcttgtaatagacgggatagagaactgggatggacattgatcatagacacttgctatgattagagttggggaaattctgcataattcctcccagggatcgacttgtaaaataaaaagcctcattcatcccgaaaaaaaaaaaaaaaaaaggcccctacttttttcatcactc

SEQ ID NO: 17025 - DNA, 2517 bp, Triticum aestivum
  Clone ID: PAT_TA_17025
catgacacgactacggacgagattctccccaccccccagcccccggtcccgaccgcacgcgcaagcggcattcctgcgtcagatcgactcatttcgcacctaaggcccattcgggaggtatgagaccatggggattatcggcccggcatcaaaagaagcccctggcgacgtcgtgctcggtgatccgtgcagcagtgcaccgccaaatttaccccttcgctccagagctgggcgacgggcgaagtgtaaacgccccgcctgtgttcctcaggctccagcgcgacgccgcgccgctcctggccctccacgaacgagggcaccggatgaatgtggtgtccgcaagccactgcggcggcgtggagtggcgccgcttcgccaagatagatcggcggaggcccgacgactgcttcgccggcaaacggacataacacgtcgtcgggatctatgggacaaagcaacgttcacttgaagaaaccattacaatgctggcaacaggtggtggatcatttaacattggtgatgattttcgggaaaatttaggtgtttagtcttgacaagcttgatgaaatggacagtgttgtttctggagcaaactttttgttacagaatgttcctggcgcagccttcacacacatgagtggaaagaggaactcgattgatatttccccagataacttgtttccttaccttcttgtgaacattggctcaggagttagcatattaaaggtcactggaaatagaaaatttgaaagggtaactgggacacatattggtggcggtactatgtttgggttagcaaaactattaacaggctgcaagagttatgatgaattcctgcaattaagccagaaaggggacaattttgtacttgatctagttgtgaaggatatatgcggggagcttgcctgccagaagcaaggactgtcaacttcgactcttgcttctagctttggaaaagttattacttctatgaaaaagctagcagattacaagcctgaagaccttgcatccgcattgttgagtgcctttacttacaatattgcacaaatttcttttcttgttgcatcactcttgggcctcagaagggtcttttttggtggatcatacatacgtggacacaagagcacaatggataatatttcttatgcactagacttctggtcagagagtcaaatgcaagcttcattcttgcaacatgaagggtatttaggtgctcttggtgccttgatgagttacggggatcccagagatgaaaacttgaacctcgaggaatctcaagaggagaacagtcatgaggcagcaggtcctactgatgtgacatcagcagacgaacataacgatagcaacatatttccttatctccttgttaatattggatctggtgtcagcatgatagaggtaattggtaaggggaagtttgagcgaattatcggatcacatctgggtggtggtactatccttggtcttgcaaggcttttaactggctgttcaagttatgaggaattcttggatttgagccggaggggtgataatttggctgttgatttgactgttggagacatttatggggagcgtggttatccaaagattggtcttccagcatccactaccgcagcaagctttggaaaagtgaactcgggcaaactttcagagtacaaagcagaagatctcgcagcagctctgctcaactctttcacatacaacattggacagatagcctactttgtggctaatctatcaggcctaaagagaatcttctttcgaggtgcttatgtctgtggtcatgagaagactatggacaagatttctcgttccctcaagtactggtccaaaggtgaagttcaaacgacatttctgtgtcacgaagggttcttgggaaccctaggtgcattctggagttatgagaacatgggcattgacggcttggcatcacatgaagtcattagggaggtcttgcttggtgctccgtacaccgggcagttcccatcttcaccattgactccagagcaggaaaatgggggaaacacaaccgctgaagctgaggtggagaggctgcggcgtgacaatgcagttctgaagtccgagcttgaatggttacaaagggagaatgcagagctgaaagcccaagttagtgaaatccgatgaagcggctaccttgtaaagcaataaaaggccaaagcatgtctccatggtaaaaataacaagatagtgagatgtgggggcacaaacagcctcagcttgttgtaacctgtaatagtcttggcgatggttcaaaggttgtctacagaaataaaatttcccataggtagttaccccaaattagggctgctcatatagtgagttcatgttgtatgtttatctttattttgtatacaagtgtgtttgtatctatttcatttgtgtaggctttattgttgtcttgtaaatatggaagcagtactctaaaagtctaaagtaatcaataaaatcagttctcataatttattaataaatgtgtgttgcacttaaaaggggggg

SEQ ID NO: 17026 - DNA, 757 bp, Triticum aestivum
  Clone ID: PAT_TA_17026
tttctcttctggagaatctgactctctaactgcagaagtagatgtgtatggccaaaggtacgaggtagaaagttatgatgagaaggtaaacacatggttcagcgaagctattggacgccattgtacctttatgagatgttcaagctccaagagccgcgtctgcacatctactggcaagaacggtcgtctatgcagggacactcgaagcaaacttagttttgtcaacgaaggacaattgctgctaatatctgaagagagcgtctctgacctcaacagtcggcttagttcaagcaatggaaatggtaagcagcacgttcttgttgatgcaatgagatttcgtcccaacattgttatctctgggtcgacgccatacagagaggacaactggaagaggcttcacattggagatgcctattttacttccatgggaggatgcaaccgttgccagatgatcaacctacaccagaacgcggggcaggtgatcaagtcgaaggaaccgctggctacgttggcctcctaccgacgagaaaagggcaagattttgtttggtgtcctgttgaactatgaagacggtttgagcggaggagaggagaccgtcgcagagagatggctccaagtagggcaagaagtgcacgcttcgacagagtgatttcgtgtacagatacagaggcagcacccgcgccagaaaaaggtgtttggcaatgagtttttttaaatgcccgtatgtaatatttttgtatacgtacatcctgccttt

SEQ ID NO: 17027 - DNA, 687 bp, Triticum aestivum
  unsure (1)..(687): unsure at all n locations
  Clone ID: PAT_TA_17027
gatctcgcccaccaaatccgaccacccgatcccccggacagccggagagcgaggcgaagcggcgacgcctaccgcaaccatgctcagggtcgcaggtcgacgcatatcctcccacctcgcatggcgccccgccgcggccgcctccgccggcagcagccccctcgccggcggcctccctggcgacgacttcccccgggaccagaatccgcgcttcgccatcgaatcacccttccacgtcgctgccagaggcttttcggctgaatctcttgttccgagggaccanggatgtagagttggctgagctcacaccaactacggcagctctgaagaatccctgtgccaaaattgtctacgatgagtataaccacgagaggtaccccacctggtgaccccagcaagcgtgcctttgcctactttgtgttgagtggtgggangatttgtgtancgcaatccttgttggcgtttgcccctcttaaagtttgtcctgagtatgtcagcaagtaaggatgtgcttgcccttgcttcccttgaggttgacctgtcaagtattgagcccggtaccactgtgactgtaaagtggcggggcaagccagttttcatcaggcgcaggactgaagatgatgtgaagctggccaacagtgttgatgttacatctctccgtgatccacaggaggatgcggtgcgtgt

SEQ ID NO: 17028 - DNA, 1633 bp, Triticum aestivum
  unsure (1)..(1633): unsure at all n locations
  Clone ID: PAT_TA_17028
ccacgcgtccgatccagactcgctgccgtcaattcttggcgaggttggattattcaagaacaagaaaagctgctattactacacagtgcttctggagaggaaaagttgctaggaaggagcttcgaaaactcaaattggctgcacgggaaactggcgctttgcaagctgccaaaaataaactggaaaagcaagtcgaagagcttacgtggcgcctacagttggagaagcgcatgcgagctgatcttgaggaatctaaatcacaagagaatgcaaagttgcaagctgccttgcaagaggtgcaacaacagtacaaggaaacaaaagacacgctagtgaaggagagagaggcggccaaaaaggtcgcagagatagagccagttattaaagaggttcccgttatagatacagagctgatgaataagcttcgagatgaaaatgataaacttaagactcttgtcagttctcttgaaaagaagattgatgatactgagaagaaatacgacgaaacaaacaaaatcagcgaggaaagactaaagaaggcaatggatgctgagtcgaaaattgatgatttaaacatggcaatgctaaggcttcaagaaaaaatatccaacatggaaactgatgagaaagtgcaaagacaagcgttgttgagcacgccagtcaggagcatgtctgagcatttgtcgattccaattgttccaaagaacctggagaatggctatcatgaggctgaagagccaaaggaaccccaaagtgcaccccctgcccttaaggattatgggaatggcgatccaaagctgagaaaatcttctgctgagaagcaacaggaaaatgtcgatgcacttattgactgtgtagcaaaaaatcttggctactgtgaggggaagccagttgctgcttttaccatatataaatgtctccttcactggaaatcttttgaggctgagaagaccagtgtttttgaccgtcttattcagttgataggatctgcaatagagaatgaggaggacaatgacaaccttgcctactggctctcaaatacgtctagcttgcttttccttttacaaagaagtctcaaagctgctggtgcacctgggactgtttcacgaaagaaacctcctcagccgacatcgttgtttgggtagaatggcccaaggcttgcgctctgcatcctttgccaacatgcacgttgaagcgactgatgttgtgcgccaagttngaggccaantacctgcgttgcttttccaagcagcatttgactgcttacgtggagaaagattatggatcatcccgtgtataatattaaaaaggatttgtcacctttgattccttaagcatccaagctccaaagaacaatggaaagtagcatgctgcgaattcctggaaggcatctgggcaaactcaagacaacattgggcagaattatgagaacttgggtaccttccnaaaatcctacaagatacatgtacccaantttaactcaaaaanctttaccanatatccatnctaatgtcanctatcaaaatcngncctctctgagtgcngncctcaaaatggaattttcaanctggttacnanttgantttggtcaagganatcnatanacanctcatggataatcagnattaacagg

SEQ ID NO: 17029 - DNA, 739 bp, Triticum aestivum
  unsure (1)..(739): unsure at all n locations
  Clone ID: PAT_TA_17029
tgatgtgtacagctaccggagttgtactggcttgaacttatttcagacaaaaaagcactggacccttccttttctccgtatggaaatggattcaacatagttgcctgggcttgcatgcttctgcagaagggccgagctcgtgagttcttcatagaagggctgtgggatgtggctccgcatgatgacttggttgagattctgcacctcggtatcaagtgcactgtggactctctttcttctaggcccacaatgaagcaagttgttcggcgactaaaggaactcaggccgccctcttactagaatttgcaactccagtatggcatacatctcaagactgagagtaagaaagcaaccgcagtatcggagggatgaatttgttgatcctgatcaaccgatgatttgctgttaaagctgttgaggattctgtttgaccccaactgccaaggatactcctgacaaattagtggacacagtatccatgccatatcctccggtcatgcgataattgaccagtaccaagtgcaagattgcatcattgcacggcataccggtgccgctgaaacgaccgtcgctcgaagggactcccgtggggaattgtgccgcgcctagcatgactcggcgtggcatcatcgacgcgatgaaaacgactgcgcggcgtggttcatcggccttgccgtagttctgccgcgatccacaaaattcagagggaagccctgtcctgcgggcgccgccaagantt

SEQ ID NO: 17030 - DNA, 586 bp, Triticum aestivum
  Clone ID: PAT_TA_17030
ttcgtggctgtgctctgttcctcttcctctctcgctcgctactctgtcttcctcctcaaatcttcctctgcacttgatccaaactcaaattccagagagatatccagtggtagctagaggtcagggagggagagggacaatggcgcgagcctttcttgcctccgccgctgcagcgggcttcggggcgcaggcgcagcagactccgtggctccttctactgctggtggtgctggtcatatcggtcttcctctgcggcgacacctccaagaagaagaaggccagtgcaaagcgggcggcggcgaccactgcaagttcgtcgaccaaatcagccggcggtaataccttcctctttcttgctgcgggcggaggcggagggggcggtggcggagggtgcggtggcggttgcggtgcctagctagaggagctgcagcctgcagcgcaggaaggcatggcttgagccggaacccggagctgctacgggactctctatagtatggatccctccctgcagttactacttagtagtcgatcactagatttgggttcgatgatgtattgcaagaaacatttggtactgctatgtatg

SEQ ID NO: 17031 - DNA, 413 bp, Triticum aestivum
  unsure (1)..(413): unsure at all n locations
  Clone ID: PAT_TA_17031
cgggtcgaccggtaattccaacagtcgaacgtatattttgtgtatgttggatataaagatcgtttgggtaagaagtataacggaaagaaactatatgcttgtttgtttaggaagtgttgcatacttgtgtgagttgacgcgacacatcaaagtagtactgtactactactagtagtactccctccgatcctaatttctctgcgcataagtcgaggtgcagataccaaggaggtcttgcttgtgtctatacttggacaactcatccaactgcgcactangcagacgaagctcgtgtcgtgttggtgccgtgtgtctccatcttagcctccgtgttttagacttctcaatctcaagggcaaggagcaacatgaaacctatgatagagcaaatcggatggtttagaacactacaat

SEQ ID NO: 17032 - DNA, 623 bp, Triticum aestivum
  unsure (1)..(623): unsure at all n locations
  Clone ID: PAT_TA_17032
aaaaaaagggggaggatgannaggccgttcacgctcgcagcaggccgagacatcccctacaacaccttgaggactattacctttccaaaagcattctagtctcgctactttaaatcttcaattgaatcggccatcgacacaatgcctcttaccggcagctgcatgtgtggcgccatcgcttacaagagcaccactgaccccgatgttactgctctatgccattgcaccgactgtcaaaaatggactggcggtgcctttacttccaacgctgtagtccctgaggaatccttcagcattaccaagggtacccccaagcaatacgacgtcacaggcgcttctggcaagattaatcatcacttcttctgtggtgattgcggttcaagcctgtacactcgccttgacattatggagggcaagatcattatcaaggccggtggtcttgacgagggcaaggctaacctggacaacaagattggtgtcgagttttacacccgtgatcgtgttccgtacattcagcctgctcagggagcaaagcaagaacagatgtttggttaagccgcgagtcttcgcttactagattagtagatagatagttggtataaataaatagcatacttttacgc

SEQ ID NO: 17033 - DNA, 1019 bp, Triticum aestivum
  Clone ID: PAT_TA_17033
tctcggcgcgtgctcgaggcacaggtcgtcggggaagaaaaagaaaaaaacggaaaaaaaaatacgccagagcggccgcacgatctgaaaaaatcgacaaaacatgtcgtcggagaaacaggagacggcgtcggtgcgcgtgctgggcaggtggccgagcccgttcgtgatccgggtgctgatagctcttgggctcaagagcgtggaccacgagctcgtggaggaggccgtgggcaacaagagcgagctgctgctcgcctccaaccccgtgcacaagaagatccccgtgctcctgcaccacggcaggcccgtctccgagtccctcatcatcctccagtacgtcgacgaggcctgggcctcccaagccccggcgctcctcccgtccgatccctacgcccgggcggccgagcggttctgggcccagtacgtcgacgacaagttccctacggcgatccgggtcctgaggggaaggctggacggagacaaggacgaagcggcggctcaggtgtgcgccgctctgcagcacctggaggtggccttcgccgactgcagccaagggaaggattacttcggcggcgacggcgtgggttacctggacattgctctggggtcgcacctcggatggatcagggcggtagagaggatcgctgaaatcaggctgctcgacgcggccaaggttcctaagctggccgcctgggcggatcggttctgcgcccacccggcggtggcggacgccatgcctgaggtggacaggttcgtggagttcagcgtcaagaatggcggcgctgtgaaggcggctagtgctaattacaagtgaacgaactgtggtggacactagacagtgctcgatggcatagcaagaataagtaacctgctggctaagtaacctgctggctgtcggtgtaaaccgtcctttttacacgaaaatgataaatcccgaacgttcggatttaagcatggcaatctaaatgtttttatgacaacattaattcacgtgaggttgacaaacatgttttaac

SEQ ID NO: 17034 - DNA, 703 bp, Triticum aestivum
  Clone ID: PAT_TA_17034
gccggccgccggccgggctctggagttcgatactcaacaagcaatttcaacctacctactatcttcaattcttttctcttccgctggtcggctggtctactttcacatctcacatcttctttactacaaccaaccaaccaaacaaacaacctcttcttcaccttcaacaaattcaagatgcagttctctctcgccacccttgttttcggcctcgctgccattgcctctgctggcaccctggacgttgagggtgttcgcaacgctcctcgcagcgctgtcaacgtccgtcgccagaacgacaaccgacctgttcccaacggagcatgctgtgttgccaacaccagcttgaagcaggatacttgcactgctgccaacggccagaccggtcgctgcgtgcctggtggaaacaactgcggctcttctctaagctgtgttgcgcagtccaacctcgagtgcgataacaacgtcattgagcgtggaagctccctttgccgtgccaaggctggcaacggcggtctctttgacggcgccaacattatccagaaccttggacaggccaaagtcaactaagggtctattagttgaagtgattttgggggatatgtaaagtagctgtgggatatgaaatagatctaccgggtctggatagtaggtagttgaaatatataataacctcgaaaaaaaaaaaaaaaaaggcccctaa

SEQ ID NO: 17035 - DNA, 939 bp, Triticum aestivum
  unsure (1)..(939): unsure at all n locations
  Clone ID: PAT_TA_17035
tggccagagttgtgggtttctacaattccctacttttggtctaaaggcttggaaacaaacgttcttctttgattttagtctcacatatgtcggcgcggggatgatctgctcacaccttgtaaacctatccacacttttcggtgcggtactttcttggggaataatgtggccactcatcagcaaacaaaagggcatttggtacccggcaaatgtaccagaaagcagcatgacaagcttgtttggttacaagtccttcatgtgtgtagctctgatcatgggggatggcctctatcacttcatcaaactcacaggcatcactgctaagagtctgcatgcacaatccaaccgtaaacatgttaagagagcggcaaacgaggatacagtttcatttcatgatttgcagcgcaatgaggtcttcaccagggaatacattccaaactggctagcgtatgccggatatgcctcattgagcatcattgctataattgtcataccgacaatgttccggcaggccaagtggtactatgtcgttgtagcttatgtgcttgctcccgtgctggggttctccaatgcctatggagctgggctcactgacatgagcatgagctataattatggcaagattgctctcttcatctttgcagcctggggagggaaggatgatggtgtcattgccggccttgttggttgtgcgatagtgaacactagtgaagtctccgcagatctgatcatgactacaagacgggcatctgcactgacatcaccgagatactgctttcgggcagccattgncagtatggctgatcgttgcgcatcacatcttgctcttcacaacattanttgaaccaacganctgaagtcgacggtatanccgacatgcatctcgcgcaggtnntcatgcaangtctcactgcttnctctnattcttnccaacttagg

SEQ ID NO: 17036 - DNA, 1169 bp, Triticum aestivum
  Clone ID: PAT_TA_17036
gcgccccgggccagttcgtgccggggcttccgccgccgatgccgtccacctccgccgacagcgtccagaccaggctgtcgaagctgctgatgagcccgcggacggggaagacaaaggcgtcgtcggggccgatcacgcggcgggagcgggagggggcgggggcgccgtcccgggtgcacccgccgatgcagcagctgagcagctcgtgcccgatcatcggccagaggccgctgtcggggcagaagggcggcgtggactggcgcaagcttctggacccgccggccagcacggtgggcggcgcggggctggaccagcagtacgcgaacgtgatcgtgtcggcggaggagctgctgcagatggaggcggaggggcggcaggaggaggcgaacgcggagcgggcggagatgtacgagatgctgccggggaagctccgcgcggcggtgcggtcgaagctgcgcgactggtggcgggacccggggccgctggacgccgggctggcggaggggtggaaggaggcggtggagcggatcatggcgtggctgggcccgatggcgcgcgacaccgtgcagtggcagtcggagcggaacatggaccggacgcggcggttcgacggcggcacgcgcgtgtacgcgctgcagacgctgcggtgggcggacaaggacaaggcggaggcggcgatcgtggaggtgctcgtcgcgctgagctgcgtctgctggtacgaggagcggcggcgcggctccgtgcgcgtcagctgatcgccgtcggaagccgttcaacgacggcgccatggcatggcacacacaccttgtccaaagcccattcttttcttttcttccttctttggttcgtttgtcaaagcattgatttgaagagttgaattttttggaggggttggtgttagatcgtcaggggttagtggcccacgcgttagtagcagctatagtggactgtagcagcagtaaatcgttctgtagtttgaaaatttggagggagaaagaaaagccacggtccagtggtcgttggttacttaactgtcaatggcgtgaggctggcatgacaggacggtctcacgccggtgacagcgagcgtccgggtgtataagtttgtctgatttgtacgtacaatgaatacacgattgattctttgaaaaaaaaaaaaaaaaaaactcg

SEQ ID NO: 17037 - DNA, 1045 bp, Triticum aestivum
  Clone ID: PAT_TA_17037
cacacgccccgcccaggccatggccatgaccatgggcatgggagcgaggagaggccgtcccaagctcatcatgtggttgtctcgcagattatggagacggggattgtatctcattcggtgattatcgggctatccttgggcgtttcgcaaagcccatgtaccattaagcctcttgttgctgccctctcctcccaccagttctttgagggttttgccttgggtggctgcatttctgaggctcagttcaagaatttctctgcactcctgatggctttcttctttgctatcacaacacctattgggatcactgtcggggcggggatcgcatcgttctacaacgccaacagccccagggcattggtggtggaaggcattctggattcaatgtcttctggtatactgatctatatggcattagtggatctcattgctgctgatttccttagccggaggatgagctgcaatccgaggctgcaagtgtgctcatacgttgccttgtttgtcggggctattgccatgtcatcacttgctatctgggcttagtgccagtgagtattcttgaagcttgggacaagctgcttggcgttcaacgcactacgacctgttgcctagctaccggtaactgagtaagatgggaggctttttctttctctgtccattcttttgtttgatcttctcatggtgctgggccgggtaatgtcctcttttgggcacagaaaaggaagcccctctctggggttcttttgtttgttcttccgtggtgctgggccgtgtaacgtcctcttttggtcatagaaaaggaagtccctctttggggtacattgtggtggtacagaattgggacaagttagttagggaataaagagtttacgagtcccaccagtctttgcagatgtacagttcatcctcggtgttagataagaggccttgtctgttctcaagtataatcttgcacgtacatcaatgtggatctcctgaaagtcgcttcaactgttcgaatacattcgcaggtgctgtttgaaattaaaaaaaaaaaaaaaaaaaa

SEQ ID NO: 17038 - DNA, 932 bp, Triticum aestivum
  unsure (1)..(932): unsure at all n locations
  Clone ID: PAT_TA_17038
ngcctacgccgacgaccgctcgtgggaggcgctgcaggaggacgagtcgggcctgctccgccccatcgacaccaagaacctcgtccactcgcagtaccgccgccgcctcctgctccgctccgccgccgccgcggcccgcatccagaagggcctcatccgctacctctacatcgtcatcgacctctccagggcagcttcagaaatggattatcgccctagtcgaatggctgttgttgctaagtgtgctgaggcattcataagggaattcttcgatcagaatcccttgagccatgttgggctagtgacaattaaagatggcatttctcatcgacttacggagattggagggagtccagagtcacagattaacgcattgatgggcaagcttgagtgttctggtgattcatctctgcagaatgctctggaacttgtcaatggttacttgaaccagattccttcctatggtcacaaggaagtattatttttgtactccgcactgaacacatgtgatcctggtgatgtcatggagacaatagaaaaatgcaagaaatccaaagttagatgttcggttattgggcttgctgcagaaattttcatttgcaagcatctctgtgaagagactggtggatcatatacggttgcactagacgagtcccacttcaaggaattgctgcttgaacatgctcctccaccacctgccattgcagagtatgctgcagccaatttgattaagatgggttttccacagaggggagcagaggatcttatctccatctgctcttgccacaagaaaattaagtctggtgctgaaggttacatatgtcccagatgcaaagttaatgtgtgtgagcttccaacggagtgccgaacatgtggtctaacacttgttagttccccacatctggcacgatcctatcaccatctcttccctg

SEQ ID NO: 17039 - DNA, 503 bp, Triticum aestivum
  Clone ID: PAT_TA_17039
catagaaagtaccaagacggaagatgtcatggcgggcatagaaggtaccaagacggaagatgtcatggcgggcatagaaggtaccaagacggaagatgtcatggcgggcatagaaggtaccaagacgaaagatgtcatggcgggcatagaaggtacgaagacggaagatgtcatggcgggcatagaaggtaccaagacggaagatgtcatggcgggcatagaaggtaccaagacggaagatgacatggcggacataaaaggtaccaagacggagaatccaagcgacgaataaatcagtgcatgaacggagagtagaaatggcgccacttctttggtggccctgcagtagaaacttaaagagcagtggtagatcggttcctctacaagggaggcccatgctctgtgtgatcatctggtcgtgtagcgtggtctttactcgaacgctgctgcaacgagtgggctaccagcactcgggaattgttgcaaccgctttaactacctta

SEQ ID NO: 17040 - DNA, 792 bp, Triticum aestivum
  Clone ID: PAT_TA_17040
cggcaccggggcgccttcgggtccgcgcgcgccctccgcccaagccggccgcacccacactctttcgctttcacactcctgccgcgctcagtcctcaactcctgatccccacctcgcggcgccgccgggtccggccatggcgtactccggccgagctggcggcggcgggatgtcggcggtggacgccatcctcgccgaggcggccgacctggtcgcgctggagcagatcgccaggctcaacacggcgcacctcgccggcctcgacgactcggcgctcccgtccagcctcgagtcccgcttccgcaagctcaagtccctccccaccgcccccgcgccgcccgccaagaccctgggccgcagctccaccgcgccgccgcagcgccgcggcgatcctcctgccgacccgctcccgcaaccgcacgcggaccctccctcgcccacaccggtcgccccggcgagccaggagcagaaggagcagcaccctccgccgcagcggcacagtgatcctcgtaagaagagcgtccccgcggcccgagaagatggcgacgaggaggaggaggacctggagcggctcttcggggcagggcgcggccggccgacgctgagggagcggaacaggtgcagggacgaggacggctccctgtcgccgccgccgccgcgccaggcgtgctgcttccccttctcgcccaagaaggccctgcagagggccccggcggcgcggagcaggaaggaccgcgtcggaggagcgccgggcgacgacgtcctcggcatcgacgccggcgagtggggcga

SEQ ID NO: 17041 - DNA, 899 bp, Triticum aestivum
  Clone ID: PAT_TA_17041
ttttgtgccgcgctcgaggccggccgggccgggaaaaaagttcactcctacgaccatccgccaattcgattgcctggtgagcgccaacatcatcagaaaccgcaatcatgggtatttcgcgtgactctcgacacaagcgctccgcctccggtgccaagcgtgcctactacaggaagaagcgcgctttcgaggctggtcgccagggtgccaacacccgtattggccccaagcgcgtccacaccgtccgaacccgaggtggtaaccacaagtaccgtgccctccgtctcgactccggtaacttcgcctggggttccgagggcctgacccgcaagacccgtgtcattgccgtcgcctaccacccttccaacaacgagttggtccgaaccaacaccctcaccaagagcgccgtcgtccaggttgatgccgctcccttccgacagtggtacgaggcccactacggccaggccattggccgaagacgccagaaggcccaggctgccaaggagggcaagaccgaggaggaggtcaagaagtccaacgccgtcgagaagaagcaggctgctcgcatgtctgccggcggcaaggtcgagagcgccatcgagaagcagttcgaggccggtcgattgtacgccgttgtttccagccgacccggtcagtccggccgtgtcgatggttacatcctggagggtgaggagctcgctttctaccagcgcaagctccacaagtaagcttgtcattaaaacctgatgaagaaaggagtgttggccccatggtatggtgtttaaggatttctcactgtctcacggttaacgacagaatgagggtaacataacgcatcgggatgggtccttaaggaaaaggaataaaaatcttcttgcgctgaatttaatgtcatgatc

SEQ ID NO: 17042 - DNA, 947 bp, Triticum aestivum
  unsure (1)..(947): unsure at all n locations
  Clone ID: PAT_TA_17042
gcaagcaccaagcggcagcaagcacgtctttgctgcctcgccggagacgccgctcctcgcgccgccacaggtcctgtccccttcttcttcttcttcttcttcttcttcttcttcttcttcttcttcacccaagcagcagcagcaggctacactcgctgctcctcgccggacagcagcggcgcagccgcaagcatcggccgaagcaccaagcagcagcaagcacgcgcaagcaacaacagccccggccgccgctgctgctcctctttctcggccacgacagcaacaagtggtcaagcacgtgtgcaagcagcatcagtccggtggctttgacgcaaggcgtgaggaggcggctgctccgtgcaacactgcatctcgccgtcctcctcttgatctgtgccttccctgaacgtcggaggcctgtgcgcagctcaccaacgcggccattgcggcactacggtgaccaccacgggtgcgtgggcggggcacacgcgatgggagcagcgccggcgactggatttggccacgattaaatctgggacgggatcgggcggtgcaattttttttttgttttattcactacttttaccgagtggcgctctcggcaaacctcctgcgccatgtggctatagcgccgttcgctctgagtcttctcatcacttaggatctgcttcatcgcgttccaatggatgagtgctgggtttctccatgctccggcgtctccgcccttggaggaaaaagtatccatctaaaattaaatttaaaaaataacatttaaaaaaatgtgaacatttatcaaatctgtaaatgtgaacaatatattccgtacattgtttaaagtggatgcatgttttacgatttagttttttaaaagctttgtacttttccaattttgatttattttttaatatacgcattttttaaatccattttttaactnaacaaaagna

SEQ ID NO: 17043 - DNA, 784 bp, Triticum aestivum
  Clone ID: PAT_TA_17043
gccggccggtccgggaacagccggccggcgtccggtagcgaagacgtttccggatcacgactcaaccccccttccacttctccttgatacacatagaaatcttcgaggatcgcccgacgagaaaaaaatattcaagatgtcggacgtagaagacaacacccccgaggtcgccgacgttgtcgaggtttccggcgatgcccccaagggccagatgtccattctcgatgctctcaagggtgtcctgaagctctctctcatgcacgatggtcttgcccgtggtctccgtgaggcttccaaggctcttgaccgtcgccaggctcacatgtgtgtcctgaacgagaactgtgaggaggaggcctacaagaagcttgttgtcgctctctgcaacgagcacaacatccctctcatccagatccccgacggcaagcagctcggcgagtgggccggtctctgcgttctcgaccgtgagggtaacgctcgcaaggtcgtcaactgctcttgcgtcgttgtcaaggactggggtgaggagtctcaggagcgatctatcctcctgaactacttccagaccgagcagtaaatgtctgaactggcgttggatgtgaggatgattagaggtgcggacttggtttcatgaccgcttgacacatacgtgctgtactctagccacttcgactggcatctacaacggttttaaggccttacgtctcatggccattgagaggaattaaaaaaaaaattgggcatcatccgatattcaaaaaaaaaaaaaaaaaaaggcccctag

SEQ ID NO: 17044 - DNA, 749 bp, Triticum aestivum
  Clone ID: PAT_TA_17044
ttgcccaataaagaagagtcccttgatatcttggagaacaatgatgagggttctcaaccattgaccaatgaagacgagacttctgatattccactggttcagaacaatgaggcctgcaagtccccatccaaggcaggcaaggtttgtgatgccagcaatgagattattgaggatgaggttcagggtttatcacagtcagggaacaatggtccgaattatcaaacgctgaatgtggaagatgaggcttttgtttgctcggggcgcggcgcggaggctccccccctcttgctcaagaaagaagagccccttgatgtcttgaagaacaatgatgagggttctcaacccttgaccaatgaagatgaggttcagaatgatgaggcatgcgaatccccatctaagtccggtgaaatttgtgatgaaagcaatgagaatattcaggctagttttagcagatatgatactttcagaagttgcttggatttgacatcacaagatgatggagattcaggaactgaactcttttcacctgaatttgatcaccagagggatcctgagcttagtctgagtatccgttccgatgttgacatagatctgggagaagatggaagtgaaactgcggactgtgatccatccaatcaattaaagcatatagaggaagtggatgtttcatcagttacttcagacgataatataacacgcagcgaaggctgctctcctgtctatggcaaggcagctgacttgtcctgtga

SEQ ID NO: 17045 - DNA, 712 bp, Triticum aestivum
  Clone ID: PAT_TA_17045
aaataaatataaggcaacaggctattcagataatctcatggcttgtaaaatttaaagcatctttcttaaaaaagaacaagctgattgtacctattctacaagttatgtgccccttgcttacagaaacagctaatgaagatgaagactctgatttagcggcagatcgctctgcagccgaagtcattgatacaatggctatcaacttaccaagacacgtttttggaccagttcttgaatttgcttctgtgaactttcgtcacgttaatcccaagtatcgtgaggctgctgttacttcgctgggtgttgtctcagaaggttgttctgaacattttaaggataagttggaagaatgtctcaaagttgttttagaagctttaaaggatcaagagcagatggttagaggtgctgcatcatttgctcttggtcagtttgccgaacacttgcagccagaaattttatctcactatgagagtgtacttccatgcatcttaaatgcacttgaagatccatcagatgaagttaaggagaaatcttattatgcactggcggcgttctgtgaagatatgggtcgacgcggccgcccattcctggaacctttgatatgcagattagttatatctttgcagagcagtcctcggaacctgcaagagacatgcatgtctgcaattggctctgtagcagctgctgcagaacaggcatttatcccatatgc

SEQ ID NO: 17046 - DNA, 630 bp, Triticum aestivum
  unsure (1)..(630): unsure at all n locations
  Clone ID: PAT_TA_17046
gcctagttctagnacggcgcgtccagcgtgcgtgatgacgcgagcctgtcgggctcttccccgtctgtgccgagctacatggcggccaccaagtcggcgtcggccagggccaagctgcgcgtccagagcccgacgctgaccgagggcgctgctcatgctgaaacgctggagaaaggatggtcttctgtgggttcagcgaagaagaggctgtcctttccggctgggacgccgccgccggtgccgtcggcggcggcgagacggcactctgggcctcccaaggtgcggcaggcggccgtggaaggtggtaccgagggacgggactcggcgctcgtgtgacatcatggaaaggagattatttgtctgaaacagagcagagcagagcgggattcgttgtgtttgttgagtcaaaggaacgtagaatgtgtgttgtgttgtgtggatccatttgatttgatttgtattcctatttgatttgtttattcattcactgaataagcgtctatctgtaatgatttgatttgcagggagaggtttttcggatcatcatcatgtgtatgtatgtatgtgtgtgttgacaagaagatgaggagttttttgaatttcaaatcatgatgatgatgaaaaaaaaaa

SEQ ID NO: 17047 - DNA, 648 bp, Triticum aestivum
  Clone ID: PAT_TA_17047
ggcaccagataaagttcagcaagctaactggtacgaataaagctatgttgttattcaccctccatttaccggggtatccaatctgcttagattgatctgcacttgcacttcctttgactagcaatgtatcatccatagtatcctgcgtattgattctgaggatgctctgagatctggcaatacaaacgcaaggggccgaaggtaccgctgcagtcaggctggatataccgctgcagacgcaagcttacatgatcgctggaggagagacatggtttcagccgtggcggcgcgagattactcgacactctattaagacggcgggggaagatcagtgtcgccgtccaatcaagtgtcgctagctggggaagctggcagcagtctgggagatcacagctgagctaatattgctgaataatggtgagggagaaggtatttgttgataaccttacaaggaagctgcctcaccctgctgaatgctctgctgccgcttgcagaaggcaattgtgcactagattcagatttgccagcctgataaaaggaacagtgtgtcaaatttcaaaagtaatcagttagttctttttctcccgactaaaagtttgatttcttaacatggtggcatactgttggaataaaaaaaaaaaaaaaaaa

SEQ ID NO: 17048 - DNA, 1595 bp, Triticum aestivum
  unsure (1)..(1595): unsure at all n locations
  Clone ID: PAT_TA_17048
cccacgacatcatcacgaaaatgctagctagcctgggtgatccatatacaagattcctgtcgtcctcagatttctcgaagatgtcgaagtatgacatgacggggattgggttgaacttaagagagattcctgatgacaatggttctttaaggttggtggtattaggattgatactagatgggcctgctcactctgctggtgttagacagggtgatgagcttttgtctgtcaatggtatcgatataagaggtaaatctgcattagacgcgtcgtcaatgctgccagggccagaggaaacttacgtaacaattaaggttaagcatggcagttgtggtcctgttgcgtgtgtgggagtcgagagacagatgccacctcgtactccaatccgatatcgtttgcagaaaagagtcaatgagaattcatatgttggatatattcacattaaagaaaggcttaatcaaatcccgctctagagcccacgacatcatcacgaaaatgctagctagcctgggtgatccatatacaagattcctgtcgtcctcagatttctcaaagatgtcaaagtatgacatgactggtattgggttgaacttacgagagattcctgatgacaatggttctttaagattggtggtattaggactgatactagatgggcctgctcactctgctggcgttagacagggtgatgagcttatgtctgtcaatggtatcgatgtaagaggtaaatctgcatttgacgtgtcatcgatgctgcaaggcccaaaggaaacttttgttacaattaaggttaagcatggcaactgtggtcctgttgagtcaatgaaagtgcaaagacagatggctgctcgtactccaattttctatcgtttggagaaaagagacaatgagaattcatctgtcggatatattcacattaaagaatttaatgcagtggccaaaaaagatttggtcagcgcactgaaacgtctacagaattcaggtgcctcctattttgttttggacctgagggacaatcttggtggactagtgcaagctggaatagagattgcaaagctcttcttgaacaaaggagacacggtcatttatactactggccgggatcgtcaagtccaaaatacaattgttgctgacagtggacctttggttacaactcctgtgatggtactggtgaacaataggacagcgagtgccagcgaaatagttgcttcagcacttcatgacaattgcaaagccgttcttgttggcgaaaggacttttggcaagggcttaatccagtctgtatttgaacttcatgatggttctggtattgtcgtcacagttggcaaatatgtcacgccaaatcacaaagacatcaatggagatggaatagaaccagactaccgccgtcttcctgatctcaatgaagccagagattaccttatgcgttgccaaagcaagaaattaaattgaggtgaagtgcttcattacaaagcttcttacgcagcaacacgttagaagtatggaacggagccggaattccggccataatccctggnagnaaaccaactcaatcaacataagtggntcgaaaatnntggnatctgatccacgtt

SEQ ID NO: 17049 - DNA, 1671 bp, Triticum aestivum
  unsure (1)..(1671): unsure at all n locations
  Clone ID: PAT_TA_17049
gtcgacccacgcgtccgtcccaaatagccaagggaaggaaaggatagatagaagagaagaggtcagtgaccaccacccttccctcccctcccctcactcccgtgcccccgcctctgcctgcctgggttaccctaccacccctcctcccacccatagccgaggccagaggagagagagagagaagccagggcttggctggtagatgcgcgagtagcggtgtctgccaaaggccaaggggaatgggaggcgacggcaggcccagcgacggcggcggcggcggcggcggcgccggccacccgcaccagttccagtaccaagccctcctcgccgccgtgcacacgcagaaccccaaccacagccacaacctcccctttccccttcctcccctcaatggacctggacctgatgcatctacacacaatgctgctcgccagcctccgacgccaagggggtttgctgattggagtgcgtctaccagtgccttcacgtcccttgctgtgcagagcactccttccacagctactgccaatgcataccattacagcctatctccttgctatgctttctggacccattacatgcttaacaagaatgcatatagctactatcctgcacctaatcaggagcacacccaccctttcagccttgataacaaccaggctaaagatccaggttctatacccagcttcgggattgagtcatttaatacaacatccctggcaccaaacatgtctgctcatatgcctcccatggaaggacccctacctacaaaggaacctgaggctccagaggacatgcctgctagagtagctacaattaaggatgaaatggatgccagaaatggtgttgaacttaaatgtgaaacagttgacgctcttccagagttgaagcaaggtcatgaaagttgtgccagtaaattcaactctggagaataccaagttattttgcgcaaggaattgacaaagagtgatgttgcaaatgtaggaagaattgtgttacccaagaaggatgcagaagctagtcttccaccattgtgtgaaagggatcctgtgatactgcagatggatgacatggtgctcccgattacgtggaaatttaagtacaggttctggccaaacaacaaaagcagaatgtacatcctggattctacaagtgaatttgtgaagacacatggtcttcaggcaggggacgcactcattatctacaaaaatcctgtgcctggcaaatatattgtccgaggggagaaggccattcagcagacaaattagaggatgtggatggtgattgcgaccgcgtcagtgaggacatttcaagcgagggatgtgggttcgcaatccaagggaactcggagttgagctggctggggaattcatgacagtctgacttgttaactggggagtgaacggaaaaagattggatgtgcgtgctgccaaagagcttgcttctacagcgcgacatccaagttgaggagacccttttgcctattttttttgttcttctttctttctttctaattgagttgcatttggaaactttgagttctaccttctccttcagaatagcatttgcggttctgtaaatattctcggatccataagataaatgaagtggcgtggactttggacgtgctatgatgtttctctttgtcacagaagaatcagatgagagngc

SEQ ID NO: 17050 - DNA, 593 bp, Triticum aestivum
  Clone ID: PAT_TA_17050
gccggccgggtgacccagaagccaccagccacccaccccatccctgaggttgatcggagccggaggagaccaccgaggaagaaggagaagcggcgaggcgaggcgaggcgaggcgagagatggggaagatgccggtgcggatgaaggcggtggtgtacgcgctgtcgccgttccagcagcaggtgatgccgggcctgtggaaggacatcaccaccaagatccaccacaaggtctccgagaactggatctccgccacgctcctcatcacccccgtcgtcggcacctaccagtatgcgatgtggtacaaggagcaggagaagctgtcccacagatactagaggtggagctttgtccaatatcgcagcagtcggaatttccatgttctataatccgccaagagtgatttaacgtttttggaatcatttcctagctgtactcttttgctctttccgttgcatatgcaatgatgcagtaagtgtgacttgcaaacttactttgaggctcaaatgttgtgttgtccatcgttggagtgattttgtgcaataaagcaaattaactcgtcataaaaaaaaaaaaaaaaaaaaggcccctaa

SEQ ID NO: 17051 - DNA, 614 bp, Triticum aestivum
  Clone ID: PAT_TA_17051
ctgtgcggcgctcgaggcggccggccttttcaaggcagaagccacccaccacccaccccatccctgaggtagatcggagccggaggagacccgaggaagaaggagaagcggcgaggcgaggagaaagatggggaagatgccggtgcggatgaaggcggtggtgtacgcgctgtcgccgttccagcagcaggtgatgccgggcctgtggaaggacatcaccaccaagatccaccacaaggtctccgagaactggatctccgccacgctcctcatcacccccgtcgtcggcacctaccagtatgcgatgtggtacaaggagcaggagaagctgtcccacagatactaaaggtggagctttctcaaatatcaaagcagttggaatttccatgttctataatccaccaagagtgatttaacattttcggaatcacttctagttgtactcttttgctctttccgttgcatatgcaatgatgcagtaagtgtgacttgcaaacctattttgaggctcaaatgttgagttgtccatcactggagtgattttgtgcaataaagcaaattaaccagtcattttacttggttgctgccaaaaaaaaaaaaaaaaaaggccccta

SEQ ID NO: 17052 - DNA, 776 bp, Triticum aestivum
  Clone ID: PAT_TA_17052
gccccaaacgcgctcggggagcgccaccagcccaccccatcccctgatgtttggagcgggagccggaggagagcatccacaccaagggaagcagcggccgtggggggggtaggagacggagggacaagcggcgagggaggaagggggggagcggggacgcgcaagatggggacgatgccggtgcggaggcaggcggtgggatacgcgctgccaccgttcccccagcaggtgatgccaagggccgtgtcgcaaggacattcatccacccaagatccaccacaagctctccggaagcaattggatcaccaggcacgcgcatacagccaccccccgtctatcggcgcttacaccatgtatgcgatgtgggtacaaggagcttggagaatctgtcccaacacggatactaaatgtgttagctttctccaatattgcatgcacgtgggaattttcccatgttctataatccacccaaaaggtgtatttaacattttcaagattccacttctaagttgtagccctttttgctcgtttgcctgttgcatatgcaatgcagcaagtgtgacttgcaaacctattttgaggcctcaaatgttgagttgtccatcactggagtgaacttgtgcaataaagcaaattaaccagtcaaaaaaaaaaaaaaaaaaaaaaaagtcagccgagatgctactttgcccttcggcatctctcctgattttgcctatcctcgtggtaccctggcgggcttccccgcgtctcctacttgattattgtaggactgt

SEQ ID NO: 17053 - DNA, 1501 bp, Triticum aestivum
  Clone ID: PAT_TA_17053
cccccgccctcctgccggcttccgcccgcgcccgtgccgtagccgccgcgcgcccaggctagcccctccggccattcctcccggcgctcgatctacccatccacccaccagcgctccatccgttcacgggagcatttcttctgaactctgctacgcttgaatcgccgcagagttttactgaattaccagcagcagagcagagatctcggcctgctgctcggcgccaggggctccttctgccatgagcgccgccaggtcctccttcttcgcctccaacaacgccaagaagaagcccgccgccgcccggaaccccttcgactccgactcggacgacgacggcggcatggtccagcggcggggcccggcgcgggcctcctccgtcccgacccccgccgccgcgccggccagggccgacgagcgggactccctcttcgccggcggcggcccagcgcaatccggcttcgcgtcctcctcctcctcgtccgcggcggccaggggcccggtacaggaacgactttcgggactccgggggcgtggaggcgcagtcggttcaggagctggagggctacgcggccgtacaaggccgaggagaccacgcgccgggtcgacggctgcctccgggtcgccgaggagatgcgggacaccgcctccaagaccctgctccaggtgcaccagcagggccagcagatccggcgcacccacgccatggccatcgacatcgaccaggatctatccaggggggaaaagctacttggggatcttgggggtttgttttccaagaagtggaagccaaagaagaatggagcaatcaggggccctatgctgaccagagatgattccttcatacgcaagggcagccatatggagcagaggcataaactggggctgtcagatcgtccgcgtcgatccaatgcacgtcaattcctatccgaacccacatcagagcttgagaaagtcgaggtggagaaggcaaagcaggatgatggcctatctgatcttagcgacatactgaccgagttgaaaggaatggccattgacatgggaactgagattgaggggcaaacaaaggatctgggtcatgcagagaaggactttgacgaacttaactacagggtcaagggggcgaacactcgaacccgtcgtctgcttgggagatagacggaaagcatatgttgttgtcaccggaggattcctgcgacactcgttatcttctgcactttgctttcgtgggttgttaattcagatcattttgtgcatacgactctgatcaggatggtttgttggggaggtggccggggagttgtatcagggtttattgtgtaaatgctagacggcggttcattttctatgttgcagttgtagtacaatttgctatggacagtagataagtctgtattcggttttcttgttttgtaatctctatgctacaggaaagcacaacaatttcacattggtttatggagttgctaattctgggtggactcagaatttggtatttctc

SEQ ID NO: 17054 - DNA, 1395 bp, Triticum aestivum
  Clone ID: PAT_TA_17054
tgaacgggcgcgccgatcgagccaaggcattaaagctcggacaggtctccgccggtacgtgacgccaacctcgcgggaagcgccggcgtctgcgcgcgtgcgatcatgatgatgaggcgccagttatcggtctgcgtcctcctcctgctcgtgctcgcggggcagcagcaggcggcggccaagaagtacgccgccatcttcaacttcggggactccctcgtggacgccggcaacctcgtcgtggacggcatccccgagtacctcgccacggcgaagctgccgtatggcatgacctacttcgggtaccccaccggccgctgctccgacggccgcctcgtcgtcgacttcatcgcgcaggagctggggctgccgctgctgccgccgtcgaaggcgcgcaacgccacgttccaccacggcgccaacttcgccatcaccggggccacggcgctggacaccagctacttcgtggcgaaggggctgggcaagacggtgtggaactccggctccctgcacacccagatcaagtggctgcaggagatgaagcccaaaatctgcagctcccccgaagagtgcaggggcctgttccggcggtcgctgttcatcgtgggcgagttcggcggcaacgactacaactcgccgctcttcgcgttccgcccgctggaggaggtgcacgagttcgtgggggacgtcgtcaactccatcggcgagggaatcgagaagctgattgcggagggggccgtggacctggtggtgcccggggtgctcccgatcggctgcttcccggtgtacctgtccatcttccggaagcagccggagatgtacggcggcaagagcgggtgcatcaaggacctcaacacgctgtcgtgggtgcacaacgtggcgctgcagcgcaagatcgtggagctccggaagaagcactccgacgtgcgcatcatgtacgccgactactacacgcccaccatccagttcgtcctccacgccgagaaatgggggatgctgaggcagaagccgagggcgtgctgcggggcggcgggcctcggggtgtacaacttcaacctgacgtccaagtgcggcgagcccggcgcgtacgcgtgcgacgaccccgtccaaccactggagctgggacggcatccacctcacggaggcctcctacgcccacatcgccaggggtcgccgtgcgctggctttcgccgacctgcccatcgtcggcaaccggaacctcgagtagcactgtagtagaagtaggaaagggcttgtttttgcgtacatgcccatatgtcactgtgtagagaggaaggaaaggaagtcaaagaacagacatgtcttgtgcagattaattaattattaattcttttgaaaaaaaaaaaaaaaaaacacaacaaggggcccggtacc

SEQ ID NO: 17055 - DNA, 872 bp, Triticum aestivum
  Clone ID: PAT_TA_17055
ggtcgagcgccgcgccaccgtcctcgcgcagcaggggttccgccccgaggtcgtcagccatctgccctcagctccaccttatgtagaagaagcagagagctccagtccacgttcgagccccgaagaagatcgcaatgcgcgtgatggccacggctgctccatagagcttgtcgacgatttctctgctctcgacggcgaagtcggcaaaagactgaatgacatggttcctgtccctcatgtccctaaaacaaatggagacattccttcttttgatgaagccttttcagatcaccgaagacttcttgacaggttggtgctgtatggcctggttgagctcaaggttaacggagatggcaattgtcagtttcgggcattgtccgatcaattctaccgaactcccgaacaccatagatttgtgcggcaacaggtggtcaatcagcttgagtctcatcccgagatatatgctggatatgtccctatggattacagagaatatcttaagaagatgccaaagatcggagagtggggtgaccatgttacactgcaggctgctgcagacttgtatggtgtaaagattttcattctgacatcattcagagatacatgctacatcgagattctcccagtcgtccaaaaatcaaatagagttatatgtttgagtttttgggccgaggtgcactacaactcgatatatccggaaggagagttgcccgtcgtggagaacagaaagaagaggtggtggcacttggagttctagacttgtagtgctaaaaccaaaaggggaatagaagatttgatttgttcttttgatctcatggcagcttgtcggatcgacggtcgttttgttcgaccatgtgattacgagggatctg

SEQ ID NO: 17056 - DNA, 596 bp, Triticum aestivum
  Clone ID: PAT_TA_17056
ccgatctgcttcaattaggtcgcgccatggctgccgccccgttcccgaactggctgatgatggagcgcttcgtcttccgcagggacgacaaggggtccttcccggacgccaccaaggcgcccatcagggcgtccggcaccacctcctggaacgctcgcttccacatcgccttctgcctcgccgagcccccgctcccctcccgcctctacgcccggctgccgcgttttccagaccccaggaagcacacccccttggccatcctggcggcgcaccgccatctcctcctgcttcgcatcggtaccgatatccccggactagggctggtgcaggacttcctcatctacagcgcctacgacacttcctcgctcaaagctctgcccccttgcaccgagccctacacggattacacccgcaccggtgacagcctacctcgcggtcctccgctcgagcaggggaagcaccgcctgctgacggtcaaatccatcggcctcttgtgccgaggcggcgaaggcgagcaagagtttgcggtggcggagctctgcgtttttaagtccgtccactcgggggtctacgctgacgtctgtttgctgcgctcc

SEQ ID NO: 17057 - DNA, 1017 bp, Triticum aestivum
  Clone ID: PAT_TA_17057
tttatggacatttagataatgattatatggaagctggcacttgggaagccttaagtttcttcttacaatttgaatggctaatgtaggtccaagtggttctgaactggctccttctacgttcgaggcttttacgaaagttccaaatgttctacgtccgcatacacaaatcttttgcactagcgaatgggttcttggcacaagagaggacttagtgaaggatattattgctgaactacgacctgaccttggtgaagagtggtggacatatgtttgtatggggccttctgatcctcaaccaaattggcaccttgggatgcgcggaacccagcatcgggcagtgatgtggagagcatggaaggagggtggcacaggatttctttactggggtaccaactgctacgagaaggctatgataccaagtgccgagatctgtttccgacgcggccttcctccaggcgacggggttctgttttaccctggcgaggtgttttcttcgtcaaaggaaccagttgcgtccctcaggcttgaacgcattctcagtggcatgcaggacattgaatacttgaacctttactcctcaaagtacggcagggaggaggccttggccctcctggagaagactggcgcgtatcttggcccggatcgctatgcacatgatcatgggccagttgatgtgatgcgcggtgaggtataccgcacctgcagatcttagggcagccatgcatacctgtcgctctttctttcttccattgcggcatatctgttgttgtatgtggcttattacactgtattagccaactgaaactcgctaaatacttttgagcaaactcgtcaaagctagtatagtaattgtagatactgcctgtactaagtcagcgacaattaagtatggacgggagagggaggagtagagtatggtagtgtggccatctgggccttgtacatatacggacgctcttttcgaatcgggcctctttttgtttgtgctgcgaaaaaaaaaagtcgacgcggccgcga

SEQ ID NO: 17058 - DNA, 585 bp, Triticum aestivum
  Clone ID: PAT_TA_17058
ggtggccgacgacagcctgtcggagcaaaccgccgtctacttctacctggtcaggggcgcggacgggaagctcagcacgcacttctgccaagacgccttcaggtcatcgagggcgaacgatctcgtcaaggccgtttacggtagctccgtccctgtactcaccggagaagatctgtcagtgagaatactggttgatcattccatcgtggagagctttgcgcagggcgggaggacatgcatcacatcgcgcgtgtaccctacgaaggccatctacgactctgccagagttttcctcttcaacaacgctacgaatgttaacgtcaccgcaaaatcgatcaagatctgggagctgaattcagcctacatccgtccatatccagactcatcataagtaggccggcaaccaatgtttgcctcaatagtttgattgtatacagtgtagggtagcagttcttttgttttttctttactttcttcatttgtgaatatatatcataacgggcagtgaggctattggtggacaacaaatgtattatttgctacaaaataagtgcttttctgtgcctaaaaaaaaaaaaaaaaaaa

SEQ ID NO: 17059 - DNA, 746 bp, Triticum aestivum
  Clone ID: PAT_TA_17059
cagatcctctcgtgtaggaagcgccgcgcggccgtgatggttcatccgttgcatgccctccatgagctgctgctgcaagcgaggtctccacatgcggccctgggactggtctttgtcctgctcgtctgccctctcctcgccctcctggtcgtgcgccgcctcgcgacgccgtcgacggccgcggccaccgcgagagccagagaagagctgctgggcaggctgccctctccccccaggaggctccccgtcatcggccacctgcacctcgtcggctccctcccgcacatctccctccgcgacctcgccgccaagcacggccgcgacggcctcatgctcctccgcctcggcgccgtcccgacgctcgtcgtctcctcgcccagcgccgcggaggccgtgctgcgcacgcacgaccacgtcttcgcgtcccggccctactccgccgtcaccgaaatcctcttctacggccccacggacgccgccttctccccctacggcgagcactggcgacaggtcaagaagatcgccaccacgcaccttctcaccaacaggaaggtccgctcctaccgctatgcccgcgaacacgaggtgagatcggttgtggctaagatccgcgatgcggcctccaaatgcaccgtcatcgacctgactgaccttctcaatgccttcaccaatgacattgtgtgcgaagctgtgtccggtaggcttttcagggaacaaagccataaaaaactcttccgagagctcgt

SEQ ID NO: 17060 - DNA, 1194 bp, Triticum aestivum
  Clone ID: PAT_TA_17060
aggaaatcccttccctcttgcctggccgtgggcaaaaggcccccggccggccctctcgcggcctccttctagcagccatataacaaatacaatagtcaacaataatagaataacaaagcaacacatgagagagtaaataacaagatggatgatgaacaagatcgacaggagaatacaaacctcactcgtcaaggaagaccaaacaaaaggacagcatctgttttggattctatcactgacacagtcaaggaggggaatccagagtataatctagatgaaccaactatggagcagaaactcgagagtctaaatttgctcaataagtctgaattccttgaagagcaatcagcctctctggcgccgccgagtgcggattcagtctatattttgctgaagcaagctttgcgtgctgatgatcacgctgaattgttgaaatgcatgtacaatagagatgaaaaggtcattgtaaagtcagtatcactcctaacaccaggagatgctctgaagcttctcaagttcttcgtgtcgtcaatacaatctaggggtgcaaagctggtttgtttgctcccgtggcttcaaactttacttagccggcacatgagcagcatcgtgtcgcaggagtcttctctgctattgctcaattcactctatcagcttattgaggcaagaacgtcgaccttcaaatcagcacttcaactctctaccacccttgattaccggttcagtgagattgctgatgaagaaactgacgaggaagaggcggccgcaccgattgtctacgaggacaaggacacagaggacgaagaatctgacatcgatgctatggaaaccgatggggagagtgaagagcttggcgatgttactgatgccctaaggcattcagatggaagtgagagagtattatgagcgactgacctgtagactcttctaggactgagctctcaatcatccttttcgggtcttgctaaaaaaatcatttgtaaaaggtacccgctcgaaagctgatggtgtatacgaggctgctatatgttgttggataaagttttgagagcctcagattttcatggaaaacccagctaggcttgtacctccgccgccaccgcgctatctagcacaaacactctcaaatatctgcaagcatttgaaatggcatttcatttgcgagatgacaaaaaaaaaaaaaaaaaaaaccga

SEQ ID NO: 17061 - DNA, 596 bp, Triticum aestivum
  Clone ID: PAT_TA_17061
tacccacgcgtccggtaccaaccagtcccaaaaaccccaaccatgctgcggccacgcgctccggcttccgccgcccacttcgtcgccgccaagctcgccgcccaaggaatcagcgcccatcaggtcgaccccgactacctcagccgcctccagctcctccaccccgacggcgattcctccgccgacttcgtcgctgccaagctcgccgcccaaggaatcagcacccatcaggtcgaccccgactacctcagccgcctccagcacctccactccggcggcgattcctccgccctcgagcaccctgcccgcggccgtcccggcacccctccccacgccatcaagtgcgagcagcccgaggatggcgaagcccgaaccgcccccctcccctccccagccccggaaggaggcgaccgcctggtggaggagaaggaaccccccgcggagatcccttggtacgaaacaggggaaatggatgagagctaccgtcaactatggcggcacacgcacaaggacgatgacacgctagtgctcgagatacagggcgaggttgtgcgctacgggcaggaagctgatgcagagaagaaggatggggagga

SEQ ID NO: 17062 - DNA, 511 bp, Triticum aestivum
  unsure (1)..(511): unsure at all n locations
  Clone ID: PAT_TA_17062
ccccccccntgggacncttgatttaaatcactgcttctctaaaacattatgcaatgtgtgtcatttagtacattcagttttgaccagtaaaattcagttttgactgtaaagttcagtttcttcaattaagttcagagtcaacagtatttacagcatctgtcggagcggccgtggcgcggctgatgcgttttacatctagcactttttggtgatgtattttacatcatctattgcacatgatattagactcccacttcagattaatgttgtctgtcttgtcatgcttcagcctcgtcgtcgtacaccttagcggagctgctccaacgacggaaccgtccatcacagcggagcagtacccttggcgccgtttctagaggcctctgatcttcttccccgcctctgacagtcacaccagcatcatcaccttccactacgtataacccaatgatgctgaggtgcacaaggctatgccaaagaggttgtacactcgtcgcatcactttgtttctcca

SEQ ID NO: 17063 - DNA, 1001 bp, Triticum aestivum
  Clone ID: PAT_TA_17063
ttttttttttgttccagtttcggccgttgcaataattgttttggtcgcgacgtgctccattattgctctgaagattcacagaagtggaagatctccatttccgtcattgacaggaaaggactacaacgaccgtagggacaacatcaaaaaaatattgggcaactacggctcactagctcccaggaggtaccaattctcacacctcaagaaagtaaccaaatcatttggtgaaaagctagggcagggtagctatggcatggtatacaagggcaccctagcaaatggccgccatgtcgctgtcaagttccttcatgacacgaccggaaatggagaagaatttgtaaatgaggtcatcagcattagaaggacatcccacgtcaatgttgtcactctgcttggtttctgtttggagggttcaaagagagctctcatctatgattatatgcctaatgggtcactcgacaaattcatctacaccgagaattcgaaacaagctcttggatgggagacactatatgggatcgcaacgggcatcgcgagaggattggagtatcttcaccgagggtgtaacacacgaatcatacactttgacatcaagccccaaaacatcctcctggaccaggacttcgtcccgaagatcgccgattttggtctggcgaagttgtgcaaccccaaggagagctacctattgtcgatggatggcatgaggggtacggtcgggttcatcgcgcctgaggtcttctcgaggcggttcggggtcgtgtcgacaaagtcggatgtgtacagcttcgggatggtgctcttggaaatggtcggtggaaggagaaacttgcgagcaagtgttgagagggaaagtgaggtgtacttcccggattgggctcacagtcacctcgcacaatttgggagcttgcaaccatttgacttgggatttgatggacctgaagagatcgcgaagaagatggccactatcgggctgtggtgcatacagatctcaccggcgt

SEQ ID NO: 17064 - DNA, 752 bp, Triticum aestivum
  Clone ID: PAT_TA_17064
gccggccgggtcgggaacgaaccacgaagcaaaccaaaggaaccgagcgaacatgcgtcgcgagggacggcagcgagggtgggtgcgcgtgtacgaccgcgagctggtcgacccggagggcaagcgccgcgccgtgcacgtcgtggaggggccggcggtggccaacggcgggttcatcagggcgccgcggaagccgaccaaccagtccaagtccggcggcctccgcgcgctcggcaggagcggcatggcgcaagaggaggaggaggagccgcaggcccttccgccgacgatggccgggcgcttcggatactactactcgacgggattgcagtcgccgttcaagttcgagtccgccatgtacacctacaagaaagtggagatccgtccggcggcggcagcgcgcttcgggggaagatcgtcgtgcaaggcggggcgcaagttcaggcacgacgaggtcaagaagtactacctcgacgcggccgacgtcctcgatgggcagctcgattatctttgtgacttcgattcgtgagcgctcggaacggaggtgcattgtccggtccctatgccaacagaaggatttttgtttttgctcctcaagttcgacatgaggaatggggagttgtatactggatccagtggtgtatctaataaaaatgagacttttttgtgtgtgaatgtaataaaaatgagacttcagttcgtcttgacactcccaagatactaccccaaaaaaaaaaaaaaaaaggccccta

SEQ ID NO: 17065 - DNA, 1308 bp, Triticum aestivum
  Clone ID: PAT_TA_17065
gtattagttgattttgctcacgagtgactagttgttctatctgctcgctacgaagttgttctatctgatctcgcggtatcacgagcttcctctgaaggtgcatgatccgtgacttccctcgccacggttggtcacgcctcatcctccgtcgaagctgaggccccgccgggcgcactcccacacggggcacacgctgtcccggtagcccacgggccaggccaagttcaacgtgctacggctgcgtcgaggacatcccggggggctacaggcacgcgtgcaagcctcgcgagcactacaaccgggggcgcctgctaatacgaagaggccgccgggccagttcaagttccatgcggcccggcagcctcgacgtacttcgcgggggtgccaccgcgtcccgtgcaagcgctgcgactgcgacctccaccaggccgcaaagctccaagcagggaccacgccggagcacgggccgcttccctacgagcatgttggtcgttggtgcctatggcgacccatctaagtcgagcaactcagcttctgccgccacgaaaacggatgtcgccgctctaccaattgcaaggaaggaggcggccacttacaccaatgctgtgctgccccatacctcactatggaaataaatgcacatgcatatcacgtgcgcgagagaggatcctcctatgccgagctcatgctgtactgagtctcaatctgaagtcggcggtaatggcagggcgagcaaggagactgcgttgcggaagtacgggtcggggaagtccgggatgaacctgggcaccataggcgacatcgttaaggccttggcgggcatcgtcctcgcggtgctcactggaaacccgctgccgttgatttctgcaggggtcgatctgctctccagcgtcgccaagttgaaaaagtagctagcagctccatccttgctcatcctacgcacgtacgtacaacttgttggtgacgggctgcatggtgatatatgtaacatcctactatttgtacgatatagtccccgcctgcattgtgtatttgtgatcgctacagtccatttctcatttcttcttccatgtcgaataatgtcaacacgttattatatgtaagtgtgtagatgtgtgatatgtaatcttgcagaatatatcttgtgaatttgagatatgtaatcgtgcagccacgttattatatgtaagtgtagatgtgtgtaatgaataaatattctgatgatatgtaatcttgcagaataaaaaaaaaaaaaaaactcgagactagttccctcctgcccggccggattctatcgtatgtttttta

SEQ ID NO: 17066 - DNA, 742 bp, Triticum aestivum
  Clone ID: PAT_TA_17066
gccggccgggccgggacatatcgtctgttcgtcgtcatcatacagcacacaccagaagtaaaacgaagaagagtcgtcgtgctcgtgcgtgcgtgcagcttagccacgcctttgcatccgagaggagtgacaagggggagcatacatacatggcggcggccatggagcagagcaacgggggcggcggcgtgaaggtcaagttcatcgagacgcagttcgtcagctccgacgccgctaacttcaagtccgtcgtgcagcggctcaccggcaagtactccaagatgccgccgccggcgtcctcggtgcacaggcctcgcccggggccgtgcggcagagccgaccaacaagggcggccgtgcgcctccggcagcgaccagctgacgacggctgcgccggcgaggccaacgggggcggccttcgagccgctgcacgtgggaccggagctgaacgagctctgcgacttcgccgacctgctctacgcgaccccgagcgcgcggcgccacggcggcagcgtcgtcaacggctttccttactgatacttggcccgtgaagaatcgtgttacccttctcccttgaggatcacgtatgtgagccttttgctgtaatgctcactgggagcgccagatgtgatcttccgcaaacacaagtggaagtaagaggaaaatacgaaaatgtatgaatatattgtgttcagcgaaaaggtagaagaaagagatgggcatgtatgctggcaaacgagcga

SEQ ID NO: 17067 - DNA, 904 bp, Triticum aestivum
  Clone ID: PAT_TA_17067
gaccccgcgtccggagaagcttggcccagcacagcgccgagcgaccgccgagagctggccgcgtcgggcgctgttgggcatggcgagcagcgggggaggcgcggctgcggcggcgcggatggacccggaggcggcgacggagctggcgcggaagggggtcacgctcctgctcctcgacgtgccccagcacaccctcctcggcctcgacacccaggtgttctcggtcggccccaggtgccgccggatcaagatggtgcccccaggcccgcacttcctccactactgctcccccagcaggcgcgggaatgagttcgccccgacagtcggattcttccttaccactcacccatctcaggtggtcgttcgaagatggcatgctcaagaggagagactagtgacactgtcagaagaggaggaaatcagatactctgaagcagtaaaacgtttcgagttcgatgatcagcttgggccatacaatttggattcttttggagactggaaacaactttcaagctacttgtcacacagtgtcattgaacgccttgagccaattggtggagaaattacaattgcattggaggcatcatggatggatagagctccccaaacagatatggagagacgattgatggaacaacttagagaagacaaatttgcaaagaaagcccctgcacagcctgagaggagaggatgctattacacaactattcccgcttcggttaagcacagaaacatttctgcagatgagctgactttgctgaacttggacagaacaagcttgctggagactgtcctggccaaaagttatcaaggccaagaagatttactcttgggggagctgcaggtctctttcatagcgtttatgatgggacagtcgctggaggcgtttatgcagtggaaagca

SEQ ID NO: 17068 - DNA, 764 bp, Triticum aestivum
  unsure (1)..(764): unsure at all n locations
  Clone ID: PAT_TA_17068
ggccaagccttctccccgaagcctttccggaaaaaccctcgcccccttccttctcccccgccccacacccccaccccggcaggccgcgatcaagccccgccatcgccatggccagcgacgacgactgctactactactacgacgacgacggcgacggcgaggaggatgaggaggacgagggagaggaggcggccgactgggacggcctggcggtgggggcggacgaggacgacctcggcctgctcgaggacgacccgccgcactcggagcgccgcgtcgattgctgggctattacagaagacaccctttctgcggcccagcaagaagacttgtccacaatgatgaatttgctcaatataaagcagcaccaggcgcgcagtctcttcattcaccaccgatggaagatagactgcatctatgattgccttgacaggaaggggcgagaccgcatgctcagagaggcaggcattgtactgcaggagaagagtagcatgctaataggtgcctcaagaacaccctcgacaagtgtccaatgcaatgtgtgctttgacgatgacttggccccggccgctgtctcgactatggactgtggccattgcttctgcaatgactgttggacagagcacttcaatgcagccatagacggcggcaagaagcagatacgttgcatggaggtgaagtgcttggccatttgcgatgagggcattgtgcagcgcctacttggccagaagtaccccgatgcagccaagcgcnnngatcgcttc

SEQ ID NO: 17069 - DNA, 914 bp, Triticum aestivum
  Clone ID: PAT_TA_17069
gctgagcctatcgaggaggagctctctcttgccatcgagtctggcaaggtcagcgcccgtgtcgatttcacgtccggtgcccgtgtcctggctgacgacttcggctgggatgtcaccgacgcccgaaagatctggaccttcggtcccgacggcactggtgctaacctgttggtcgaccagaccaaggctgtccagtacctcaacgaaatcaaggattccgttgtctccggtttccagtgggctacccgtgagggtcccgttgctgaggagcccatgcgatcttgccgtttcaacatcctcgatgttaccctccacgccgatgccattcaccgtggtggtggtcagatcatccccactgcccgtcgtgtcctgtacgccgcctctcttctcgccgagcccgctctcctcgagcccgtctacctcgtcgagatccaggttcccgagcaggccatgggtggtgtctacggtgtccttacccgacgacgtggtcacgtcttcagcgaggagcagcgccccggtactcctctcttcaacatcaaggcctacctccccattctcgagtctttcggtttcaacggagatctccgacaggccacctccggacaggctttccctcagtccgtcttcgaccactggcagatccttcccggtggctctcctctcgacgctaccagcaaggtcggagctattgtcaccactatgcgaaagcgcaagggtgtcaaggagatcgttcccggtgtcgagaactactacgacaagctgtagacggcttttttttaatgtgccgaacgaaccacgaagcgtgccacaatggacacgcaaaattaatcggctggtaacgaagatttgggacgcatgcctaattccacggaggagctccttgatgatctcagcaggggtatgctaagcggaaa

SEQ ID NO: 17070 - DNA, 640 bp, Triticum aestivum
  unsure (1)..(640): unsure at all n locations
  Clone ID: PAT_TA_17070
tcggcaccagcgcagacggcggccgtgcctcctcgagctctcttcgtccccacgcgatgtctgcggcggccgggccggtgtacgaggcggacgcggaggcggtggtccggcgaatcacgccgccgctcgaccgcgcaaggcacaagggtcaggcagggaagatagcaataattggtggatgtcgcgagtacactggtgctccttactttgccgctatctctgcattgaaagttggtgcagatctctcacatgttttctgcacaaaagatgctgcaacagtaatcaagagctatagccctgagttgattgtgcatccaatattagaggagtcctacagcgtaagggatgatgaaagagaatctgtttcttctagcattctcactgaagttataaagtgggtggagcgctttgattgcattggtgttggnccccggccttgaaagggctcaattnttatggattggggnantaatttaatgggggnttccccaaanggttannttcccaattgncnnttaatggggatggccttttncnttttaacccaataacattnggctttgttnaaaaaaaaatttttttggcnntttaacncccaaatnttttccnnnntccaancnttttttntccaaaaaaattt

SEQ ID NO: 17071 - DNA, 1140 bp, Triticum aestivum
  Clone ID: PAT_TA_17071
cccacgcgtccgcggacgcgtgggtttcgacatgcgtacagatgaaaaccctgacggagaacttggcgctgctgagctttaccgcagccttcttgacatccgcgtctggggagtcaacaacaacgacccaggccaggcgtggaaccgccgacgccgtgctcaagaaggtgtcaagagaatatacgactcgaccaagactctcgtttccgaagtcgaggtggcacgtcccagaggtattggcctgatctctgccgtttctaacagaatcggcgccaagtcgtacctcaagaaggattcgctacgatcctgtggtctcaagcttgttgaggagcttcttgcacaaggcagctcgattgaccatgttactgacaacctctggctaactgcctttggaggcattggcgttcctgttacagccttttacgaggttttggcctttttcctccgccccgagaatgcgtctatctgggctgaagttcaggccatcgctcaaaagggtgatgatgcgacactccacgcctatgttgccgaagctctgcgcatgacgagctcccagcgcaatgttcgtatttccaagacaccaggtgaagttgatggccaatccatcgcgcctggaacagccgttgttctcatgcttggtgaagccggacgaaaccccaaggagattccagatgccgacaagttcaacgcccagcgcaagcagcaagaagtatcggcattcagctatggtcaacacgagtgtgtcgccaaggacgttgccctcgcttttgttaccggtcttatcaagcttgttgccgatctcaaagaacttcgaccggcacctggccagatgggaactgtcaagacaattcgtgttggtaccgagaaggcttatctcaacgacagctggtcgtaccttggatttgatgctagcacttggaaggtacacttcaacggccatggcaagggtaactttgaaggtgacagagtccctacgagcaacactcccatccaggaatactactcgttgctccagaagcgcaaggacgagcttctgcgtcgataattgaagatagtgatagttttctcctcgaagagatagtgaagtcgtctaaattgaacaacttcgagactgaaaaaaaaaaaaaaaaaaggccccta

SEQ ID NO: 17072 - DNA, 197 bp, Triticum aestivum
  Clone ID: PAT_TA_17072
cgccaagtagcgctgccccgaccccatccgctgctacggctgaaaccactgcccccgtccccgaccgcctaagctattggtgctgcattgccagtagcatcataaaggacaccgtctacctgactgttgttgttgttacaataaacaaacccattcgtgcagcgttttaaggtgaggtctggcactttgtttgctcg

SEQ ID NO: 17073 - DNA, 1873 bp, Triticum aestivum
  Clone ID: PAT_TA_17073
gcagtcgccaccacgatccttgaaagggccacccccgcccgggcaaccccatacacacacagttcctcagattacgattacgaccgaggaagaggaagagcaaggggaataggaggaagaagatataatatggccctgggagacgactctccggcctcctacatccgcatggtgcaccatctgatagagaagtgcatgacgttcaggatgagcatggaggagtgcatggaggcgctgtccaagcgcgccgacgttcagccggtcgtcacctccacagtgtggaaagagctggagaaggagaacaaggagttcttcgacagctacaacaagcagttgagatcagaaggccgaagcagcagcaacagcagcagcgacagcagctcctaatcaccaactgcaggtgcgtgctgcttgctcgagatgttggccgttctgcaccgagtagaacgcagaattaggggatcgacggcgcgggaggtcaacgaccgccccgcgatctatgtctggtggtgccgggaactaccacggggagcacctgggcagcggccccgcgtgccgacgcggcggccggcgaggggctggagctggcgcagttcggggcgggctgcttcttgagcgtggagctggcgtaccaggcggctccccggcgtggcgcgcacagaagtgggctactcgcaggggcacctggacgggccgacctaccgcgacgtgtgcggcggcggcaccggccacgccgaggtggtgcgcgtgcactacgaccccaaggagtgcccctacgccgtgctcctcgacgtcttctgggccaagcacaaccccaccacgctcaacaagcagggcaacgacgtcgggacgcagtaccggtcgggcatctactactacacggcggagcaggagcggcaggcgcgggagtcgctggcagagaagcagcgagagtggaaggagaagatcgtgacggaggtcctcccggcgaggaggttctacccggccgaggactaccaccagcagtacctggagaagggcggccagtccgccaagaagcgctgctccgaccccatccgctgctatggctgagcctcaaggtcatggagcactgccccagtctccgcccgccattgcagctagctaagcatcgccattagcatcataaaggacacaccatctgcctgcctgactgttggtgttacaataaataaacccatgcgtgcagcgtgtaaaggtgaacttggcgcttttgtttgctcagatgatcgatgttagcgtggtcgcggccgaggtcaaccccatacacacacggttcctcagattacgactacgatcgaggaagaggaagaagatacaatatggccctgggagacgactctccggcctcctacatccgcatggttcaccatctgatagagaagtgcatgacgttcgggatgagcatggaggagtgcatggaggcgctgtccaagcgcgccgacgttcagccggtcgtcacctccacagtatggaaagagctggagaaggagaacaaggagttcttcgacagatacaacaagcagttgagatcagaaaagggaggccgaagcagctgcagcagcagcagcgacagcagctcctaatgatcaacaggagatgcgtgctgcttagatgttagccattctgcacttagtagaacgaataattagaagatcgatggggcgggaagtcagctaacgcgacacgatctatgtgtgctggtgcatgtacctgccccggcggccgcctgatactgttgccatattcttcagatgtaattgtactaatcatcagtccatctccctctactcgtcatgtgtcccgtcttcaatcaaaaaaagtaataaaagtccaagcaacgtaatatggcacc

SEQ ID NO: 17074 - DNA, 619 bp, Triticum aestivum
  unsure (1)..(619): unsure at all n locations
  Clone ID: PAT_TA_17074
ngtgctaataattggccattattgctgctgcaatgggagacccttggtcatctgaaatcggtgtgcttaagtgatgaacaaccaaggcttgtcactaccctgaagcctgtcaggaaaggtacaaatggtggagtgaccttacaaggacttcttgctgccacagcaggtggtctaaccattgggtctgacttttgttgctgttggactgatgacagctgaatgttcttttgatatgtcgtttcaacagctcctagtaatacctatctctgctgctgctggtttgcttgggagtcttattgattcattgctgggtgccacacttcagttcagcgggatactgcaagtgttcggaacaaggtggtcagtaaacggggacctactgtcaccaagatttctggaatgactatcctggataatgatgctgttaatgcagtgtctgtgctgctaacatcggtgattacagcttatgcctgcattttcttcttctagaagcaagggtttggttgcctttttcgcctgtccccaatgcgcagtgatgtgtaatgtgaatattccaaggacagaatgactgatgtttacttcaancaagatgaacaatgaatattgngaactttgggcn

SEQ ID NO: 17075 - DNA, 586 bp, Triticum aestivum
  unsure (1)..(586): unsure at all n locations
  Clone ID: PAT_TA_17075
gtcgatgattgctactganaggccagccatggagtccctttctccaccacccttgatacagaactgcctctggatgctgacgtggtgctcgtctgaaattctgatccatgcacgggcaagcatgatcttgtcgctcctggtgtcgacgctagcgaaagttatcgctttgcgttgcaggaactcaaccaacgcttggcagcgctcggacctgcaatagtggtacacgaggacatgctcgcgcatggcaagttgcatgacagcgacccctcggcgtctgtaactactcttacgtgtgtactcgaggtcgaggccgacaaacttgttcttctcctcctttagccattcctcgtacattttgatgattcgctccagtctttgggtcgttggtgtacaccacctccagcacagttgtgccatgggtagtgacgtgttcggtgtgtgttgttagtttctcgtcgtccatggctgcagggaggcggtgtgggtttttggcgggccgaccaagaatggccggggaagaagagcaaatggatgtggtgtaaatgaaattggatggtttctttgtaatgtagaaaaagtaaccgac

SEQ ID NO: 17076 - DNA, 1165 bp, Triticum aestivum
  unsure (1)..(1165): unsure at all n locations
  Clone ID: PAT_TA_17076
gctccgaggacggggaggggctgagagagagagggagagagagggagagagatggcagccgctggagttaacagggagcagaggtggagcctcgccggcgcaaccgcgctggtcaccggaggcagcagaggaattgggcatgcaatcgtggaggagcttgtcgggctcggggcgcgggtgcacacgtgctccgagaacgcggcggagctggaggagtgccgccggcggtgggaggagatgaagctgccggtcaccgtctccgtctgcgacgtctccgtgcgagcagagagggagaagctcatagagacggcgacgcaaaccttcgacggcaagctcgacatactagtaaacaacgtgggacggaatctggccaaggcgtcggtggagtgcacggcggaggagtactcgcatctcatgtcgacaaacttagaggcggcgttccacctaagccagctcgcacaccccttcctccgcgacgcctccgtcgccggaggaggcagcatcgttaacatctcctcggttgcaagctcacttggctactccgaccctcgcaagtatattgcatatctaaaggaggagttaatcagcttacaaggagccttgctgcggagtgggctcaaagacaagatccgtgtcaactccgtcgctccgggtgggatcaataccgagctgcaaaagagtgtggatccggagattgtagaaaatacgttgtcaagaactccgatgcataggctcggtgagccagtggaggtggcatcaatggtgtcgttcctgtgcatgccagcagcttcctacgtcaccggccaggtcatctatgtcgatggaggccgaaccatcagcggctaattaattattccaagctactttagtaaccattaagctcctctcccggttgataagtgagaataaaattaggttgtgtttggttctgatatgtattctaaaaaaattgttgtgacttgtgagcggtaagaaagttattataaactttcagctaaggaaaagctgaaagttgtttggttgagagacaacagtgcttaaanntttncaaaaaccttattttcaaaaaaaaaaaaaaaaaaaaaaaaaaaaaaaaaaaaaaaaaaaaaaaaaaaaaaaagggggggcccggtacccaattcgccctatagtgggtcgtattacg

SEQ ID NO: 17077 - DNA, 704 bp, Triticum aestivum
  Clone ID: PAT_TA_17077
gtgctgagtattcatattctgaggcgcatgatccttcttccaagcaaaagtcgctcgtggttttcctatgtacgaatgtttggtgagggttgtgggagaagttgaagacgtacaaaagtcggcagcagcatcttgttgataagcatcaatttcccaactcatttgaattcttcaaaagggcacaaccttcccagcggcatcgtcagaagtatcatcgaaggcaaactgcttataagggagaagagacaagggatactgtcatggacgttgatgggaagaatccaaggcaatcaaaaccgagatatcggccgaagcaacgggatcataaggagccgaaagaaaatgaacattgtcacaaggagtcgaaagaaaatgaacatcatgagaaggaggccaaggagagcgacatggaggtcgaacagaagattgatgaactgtcctcggctgtatcaaggctgagcactgcagattcggtgccttcgagcataacctttggccatcgtcgtgctcgtggtcttacttttgtaccaaggtctattaggcagaacaagcaggtctctcagccagaagcaaattgacaattcttcaacagattatcaatgtcgaatacggatttcccttgtacttggacgtttgaagtttgcactgtatttgtatcatgatcgatgtttttttcgggttgcctatttggtgttctgcctgct

SEQ ID NO: 17078 - DNA, 1214 bp, Triticum aestivum
  Clone ID: PAT_TA_17078
ccgatttcgaatcagagattccccacctctctcgcacgctgtctctccgggaggacgacgacggaggcgcggcccagcacggcacggctaccggagctggctgatcggcggctctattagggcaggatgcagcagaatcccgccgaggccatggaggtgtccgcgccgtcggaggccggggcgcccaaagatatggggccgtggctagggttctgggaggtgtcgcgccggcggttgacccccgacgaccccttcttcgccgccggcgacatggaacgcgagctactcgccaaacacgttgccctggatctctcggatgatgaccggtatcaacttgagaagatggatgtggcgagcgtgagcatggtatgttgtccaattgctggttgcggtgctcatctagattgcttggaggactttgaagaccactacagcactcggcatactgcttcatgctctgtatgttcaagagtgtacccaacatcaaggttgctgagtattcatatttctgaggcgcatgattccttcttccaagcaaaagtcgctcgtggttttcctatgtacgaatgtttggtggagggttgtggggccgcccgggcaggtataaaagaagtcggcagcagcatgcttgtagataagcatcaatttcccaactcgttttaattattcaggcagacacatccctagcggcagcatcgtaagtatcatcgtcggcagactgcttataagggggaggagacaagggatactgtcactgacgttgatggtaataatccaaggcaatcaaaatcgaaatatcgaccgaagcaacgggatcataaggaaccgaaagaaaatgaacattgtcacaaggagtcaaaagaaaatgaacatcacgagaaggaggccaaggagagcgacatggaggtcgaacagaagattgatgaactgtcctcggctgtatcaaggctgagtacctcggccgcgaccacgctaccttcgagcataacctttggccatcgtcgtgctcgtggtcttacttttgtcccaagatctattaggcagaacaagcaggtctctcagccagacgcaaattgacaattcttcaacggattatcaatctctaatacccatttcccttgtacgtttacagttgtcactgtatttgtatcatgatcgtgtttttttcgggttgccaaaaaaaaaaaaaaaacaaaaaaataaaaaaaaaaaaa

SEQ ID NO: 17079 - DNA, 1098 bp, Triticum aestivum
  Clone ID: PAT_TA_17079
gcaccgccaaagtcaggttccaagcccaaagccgtacccccaaaatggcgccgccgtcgcaggcggccaccggcaagcggaagaagcagcacaaacccgctaagagcctcgccgtgaaatcaaccaatcccgtctcgaagaagacgcacaagcagaagaagccgcgcccacctgctgagcaggaccaaaccaacgccgccgccgccgccgcaggtgaacccgcgggcggtggcgtcctcttgtcagccgcgctgccgccggcgcggcagctcgagttccttctccgcagcttcgagcgcgccgccaagatgcgcctctccccactcgagctcggcgcctactccgaggggtgcatggtgcagctcgccgagggggcgagccaggacgttgagagcttcggtgaccatgtgaagggggccttcggagcgacgtggaagggggagctctgtgaggggaagcttgttgaggggtcgatcgatgcgggcagcccggcgctcctggttatcagcttgggtgctctgagatcactggagcttctgagggggttaaagatgttttcgtgtggttgccgtcctgcgtagctctttgccaaacccttgaaagtggaggagcaggtcccgctacttaaagatcgagttaatatagcctgtggtacacccagcaggatcaagaaactaattgacatggaagctttatcgctgtcacggcgtgaaactagtggtactcgacatgcagagggacccgaagtcatttaatttgtttacgctaccgcaagtcagcaacgagttttgggacctgtacaagggatatctagatgagaaggttagaggaggcgacacaagaatatgcttttacggtgctgtttctgagaaagatgccagtaaagtcctaacgcctgctgagtaaatgtctataccgtgaagtagtgtcccaagtacacttaccgatcgtagttggcggcaagatattactccctccgatccaaaataagtgtcattgtttcagttcaaagggagtaggaattttggtcgcgtgagaaaattaggagttttggttgcgattttccaatgtaccttgccactccttgctgaatgagca

SEQ ID NO: 17080 - DNA, 883 bp, Triticum aestivum
  Clone ID: PAT_TA_17080
ctgaagatagcaaattttctgcaggggaaacacaatgtctgaaagagctggacaaactgaaagatctcgacaatcttaacagtaaaaaagagcttggtaattacaacccgctccgcaagctccggctccacccccgcctccgggagcttgaaaatcatagtagtgtggaagagcttgatagtcatgactacccaaaagagcttgatgatcacaaccgtctgaatgatcttggtaatcataaaaatctaaaagagcttcatagtgctcaaaatggccaagttactgcagtaacacatacagatggtttaatagatgagcagtttaacactagaatatctaacaaagaagccatgatcatgacatccgaaagtgatttggtgaaggaatctattgctttacaatccaacggtagttccgtggataatgttgttcctgctgaactggagatggatattcaggttcccctgagcttattgactttgtaggatatatgtcaaaagagcagtgcattccagcatgactttccgtgagcttgtactgttcagtcttgctgctgctttggtagagaattccttctgattagcttcggttgttgagctacctgacagcttagttttgtgctataggatattacattggtgatgcaacccagtaataataatctacaaaaaggaaaaatatatgtttgtggattcatcgtattttggccatttccttagggaagtatgctgacctgacaagcgcagcattggagctattgactatgccatcacaagtgtttattatggttaacattcttggctgggctgacataggaaatatctggggcccatttccttcccatgctttctggccagaacttgtgattcatgttgcactattg

SEQ ID NO: 17081 - DNA, 2808 bp, Triticum aestivum
  Clone ID: PAT_TA_17081
atcctcatctcagtcttccgcatccattccagcagcagcagagagcggaagagcaccacacgctcgccatggacacgtggcacatcttcctcggttcgatcctcttcgccatcccgctgatcctactcctccgcggccgcaagggcggccggctccgcgtcccgccgggcccgccgtccttgccggtgctcggcagcgtggtgtggctgaacaactcgctcgccgacgtggagcccctactccggcgcctcttctcgcgctacggccccatcgtgtccctgcgcgtggggtcccgcctctccatcttcgtcgccgaccgccgcctcgcgcacgcggcgctcgtcgagcgcggcgccacgctcgcggaccgccccgccctcccttcgctcaagctgctgggcgagaacgacaacaccatcacgcgcgccagctacgggcccgtgtggcgcctcctgcgccgcaacctcgtctccgagacgctgcacccgtcgcgggtccgcctcttcgcccccgcgcgctcctgggtgcgccgcgtgctggccgagaagctgcgtgatgagtcgtcctccggcggcgcggccgtcgtggagacattccagtacgccatgttctgcctcctcgtgctcatgtgcttcggtgagcggctcgacgaggccacggtccgcgcgatcgctgccgcccagcgcgagccgctcatctacaggtcgaggaagatggccgtcttcgccttcctgccgtcggtgaccaagcacctctaccgcgaccgcctccagaccgtgcacgccatgcagcggcggaagaaggacctgttcgtgccgctgatcaacgctcggcgggagtacaggaaacgcggcggcgagcccaagaaagagagcacgttcgaggactcctacgtcggcgccctgctcgacattaagctccccgaggtggcaaaccgcccgctgaccgaccacgagatgatcctgctctgtgccgagttcctcgacgccgggaccggcaccacctccaccgtgcatcatcggatcttacccgagcttggcgacaacgcggcccttcttgagtagctctgcagagtcatcagggccacggagggggtcggccaggacgaggtctcggaggaggacctccacaagatgccgtacctcaaggcggtggtcctcgagggcccccggaagcacccaccggcgcacttcgtgctaccgcacaaggcggcggaagacatggaaatccgcgggtacctgattcccaagggggcgacggtgaacttcatggtggccgagatgagcagggacgagcgggagtgggagaagccaacggagttcgtgccggagcggttcctgccaggcggcgcgggcgaagctgtggatgtgaccggcaaccgggagatcaagatgatgccgttcggcgtgggccggaggatctgcgccgggctgggcatcgccatgctccacctggagtacttcgtggccaacatggtgagggagttcgagtggcaggaggtcgccggcgaggaggtggacttcgccgagaagaacgagttcaccgtcgtcatgaagaagccgctgcgcccacgcctcgtgccccggaagggcctgagacaaagtccatcgccatcagccaccagcgcaatccgaccaaccgtccacgccgaccgcttcgatcgaaatcgcctagttactgaatcccaaaggctcgacgatgactagttgatcgacgccgagttgggcttgcccgacgcggagacggacaagccgtcggagttcttgccggagcggttcctgccaggcggcgcaggcgaagcggtggacgtgaccggcaatcgggagatcaagatgatgccgttcggcgtgggccggaggatctgcgccgggctgggcgtcgccatgctccacctggagtacttcgtggccaacatggtaagggagttcgagtggcaggaggtccccggcgaggaggtggacttcgccgagaagaacgagttcaccgtcgtcatgaagaagccgctgcgcccacgcctcgtgccccgaagggcctgagacaaagtccatctccaacagccagtagtcaaattcgaccagtagtccagtcctatcgcttcggtcgttcttgtttagtttactccatgttgataatggttaattcgttgctgtacgatgcggcgtgaacaaaaaaaactgcgccaaaaaaaaaaaaaaaaagctccacatgaaatactaagtgaccaacatggaaaaggagttagaatagcaggaggtcgccggcgaggaggtggaaaacgccgagaagaacgagttcaccgtcgtcatgaagaagccgctgcgcccacgcctcgtgccacgaagggcctgagacaaaatccatctccatcagcaagtcggcacgagcgaccagtagtccactcctatcgcttcggtcgttcttgtttttagtttactccatcttgataatggttaattagttgctggacgatggaatattactagtgccgctttcgagaagttgaggtgtttgaaatacaaagctgcagtcagaggccggataggctggtcatagtgggagtaacttagattagtgtcatatgcatgacactagtctaagttactaccttcataatgcaaagtaacataatagtagtgtcatagatggcttcatttattagcttgtagactcattttgtttggaagcgctatgttacagtaatatattatgttactacctcatattaaatacttgccatataaataaaaaattcctgaagtgcactatgttactagctaaaaaaaaaaaaaaaaaaaaaaaaaaaaaaaa

SEQ ID NO: 17082 - DNA, 671 bp, Triticum aestivum
  unsure (1)..(671): unsure at all n locations
  Clone ID: PAT_TA_17082
ttgatgcttggtgatgacgatgatgatgtttcagatgatgaagatgatgaccatgaggttctacgtgggtctcttcctgactgtgttccagagagtgtgcatgatgtaaaactggcagatgctgatgggtctagtattgcctcaatagcaagtgataaccagacaccaccctcatctggctccagcgtaaaacatacttttagtagcaggggagcaggttctgttgaacttagaaatccaagcacacttggttcacggggcgcgatgtcgtttgctgcagctgccatggctgggcttgcttctgttggtagtcgtgggtatcagaggtagccaggataggcgtggcttccacttggaactagtgcacatgaacattcgaacaaattgattttacaagctggcggcaacacttaanaaggaatttaccggtaatcaanctttgcacaancattanttaangataggtttttaggaaagntaggtggttccgattaacccaatgatggaaccttccctggatgananttaactattacatatcaaaagntataacaaatggntaggaanaaccaagtcaacttanggctaaatcgccaataaaattncaaactcaccaaganaagtatcnctctgancattncaagggaatccttgnaaattanaatcnccan

SEQ ID NO: 17083 - DNA, 1371 bp, Triticum aestivum
  unsure (1)..(1371): unsure at all n locations
  Clone ID: PAT_TA_17083
cgctcgggctggtggtcgcgccttgggcacacttttgttcgccctggtccactccgcgaagtccctggcgggctgcgtgctctgcccggggtcctacgtcccggatgccctcgcgtctggttccagggtccatgatggcttcgttgcgtcccttgatttcgctgctggtggctccgccgtacgcgatcggtttggcgtttgcagcggttgaatgggccaattagcgtggtcgcggccgaggtctttaggttccaccctagacaggtacgatggcttgcttctttcagtgggaggaaatggaagatcatatgttgttattcttgagactggtccattggctgacacctcccagagtaagaagtattttgctcggatgactacaaaagtaggcttttgtagggtaagagtacctttctcggctttccgtccagtaaaaccagaagatcctcccctagacccttttcttgtgcataccttcaccattaggtttgaaccaaaaaggcagagacctggtgatggaacccaaggtgccactgaccccagtaattttgagctgatactggagtacatcaaagctttgcctaacggatcaagaaacccccttcatactggaacgcacgtcacagggttcaggtcaattagcaccttaacccactgtaaaacaatgttctcttgtttaaactaattctcctctgagaatgtaagcttgcagagtttcacgcaaaacgaagaagaaacaagattcaagtagaaatgaaagaatagcctttgaagctcagaagcttttgtttaatgatgacattagctctcaggctatcagctgtgcggatgtagcagatatctgtgtcaaagcattgcatgattccacggcgtagaaacaaaagttttgatgtatgctatgagtatgtttctgagcaagggaatgaactgtatgaacttgtggctcatttgccagataaggctaacaactatcttacaccggcactatcggttctagagaaaaacacctaattcagatttgtgtcatatacgggtcgtaatgtgtatactcttcctcttgtaaggttacatgttttcctcatagaagccttgtggaattcacacgacaagcccttttttcttgtaaagatcatcgatgggatcacttcacagaacaaattcggccactgtaatggtatattctcttgtttctactctttctcctctgagaatgtaagcttgcagagcttcagcaaaacgaagaagacacgagactcaagtagaaatgaaagaatagcctttgaagctcagaaataagtgtttgatgatgtgatttgtgaaagatcggcttgatttattgggaaaaaatgttgagctatttttatcnnnnnn

SEQ ID NO: 17084 - DNA, 607 bp, Triticum aestivum
  Clone ID: PAT_TA_17084
gcacgaggccaggacgcggtggtcggcgctggcggcgagcgcgctgatccagtgcttcgcgggcggcagctactgcttcggcgtctactcgccggcgctcaaggcgtcgcagggctacgaccagtccgcgctcgacgccgtcgccttcttcaaggacgtcggcgccaacgtcggggtcctctcgggcctcctcgccgcgtgggcgcccgcgggagggcgccgacacccctggatcgtcctcctcaccggcgccgcgctctgcgccgcagggtacctccccatgtggctcgccgtcgcgggtgtcgtccccgccccgctcccgctcgtttgcctctacatgctgctcgccgcgcaggcgcagaccttcatgaacacggccgacgttgtcaccgccgtcgagaacttccccgaccgccgcggcaccgtcatcggcatcatgaagggttttcttggcttgagtggcgcgatactggtccaagtacagcgcactctccgtattgatcccggcagtttcatacttatgctggcaatactacccacagccatcgcattgctgctcatgtactttgtcgacgtccacagcgctcatcagcggtacaacaagaag

SEQ ID NO: 17085 - DNA, 625 bp, Triticum aestivum
  Clone ID: PAT_TA_17085
atcatcagcttggtgggatgtgacctccatgccccgaagacccttccctggcaggggagcagcaacgacagagatcttctcccatccttgatcaagcttcagctgccacagtacaacatcggtgttggtgtcggcccgcgacgcgacacagatggaacccgacagctgcatgagccccgagtggagagcctcaggggggaggtccaccttgatgctcgtctcctcctggaggttgaaaactatcaaccgccggatccggttgtcgtgcccgccagcctccaacatgtagaccaggttgtctaggcaaatagaaggatcaagctctgcgatattgtcggagggaaggatgctccgtggctgggtgcttgggtgaccgccgaggctcttgaccattatagacccgttctgcagcatcaagatcttgaagttcttggcagatttgcaatagccgaacccacagaacctgtgcctggaatcgaattccataaagactagcatcacatcaatctttaaagcagggttgaagatgacgcagccgctaaaccttttggtgacgagatttgaaacctggagagcgatcaatccattggcagttccaaagtagctgtaaccgaacttggcgctg

SEQ ID NO: 17086 - DNA, 692 bp, Triticum aestivum
  Clone ID: PAT_TA_17086
ttatttgtttgagctttgaattatcaagcaatccagctgtttgaaaaaacttgggtgggcattacttttatttcatttaaacttgggttcaactttcattttgttaaatataggaacatgtttttgtagctagaatgataagcatttggtgctgtatcatattaatggtggtagacactgaactgtatttttccggttttatgatcgagtttttcccaatagctgtaccgatgtgtatcatatgtgtgtgatgctaacaatgtgacattgatttccaggtaagctttatttgctgtcagattggttgaggccctgcgggtggcaagtaagactggtttatgaataaaagtcgctgcacctctcccttcggtggtgaggtgtgattgtccaccagttttgctactactttggcattggcttgccccagtaattgtgcgcaaaaactcggtttgagagtgctgaactttgttgtattgaaatgttacacccatgtaatacagtagttttgtttgcacctgtcatctttgatgtcaagtgtactcatgcactagcttatgtttattgattgcagtggtggattgtatcagttacttctgatgttcctattcagtgacaaaaatcaaattcacctgcttttgtatttacgaaagcgattggcgaaacaataagttaatttcgtcttccctgaacct

SEQ ID NO: 17087 - DNA, 1180 bp, Triticum aestivum
  unsure (1)..(1180): unsure at all n locations
  Clone ID: PAT_TA_17087
acttccgagaagagtctctacaataataccagaaccggatgagataactgacgacttaatgcaattggcatcatcctacgaggcatcgggtggaagacggttggcaggttcaaatatcactagacgcattagaagttctcaagaaaacaatccaaaatttgtttccgcgttttgccaagtcaaactgtggagatgttagtccaaatgtcctgggggcgttttgcatagacacccaccttccttgtgacttcaaccacagcacatgtaatgggaagaacgaactttgctatggacgaggcccagggtatcctaatgagttcgagagtacccgcataattgggaataggcaatttctgaaggctgtagatctctttaattcggcttcggaagaactacaaggaaaatttgactatcgtcacacttacttaagatttctcgcaactcgaagttagtgtttctacgagtacgggaggtcagcaggtggtgaaaacatgcccagcagccatggggttttcatttgctgctggaaccacagatggccctggagcttttgatttcaaacaaggagacgacaagggaaaccctttctggaaattagtggggggcatactaaagaaaccagggaaagagcaagtcaagtgccaagctccaaaaccaatattgctagacactggtgaaataaaggaaccatatgattgggcgcctacgatacttcccattcaggatcataagaattgggtcagctggctattttgtctggtcctggcaagaatcaacgacaacccccggcaggcggtttacgccgatgctgtaaaaaaatgttactggataaagtggcagcaatggtgaattttaattccccaacaccacattggtcttggccggggctggacaaacacatatcctcaagtatgttacaacattcccaaagaataccaagtcccaaaagtacganggggcatcaactttngtacngcccgcaancttggagtgcatacattccaaagtttcaaaaacnttncacaactatngttgcaaacaagggtttccaagcaacaaatcctactcccngacagtttggcaaacaatccgncggctgcaagnncttctcgaaccnaccccccgggggtcaattgnggattcaanncgactccaacaaatcanactctgaaggnagtac

SEQ ID NO: 17088 - DNA, 473 bp, Triticum aestivum
  unsure (1)..(473): unsure at all n locations
  Clone ID: PAT_TA_17088
ctcgtgccgaattcggcacgaggacgcaaacccaaaccaagcgaaaaatatccactgaatctctctcgctgctcgcggccgcggcgaccggactaaggaaggaatcgaaggcgacgatggcgtgccgagccctcgcgctccgctccttgctgctccccgaccccctccaccacctgagtctccgcgccgccgcgtcggccccggcggcgccgtttccttgtcgccgccgccgccgcaacctccgctgctgctccagctccagtgggggcgggcccggggagcagggacagccgccgcaggaggccgtgctcgaggccatctcaaaggtggcaaagtctaaaggaaggggttgcactcacaacaaatatggtcataggtggnaactgttacagatgattcaactgatgaatgggnttgttctggattaagaagggtgaatacatatcccaacagacaagagggnttaaaaagaa

SEQ ID NO: 17089 - DNA, 658 bp, Triticum aestivum
  Clone ID: PAT_TA_17089
gccggccaggcttgcgaaaaaaaaaaaaaaaaacgactgaccgactcgactatcaacgccgtcaccatgccgagccacaagtctttccgaaccaagcagaagcttgccaaggcgcagaagcagaaccgccctgtgccccagtggattcgcctccgaactggcaacaccatccgctacaacgccaagcgaaggcactggcgcaagacccgcatcggtatctaagctactcgttctcaaccgttgtccgcccccagcacccgactttctctctcttgggcatggtatcacgatgttaaaggaaaggatggattgatttgttatggcgtgaactatgggaccgtgttgttagcgtacgcgcgtgcacacggtgggggatgggccggatgcctggtttatcgattatcacggttactgcatgtcacggacggtcatagggaaaaaggaatgcaaagatatgatgcccccaaaaagaaacgggcctgaactacacggatgctgtccacttgacccgtgaaccgcaaagcaaacgatgctatgtgccgtcttgttgagcggctgaccgtacacttcaagatgcaccacgcactcttaaaatagccgaatcaactcacgtcacgccccaaaaaaaaaaaaaaaaaaaaaaactaaaaggccccta

SEQ ID NO: 17090 - DNA, 611 bp, Triticum aestivum
  Clone ID: PAT_TA_17090
gcgggccggccagggaaaaacttcccggatttgatcaccatttggcaacgactgaccgactcgactatcaacgccgtcaccatgccgagccacaagtctttccgaaccaagcagaagcttgccaaggcgcagaagcagaaccgccctgtgccccagtggattcgcctccgaactggcaacaccatccgctacaacgccaagcgaaggcactggcgcaagacccgcatcggtatctaagctactcgttctcaaccgttgtccgcccccagcacccgactttctctctcttgggcatggtatcacgatgttaaaggaaaggatggattgatttgttatggcgtgaactatgggaccgtgttgttagcgtacgcgcgtgcacacggtgggggatgggccggatgcctggtttatcgattatcacggttactgcatgtcacggacggtcatagggaaaaaggaatgcaaagatatgatgcccccaaaaagaaacgggcctgaactacaaaaaaaaaaaaaaaaaaagcccctaaaaaaaaaaaaaaaaaaaaaaaaaaaaaaaaaaaaaaaggggaaaaaaaaaaaaaaaaaggcccaaaaaaaaaaggccccta

SEQ ID NO: 17091 - DNA, 554 bp, Triticum aestivum
  Clone ID: PAT_TA_17091
gccaatgacagaaaggacagtgcggagatgatggcaagtggtgatgaaaaacaagatgatgataaggtcccgagctgcagcaaaaaggaggacattgatcagattatggcaactgatggttgctctgtcaatgtaaatcctgacatgtgctgtaacgaaggtgtgtgtgcaaatcctcctttggttgatgctgaaaacacccccccccgtaattctccagacattgacactactgaacagccagacagtaaaacataccaccaggagtgtaggaatttgaacagctcagcagtggaatttacatcttccagtaagcagccgcatgactttgcgcggcataacgatggtcataatgtggatgtagccgctgaagaaacaagtgcgccagtgagttgtggtgataatgaccctgcctcttgcagtactactagcgacaaaaaggttgaatctggtggtgccaatgctgaagaagttgtgactagtagccttccacctgagacgcaaagcatcttaccgagcgccaaagataatgaagatggcttcccaaggaatac

SEQ ID NO: 17092 - DNA, 512 bp, Triticum aestivum
  unsure (1)..(512): unsure at all n locations
  Clone ID: PAT_TA_17092
aaaaatcaaacaagcaacaaaggagtgaggagatggttgccagaatcttgccttacctgacctatggagagccagcagctatggaagttctggtcgaacattttgagccctaccttagggactggagtgagtttgaccggttgcagaagcagcacgaagagaataaaaaagatgacaatttaagccaaaaggcatcaatgcagagatctgctgttgaaaactttgttcgagtgtcggaatcactcaagacgagttcatgtggtgagaggctgaaggagatcattctagagaagggcattacaaaagctgctttagggcatctgaaggaaagatttgcttctgcagggctggctagctctagaactagggcagaatgggcagctggattaaagctgccatctattccattcatcctatcaatgctgaaagggcttgcaaanggtcatttgcctacacagaagtgtgtcgatgaagaaggcattttacaacttctccatgcnttagaaggggtg

SEQ ID NO: 17093 - DNA, 642 bp, Triticum aestivum
  Clone ID: PAT_TA_17093
gtactcagatcgtcttcctcccctttgccagattctgtaccagtacatcctcttgaagctagggttaaggtccagcgaactcaaagattgatctcagagcttaacgaaacgcggctgtctctccctcttttgtaccactcaggcgaattagggttattaaatttcgacggtctctctcaaaaatccgccgccggcgccgccgccgccgtcagcactatccaacgatagccgccgccgtcagcactatccaacgatagccgccgccgtcagcactatccaacgatagcagctcaaggatgtaggtctgttcgctgcctcctcgccccgtcccggtccagctgtcgaagggcctgggctttgtcggggtagtcttcggagggggcgccgtcagcgccctccttgggggcgtgctgcgacctgatttcttcaccccgcgtgccagtcacaagggatgcactccctgttttcatcctttattggtaaacaatattaaagagaacgtgtacttacagagtctaactgaatttcgtgaaagcattacgagttcatcttattgattttgttatctagttcgtcctttactcatcatcaatttatgttttccatagttaccaaaacatttttagctaactaccgcctgag

SEQ ID NO: 17094 - DNA, 351 bp, Triticum aestivum
  Clone ID: PAT_TA_17094
acctgagcactgttcatgtgtcacccagccatcatgtatagtgtcacttgtcccttggcactatttatgaagtgacccaggggacaagcttaacatccaccatgccttgcccatgcctacatggcttacatcctaagctagctcccactatatatagctagccatccatccatccacacattcacgtgtgcacacatgcttacgcccacaaggccactcacgcgagcataaggctctcacaccatacacactagctagctagctctctgctactactctcaatccaatacagctccaggagcactttgtccctgcgcactgatcccagatacagctccaggagcactttgt

SEQ ID NO: 17095 - DNA, 375 bp, Triticum aestivum
  Clone ID: PAT_TA_17095
tagcgtggtcgcggccgaggtacgtgttcaggcagtgccccagcgcatcgatcatcctgtttgcttccgcattttcaaaagtccaaccaaccccagcctcctcatatggattgtagtgctggacggtgtctcgaaggccacccaccgcatgcaccacgggcacggtcccatacatcattgcatagagctggttcaacccgcaaggctcgaaccttgacggcatcaacagtatatcagctcctgcggtcatacgatgagccagcctgacagagaaaccaacccaacccctaactctgtcgtagtgctggctttcaagcctcctcaatgtgtcttcgaggtcttgcctcccggtacctgcccgggcggccgctcgaa

SEQ ID NO: 17096 - DNA, 1229 bp, Triticum aestivum
  Clone ID: PAT_TA_17096
gagagaactagtctcgagttttttttttttttttttgatgaagttgagttgccaattaagaagaagatccacagcgttgctatcaaccatctcataaatacgtacatgattttattgtacttacgccacagccatcatctgtttcataatactactacatagcatagcataacatagggcattccacccgggaagacataattaatatgcagcagcacaaccaacaacctaaggcatgtcatcatattacaagtctttcgtatccacaaatgatatatagattgggtgctcagccagctctggtcatcattttccaaacgcaaatttttctggcgatggatgcagcacttcagactgaagatagcacatttgacaaacacactctgccttgtaatgtccacacggaaatgctttccccacacaaggaacctcgctatcaacaagacggttgcatgtattgcaaaggcaatccgaactgccatcacgacgagttccccacccaagatgaaggccaaacaaactgtaggcttcagtaactggctcatctagcggggtgcacgaaacaactccttgaaaaccatctttggtaacaagctcataaaagaagagagttggtctagggggcagtaaggagaagtagctggagtgcttggggctagcgacgaattgccatgagtccagcaagagccattgtgaggactgctgtacctgcccgccggcccccgcccgggcaggtactcattttccggatgatttaggttatagtggcgaaggcattcctccatgacaagttgatgatcttgagctgctgctacctcggaggggctcggcaacatcatcatagaactgttccagttgtgttccaacctgtcgaattgctcaggctctggagcaggctcaggctgtagggatgatggtaggcaacgggacaagatgagggaccagaggggcgacgacgaagctgcagggagcggcggcgagggcgaaggctccgacgagagcgaggccaactccgagagcaaggcctccctcttggcaatcagatcaagagcatccggagaaaggctaaggctgaggcgaggccccatcgcctccccttccgcggccgcgaccttggccttggtcttgaccttggctgactggcgcgctccccttccgacgacggcctccccttccgcggcggcgcggcccatctctctcgctccgattggggattggggatttttttt

SEQ ID NO: 17097 - DNA, 298 bp, Triticum aestivum
  unsure (1)..(298): unsure at all n locations
  Clone ID: PAT_TA_17097
attcactaagtagatttcagaacaggccagcccangagcaaagtaccaaaaagtcatgttccataggcaacatcgagagatctgctgcagagnggtcaatgcgcgagagacaaaaangcagggatggtggagtcaccctgcctcagttcttgaccatggatttgatttgaatatgtgtaaanaaagatcggaaaagttttgatttagttgaggttttacaagatttgatttgattaagttaatgcaagagacataagtgagggaatatcgaggcgcggggtagtttggtggacgtacc

SEQ ID NO: 17098 - DNA, 262 bp, Triticum aestivum
  Clone ID: PAT_TA_17098
gtacttctctgcgtcctggaccatcttctcaatgtcgtccttgcctgctcatccagctctactgatacatgtttacactgttaattaggaccaaaccattgtgtagcttgtgctatttattggacataatgatctgtttgttggggaaaacctgtatgtttgatcttaattagcttaattaatactcctcgttactaggaggaggtggcccatcaataaaaaatacacacgagagaatcgtgtgtgactgctgctgctgtgt

SEQ ID NO: 17099 - DNA, 703 bp, Triticum aestivum
  unsure (1)..(703): unsure at all n locations
  Clone ID: PAT_TA_17099
nacgtagctcagatccaatatctggttcatcctttcaagagcatttcctttcatcatagcactccaattttgccttacatcatcccaggttgaccttcgctgatcaccaattagaagatttgctatactattgatagcaagtggcaaaccaccacatctttttagaatatgaattgaaatatctttaagtgcatctgggcaaggttccttcggaccaaatattctgcttaagaatagtgttcttgagtcattgtcactgagtggattcatcatacgaatacatttcatttcatcatagcaacaggcacgagcaacatgatcaatccttgttgttgtgatcactctaataccatagttgtttcctggcaaagcaaatttaatagtatcccaagtttcattattcattgtttcagaatcccatagatcatcaattactatgaaatatctctcatacatgagcaattgctggagttgactggtgagctgctccacatccaaatgttccatgtttgttgcatcctttccacatccagttagaatgttcttcaaaactaccttcacatcaacattctggcccaccttgacaaaagccataggatggtattgtgcttccagcttgtcatacacagccttcacaagtgtggtcttacccaatcctcccataccgacgatagagaatatcttgagcttattgtttggtact

SEQ ID NO: 17100 - DNA, 923 bp, Triticum aestivum
  Clone ID: PAT_TA_17100
cggccgctcaggcgcgaggcggggccggggtgaattttgagtccttgccttcgtccctcggaaaactgccaccttccaacatcgacccttccgacgagcagcaaataccgccacgatgttgattcccaaggccgaccgcaagaagatccacgagtacctcttccgtgagggtgtcctcgtcgcccagaaggacttcaaccttcccaagcaccccgatatcgacaccaagaacctgttcgttatcaaggctatgcagtcgctcaactctcgcggctatgtcaagactcagttctcttggcaatactactactacaccctgacccccgagggtctcgactacctccgcgagtggcttcacctccccgctgagatcgttcccgctacccacatcaagcaacaacgatcgcacgctcctccccgtggcatgctcggtgagggcgagcgcgagcgacgacctttcggccgtggccgcggtggtgaccgaggtgaccgtgagggtggataccgacgaagggatgctggcgagggcaaggagggtggtgctcccggcgagttcgctcctcagttccgtggtggatttggccgtggccgtggcgctgcccccccttcttaaacgaacccattttatcatctaggtggtcataaatgagaagcatggcgaagggtatcggcatgtactcataaaaaatggagggcaatttctaccatgggtttcgctcgtgtgacaggggttgcgtgggggatccgtgggagtttgagggttttagaacctcggaatcatttgcatcaaggtcaatgtttgccgccgtcaaaacgagataattgctcgggagatacgtgaagacgtcaatcttttcagtgatgtgagacgagacctaatgtttatgccaaacgcccactgaggcacgtctaaatgaatcatc

SEQ ID NO: 17101 - DNA, 461 bp, Triticum aestivum
  unsure (1)..(461): unsure at all n locations
  Clone ID: PAT_TA_17101
ggtggcgtcgtctcctcggtgatggtcgggacctggtcggagacactatgtgcaaagtacataaggaagaagaagaagaagaagctctcgtctcgttgcctcgctcactagtcagtcactagctagctcagctaggagagttcggtcatggccatgggcacgccttcttttctggcgaggcacgcacgggcatggcagagtgggtgcacatgggacggggtgcgacgtggtattaccgcggccgtcggatcgccgggatccgttgggccgggtcgctccgtggtgctgaatttacttgcctgtagccggacggaacatggtgaagatgtctctctcttctgcatcgccggtttcaaaaaccttgaaataaaaagtaccccccccttgtcaatcctataaatttggtaatnnatncaaagggatgtttnattaaaccgttttgtattccngaangggaaaaa

SEQ ID NO: 17102 - DNA, 953 bp, Triticum aestivum
  unsure (1)..(953): unsure at all n locations
  Clone ID: PAT_TA_17102
gcacgagggacaaaaacaatgtcaagattttacttgatattgagaatgcaaaatgcagcatatgcttgaatttgtggcatgatgttgttactgttgctccctgcttccacaacttctgcaatggctgcttctcanngtggttgagaaagtcttcgagcaagtcgcgtgataaaagccagagtgctgcctgtccacaatgtaagacgccagtgcaatcagttggaaagaatcacttccttcataatattgaagnnnctatactacaagctttttcgtcactacagcggtctgatgatgagattgcgttgttagagtcatatgcctcagttaaatcgaatcttgttttgggaaagcagaaaaatcaatcaagaaagcgccctttgccacctgcaagtgatgaaagcaacgatgctgaatttccatgtcctcaatgtggtacagaatttgctggatttagatgcagtccccgagcagcacacatacagtgtaatggatgtggaggaatgatgccagctaggcctaacaccagtatacaaaaatgtttggggtgtgatggatcattttgtggagcttattggtattcccaaggagtgaattcaagtcattgtaatctaatctgcaaccaggaaactttcaggatgatctctcagcaccatatctctagacttccggacacgcttcatgggggaaatccatatgaaaaagataaaggtgcatacagaaatctggcaaaacgttgcaagctgtaatctctgagtggatagcaaagtttgataataaggaacttgatcgctcaaggctgcaactgaataatgttgaggcaattacttccaggaacgtacctttgcaaccattgctacaacaagttcgttgattttctgctgtattggttccgcgtgtcanncccagaaatcttcttccagctgatgctgctgacagggatagttgctggt

SEQ ID NO: 17103 - DNA, 410 bp, Triticum aestivum
  Clone ID: PAT_TA_17103
cagaagaaacgaaaacagaggtactaacagcaacacacattctcactctacgcttattctctagtatctcacactaccactggtctgatcaccgcgctgccagaccagacaaatgagtagctaggagtgagtgacgaactccgcgacggtggccatatgcgcggcggccttgggcgactggaggttgttgaggaagtagcagtgcgcctcgccgggcgtctcgtacagccgcgcctgcccgccccagccgctgccccggagcgcgtccacgtacgcgccctgccacggccccagccggtcctgccccgacctggtcaccagcacgcgcgcggcgccgagccgccgccacgcgtccgccggcagcgccatcgggtccacgtacgggtgctccgtcccgtaccgccccgcgc

SEQ ID NO: 17104 - DNA, 791 bp, Triticum aestivum
  unsure (1)..(791): unsure at all n locations
  Clone ID: PAT_TA_17104
gtcaaacgagggcttccttctgtgtgtatgtgtttgtgtgtgtgcgcgcgcacacatgcgtgagttcacactgatattccactaagtacagcgcatgcttaactgaaattctagacaaaagttcacatccggttggtacatgtaagaagctcatttctaatttatcaggtggcataaatagaccataaaattatcttcatttatagtgctaaagatatgccaatacattttcttacgtttagggtcctaaacctgttgaatgaatcctatatacaagacttacagttgtccttcctataaatttaagactgaatttgctaacctttggtgtattgcctattggatggagcctataattggcaaccttggacaagtaacaaaacccaaagatagttttatctccttaagtgtggagcaaataagattttttaagagacttccctttggggatattttcctattacagaagttgatgctccatatttttatccatccctgatatcattcctggatctactacatcatttacaagagcttgggattgctccagggatcctacggntgttctcccataacctctggaagtgatgcaaggcgccgatcttcaaccatgaaaatgaaactgccagcgnggncggnaactgccagcatggacggcctactcctatgatctcacaggntcttgcttacactgggaatgatgaggctaacaagtttttccttggaggtgagatgtcacttgacaacacgaaggataattcgttttgatgtctctgttgtgtgtgcgcggg

SEQ ID NO: 17105 - DNA, 415 bp, Triticum aestivum
  unsure (1)..(415): unsure at all n locations
  Clone ID: PAT_TA_17105
actgaggatgcgtgtgtgtgtgcgctcttggttccggcgaaccccgtgtgcctcgtggggggaggtttggtcccggcctggaggaagacgtgtatataaactcggaaccaggaaatgtaatgttgtagtaggactattgtattatatcatgaggactctgtgatgctcccccatgccattcttgaaactggcaagaagttgcaatgctatccccctggtggatttcaacaaggatttatcggtttgattctggggatcagtacgtttgcagcttatagggtgatatatgggcagaaactggttgtttggtagaaatgccatcttttccgcctggtctgtgtatcggcntggtgctcaagacacaagtttcggttgagaattcaaggattcttgctgatgatggcaaacaaaaacc

SEQ ID NO: 17106 - DNA, 534 bp, Triticum aestivum
  unsure (1)..(534): unsure at all n locations
  Clone ID: PAT_TA_17106
tagcgtggncgcggccgaggtactccaacaacaaccaaatgtcttatctgggagcaataatactgtcagatcggggggtggcaatgttctatccggagacaacaacactgtcatatctgggaacaacaacactctatctgggaccaacaacacagtcgtatctgggagcaacaacgtcctaactggcagcaaccatgttgtatctggcagcaataatgttgtaagtgataccagccatgtcgtaaatgggagcaacaatactgtatccgggaggaacaatatggtaaccgggaacaataataccgtatctgggagtaaccatgtcgtatctgggaacaacaaagtcgtaactggaggttaatgatctgtcagtggattgattccatcttccctgacggtgctcatcaccttgtccaggttcagtgtggcttacaatcacttggtggggctaatcacgtttgtaacttcatggatatagcatcctattcctacttcaaataaaagtactccctaagatgtccgcaaaaaanaaaa

SEQ ID NO: 17107 - DNA, 745 bp, Triticum aestivum
  unsure (1)..(745): unsure at all n locations
  Clone ID: PAT_TA_17107
agattttgncgatgttcttatatatgtcaaccagatgtatgttttacaggataatcattcttaagccagacaaattgtactatgacaacaactgctctcaaacgaggcaaacgtgaagccaaatccaaagtaggaccactccccactgattggccataaagaatgatattttcctcagaggctgcataggtttctatgagacatctgtaaacagcctctatatcagcatatgtgttttgctcactgggctttccagaagattgtccctcgccggagtagtcgtacatctggcccaggtcggcggcgttgccgtgggagtagagcagcgtgagcttggcgccggtctggcgcgcgtacacggcgaccacgtccgtgccccgcttggtccgcagccgccgcgcctccacgttggccctccgcggcacccccgtgagctccaccaccacgctcccctcctttccccccttggcctcccccgccgccgccccggcggcatcgggcggcggcaggggctggatgccgtaggacggcgggctgggcgggaagaaggcgaagcgggccgcgaccgtcgaggtgacgccgcccatccccgcggggaggtctagggctatggctcgggtgagggcgaggggggagacggcgagaggggaagggggacgacgatgagtagaggatgaggaagaggagcgcgtcgggtcaggcgtttccgttgcgccgcgtgccgaaggcggcgcgggctcgtgcc

SEQ ID NO: 17108 - DNA, 1651 bp, Triticum aestivum
  Clone ID: PAT_TA_17108
cgcgcactgaagagaggcctcctcgccccctccacgctggcccgccgcgccgccgccgcctcctccacgggcgtcgcgatcacccgagccgcgccccgccacctcgcaggcgcggccgaggcgatcgaggcttttgtttccaagacgccgctctccgacttccactcctccctcggaggcccgcacgatgagaggcctcctcgcgtgcgccacgctggcccgccgggccgccgcctcctccacgggctccggcgccgcaaccgccgcgcgccgccacctcgcgggcgcggcggaggcggccgaggcggagctcaagaagacggcgctctacgacttccacgtggcgcacgggggcaagatggtgcccttcgccggctggagcatgcccatccagtacaaggacaccatcatggactccaccctcaactgccgcgccaacggcagcctcttcgacgtctcccacatgtgcgggctcagcctgcagggcaggcaggccatccccttcctcgagtccctcgtcgtcgccgacgtcgccggccctcgaggacaggaccggctccctcaccgtcttcaccaacgaccaagggaggcgccctcgacgactccgtcctctccaaggtcagccaacacaacgtctgcgccgtaggcaccgccgggtgccggagctgggaccccgccctcatcggggctcactccgaggccgtcctggagacgcccggcgacgtcgtgtggcacgccctcgtccagcgctccccccgcgccctctcgcatccgcccgccgcgccaactccccgggcgcggtcagggggaccggcctgcgcgcccgccttcggcgccggcaagatgattgacatcaatggatctgcttgcttcctcaccagaactggttacaccggcgaagatggatttgaaatctctgttccatcagagaacgcggtcgatctcgcaaaggccctcctggagaaatccgaaggcaaggtgaggctgaccggcctgggcgcccgcgacagtctccggctggaggctggcctctgcctgtacggcaacgacatggagcagcacatcacgccggtggaggcgggcctctcatgggcgatcggcaagcggaggaaggccgagggcggcttcctgggcgcggaggtgatcctgaagcagctcaaggaaggccccaagatccggcgcgtgggcatcttctcgcaggggccgcccccgcggagccacagcgagatcgtgagcggcaccggggagaacatcggcgaggtgacgagcggcgggttcagcccgtgcctgaagaagaacatcgccatggggtacgtgaagaacgggctgcacaaggccggcacggagttcaaggtggtcgtccgcggcaagcagtacgacgccgtcgtcaccaagatgcccttcgtgcccaccaagtactacaaggccccttaggttgtgtacaaaagagaaacaatggatggatgctccctggaactgcaaattttctctcgcgactctgccatggcggcctgttcatggcaggctgccgcagctgtaacctctgtcgggcttcctcttacagcttgacatttctcctctacccttctaataataatatatgccggtgcgttgtttgctatcccaaaaaaaaaaaaaaaaaaggccccta

SEQ ID NO: 17109 - DNA, 251 bp, Triticum aestivum
  Clone ID: PAT_TA_17109
cggttttgcaatggagattctactctccgagtctagtgttgtcactacgttctattttaactggtccacgagcacggtggccatctttctagctgttctagggctgacggttcttccggtcaacgtcatcgtgggaagctatatcaccaatctgttccaggacaggcaaatcttggtggcgtctgagatcatggtcctgatcggcatcgcctcgagcttccacttcggctccagctactgcgttgctcagt

SEQ ID NO: 17110 - DNA, 1019 bp, Triticum aestivum
  unsure (1)..(1019): unsure at all n locations
  Clone ID: PAT_TA_17110
ttttttttttttttttttttttctaagtcaacacgagaaatcattaaccacgaacaaaaatctggctgctcaatctgattttcgaggggaacagctcgtacttatatcacgaggtacacaacgacggtttttctgttccagatgttctcccatctatcttttaccttagggcagctaaacatcctcagccttcgagcattgccttggccgcatcaatcagtgcaggcctgaagctatcagaggctcggccaaggacagtgtagccctccttgtcttcaatgtcaacatcggcaccatgtctgatcagcagaagggcaacccctctgtcctcgcatatgacggcatgcattagaggtgattgtcctagcttgtcaactgcatcaatatctgcgccttcttcaagcaggtattcacacagctcagcatttccagtactcgcagctctatgcaggggtgtgcagccaaacttatctttcttgttgacatttgcacgatgagctatcagcgtttcagcaatgttaagccttcctttactagcagcatagtgaagagcagttcggccagcatcagtagtcaaatcaacattcgcaccgtgaccgagcaggatgtcgatgatctgggcgttgccgctgctggccaccgagtgaatgggcgcccacccttcctcgtccttcccgttcacggcgctcgccacggcgtcgccccccgcagccacaagcgcggcgacggcctcggggcgggcggaggaggcggcgacgtggatgagggagcggccatcctcgttgcggagggagagggctgcggcgaggtcggcgggggcgagggaggagaagacgccggcggccccggactccgcggcgaggaagagctccttctccgacggcttctccccgccggcgtcgacctccattgccgcggccatctggtgggtgctgggtgggctgcnnnnggcgagtaagcgaggcttgcgaattcagagttgggtcgtctctctnnngaggctctgagttccctcgtgc

SEQ ID NO: 17111 - DNA, 478 bp, Triticum aestivum
  Clone ID: PAT_TA_17111
ctcctcccaccaccaaaaccgcgggccgcatcccgcgccgcccaccggcggcagagccaccgccgcttaataaacccccgcgacccgaagcgcaagcgaccggcgcacaccaacccccacccagctatggcgtcctctctcctcaccaccccgtcccagaccctcgccctcacgcccgccgcggcgcgcgcccgcgggtcctcgcctgcggcggcccaggtgtccttcttctcttcccgcctccccggccgccgcgcgctgcgcgtgcgcgcgtcggtcgcgatcgagaaggaggtgccggagaacgaggcgccgacgacgttcctgcgggaggacggctccggggccgggtccgggtccgtgcgcgagcggttcgagggcatgatccgccgggtgcagggggagatctgcgccgcgctcgaggaggccgactgcagcgggaaagcggtcgtggaggacgtctggtcgcgcccccggg

SEQ ID NO: 17112 - DNA, 1601 bp, Triticum aestivum
  Clone ID: PAT_TA_17112
acacgcgcgccccctctccctccgtgactcctcccaccaccaaaaccgcgggccgcatcccgcggcgccgaccggcggcagagccaccgccgcttaataaaaccgccgcgaccggcgcacaccaacccccacccagccatggcgtcctctctcctcaccaccccgtcccagaccctcgcccccacgccctccgcggcgcgcgcccgcgggtcctctccgccgggggcggcccagcttgccttctcctcggcccgcctccctacctgccgcgcgccccgcgtgcgcgcgtcggtcgcgatcgagaaggaggtgccggagaacgaggcgccgcagaacttggtgcgggaggacgactccggggccggctccaccactgtccgcacgcggtgcgtagggcatgatcccgcgggtacggagcgaagagtgcaaggtgctcgacgcgtccatcaatccaagggagtggctcggggtagctgagtttgtgtgttccgtcagtctttgtgtcatgtgctgcgcgctcctgtgcagccttgtgatccacagccacgtgttgtacctgtccggcgtcgacgagttcttgctccccgcagccaggcgcgcggcctagggtcccgcgaacaacggggctgccgatcgggtcacggccggggctgagccctgctttgccgtgggcgtctgcgccgctcgcaacacctagaatcttcatcctaagaacccgcatgcccacactctgtatttcgaatcacgttattttgaaacggatgcaccaaaagatgtacctggtgcaccagggggtgggaggtttggaggtggtactgatttgactccttcctatctcattgaagaggatgtgaagcattttcattctgttcaaaaacaagcttgtgataagtttgatccaagtttttacccaagattcaaaaaatggtgcgatgattatttctatattaagcaccgtaatgagagacgtgggcttggcggaatattttttgatgatcttaatgattatgaccaagacatgcttctgaacttcgctacagagtgtgccggttctgtaattcctgcatacttacccatcatagaacgtcgcaaagacactccatttaatgaggagcagaaggcatggcagcaagtgcggagaggtcgctacgtggagttcaaccttgtttacgatcgtggcaccacatttggactcaagactgggggaaggatcgagagtatactcgtctcctctaccactcactgcacggtgggagtatgaccataaaacctgaagaagggagcgaagagtggaaacttctcgacgcgtgcataaacccgaaggagtggctgtgattagctgaggttgtttgttctttcagtctttttgttagtatttctcactctgtagccttgagatgcctggccatgtctagttacttttttgttgtgtagagtttttgataagcacatgaaggtgtaacggtttagttccatcaagatttgtacctgctgtacatgtttccttctgagatgaatgaaggataaaccgtgcagttgtaattgtccttggtactctttgtactgaaattttggctctccaacatactcctacttctgtt

SEQ ID NO: 17113 - DNA, 314 bp, Triticum aestivum
  Clone ID: PAT_TA_17113
actcatataaggatcttcgagagactgtgccgaaacataaaaaaccccggaaaatagttatagtaaaatgaactaaattgtaactaagatagctgctgacgtgccaagattggagcagcaaacttggatctatgtgctcagaaaataatcatctactccagttggcttaccaagcacgcgagcctctgtgtccgggaagaattcaaatcctgtgagcgttgagaccgtgccggccttgtttacggcgacggggtaagacagcaggtggcctgggaggtcccccgtgagctggtcgccgacgtagaggctccagt

SEQ ID NO: 17114 - DNA, 279 bp, Triticum aestivum
  unsure (1)..(279): unsure at all n locations
  Clone ID: PAT_TA_17114
acaattaccatcgtcgaaggccgttgagtgaacgtgtatccacgtcgtgtatttgatcaagttcgatgatgacctctgaagaactcagattcgccaagttccactatcaccaccgaggatcgattttacaactactttcactgccgtcgcgagaacaactactttctctacgaattcgaaccgctttgagaatgctcnccttggaaggtataactgccggagcgacgcccgtggacaaatgtttgtgatgtgttgtatgagatgctcctatttggccgg

SEQ ID NO: 17115 - DNA, 362 bp, Triticum aestivum
  Clone ID: PAT_TA_17115
acgaaacaatatcttacaagtattcagtagcactcaaccatcccactgaaagcacaaggacctcatagcagcagccatacatcattgtaacctccaactcacactgccggggcagtgctgtcagatggaacaaagggtggagaggcaaaggacgagaggaaggccggcctgaaatcaaaagagaagcctactttgggggcctcatgtaatgcacgaaagttgaacatcgcagaagcagagaagtcaatgctcgacgaggcacgatgttgcaacaagagtgatgcttcaccattggaagcaactcgtgccttaaacttggtcttgtcatcaggcgtccatgaaacaccagcaggagcaacagc

SEQ ID NO: 17116 - DNA, 838 bp, Triticum aestivum
  unsure (1)..(838): unsure at all n locations
  Clone ID: PAT_TA_17116
ctgaagntcattagntctatgngngttcttgnatgtgnatnattactgcccgtataattantactagaaccttgtgtttctttttcctgcagngtacagtatggtggccctccgttntgtcgatgggtgtnacctctacttcagttgnctgtgttgttccgtagacggtagcncgtaggcagcgggtaatgccggntcaggaacgtccggcgggccccgccccgttntagcgccgcgggccccgtggacatcccattgttccactggttgccgttgtcactcctcaactgcttgtttgctggattgcgaccccatgaaaggcgcacggtctgtttcccgatggtgctcccgtttagcccttgcaatgcatcttctgcattctttctctgaagaaactgcacgaacccgcactgtttcccaactggaatcttcacagaggaaatctcaccatactgggagaaggtttgcttaagatcatcttcactgacatttgggtcaagcccaccgacaaatacagttgtgtttgtcaaatctccgtctgatcgagcggatgaaccagtagatccagaagtacctgaagattttctgggagttgcagggccaatcctcatgggcctagttgagcaatacactccattcatctcggtcatggcgtttgtcttctcactatcatctccaaaccgcacaaagccatagcccttggatctaccagtgttagcatcaataacaacttttgcacctttgacagaggagtacctgctggagaaagtctctagcaatgcagtatcattgacatcagaggcaagatcgcctacaaatatggaatgatccctcgtgc

SEQ ID NO: 17117 - DNA, 705 bp, Triticum aestivum
  Clone ID: PAT_TA_17117
gccggccgggcccgggagagtctcacacccacaccgctcggccatcaaaacttcacaaagatgccgaggtccaccagccgcctccttctgctcgcgctagcggcgagccacctgctgctcgccggcgccggcgccggctgcgggccgagcggcacgctccggccgagccggggccactcgtgcgaggactgctgcaaggccgggcaggcgtacccgacgtacacgtgctcgccgccggtctcctcgtccacccgggcggtcatgacgttgaacgacttcgacgcgggcggcgacggcggggacccgtcggagtgcgacggcgcgttccaccacaactcggagcgcgtggtggcgctgtccacggggtggtacagcgggggctcccgctgcggcaagagcatacggatccgggccaacggcaggtctgtgctggccaaggtcgtcgacgagtgcgacaccgtcaacgggtgcgaccgcgagcacgccttccagccgccgtgccgcaacaacgtcgtggacgcctcccaggcggtctgggacgcgctgggcatcaccggggaggaggtcggcgagtacaacgtcacttgggcggatgcatgacctatatatggtgcatggacgaataaagtgcacgtccgaacccaaaatgaataaaaggagtttgtaagggcatcttataaaaaaaggcatctgaagttcctattg

SEQ ID NO: 17118 - DNA, 974 bp, Triticum aestivum
  Clone ID: PAT_TA_17118
ccggccgggccgtgagtctcacacccgccgcttggccataacttcacaaaagatgctgaggtccaccagtcgccttctgctgctcgcgatagcggcgagccacctgctgctcgccgccgccggcgctggctgcgggccgagcggtacgctccggccgacccagagccacgcgtgccaggactgctgcaaggccgggcaggcgtacccgacgtacaggtgctcgccgccggtctcctcgtccacccgggcggtcatgacgctgaacgacttcgacgagggcggcgacggcggggacccgtccgagtgcgacggcgcgttccaccgcagctcggagcgcgtggtggcgctgtccacggggtggtacagcgggggctcccgctgcggcaagaacatacggatccgggccaacggcaggtctgtgctggccaaggtcgtcgacgagtgcgacaccgtgaacgggtgcgaccgcgagcacgccttccagccgccgtgccgcaacaacgtcgtcgacgcctcccaggcggtctgggatgcgctgggcatcaccggggaggaggtcggcgagtacaacatcacttggtcggatgcatgacctactcgtggcggctggcgggactagctgatgtaaggtgtatggacgaataaagtgcgcgtccgaactcaaaaggaataaacggaccgaagatggtgcatggtacaatttgtacgtaacgcccaaacaaaaaaaaagaatttgagcgggcagcgtgcgggccacgtggcaggtaccctttgccctgagttgcactgcaatccgactgttttgccgaggcaacttcggcttaccggagtgcaccccgtgtgggctgtttaagctgaatgtctgaactcggtgttcacggcgtacacgtagataagccgagtaccacctgtcttgtcgtgtgccatcatataagccgtaaattaacccgtgttatcaacactcggcttaccat

SEQ ID NO: 17119 - DNA, 213 bp, Triticum aestivum
  Clone ID: PAT_TA_17119
cacgatttccatgttccagacttccagtgccacggattgtgtcccgtgattgattgtaataaatgaattaacgccgttctgcacttctgctacgtccagaacggcgtggacttgtgctttatttacccctatatatatgtgcgcccgggcgtgtcagaataaacattacgcccatgcgccggctgacggccgggcatctggctgtctgaatgt

SEQ ID NO: 17120 - DNA, 325 bp, Triticum aestivum
  unsure (1)..(325): unsure at all n locations
  Clone ID: PAT_TA_17120
gnacccttttcactaaacccaaacagagatggcgtttgatgtccctcctaaggtcttttggaagggtttgaatcaaattttcttcatctactcctctcgtctccaaccacctataccgttcataccgccttactcgttctctgatatccggcggcagtgatcggtgatgcatccactgctcagcatcacgcttctcaactctcatctcttccaggcgtatagcaactgattgaaggtaggtctgcatgttaccaatgaggagcgcaaagagaattagtccaaggatgcatattgcaatggagaataacacctcccagggatatgt

SEQ ID NO: 17121 - DNA, 293 bp, Triticum aestivum
  unsure (1)..(293): unsure at all n locations
  Clone ID: PAT_TA_17121
gcnaggnaggctcaatgcttctcactctattttcttttgtccagcgaaatcatcatcaatcatcaaaacaaaataaatccgagaaatatggcacaaccataccatattactacnaccatatactaaatcacacacacacacacacacacacacacacacaaaccccttttattgtcggcaagcaagcggttgatcatgctgcagctgatggaatgaaaatcctgacaaggatcactgtcgggtgcacatgagggctctgccttggaagcacgcgatgaagacgggagggatgt

SEQ ID NO: 17122 - DNA, 234 bp, Triticum aestivum
  unsure (1)..(234): unsure at all n locations
  Clone ID: PAT_TA_17122
acacgggaacagttgcaaacagaaatggngtaagcatcncgcttaacaagagcctcaagttgggcttggtgatctggtagacgtcaagagacatggggaccggattatcctggtcaagctggtagttggggacttggttctcgatgttatcaacgagtatgccccgcaagtaggccacaatgagaacactaagagggagttctgggaaggcctggaagacatggttagaagtgt

SEQ ID NO: 17123 - DNA, 932 bp, Triticum aestivum
  Clone ID: PAT_TA_17123
attcggcacgagggtttctcttcgctcctctcctctccgtctccccaaatccatcctagggttttactttcccctccgacaaggttttacccccgcgccccgccaccatgaccgccgccgagctgcaggcggagctgctccgcgcccagctcgaggaccacgacatcgagggagatgagcctatcgttgaggatgatgatgacgacgatgaagacgatgatgaggatgaggatgaaaaagatgacgatgacgttgcgggaggtgatgctagtggaagatctaggcagagtaggagtgagaagaagagcaggaaagccatggagaagcttggcatgaaggtcattactggtgtgagccgtgtaactatcaagaagaacaagagcgttatgtttgtcctctccaagccagatgtcttcaagagctcaaactcagatacctacgtcatgttcggggaggccaagattgaggacctgagcactcagctgcattcacaagcggcggagcagttcaaggcgccgagcccaagcagcgtcatcttgaagggcgagccgtccatggcagcagcccatgacgacgaggaggttgatgagactggtgttgacaagaaggacgttgagctcgtgatgatgcaggcctccgtgccgagatccagggccgtgaaggcgctcaaggctgcgggcggtgacatcgtcagcgccatcatggagttgactaactaggtaggtgcccaaaggtggaattgtgtcctgataatagggtcttggatagcaaagcagtcttttggtatgccatcttgaatgttgcagttgcgggattggaggttctgtctctctgttgaaactagcactgggatgtaggtttcgttggcgttttaaacatctgatgatcacaaactgcgcttgctctttatgggaaatcgattcgactgtgcc

SEQ ID NO: 17124 - DNA, 1000 bp, Triticum aestivum
  unsure (1)..(1000): unsure at all n locations
  Clone ID: PAT_TA_17124
tcgcttagacgcttactggttntnttgaagtgttgtccgagcncatcttcttgaattcttcaggtcttcgttgtattggttggtgtcaaatcggagtggcgtgcgatcccatgaaccggctgtgccaggccggagccttcgtgcagatcgtccagcgacacgtcgccttcccagggcccgaacaacctggctcatgcgtggtcggcgcggtgccggccgaggtacgcatgcggctgcgcaggcgatcatccttgccatctcgttatcactgaagtcgattcctaagtggggatccactaaagcatcgtgattaccatcctcgagtgcttgtgtcatcaaaggccttgcccagtcaaccaagctgtcatccatatgcgcttgttttgaacttacaggacggcgcccagttattaactcgagaagcattactccaaaagaaaagacatctgatttctcagttagcttgccagaagaagcatactctggtgcaaggtacccaaatgtgcccattactctggtggaaacatgggtgttattatcagaggttaactttgcaagtccaaaatctgccaccttagcttcacatctgtaatccagaagaatatttgatgcctttatgtcacgatgaatgatctttggatggcagtcttcgtgaagatacgccaatcccttcgcagaacccaaagcaatacgtagtcttgaaggccagtccatagttggtccacgccttccatgtaaatggaattctaatgtgttattgggaacaaactcatagacaagcaacctcttgtcttcagaaatgcaataaccaaccaacgtcacgagatgtttatgatgtactcggctgataatctcaacctctgcctggaactcacgctctccctgcccacttccatctcttaattgcttcacagcaacttctgtgccatctggcagcactcctttgtgaacaaatccaaagccaccttgcccgagaagattagcatcggagcctcgtgcc

SEQ ID NO: 17125 - DNA, 401 bp, Triticum aestivum
  unsure (1)..(401): unsure at all n locations
  Clone ID: PAT_TA_17125
cgccggcgcacgtcgtgcccctgacgaacctggactacatcgcgacgtgcatcctggtgaagccgtgggcgcacaagcccggggcgcggctcatcacccagtgcgtcacgcccgaccgtgtcgccgccttccaccaaggaatgctcgacatgaactgaccggagctgactggagcggaagaagaagtgaagccgaaggcaaaaggatgcgtacgtaggtctaagcattactcgtgattagacatatactatatggttgctttggattggttgatgggatggattgattcatggtgtgtagtctcactgaaaatgagctttgatcctgactttgaggagtcgatcaggacttgtgcaagttgcaagttgctcaataaaatgaaccaatttttctttttnnag

SEQ ID NO: 17126 - DNA, 1682 bp, Triticum aestivum
  Clone ID: PAT_TA_17126
agccagcccggcagcgagctggacacgcaaccgagtagcttgcataccacgcgcttccgccccggccccccctccaccaattctccttcccgccagcgccgcccccccttacggctgtcgtgcgcccggcccacccatggcggccgccaagtccgtcgacccgcggccgcggccgcggcccgcccccgccgcggccgccccggcccgcccgccccgcctccccggcgtcccccgccaccaccgcgactcgtcccccagcgggtccctgcacggctcgcggcgggcccccgccgggcagcggggggcgcacgggcccgcgcgcacggcccagcgccccgtgcgccacgccccggcgcatcactgccccccccgggggggtgcccggcacacgccgaccggggcggagcaggacgtcgcagccggaggaaggggtcccggggcgtgggcgagaggggccgcctccggtatctggcgcttggactagtagtagctggagcgtatattgggttgctcgtttggagggatggatgtaggctggtggtgtggagtagtttaaccggaaataagctccccgattcggggggttgggtcgtgattggatttggtgggaaacgccaccaactaactaatccttcgtggaatgtaagaatcatttgtgacagagataaatacacttgtggtcactgtacttgaggcaaaagcaccaaacaaaaaaaaaaaaaaaagaaaaaaaaacgcaattccatccccgacccgaacggcgtaatcatcggcagtctgccgagccccgcgagcgccaagcgcctcgagtacctcgccatggggggctccgcggactacatcaaccacttcaagtcccagtacaactcgtcgcacaccggctcctggtgctcggcgttcgaggtgctggtggccaaggcgtggcagagccgcacccgcgcggcgggcttcgaggaggactccatcgtccacctctgcttcgccatgaacgcccggcccctcctgcacgcctcgctcccgcgcgccggggccgggttctacggcaactgctactacatcatgcgcgtgtcggcccccgcgggcaaggtgtccggctccacgatcccggaagtggtgaagatcatcaaggacgggaagaggcggatgccgtcggagttcgggcggtgggcgaccggggaggccggcgccgacggtggcgtggacccgtaccagatcacgtcggactaccggacgctgctggtgtcggactggacgcggctcgggttcgcggaggtggactacggctgggggccgccggcgcacgtcgtgcccctgacgaacctggactacatcgcgacgtgcatactggtgaagccgtgggcgcacaagccaggggcgcggctcatcacccagtgcgtgacgcccgaccgtgtcgccgccttccaccagggaatgctggacatgatctgaccggagccggctggagcggaaggcggagcaataccgatgcctagatagagatagatacgatatgcgtatgggtgtggctgtggtgtggttggtgtgtgggtgggttgcgggtctgtagcgtggctgcccatacgcaaccgtgcctgaatttggggagttgattgtatgagtttggtggaaagccaccaacagaactcgtttttcgtggagtataataaactattattggacac

SEQ ID NO: 17127 - DNA, 425 bp, Triticum aestivum
  Clone ID: PAT_TA_17127
ggtcgacggcgcaagctatctggggaaacataaactgatgcatgtgttgaccccttgacgtgttgttaaaatctaggtgcttttatgctgaggtatcattttagtttctgactgcatgtggtaacaacctactagctgtatttagctccatttgatatgtttgttttagaactttgttgaagcaaggtcttggtggcactgtgccggaacgcacctgtgaaaaaaatataaactaaaaaaaaaaagcccgaaagaaaaaaaaatgctttgaacccaagctactgtgatcctgttcccgtaagcaaaggagcaacacgctacggtctttaattatgagttaaatacatgttgttgccaaatttgaatatttaagagcataactccataagaactactccctccgttccctaaaaaaaaaggggggg

SEQ ID NO: 17128 - DNA, 292 bp, Triticum aestivum
  Clone ID: PAT_TA_17128
ccttggccagctcgtagaacatgcccttgatggccttgacgctgtcggcatcatcgtggcaggtcgtctcgaccatggtggtgcacgcggggtcctcgttgccgcagagcttggagtactcgccgacgcaagcagacttgtcatcccccttgaccaccggcatggatgatgcggccaccaccaccaccacgagggtgacggcgacgacaacactagcctccttgcgcgcaccggccatcgatcgatcttgttttgtcgatttctactctttcttgatgggcaccggtggtac

SEQ ID NO: 17129 - DNA, 765 bp, Triticum aestivum
  Clone ID: PAT_TA_17129
cagatctcgtttgaatttgtcatgtatgtagcacagattacagctgctattgtcatcctcatcttgtcaagacatgaacttccccatgcccctttagttgcatggataattggttatacagttggctgcactgcaagtcttcctcttgtatattggcgctatgtccatcgaaacagaccttcggaggaagaacctgaacagccacctacaacttatcctactttgacttcatcttcatcagaaggacgcaatcagcgtaccagtggcactgtcttgcatcttgggtgtatcacaattgcttgtccaaggcctagcatattggtttatcactccaagacagctgtagactgtttctttgctatatggtttgttgttggcaatgtgtggatttttggtgggcgtggcacttcatcagatgctcaggacgctccaaatatgtataggctatgtttagcgttccttgcacttagttgtgttgggtatgccattccgttcatcatgtgtgcagcgatatgctgctgctttccatgcttaatttccgttttgcgcctccaagaggatttgggtcaaagtagaggagctactcaagagctaatcgatgcattgccaacctacaaatttaaaccaaaacgaagcaaaaactgggtgcttgatcatgcttcgagctccgagaatcttagtgagggtggcatcctgggcccaggaactaagaaggaaagggttgtttctgctgaagatctgtttgctgcatctgccttactaagt

SEQ ID NO: 17130 - DNA, 2426 bp, Triticum aestivum
  unsure (1)..(2426): unsure at all n locations
  Clone ID: PAT_TA_17130
gaatcggcacgagctctgccccctcatccacccctccgccctctccataacagcccagaattctgctctgctctgctcctccctccccctgaatctcccgcccgcctcgcccgacccctcccccggcatctctcccccgcgtcggacatggctatgccgcgctccttcaacgacaccggagatggctccgctgagatgcaccaaccacaccctcctcggctcgccgacctgcctcgcgcgccccgcgccgggccgtggcgcgcgccgccgtcgccgtccaggccgaggcgcagcccaaggtctccctcatccggattggcacgcgcgggagtcctcttgctcttgcacaagcccgtcaaacccgtgacgaactgaaagctgcacacacggagttagccgaggatggtgccattgagattatcatcataaagaccacaggagacatgatcttggacaaacccctggcggatataggaggcaagggtttattcaccaaggagatagacgatgcgctcttgcagggaagcattgacatcgcggtccactcgatgaaagatgtcccaacatatctaccagaaggcatgatattgccctgtaacctcccacgagaagatgtgagagatgcattcatatgcctgactgcaaaaactcttggggagcttcctgctggtagtgttatcggaagtgcttccctgcggaggcaatctcagattctctataaatatccatcactaaaagttgttaacttcagaggaaatgttcagacacggttaaggaaacttaaagaaggagatgtacatgctacattgttggcactggctggactaaaacggttaggcatgccagaaactgcaacatctgtattatcagtagacgaaatgcttccagcagtcgctcaaggcgctattggaataacttgcaggagcaatgatgataaaatgatggagtatctgtcctctttgaatcatgaagataccagattagctgttgcatgtgaaagagaattcttgtctgttcttgatggtaactgccgaactccaattgcggcatatgcttatcgtgacaaggatgggaactgttcattccgggggctattggcttcaccagatggctctatagtatacgagacgtcaagaagtggaacatattctttggatgacatggttgcgataggtcaagatgccggccacgaactgaaatcaaaggctggacctggtttctttgatggcttgcaatagaaaatctgccaccccctaatagtgttgattttatttttcttaccatcgccttgtagttatgatagaagtttgtactacatattgagctgtaccatccaaatttgtatctctgtttttttggctctgcgggttagaacttagaacacggtttagtggtttgttatcctttgattttcatcgagttctggaagaggcttctgctcgcagtattgttgtaacattgtaatgtgatgtaattttgcagatgttttgctgtttcaagaaataaccggttctgaaaaaaaaaacctctttcgctttcgtcttcctctccacccaagtcagtcgccctggccgcgacgccccgcaccgccgggcacgccacctccgccgccgacgccgccgacgggatcgacgcgagcatgacgcaggcggaggcagatgccggcgaggcggccatccagcgcgcgctgcgggcgctgcggcagcggcatctcgtcgaggagggggcccaccgccccgccatcgaggcgctcaaccggcccttcgccgcccacgctttggagtggaaagagaaggccgagaagaacgagttggagctgcagcagtgctacaaggctcaatcccggttgtctgagacagctcgtttccgagcataaacgaggcgaaaacgtccaaagcgctgctcaaagagaaggaggcactgattacggctttgcagagtgaacttcagcagactagcgaagagaacgtacagctaaaacagtcacttgaagagaagacaaacgctttagatcttctcgttcaggagcaccaggcggctaaagccgaacttgaacgggtgctaacaaaacttaaagctgtggagcatgagaacacacagctggttgagcgattgatgcaagcgaagatggtggaggcagagaagcttaatgaggccaatgcgatgtatgaggagatggtcctaaagctaaaggcagctgggcttggcgctggcggaatacaacaccatgcacaacaagaagctgatggcgtcattcggcgatccgaagctgggtatgttgacatcatggaaacaccaatcccatctacatgcaggatcaccatncgngctcatgatggnggntgtggatctataatatnncanaataacacanntnnnctnatnannggngnccangatanactgnnnnnanntgnnntgnncnt

SEQ ID NO: 17131 - DNA, 555 bp, Triticum aestivum
  Clone ID: PAT_TA_17131
accatccattcaagcactgagccgtcaccaccgcgacgcgccccacgaaccgctccggggtcctcttgtttcccttgattatcacccggtcgaagacagcgaaaggatactggacacctttgcctcttgaaacctcagctggacccgggtcatcgttgccacatttgtcctgttccaggcggtctctttttctttttaacgcttttgccgactcttcctctcgtctaaatgcctggactgcaaggccaagagccaggtttggtcgaatggagttctcggtgattggctgaccacatttaccacaagctttcattctgtagatatgctgcatcccactacttccataagaatggccacatgaaagaatcattgcgtcgtccatgagaatacctgtcaacgggtccgaaaggtgcgctctgagcaggtcccagtagctagatgcagggcctccctctcttctcccaataaccccatatccatcctccaccctcatctccctgggaacagaaccaggttcttcgtcccctctagacgaagcgcggtcatgctgctcgg

SEQ ID NO: 17132 - DNA, 726 bp, Triticum aestivum
  unsure (1)..(726): unsure at all n locations
  Clone ID: PAT_TA_17132
cacgttgcagcacgtcccagtgcctgctggcgcacgtgtggaagaaggctacgncggcgcggggtctggacctagaggagttcacgcaggtgagggtggccgtgaactgcaggggcagggccaaccccacccgtgccaatggacttcttcggcaacatggtgctctgggcgttcccgaggctccaggtccgggacgtgctgggcttgagctatggcggcgtggttggcgccatccgcgacgccgcggcgcgcatcgacgaggagtacatccagtcgtacgtggacttcggcggggtggcggacgcgaacggggaggagctcgcggcgacgtcaactttcgggacgatgctctgtccggacatcgaggtggacagctggctggggttcaggttccaccagctcgactttggaaccggaccgccctccgcgttcctgccgccggggttgccggtcgaggggctgatggtcttcgtgccgtcgcgcacggtggagggcagcgtcgacctcttcatggccctcgcggaggatcacgttgcggcattcaagaggatttgctactccctggatattctcccatcgaggatgtaattaagaaagcgaagcatgatgcggtagttttatagtcattgcttttaacaaaattcaagaaatatagatcaataaagtggttattgtacacatcatttttttaacagagtatagacgcgaacgcttatacatatgcac

SEQ ID NO: 17133 - DNA, 1283 bp, Triticum aestivum
  unsure (1)..(1283): unsure at all n locations
  Clone ID: PAT_TA_17133
cccacgcgtccgcaggtctagatcacaacaacaccaccagcagcagcagcacgcacgtagaactagccttagcgcaggacctcttctaaacacttccgctatagcacgctatttaaaaccatgggtgtagatcgaccttgtgcacgcgttcgtacgcagaaagaaaccagcagcagcagagcacgatgctgaggccggtgtaccgcgtgccgcaccctctggcaggcgacaaggtccagctgaccgtcttcgaccgcgcagccatcgacacgtacgtccccatcgtgctcgcctacctcgccccggcgccgcccaacgaggcgctcaaggagggcctcctccgggccatcgcgctctaccctcacctgctagggcgcttcgccgtcgacggccacggccggcgcttcctgcacctcaacaacgagggcgtgcttgtcatagaggccgatgtcccggccgactgggcagacgtgctcgcaaccggcggcatgaccacggacgtgggcgggttttaccctacagcgcccgaggagagcgccggtgcggcgctgctgcaggtcaagctcagccggtacaggtgggggcggcctcctgctccgggggtgatatgccaccaccacatctccgacggccacgcagcgagcactttctacggcgcgtgggcgaccncggtgcgcgagggcaagggcttcagcgtgccgtcccctttcatagaccgcgcggccaccgccgtgccacgcagcacgcccaagccggtgttcgaccaccggtccatcgagttcaaggggggagaaggcagcggctccagccagccccatgccgttctccccatggacaagatcaggaacatcacggtgcacttccctgcagagttcatcgccgagctcaggtcccgcgtcggcgcacgttgcagcacgttccagtgcctgctggcgcacgtgtggaagaaggctacggcggcgcggggtctggacctagaggagttcacgcaggtgagggtggccgtgaactgcaggggcagggccaacccacccgcgttcctgccgccggggttgccggtcgaggggctgatggtcttcgtgccgtcgcgcacggtggagggcagcgtcgacctcttcatggccctcgcggaggatcacgttgcggcattcaagaggatttgctactccctggatattctcccatcgaggatgtaattaagaaagcgaagcatgatgcggtagttttatagtcattgcttttaacaaaattcaagaaatatagatcaataaagtggttattgt

SEQ ID NO: 17134 - DNA, 1180 bp, Triticum aestivum
  unsure (1)..(1180): unsure at all n locations
  Clone ID: PAT_TA_17134
cccacgcgtccgcccacgcgtccgcgcgtccgcgacgagttcaggctacagaccggcttcttcctaacaaggtgacagagatcgacctcgtgcgagcgtgcaaaatggaggctacgtacgcggagacgggccagcaggttgctgctaccagcagaagcgcgatgctgaagccggcgtacgccgcgccgcacccgctggccggcggcaaggtccagctgaccgtcttcgaccgcgccgccatcgacacctacgtccccatcgtgctcgcctaccccgccccggcgccgtccaacgaggcgctcaaggagggcctcctccgggccatcgcgccctaccctcacctgctgggccgcttcgccctcgacggccacggccggcgcgtcctgaacctcaacaacgagggcgtgcttgtcatcgagaccgacgtcccggccgacttggccgacgtgctcgccgccggcggcatggccacggacgtcgccggcttttaccccacggtgccggaggagagcgttggaccggcgctgctgcaggtcaagctcggccggtacaggtgcggcggcctcctgctcggcgtgatatgccaccaccacatcgccgacggcatggcagcgagcacattctacggcgcgtgggcgaccgcggtgcgcgagggcaagggcttcagcgtgccgtcccctttcctagaccgtgcggccaccgccgtgcctcgcagcacgccgaagccggtgttggaccaccggtccatcgagttcagaggcagctccattagccagtcccatgcccttgtacccatggacaagatcaagaacatcgccgtgcacttccctgtagagttcatcgctgagctcaagtcccgcgttgatgcaccttgcagcacgttccagtgcctgctggcgcacgtgtggaagaagatcacggcggcgcgcggtctgaaccctgaggattcaccaggtgagggtgggcgtgaactgcaggggcagggccagccaaccgtgcaatggacttctcgggaaatggtgctctgggcttccaagctnaagtccggactgctgggattaactacgctcctggaagtgcatccgcnacccgtggcgcnatnacacanantcatctagttgactcgngtttgcggcccaacgnaaaaccccggaatcaattcnggcannccttcggaaan

SEQ ID NO: 17135 - DNA, 619 bp, Triticum aestivum
  unsure (1)..(619): unsure at all n locations
  Clone ID: PAT_TA_17135
cactgatccgacggcctatctagcattaaacactagggcaacanccttcggccgctggtacaactgcgtctggtgcagggcaaaaaggaagggaggaagaaagaacacaatacatgtgcactagcctgctacctactatgcaaaactgaactgaactgaaatttctagtatgccagacaaagctgaagattcatacagcgtgttccggtcgatcacgatagcttggctgcatcggcgttgcccgactttgcagtttcgtagctaagtagcttgtggattgggaggaaatacggtgctagtgatgccaacacaaggcaaatcactgctgcaattccaacccaccaggcaaagcgagggatccccagcaaaagttcatcacacacaatgttgaacagggcaagctctctctccttgacatttggctttgcaaccacaccctcaggctccaccgtgacaagaacataaaccagcttggtgctctcagccttgaaaatgatcttctccgtgttgagcagcctcctgttcttactgccctggtcctccacagcatcaggatcgctcacgagccgaatcgagaagctggacggtatggaggccgggtaggagatcttgacttcgt

SEQ ID NO: 17136 - DNA, 312 bp, Triticum aestivum
  Clone ID: PAT_TA_17136
accacatgtcatgccaaggaggccgcatagacaaacagacgctcataatgttcaaagctgaaaatatccgacacctaaaagcaatacagggatgcaaaaggagatatctgagttttccctttctggatagtataggcagagaagctactagtgcactagtgcagttgacgcttgattgtctgtccctctccggtaggtagcaaccgattccacgtcagggtgaggatagataaccgccagcacaccatcatgggccgggacgagattctgttccgctgcaggcgaggagatcgagcaagccgtcgagagagt

SEQ ID NO: 17137 - DNA, 214 bp, Triticum aestivum
  Clone ID: PAT_TA_17137
gtcaagtggatcgacgccggcgccacgtgacgcagctgccgcaggtagatcagacggcgatgacgatggtgtaggactgtagggagctgttgcatgtctgtgtgagtgtgctgctgttactgtctgttatgtatctgaagttttcaggcagttcttaacggaacaattttttcttagatataaggaggatacgggacctcttttttttttctaa

SEQ ID NO: 17138 - DNA, 928 bp, Triticum aestivum
  Clone ID: PAT_TA_17138
cctcgcatcacccaccccccgccccctcaccactccaccaccacgcccgagcgcacgcagggcaccaccgcaggcacaagagcggagggggagcaagagctcatacatactcttcaaccaaggcaaggcaagaggatgaacgaggaggcggaggggaggggggcgaggcccggcgtgcttaaggtggtggtggcgcaggggaccaacctcgccatcagggacttcacctccagcgacccctacgtcgtcgtccgcctcgcagacaagagtgcaaagacaaaagtcatcaacagttgcctcaatccagtttggaacgaggagatggtcttctctatccgaggacctggtctgatccgccatgtagagttggtcgaccgggaccggttcaagtacgacgacaagatgggacacgccttcctcgacctgcagccggtggccgccgcgacgaagctgcggcgcgcgctcaagctcaccacgggggagaccaggctccggaaggtggcgccgaccgccgacaactgcctgctctccgacagcttcgtgacctacgccgacggcgttagtgtgctcgactcccggctgcggctgcgcgacctcgagtccggggagctcttcgtgaccgtcaagtggatcgacgccggcgccacgtgacgcagctgctgcaggtagatgagacgacgatgacgatggtgtaggactgtagggagctgttgcatgtctgtgtgagcgtgtgctgctgttactgtctgttatttatcttaattttgtctgttgttcataagaaaacattctgttagttcttaacggaaaaattttttctcatattttttttctaaaaattcgagcataaggccggcactaactgctaaccgttgtggaatgacagtttacaacaccttaattttaggaggcacacgagccttccaaa

SEQ ID NO: 17139 - DNA, 549 bp, Triticum aestivum
  Clone ID: PAT_TA_17139
acgatgcttaccaaatatcggtacactctttcggactacagatatgtaacagacttcagagttttgcaaaaaggggaaaatgaacatacttcagaaatatttctactcgatcgatggatcgaccgtgcgcatggagcatgcatatataattgagcatgcagcggttcgtcaacttttaaccttcgatcggcatgtgctggtagtagtagtactaataattttggtggatcgatctaggcagcgttgatgatgccgatgaggggtatgccgacggcggtgacgacgagcgtggacggcgcgccgaagacgacgtggctccagaaggtgaggtcgtgtgcgttgcgcggcgcccggcgtgcctgctcgcacacgatgaggttcgccgccgaccccagcagggacaggttacccgccaccgtgctcacccacgccagcagcagccacgaccgcgtcaccgccgccgccgagatcgtcgccgccgacgccgccacctcgtcacccatcagcagcacggttggtacgttggaggctaggttggagaggatgatg

SEQ ID NO: 17140 - DNA, 670 bp, Triticum aestivum
  Clone ID: PAT_TA_17140
attcgtttaaaataccggaggattccttcctgtgtccccttctagcttcttcttcgttgttttcttttcgaggatttgtccgcttcttcctttactgactgaggtgggagcgttgctaatctagtggatgcctgcagatcacaaggcgcggtgttgtaactggtgcgaccaggaaatgagcttgcacagctgtccggccgcggccggggacgcgccgaccgggacggcggaggacctgctcgagcgggcgcggggcctggtgccggcggcgctggacgcggcgcgcgcggcgacggggtttggcgcgcggtggaaggccatcgcggcgaggctcgagagggtgccgccgtgcctgtccgacctgtccagccacccctgcttctccaagaacgcgctctgccgggagctgttgcagtccgttgctgccaccctcgccgaggccgccgagctcggcgtgctctgccgcgagccgcccaaggctggcaagctgcagatgcagagcgacctggacgctctcgccgggaagctggacctcaacctccgggactgcgcgctgcttgtcaagacccgcgtgctgtcagatgtgacggttccgtctcctccggctgaggcggcggcggcagaagcctcgcagacggacgtgcgggagctactcgctaggctgcaaatc

SEQ ID NO: 17141 - DNA, 1459 bp, Triticum aestivum
  Clone ID: PAT_TA_17141
gcggctcgctcgctacaagtgcagcccggccgtgcagcggcggcggcggtactagcactcgttggtttcttctcgctggcggccggcgccgggaggagggccggagcaggggcgagcgggggcgcgtccagcggaggcgagcggatcgcagggcgagatcacaaggcgcggtgttgtaactggtgcgaccaggaaatgagcttgcacagctgtccggccgcggccggggacgcgccgaccgggacggcggaggacctgctcgagcgggcgcggggcctggtgccggcggcgctggacgcggcgcgcgcggcgacggggtttggcgcgcggtggaaggccatcgcggcgaggctcgagagggtgccgccgtgcctgtccgacctgtccagccacccctgcttctccaagaacgcgctctgccgggagctgttgcagtccgttgctgccaccctcgccgaggccgccgagctcggcgtgctctgccgcgagccgcccaaggctggcaagctgcagatgcagagcgacctggacgctctcgccgggaagctggacctcaacctccgggactgcgcgctgcttgtcaagaccggcgtgctgtcagatgtgacggttccgtctcctccggctgaggcggcggcggcagaagcctcgcagacggacgtgcgggagctactcgctaggctgcaaatcgggcacgccgaggcgaagcaccgggctgtggaggggctccttgatgcgctgcgcgaggacgagaagagcgtgctgtcggcgctcggccgtggcaacgtggccgcgctggtgcagttgctgacggcgacggcgcccaagatcagggagaaggcggccaccgtgctctgcttgcttgccgagtccggcagctgcgagggcttgctggtgtcggaaggcgcgctgccgccgctcatccggctggcggagtccggcagccttgttggccgggagaaggccgtcatcacgctgcagcgtctgtccatgtcacccgagattgcccgcgcaatcgtcggccacagcggcgtccgtccactcatcgaaatctgccagaccggggactccatctcgcaatccgcggcggcgggcgcgctcaagaacctctccgcggtgccggaggtccggcaagcgctggccgaggaaggcatcgtgcgcgtgatgatcagcctgctcgaccgcggcgtcgtgctgggctccaaggagtacgcggcggagtgcctgcagaacttcacgtccagcaacgacaacctgcggcgcgccgtggtgtccgagggcgcgctgcccagcctgctcgcctacctcgacggcccgctgccgcaggagtccgccgtgggcgcgctccgcaacctcgtctctgccgtctcgccggacaacctcgtgtcgctcggcgtgctcccgcggctcgcgcacgtgctccgcgacggctccgtgggcgcgcagcaggcggccgcgg

SEQ ID NO: 17142 - DNA, 517 bp, Triticum aestivum
  Clone ID: PAT_TA_17142
ctccacgtcgacatctccaggccggagagcagcaagtcgctgcagttcctgtgtggattgtaccccgacgccgtggggatccattccgtttgccttcggtcgaagacggccgcgtctggggccggcgccctggccgcggcctcggggggcggcggcccgcaccagggacgcatcttccaagagttggatgagaaggtgcgcgatgcattccatttttacattgaggcccgtggcataaatgagaactcttcccatttctacaaccctggcttttcgtgaaggatcaccgcaacctgatacgctggtttaagagtgtgggtgcagtcatcagcgagccgaagcccgagtaagatgacaagaacacatccttcaagatcacccgtaaggcgactgcgcaagtttttgcctgttgggagaacccagaggattgagagtagtgctagtggtataaagttggcatcggtgcaagatagtgccatcaactaatatatattgccttgtctttagctttgactgt

SEQ ID NO: 17143 - DNA, 1452 bp, Triticum aestivum
  unsure (1)..(1452): unsure at all n locations
  Clone ID: PAT_TA_17143
ggccgggcccggatgttcactggcctgtgtgttttttntgagccacaagaacacagaaacagagctcagaagcaagaaacagagcaagatttttacagattcctttgcaatttgcgtagcatccagttcacggcgagcaagatggtggccaaggaggcgatcccgctgctgacgccgcacaggatgggccggttcgagctctcccaccgggtggtgctcgcgccgctcacgcgctgccgctcctacgccaacgtcccgcagccgcacgccgcggcctactactcgcagcgggccaccaagggcggcctgctcatcgccgaggccaccggcgtctccgccaccgcgcaggggtacccggagacccccggcatctggacgcagcagcaggtcgacgcctggaagcccatcgtcgacgccgtccaccgcaagggcgctctcttcttctgccagatctggcacgtcggaagggtctccaccaacgatttccagccagatggacaggcgccgatctccagcactgacaagcagataacacctgatgctgagtccggcatggtctactccaagccccgacagcttcaaacggacgagataccgctgattgtcgatgacttcagacgtgctgcccggaatgccgtcgaggcggggttcgacggcgtggagatccacggggcacacgggtacctattggaggcagttcatgaaagacagctctaatgatcgcaccgacgagtacggtggcagcctcgagaaccgatgccgctttgcggtggaggtaattgatgctatcgtccatgagattggtgcggatcgtgtaggcatcaggttgtctccattcgtggattacatggactgcttcgactcggacccacatgcactcgggatgtacatggtacaacaactcaacaagcatcaaggatttgtctattgccacatggtagaaccccggatggcaattgtggatggtcgcagacaaataccccacgggcttctgccattcaggaaagcattcaacggcactttcattgccgctggagggtatgatcgagaggaaggcaacaaagtggtggccgacggctatgctgatctcgttgcttatgggaggatctttctggctaatccagatttgccaaagagattcgagctcgactcaccattgaacaagtacgaccgtaacactttctacacgcaagatcctgtcattggctacacagattatcctttccttgaaggcggctcgaatgccgagtagttcacccactcgacttgaattagtgatgtgcttgattttataaagtatgtaatgatttattcaatgtgtgtatgcacggggcatgtgcactgtatcattttcaccaataatttacttttgttttcccatgtaatgcccctatgtcaagatattattttttacatctccaggggggggcccggtacccaattcgcccatac

SEQ ID NO: 17144 - DNA, 1067 bp, Triticum aestivum
  Clone ID: PAT_TA_17144
cacagtctcaaaagagcccaagccacctcctgcccccagccggaccccgcgtgtgccctcgccccccccccgctccgcccatggaggccaccccgatctccgtcaagcccccctcgccggccccgccccagcccccgcccccgcacctcacggcggcggtgcccctctcggccgtggagcccccgccctcgccgcccccggccgtggcggcggccccggatgggccccgacgcgctgccggatcccgccagcatgaaccagctcgcgctcgccaccacgcccaagaggcagaagctggtaggacgccgcggatgggtgcaagcattgcgcctgcaaaaagtccagatgcctgaagctgtattgtccatgttttgctggtggaggttattgttctgaaaaatgtggatgcgtgccatgtttcaacaagtctgattttgcagagacagttcagaccactcgcaaggtgctactttcacgtcagaaacggatgtctctgaaaattaatagaagactggaggctaatgctgaaactatggaagatgcacacaattcttcttcttcaactccaccaaggcgaggttgcaattgcaagaaatcaagttgcctaaagaaatactgtgattgctaccaggatgggactggatgctccttattttgtcgatgcgaggattgcaagaatccttatgggaaaaatgaaggttttatggcggacgaaagcaagcgttttatatacaccggtgcggatctggaccatagcgaggacgaacacgactttgtcgtggagcgttcgcctcgcctgcaatcgcccatctcaaaggagtcctctttccaacacaccccgcctcgcagcaaggcctcgagcagagacacgcacctgctgccgcaggtgctgtcgcagtggcagccgcgctcatggcagctgtccttgaagaggcagggcaacgaccaccgggcggtcgacgactcgggagagaaccacaagagctcgagccacgagtggcagctggcgaagcaccaggtccaggaggacgcctacagcatctcgcggtgcgtccagatcctgaacg

SEQ ID NO: 17145 - DNA, 991 bp, Triticum aestivum
  Clone ID: PAT_TA_17145
cggcattgctcgtggcctcgaatacttgcaccatagctgtaatacacgtatcgtccatttcgatatcaagcccccaaatatccttctagacaaggattttaacccgaagattgctgattttggtctagctaaattgtgtcaaacaaaagagagcaagctttcaatgactggtgctagaggaacaattggattcatcgctccagaagttcactctcgaacatttggagtggtttcaacaaagtcagatgtttatagttatggaatgatgcttttggagatggttggaggcaggagaaatgtaaaatcaactgttgcaaaatcaagcgaaaagtattttccagactagatttacgatcactttgcacaagatgatggactacaagcatgtgaagtgacaagagaaattgaggagattgcgagaaagatgacattcattggcttgtggtgcatattggtgttacctatgtatcgccctactataaccaaagatctagaactgttcgagagaagctcagatgacatggacatgccaccgaagcaaaacttctctggattgcttgaaagttcagctcacaatatggatgtacaaagttcaagttctaaaagatctgttgtgatcagccttgtgacaagatccatcgtaattcaatcgaacactctttgggcgcaggctctttgagatcgcaacatgtacaagcattagcaaagcaataaagttcaatggtgtatcactaaacatatttcatttatgtacagacttgatttaaggctggctctacctgaaacaaacaaactaggataaatgtattttccaagttccattagtcaattccgctgtgtgttgtgtgccggctgctacttggccccgggggcaggcagcgaccgacgccttctggactcccacgttggttacagctgggaaggagatgcaatgatttatacctttgtgttcatcatagataggagttgattctcttgcactcgtaaaaac

SEQ ID NO: 17146 - DNA, 631 bp, Triticum aestivum
  unsure (1)..(631): unsure at all n locations
  Clone ID: PAT_TA_17146
acaacaatcaattgttagctcatgttatctatctatcttttgctctgctttgcattgaacttcatatcataggttctcctaactcctaagaggaaaaactaactgatgagtgatgacaaaaaggcaagcgtaggctaatcaccaaacaataacaagtttattagcttcccaacgataaatggagcatcttatcaccaaaagagagaaactgtatatggactatgatcccaggaatccaggatacgttatgatcccagcaatcctggatagtttatgaacccgggaacccaggatactttgtgatcccagcaatcctggatggataggttatgaacccaggaatccaggactgaggatactatgcaaagttgcaaccaccaggattgctgcaatagagcgcaatttcagtgttcgctttaaagtggaaagaggaaaatncctcagtatggtcagcnagtntccannnacacagtgaatatcatcttaaattgggatagttaccatttctgacatatggcctacttcatctnaccccttacacaaagctaactnagctgaagattgaacaaaaggggtcaatttctttcgaattgttacctggaacccactcaaggtcaatgacattagttaa

SEQ ID NO: 17147 - DNA, 700 bp, Triticum aestivum
  unsure (1)..(700): unsure at all n locations
  Clone ID: PAT_TA_17147
tatgaaacagcataatcagggtctaacattcttaatgtgatggcagcagtagtgtcaggaacccatggaagtacagaagttccaggtagtgaggaaggattctgggaaggcatatcttctgtctttgagttattaagcaattcatttgatgtttcaaaatcagaagacaggtagtctcgtcttattgcaccttccagcagagtcaacatctggaatatttcctcgacggatgtggtagagtgcaacttcacgccccaagatttccgatatccatcactccaaaatggttgaagtgcttctgatggtatcgaagcctcaatggtagctaactgcaacttgagcaatctcattccaattggaacagaatagtctgcgatttgcatcttccagttagggtcagttcttctcttctcgtcgcattgtgacgtngtgctcagaataattataaatggatttgaaggtcttatggcaagacgagcagtgcctttcttctgctaagtaaatctgatagcagtaattacaagaatgcatcagtgcagagcatcttttcttcccatacttcatggcacatgtcagttgggcgatcgcaacattcgctccacatccattttaaaaaaccatccgtccttttttgagatagatatcnnctccacatcattacgtccaagctctatttttgaacgaatcagaatatgtgact

SEQ ID NO: 17148 - DNA, 920 bp, Triticum aestivum
  Clone ID: PAT_TA_17148
cggagcgtcgtgctttcaaaattgggctccatttattccaaagcctgcagcaagcagacaaacagagggagtggtagagagtgggactggagagtgagagcagagcagagtgagagagatgggttccatggcgctcctccgttccctggcctgcgtcctcatcctcctctgctcgtcgctcggggcagcgaatgggatgtatcgtagagctggcggcgctgagggggaggaagcgggcggcagggtcgccggcggcgcccgcggcggcgtcaggagcgcgtggccggggtacctctacaccagagccgtcgggcgatgcacaccccagttctggagcagcggggttgagcaatggcccaacatcgtcccccaggaggcggcggtgtccaaggtgttcgggtccaggtccatggacaagtacgggccgcggctcaccctgctggaggccaccatgaggacggacgacgacggcagccccttcgtgaagctggtgaagcacgggagcgcggcgctcatcaacgcctacacgcggacgggcttccccttcgactcctgggaggtgaaggcgctgctgctggaggcgctcgtctccgaggacgccgcggccgcccaggccgagcggttccagcaggccaacgagtcgtgtgtctgaatcccatggtatgtatcaacagaaatgcagaatggcacgtgttggtggtaggtcaccgcttctgtgacttgggagggagatctcaagcagtgttcccattcgcggttggcatgtttcttggatgcctgcgggttgtttgaaatggtgaagtgtgacttgcactcgtgtgtgtttgtgcaatgtgcgtagcctgtagctgtagtagtggagtgtgccatcgtgcaagactgcgatcggtggaggatgagcgttttatgtcgccgtgtcg

SEQ ID NO: 17149 - DNA, 694 bp, Triticum aestivum
  Clone ID: PAT_TA_17149
ccccgcgtccgcgcctcctcctggctctcgccagtgccagccgccacccaccacctcgtccgatcctactgtggactgtggtggtagttaatcaatggaagagctcgacgagttcgaggtgctctggccggagtactgcgccggcctcgcgcacgccgacgatgaccagtacaagacaccggcggcggcatcgagcgtgcagagcacggccacgtcgtggcagcggcgcgcggcacggtctcggccggtggacgttcctccaagcagggccgccgtgctgttgctacggtggaaagacggtaataccgaagatgactcagtggagaaggacggcgggggcaagatcatcgtgccgccgcacctgctggtctccggcaggcggctgtccgacggggaggccgccgcggcgtacacgctgctgcggtcgggggcggcaaggcacggcaagcgggcgcgcgacctgcgccacctgcgcaactccgtgctgcggatgaccggcttcatcgaaggatgacacgttgacacgtagtaccaggtcgtcctatggtttggggcacaaacacgtgcataaatttctcaaaattaaatttccttgtgcgctcaacgaatgttatcagagtgcccaaaaaacttgttgctagtactaccagtttgtcagtatcggttaatgagattagcaccaagttttgaacct

SEQ ID NO: 17150 - DNA, 931 bp, Triticum aestivum
  Clone ID: PAT_TA_17150
ggatctccgtaactcactctttttatattaaatataacaagtattagtacagacatagacatggatacatcaaacccaaaaattcccattacaattctcaaaagagaaaaggtctcccacacaaaggaaagaatcaatgaaggaagtcctgagcagttgccacagaggcaaaaatagatgtgggagaaaccccactccgcttgcaggataaaaagaggcctgaagcagagaaaccttaaatcagctgtagtccatctcatcctgcaattttatcatggtggaattgcaccacgatgcatgtaatattgtcagcgctgccacgggagtaggcaatctccgtcagtttcctggccgcagactctggcacatcttctgtttttgcaagggacacagcttcctcattttctacggcatcccaaagcccatcactggcaagaaccaggctctccaattctccattaatcaattcttcctgaatttcaggttctgccaccacaaatggcttcagtagacgattaccaaacgcacgggacattgccagtacgccacctaccctccaagtaccagcccagatgacaacacctccagcattttcaattctcttgcgttcatcagacctgttaggtttgtgatctactgagagtgccctagctttcccggcttttgaaataacagcacgggagtcaccaacatttgctacatatagatggccacccactaaaaccgcagtcgaagctgtggaaccatcatccctgaaagcacttgattctgattctaagaaatctgcatctgtcttctgatatgtttcacttatagcaagctttgtatcagtcaagaacttggggtgtttcataaggttctcgaacaaatgctccttcaaatactcagcagcacgtgaccccccatgaccatagaatacaccggacgcgtg

SEQ ID NO: 17151 - DNA, 1188 bp, Triticum aestivum
  Clone ID: PAT_TA_17151
gatcccctcagacggagcgtggaccctgccgaggtactacctcgccgattccgccgttggacgccccgacctcgacttcgcaccggtgcgctatggattccgcacgggcagcattttccacggatcggtcgccaggacggtgtcctggggccgtaggatctcgaccgtcatgggtgtcccccggggctttcagtgccaggatcgagggtggagtcctgccgtgggtgcgtatctccggaaggtccaccacttccttatgggccaggatcaggtccccagaatcggcggctacaacacccccattccctcggagaccctggaatcagagggaggagctgcaagcaagtatccaccggatagccgtcgactcgatcacaaccgtgataggaatctcccccacgattttggtgtgatactgctggaggttatctccggcaggcccatcagttccatatacgaggtggagatcatgaaagaacagttgcaatcggcgctgtcagcacaaggtccgagcaagaggagcaactttgtggacccggcggtgagcaagggctgctccgacgactccatgaggaccgtcatggagatctgcctccgctgccttgccaaggagccaacgcagaggccctcagtggaggacgtgctctggaacctgcagtttgcggcccaggtgcaggatgactcccgcagcagcgacgagtccccgctctcgccctcgcagccccatgcacaatccgcacacggctgacccaccccaccccaccccgcagctagggcacacaaaaatacatcggcaagcatcatcatggattcatggctcaaggcaaggattagacatggtattttcaggccaagtgtacagcagctcaagctggaccccgtgatgcgtatggtgtactagttctcaccaagacgccaccggatatgatgagttttcaacttctcaaattaagtagaacgactttttttttcttttttcttttgagaaatctccaatagaacgactagtaaccataatctcgttatggattggaatgcactcccataaaaccattatatgttcccacagtgtcttaaaattccactttgtctagtctagaaatacaaatttgtacggtttttgagaaccgggtattgtaatgttccaatgcatattatatactagtaaaaaataatgttgctatcccc

SEQ ID NO: 17152 - DNA, 787 bp, Triticum aestivum
  unsure (1)..(787): unsure at all n locations
  Clone ID: PAT_TA_17152
gccggccgtgtcggggcagtgggacaacatcaaaacactttgtcatttacactccaaaccaagtcactcttttacaatctcaagacttaccaaacaaaagaaagcaataatacctccaagaagacataaccgcatccataagtaaaagaaaacacctactacgaccgccaacatgtcggatctcgatcactttgatctccttcccatccagatggaccctcagtccaaggccatcacctcgcaaacagcatcgcgctctctcgccgccgaactcgaagctctaaacacactccaccgctctctccttaccatcgagcacccttcaggtgcacccccacctcccgtgcccgtcaaccccaagcgcactgccaacgtgaccaagctccgcgactctggcaacaacgaataccgcaagggcaagttccccgaggccatcaagttctacactctgggtgtccagatggccatgcagcgccccatgtgggagcccgctgcgctcgtcagggaggagatcagcggactgcttgccaaccgagcgcaggcgcacatggcgatgcagaactgggccgagggtgccgtggatgcgcatgcgagcgttgaggcacgctgggtcggaaacgcaaaggcttggtggagaaggggaagatgtttggccgagatgngcagacttgaagaggctagggactggattaggagaagactggaggttgaggggtgagagggagagctggtgcagctattgagggagattgaggagaggattgagaagcagcagggttaaagtgac

SEQ ID NO: 17153 - DNA, 1039 bp, Triticum aestivum
  unsure (1)..(1039): unsure at all n locations
  Clone ID: PAT_TA_17153
cttcttttatagctcacgagcagaaggcggatcaagatctaagcagcaagcagcacggaggtccaacaatggcggagaagggagtgaaggtgtttggcatgtgggcgagcccgatggccatccgggtggagtgggcgctccggctgaagggcgtcgggtacgagtacgtcgacgaggacctcgccagcaagagcgacgcgctgctccgccacaacccggtgaccaagaaggtgccggtgctggtccacgacggcaagccgatcgccgagtccaccatcatcgtcgagtacatcgacgaggcgtggaaggacggctaccccatcatgccggccgacccctacgaccgggctcaggcgaggttctgggccaggttcgccgacgacaagtgcaacgccgccatcttcccggtcttcacggcgaccggcgaggcgcagcgcgaggtggtgcgcgaggcccagcggtgcctgaagacgctggagaaggccctggaggggaagaagttcttcgggggcgacgccgtcggctacctcgacgtcgtggttgggtggtacgcgtattggctgcccatcatcgaggaggtctccggcgccgacgtggtcaccgacgaggagctgcctctgatgaaggcctggttcggccggttcctggccgtcgacgtggtgaaggagaccctgcccccgagggacaagctcctggcgctcaacaaggctcgccgtgagcagctctcggcgtagagcagcacttgttccgagccttccagctagtacttaagcttctgccatggattatccatgatggataaataagcggcgagcatttgcacattgtgcaacaaatgtttggagcttctttcagccgcctgcttcacactcccagtttccgttatataaacttcacccatgatgttatatatacggtgcaatatacactgcctacttatttcctcgaatgtgaaaacaaaaaggacgctcataacgcccacgcgccctataacccccttcgggggcgaaacaaaancaaatncncccgccgccaaaag

SEQ ID NO: 17154 - DNA, 648 bp, Triticum aestivum
  Clone ID: PAT_TA_17154
aattccacagaatccacgaagcgaaccaaggaaacgagcgacgatgcggcgcgagggacggcagcgagggtgggtgcgtgtgtacgaccgcgccgtggtggacccggagggcaagcgccgcgccgtgcacgtcgtggacggcccggtggtggccaacggcggcttcatccgggcgccgcggaagccgaccaaccagtccaagtccggcggcctccgcgcccttccccgagacgcactcgttcaagacgaggagccgcaactccatccgccactgggcgaccggcattctgggtactactacacaacgacgtgccagtcaccgttcagattcgaggccgcgccgtatggatggaggtacgacgccttcgcacccgaggaagtgcaagctcctcgcccgccgccggcagcggcgcgttctggggggagatcggcgtgcaaggggagccgcaagttcaagcacagcgagatcaagatgtactacgtggacgcggccgatgacgtcgatgggcgcctcgattatctctatgactttgattcatgattcccccctttgttttccaaagttcagcaagaggagttgtaaactactgtagatccgatggatgtgtgtatctttgtcccttccgttatcaatgcaggtgcttgctc

SEQ ID NO: 17155 - DNA, 867 bp, Triticum aestivum
  unsure (1)..(867): unsure at all n locations
  Clone ID: PAT_TA_17155
ggccggccgggccggggtacagaatccacgaagcaaaccaagaaacgatccaagatgcggcgcgaggggcggcagcgagggtgggtgcgcgtgtacgaccgcgccctggtcgacccggagggcaagcgccgggccgtgcacgtcgtggatggccccgtggtggccaacggcggcttcatcagggcgccgcggaagccgaccaaccagtccaagtccggcggcctccgcgcgctcggcagggacgccctcgtgcaagaggacgaggaggagcggcagctccatccgccgctaggcgccgggcattccgggtactactgcacaacgacgtgccagtcacccttcagattcgaggccgtgccgtatggatggaggtacgacgccttcgcgcccgaggaagtgcaagctcctcgtccgccgccggcagcgcgttccgggggtagaggagcgtcctgcaaagggagccgcaagttcaagcacagcgagatcaagatgtactacgtcgacgcggccgatgacgtcgatgggcgcctagattatctctgtgacttcgattcatgatttccccctttgttttccaaagttcaaaaagaggagttgtaaactagtactgtagatctgatggatgtgtgtatctttgtcccttctgttatcaatgcaggtgcgtgctctaatgaagatcatgttgttaaaaaaaaaaaaaaaaatttactcacaacacaatcacaacaacaacaaacactcaatcacttacacctttnaacacattctactattcaaaatgactgcctcaagccgccccgccgagtacagagacgttcgcaccgcgaatctcacactatcacctttgacacctcttcgacaaggatg

SEQ ID NO: 17156 - DNA, 1256 bp, Triticum aestivum
  Clone ID: PAT_TA_17156
gactctcggcaacggatatctcggctctcgcatcgaggcagaacgtaatcactcacaacacaatcacaacaacaacaaacactcaatcacttacacctttaaacacattctactattcaaaatgactgcctcaagccgccccgccgagtacagagacgttcgcaccgcgaatctcaacactatcacctttgacaacctcttcgacaaggatgaggctgagcttaagcgcctcattgagtcttgtgaaaaggatggattcttctatctcgacctgaagagtgccgcgtctcagaagttctggaacgacctctacacgatcgacagcaccactaaggactggttcaagcagcccatcgagaagaagctccagacccccactgtttcgcttgcgcacggatttaaggccgtgggtaaccagtctggctccatcgagtccaagaaggatggtttcgaggctctcaagatcggcaagagtgagctcgatggacgatgggccctccctgatgttgtatcggacaaccttcccctgtttgaccagttcgcttcatcctgccacttcatctccaagctcctcctcgactgtctctccgacggtctcaacctcaagggcgatgctcgcttcgagactcaccaccgcgacgactgtcgctccaagagcaccctgtacttcttgcactacccccctggcgctcaggaccccaacaaggtcggccagaacatgcacacggacatcggaacgttgacgatcctctatgcgcctcagtggggactccaggtcttctcccctgccgacggtgcctgggagtacgtcgagcctcgccccaatcagatcatcgtcaacgtcggcgacactcttcggttcctctcgggcaagcgcttcaagtctgccctgcaccgcgttcttcctctcggaggaattcagattgaggaccgatactctatctcttacttcctgcgcgcttctgactcgactgagttcaaggacagcgatgaggatgagtcgaatgctaagcagtggtacaccaagaagtacgctatgtatgagatgccccatgtcatccagaagcagcagacgacactctcgggtggtatggcgcaagagcttcaggccaccttctaagttgggtctttttagggctgattcggggaggcgtgaagtcggaggataatggcggaatgatggaagatttcttatttttgcgaaggatcacactagttacctagttaaaattgcaattcactcctttatccattac

SEQ ID NO: 17157 - DNA, 457 bp, Triticum aestivum
  Clone ID: PAT_TA_17157
atcacatatcccatcctcttgagtctggatttgttgaagacatgaagtattgccaagtaacactcctcctggccttgatcgttcttgcctcatcaccagccatggcgaccaagtgccctccagagtacacctgcaccaagtacatcaaccagggcccatgtgatgccgccaagtgcatgatggactgtgtgagcgcgtacaagggcgcaggggaaggccagtgcttccctcaaggatgcaggtgttcctactgctgcaagccgcatcaacgaactatttaaccgagcttggccaccacgccgtttggagacgtgttgatggatgatgtggtgcaaattgcaaacttaactagaatttgtttattctgcccttttgaagtagttataagagactcttgtagcatgatcatcgttctatctaatatgaagagtaataataaatgggcatattgtaggtt

SEQ ID NO: 17158 - DNA, 802 bp, Triticum aestivum
  Clone ID: PAT_TA_17158
tgcaggagcacttgcaaggagaggcagctagtttgaccaccgttccccacactatctcaccgggagtttctcgccggatctgagcaccgtcttcctgccgcgcgcggagttcaccggaaccggacccggcggagggaagcaccggctgccattgctcgccgccgtctcgcaaggcgacccgaacccgatgcgacggagcaggatgcctgataagaagagggcggccgtgatcgacgacctgcccgacgacatcatcttcggcaagatcctcatcacgctgccgcccaaggacatcgggcgctgccgcatggtccgcacgtcgtggcgcagcgccacattcacgccggaattcatggccgagcaccgccgccggcaggtgtcgctcccccgcgtcgacgggaaggggcagcgagccagtttcgtcaccctccgtgacgctgctgccgccggagccaccagccagcagctctggcccttcctctcccggtgccgtaaatcctgctgcaagattcgcctccatgcctccagcgatggcttcctcatcgtctcgcggggagaccggttctacatctgcaacccgaccacccgcatgcacgctcacttgccatttcctcgccctcctctgccgcgctcctcctgcatcaatgacatctacattcacggcctctaccatcacatatcaaccggcaaatacaggctgctcttgtccaacattcacaagaaagaagccacattgtacgtcctcaccctagaaagagccaacgagttgaggagcattcaaatcgtcatgccaacactgcct

SEQ ID NO: 17159 - DNA, 460 bp, Triticum aestivum
  Clone ID: PAT_TA_17159
ccccccctttttccaccaacacgaccaagcacggttcatttcagccacacacatacagtacgagcgaggcaggcacataccaagcacggtccatttcagtcacacacatacgagcgaggcaggcacaactctggcgctcagctcagctcacaatggtctgcactctgcaccgcagtcatgccccagagttttacactacatatgtacagttacatagcagcagtgcaatcatcaggcagcttgcccgtgatacaccgtgcggctaccacttattacatcttcttgccaactcccacttaatcacttggcaggacgagtcaggccgccgcgtcgtccacctgctgcctgcgccgcttattggactccttgatcttcagcagctcgtcgcagacgttccacgggaagctccagaactgcttctttccaggccggcggtggtccgggtgataggtcacccggt

SEQ ID NO: 17160 - DNA, 767 bp, Triticum aestivum
  unsure (1)..(767): unsure at all n locations
  Clone ID: PAT_TA_17160
gccggccggttcgggactgcaccaataagccggccggtccgtgcgtgcgatccaagagtatcagtatactgtatacgtggctatagccatgctcgggaggagaaacaatgggccgccgacgacgtccaagccccgaccggacggcgcgggcctcgccggcgccagcaccgtcgtcgccgacggcgggcaggcggaggtggccgcgtcgcagttcgtcgtgcagctagatgaggcggctcgggagaggctggagcgcatgaaccggaggctgaggctgctggagcagcagatggagatgctggaggcggaggtcgggagggccagcagtaccgccgacgactaggagcagcggcgccgcccctggtcggagagacgatggatgcaagtagaagccttccttttcttcttttcccttctcagcttcttgctgatggaaggacacgcacggtgatagtatcatgcgcttgttaaggcgttaggcctttttcttgtagtgatggaagaacatgaccatgactatagtgaatcacggttgtattcctgaagctttttgccacatttttcctttgatccctgcttggtttgaggggtttgactgactctcaggctcgttgcggaaaagtatggcttcgtctccggtggaaaatggctgccgttccaagcatgcaagtacatgatggatctctgaattgtcgcttgatgtacgattacctcagcaccttanattaaagacttcataccaaaaaanaaaaaaaaaaaggccccta

SEQ ID NO: 17161 - DNA, 747 bp, Triticum aestivum
  unsure (1)..(747): unsure at all n locations
  Clone ID: PAT_TA_17161
gtcacaactcgccactgcaccaataagccggccggtccgtgcgatccaagagtatcagtatactgtatacgtcgctatagccatgctcggggggagaaacaatgggccgtcgacgacgtcgaaggcccgagcggacggcgctggcctcgccggcgccagcaccgtcgtcgccgacggcgggcaggcggaggtcgccgacgactaggagtagcggcgccggatgcaagtccgtgtacatttattccagtgctcaatcattgtctgtctcaaccaaacctaacatggcggtgcgaatttctgctaggagtaatcgaatgttaattggctggtagtggcatgttcaagtatggaaaatgatgagctcctacttctttttatgccaactctatttagtagagcacgggctgcctggggacggcgccggtcctgtaccaccgagggggtttcttttgtagttctggatacacaatttttcatgaagagatggctaccccaaggcaatctgaattaggaacacttcgttatgcacaactgttaaaggtcccgaagaatcctccaagttagttgaagtgaataggctgattgagatgcanataccagagagacttacaccttggacctgcttggcagcaaaaagatgaaccaaacccaatgtgattcaccatgtaggctntttttggtggagcagaatgacgnaacttctcacaatcagaggtagtgtagtatagcttaggactacagagctgc

SEQ ID NO: 17162 - DNA, 560 bp, Triticum aestivum
  unsure (1)..(560): unsure at all n locations
  Clone ID: PAT_TA_17162
agtaccagtggaagacgtgtgttccatagtaatctcctcctgaagaaaataggttgaatttcaaaaaattaagtggcacgatgacccgggaaccatacatccacctantcaaggaatgttgttgctgcaaggacgatggcccctagaggaatgacctcaagaaacagaaatcgacatttcgattttatataaatggaagtccaaaaggaccaacatacaaccatgttatggcacttgttggccgaatggcgcaggctaagggctgctattgagtagcgccacttnttcttggaatgagggactgtgggtagctgggcggcctggctgcttttgaaataacaagaaatttccttgggaagactcaaattgccaataaaccaaataataggagtccagccacaagtcaaaaactggtctcccaagctgttttgataagagtcccgtgttaatacagaaaaaacatgaacccagttcacccaactgncgaaaataatgtccactggggcaacgtgctcgctggaaaataaagtttgggngagttttatacaaggtacctcggg

SEQ ID NO: 17163 - DNA, 286 bp, Triticum aestivum
  unsure (1)..(286): unsure at all n locations
  Clone ID: PAT_TA_17163
accaataaaaacatttaagccatataattttatcaaactatccaaaaaccagtaagtctgtnccttgtggtatttcnncgattatcatggctagcctccaagcaaaatatcaatctcctcaggcaaccactgcacctcactggcctgccccacaccactacctcgcatgcggatgtcatcatcctctggttaaccacatcgccggtagcatgtatcacccactagccaaggccctagcagtggagaccggcacgtctctccttgcagatctcactcacccaccggt

SEQ ID NO: 17164 - DNA, 643 bp, Triticum aestivum
  Clone ID: PAT_TA_17164
tcgagtttcatctcgttcgtcattagcgtgagagagtcagtcgatggggcacgcggagtcgagccagcggggataaggcgatcgcaagggagctcgtgctcaaggtgtcgatgcactgccggtgcgacgggtgcacgcccaaggtgagctccgccctgaacaacctcgcgctggcaccgggcgtggtggcggtgctggaacggtcggcgacggaggacaccgaggaggtgcgcctgctggcaacggcggaccccgagcgcctccgcaagagcctccacgaggccaccggcaagaaggaggtcgacctcgtcttcatcccgcccaagcccaacaagcaggagcgatccggccgctggaacggccgcaaggaggaccctcggctcgtagactttgctgcggtccaggggctgctcgccgacccgcatctccacgaccaagggccgctgcccggccagcctcggtagaggagcacctccgtcgggcagtttcctccggcggagtacccatggttacctctccgtgcgctctctgctcggtccgtcgcccatgctggccatacataggcgcctttcgggacgtccctgcctaatgcgcccagcgcgccgggggccacagtgtggccacgcaactgatcggtcgagca

SEQ ID NO: 17165 - DNA, 270 bp, Triticum aestivum
  Clone ID: PAT_TA_17165
actttcagaaggtgttgttgctgctgctgcttcttgctgttcagatgagggaggttgctgtgcattccaagcagcaattgcggatgcagccagctgttcttccgttactttcatgagttcctcgctggtgtaaggcacggttgtttcaggcttgacatctaaaagcagaagcaataaaaggcagtggcacggattcttaaattcagcaggctgtagcaaatccatcttttaagccaagtaattgatttaagaaaaatatggtacctcggc

SEQ ID NO: 17166 - DNA, 779 bp, Triticum aestivum
  Clone ID: PAT_TA_17166
aattttcagtatacaccaagctccagctcagcctcggccttttacacgcgacaaactcgatatccacgcagccgcaatcatgacttccacaatcggcattcccatcaagctcctgaacgaggcacagggccacatcgttaccctcgaaatcacctctggccagacttaccgcggcaagcttctcgatgccgaggacaacatgaacgtccaactcaaggacattaccgtcaccgcccgcgacggccgcgtctcccatctcgaccaggtctacatctgcggctcccacgtacgcttcttcattgtccccgacatgctccgcaacgcgcccatgttccgcagccgcaacgtccgtggccgcggtgtcggtctcgccagaggtcgcgcgaccgtcagccgagcgcgcgcaggcggtcgaggaggacgataaacccaacaagagggaagaagagacgaataatagagagacaaatgcgtgttttggcgttcaggcttatttggatttttcatgagcttcaaacgagggggtttatcatcttcgttttcttggtaaaaatgaatcacaaggagaggggggagagtgatacaacaacaggcttcggtatgataccagtctagacatggaggacgagatgttgcattgattgtgaagctcgacgaggaatgcatgacctcgtggcagagtgggctattcgagattgactagattacaaaaaaagaggcgtctgtctgtcacgcctggtatctcgtcaccgtctattatatcgtctcagttgctttcg

SEQ ID NO: 17167 - DNA, 940 bp, Triticum aestivum
  Clone ID: PAT_TA_17167
agcaaaccgagcgaagatgcggcgcgagggacggcagcgggggtgggtgcgcgtgtacgaccgcgccctggtcgacccggagggcaagcgccgcgccgttcgcgccgtggacggcccggcggtggccaacggcggcttcatcagggcttcccggaggccgacgaaccagtcgaagcccggcggcctccgcgcgctcggcagggacgccctcgcgcaagcggaggaggaggagccggagccggagccgcagctccatccgccgctgggcgccgggtactccgggtactactgcacgacgacgtgccagtcgccgttcaagttcgaggccgtgccgtatcaatggaggtacgacgccttcgtgcccgaggaggtgcaggctcctcgtccgccgccggcggcggcgcgtttcgggggaagagcggcgtgcaaggggggccgcaagttcaagcacaacgagatcaagatgtactacgtcgacgccgccgaggatgtcgatgggcgcctcgattatctccatgacttgttataggatatgtaccgaataatgagtatgtacagaaatgttggttcttggttcttgcatggagggtgagcaaccatgggttgaaaatgctgccgccgcccatcacctggtccaattcagaacaaccagtagactgccttgaatgtcaggagttctcagcatttttattgatttagtttctactcccttcgtttctaaatataagactttttagagatttcaatatgaactatatacggatgtatatagacatattttagagtgtagatttactcattttgctccgtggtagtccatgttggaatatctaaaagggcttatatttaggagcggggggagtacacaatttggggcatccaaacttggaaagttccatcattcaagttaaattgggacaatccattaattaattgcaac

SEQ ID NO: 17168 - DNA, 829 bp, Triticum aestivum
  unsure (1)..(829): unsure at all n locations
  Clone ID: PAT_TA_17168
gcccgctcgaggggccggccgggccggggaattacanannnnnanaaaaaaaaaaaaaaaaaaaaaaaaaaaaaaccggacagaacccacgaagcaaacgagcgaagatgcggcgcgagggacggcagcgagggtgggtgcgcgtgtacgaccgctccctggtcgacccggagggcaagcggcgcgccgtgcacgccgtcgacggcccggtggtggccaacggcggcttcatcagggcgccccggaagccgacgaaccagtccaagtccggcggcctccgcgagctcggcagggacgccctcgcgcaagaggaggaggagccggagccgcagctccatccgccgctgggcgccgggtactccgggtactactgcacgacgacgtgccagtcgccgttcaagttcgaggccgtgccgtatcaatgggagtacgatgccttcgcgcccgaggaggtgcaggctcctcgtccgccgccgccgccggcgcggttcgggggaagagcggcgtgcaaggggagccgcaagttcaggcacagcgagatcaagatgtactacctcgacgcggccgaggatgtcgacgggcgcctcgattatctctatgacttcgattcatgaagcgcacggatggtcttctttttttttttttgaaattttcttcccctttgttttgcccaagatcagcagaaggaggtgtaaactggatcccgatggatgtgtatgcagtgcaggcgcttgctccaatgaagatcatgttgttattgtactcccgagtccatgaattttttaaacgggttgatcttctaattaaaagttaaatttttgtagtgaac

SEQ ID NO: 17169 - DNA, 465 bp, Triticum aestivum
  Clone ID: PAT_TA_17169
gcgacgcccatgtgtacagcacgcacgtccaagccttggaggaacaacttcagaagcagcccaagccatttcctattctgaagataaaccctctgaagaaggatatagactcgttcgtcgcgtcagacttcaagctggtctcgtacgatcctcaccagaagatagagatgaagatggcagtataaaccaaggagctaatcagcatccagcattcgtaacagcatacgacatactccttttaaaaccatgattcgtgacagaatctctaggcaacctttttcactgagcgattgatgccttggtggatccctgaccatggcataagctggctggcgaatgtgtgcaaaatagtgggatctttgttggttgctaccaatagcgactagcgagttgtttatttctcattttgcatttccgaagttttatgcagtgatggcagggtcatgttcctcgctgcttctagtc

SEQ ID NO: 17170 - DNA, 859 bp, Triticum aestivum
  Clone ID: PAT_TA_17170
cgtcccccaaattggaagctaggtttcctcgatcaaattctccccaattttggcggcgaggtcggttagtcgaggcgaaccgcggagatcgacggccggcgaggaagtagcggcgcaccaccagacgcatggcggcgaaggcagctgtgaccgccggcgatgtgtgtgtgctgaagcggtgccagcagcatggcggtcaagatctgaaggagaagaagggaaccaaaaggaaagcagaggaggcaccagaaggcgacgaatctccactggaggtctgctccatcagaaggaaaacagccgggatcgactgctctgagttggggcagggagccacaccggcgacggcggcggcagccaggcgcgaggaggctccggagagaaagatgacgaggctgccgcaggaggaggtggattccatcctaaccaaggagatggatgacgactctctccctcccgagtacaaggccctgaagcgccacaaccctgccctgattccttcgccggaagaggagatggacgaggacgtggtgagcttctacaacgtcgtgcgctttttctacgagattggagaggatttcagggaattccaggcctgggtccgcaccgagtacgccaagaatggctacgtcgaggtggatgatgactacctgcgccatcaacaggagatggaagcaatgaacgaagcagcacgcaaggaggcactcaaagccttcgatttttcagacttgctcgacttctgacatggtgcagcatcagcctatgatgattgtagatggattgcactttctctagtattatcatccagcgactgtattatgcaatcaatgtaataagaactcactttgtcgagtattcgatt

SEQ ID NO: 17171 - DNA, 1085 bp, Triticum aestivum
  unsure (1)..(1085): unsure at all n locations
  Clone ID: PAT_TA_17171
acctcccccagctcctcccttggtttttatataccacatactgacaccaaccaaggaaatcactagctgctcacggtgaggatgaccggagttcaggtgatgccgggggtgggcgcggtgaccacggtcgacgtgaggacggagggcggcaaggctgtggcggggctcgcgaggaggcgtgtggcggtggggagcagctccagcacgagcctgtttgctggtgactggaggaggaggcctcgccgggcgacctgctccgtcaggctcaggcagtgtggccggggcaggggcggcaggagcggcggcctcgccatcgtcagcaacctcgggggcagttacgatgttggcttcggcgacgtcgacttgcaactgatgaactacttcacctacaaagccgtgaggaccgtgctgacgcagctctacgagatgaacccacccagctaccgctggctctacaactttgttgctgtaaacaagcccactgatggcaagctgttcctccgcgctcttggaaaggagaggcaggagcttgcagagcgagtgatgataactaggcttagcttgtacggcaaatggatcaagaaatgcgaccacgcgaagatgtacgagaagatctcggaggagaacctggagctgatgcgggagaggctcatggagacggtcatctggccaaccgacgacaccaacacggagaagatcggctgatatgcatgcggtttcagtaatttcagccgctgaagttcattaattaattagctcatcggttaattaggtagagcgaggactatgcatgcacacacgattgagtcaaacatgtgtatatatatgtatgtgatctagcagagagtctatatggttgggtcttttggtggagatactgcaagctgtttgtgttggtgtcggtgtatgtatcatgtgccgcctgtgttgataggcacattgactagctgggttaaatgtatggatttagtcatcccccatcagtgcaaggggtgcgtttgagcccgaagttatatacaaatgctcacgtgttatccaaaaaaaaaaaaaaaaatattcaaaaaatgctcnancngngtttancg

SEQ ID NO: 17172 - DNA, 684 bp, Triticum aestivum
  Clone ID: PAT_TA_17172
ttattttctggataaacgcaaaaaaagaagaaaaatataagtatttatgctactacatggaccaagtttttcatgttgaagcccgtggagatgtattcaagatctctgctgtatggatgcgtatggacaaaggttctgcatatccttgtgtgaaaattgtctgcagcagcgcgaaggtggtgctgaagaaagcgtagcgtgttagttccaagtgaagaaaatgtggcgcaacacgaagtgctctgtgccatggtaaataattgttcagttctgtatttggagcattctgagaaatttacaaagataggatcttgattggtttaaaacagggaaaggaaaagggaaccaaaagttttttatgaaaaatgcaggctttagcagtgttttcatcatttaatactaaagtttgttcaaatatctggttttatggcaggtgcacgtatgaattcagatggtagtggtctccttctttacagttataagaataataaaaatattgataatggtctttccactattacaacctcatagattacattacctgcttccattagaaaggaattgtggctcatgggtttactggatgatctttttgatagacattttaaaaatagcatggtttaacacatgggctttttattactagtatcgaatatgtccttgaaaaatgaaattattttcatc

SEQ ID NO: 17173 - DNA, 468 bp, Triticum aestivum
  Clone ID: PAT_TA_17173
gggccgacgggaggaggttcagcgcggagttccagctcgtcttccgtctgatcaaggggctgatattcataacattcatctccatcatcataatcttaacagcaatcgcccacatgacagtccttgacatcttcgtctgcatcctcgccttcatgccaactggatggggcttgcttctgattgcccaagcgatcaagcctgtggtcgagatggtcgggctgtgggggtctgtgaaggctctcgcccgtggctacgagattctcatggggctcctgctgttcacgcccatcgcgtttctcgcgtggttccccttcgtgtccgagttccagaccaggatgctcttcaaccaggcgttcagcagaggcctgcagatctcccgtatcctcggcggccacaagaaggaccgagccacccggaacaaggagtacgtagaaagaagatcaaggctagctcccgcggactttgttc

SEQ ID NO: 17174 - DNA, 1998 bp, Triticum aestivum
  unsure (1)..(1998): unsure at all n locations
  Clone ID: PAT_TA_17174
tcgggttgcgctttttaatctttcaatacggtttcgtgtacccagttgaacctaacccagtagtatgaccaaattgtgttgggttatgtgctgctacgggatgtgattctgataatgctgcctgttatgaagggtgaggggatctacatgaagttgcgtcggcgagtgggtgatatagagagatcctcgaatggggacatcgcattcttggtggcaatcgaagatgagaaagtccttggcatcttcctcagtattctcgccttccagttcaaagaaccgggtttgctaatggttgcacttgcggtcaagaatgtggtcgagatgggcgagatatgggggaaagctaacactttcctttcttccaagtcgacagttgtggcacccccagtgttctcgccaatagcgttcctcggttatttcccattcgaggcgaagtatgatttctacagtttcgggagtaatgcttttggcaatggccaacttttctcgtgtattgtcggcggccagaagcttatccaagtcatccgggtaatagggattaggcaacaaacggcttgagggttagctagaggttgatctgctgatttgctgtcatattatctttgctgcttggacaccaatcctagacattcaccttcgttggaatatcaccaagcaattctaatcagattgctgcggctacgagctactgggtgtctctgacaatttttgagtcaaatttttggataaaggtatagacagaaggaggatacaactcccgctgatacacctcgttccacctctttcatgtggcagcccgtccgtgatgtattttagatttctgctgtatggatgcgtatggacaaaggttctgcatatccttgtgtgaaaattgtctgcagcagcgcgaaggtggtgctgaagaaagcgtagcgtgttagttccaaatgaagaaaatgtggcgcaacacgaagtgctctgtgccatggtaaataattgttcagttctgtatttggagcagggtgggggtgattctgagaatcacaattcactgctcccattggtgtccgagttccagagctggatgcttttcaaccaggcgttcagcagaggcctgcagatctcccgtatcctcggcggccacacgaaggaccgagccacccggaacaaggagtaggtagaaagaagagacggggcttggcctcgcggactttcttcattcacctagtattatcggtgtcgctcgcccccgactcttctagattctgctgccacgattgttccccatgcgtttctaatttgacttcatccagagatcgggtggccgtgctataggctacttagtagtgttctcccatgtaggtgtagattcagagctgttgcgactgcgctttatgtacagatctactactcctttgcgtggctgctgaaccttatgtagacttgtaggattaggttccgaagtcatgcctttgccttactattgtgctaatactggatgcaacattgtggacctttggttcgagcatggccagcatggccacggattgtaggggaggaatgtattgcctaatgagttgtatgctttcttcggatcctctgtgcttcctatcacatctaacttggccacctacagattcttgggtccaggttcctgatgtgaagcagagggaacacgaggtcacattcgcaaagtggcagaaggggctgcaacgtttttcttcagtctgataatcatatagtaattagatggtgtattactattggcggtggtatactgacttggtttggaagggttctctaggctntaagatctttctaggataattgcgtcattgaatctggaaggtttatgcgatctcctgtgttgctgcatggttgatcttcttgtttttgttgtaacctctgttttgctgctcgaggaccatttcctggattaatatcttacctgggagacctaggagtccacccgaattcagtctcctgggaagccgttcattccaggatccaccaaaattc

SEQ ID NO: 17175 - DNA, 409 bp, Triticum aestivum
  Clone ID: PAT_TA_17175
tagcgtggtcgcggccgaggtacatattgcagtcaggcaatttaggtaaactaaacagggcaaagcagtggcaaataccttaaaactacttcatcaatgatgactcacatgatacaaaagaagtagagtggaccaagttactaatccaagaaggttctaggatgtcaaccaaatgatttggccatcaaaggtaacaatggcattgcagggaaagaccttactaaaccatggattaaagcagatttatccagcaaaatctgaaatgtcaccggtctatcagattcaaacagtttatcaatttctaaagcagcaggtctatcagattcaaacagtttaccaatttctaaagccataaacacaacaatcatgaacaaaactaacactgtacctgcccgggcggccgctcgaa

SEQ ID NO: 17176 - DNA, 688 bp, Triticum aestivum
  unsure (1)..(688): unsure at all n locations
  Clone ID: PAT_TA_17176
cggacgcgtgggcggcgtgccggggcgagacgccggccgccacgccgtgcttcgaccgctcgctcgtcaagatgcccgccggcgacgagctggccagtgatgttctgcggaagttcgctcccaatttgccctcggtggcactagcatcatcggtcttcgaagaccgaaagcggctcactcgccgaacgttcaccttggacgaaggagacatccaacgcctgaagcagcgcattgtccacctcaatgagtcgggcggcacgcccctgcctcgcccgccgtctgctttcgcggccgtcgtcgcgcttgcgtggacgtgcttcgcccggtgcaagtccttctccttggacgacgacgtgtggctcttcttcttcgccgacatccgcgagcgccttgaccctcccgtcggcgcggggtacatcggctcatgcctcaccaagtgcttggcaaggctccccgcccgggagcttcatggcgagcgcgccctggcggttgtggcgtcggcggtccaggacgagatcaacaagatgaaagaagacctatcgctgggtggaatttcttctcattcgatcccatgccttccatggaccggctgatgaacatataagctcgtcggctttatgnanaaagttgccgactcgggtggggaaaccacaggacagaccgttaggtgaaanaacggtangnggan

SEQ ID NO: 17177 - DNA, 636 bp, Triticum aestivum
  Clone ID: PAT_TA_17177
gccggccgggctgactacagaaacacataagcacacactgacacacgatcagtagcagagaagacctgagttttctctaagcttggagagcagaggaaagaaagaaagaaagagagggacggggaaattttagtggtgtagaagcttagcagagcatcaatggggttttgctgtgggtgttcggatgtcaaggtgctccccaagaacaactccttggcttcctcgccctcgccgtccgctaaagattccagcgatggcgccaagaagaagcagcctcaagccgtaaagaaggaagggaaagagaagaaaaggagcaaccttgaccgggccgccatggcgtcgccccgcctccccttccattctcgacccggcctaatgtaatagagtttgcagattttcagaacaatagtgcatacaacatacaatcctgtaggttctcttattagcttacgcccgggtttgcctcggttgttccgctgaagatttcatttgtactgtgtccacgtgtactgttttattcatggacggtcggttgatccaattgctggtgttcttgtcaacttactagtagacattacattcattgtcatcatgataatatttgtttccctactttcgtcttggattgttattccg

SEQ ID NO: 17178 - DNA, 1308 bp, Triticum aestivum
  Clone ID: PAT_TA_17178
ggcgcgtcgcgcggtgccaccccggctccaccccgctccatgccacgcccttcactgccacccacgggcctgtcctaagtttgctcgcttccattttcctcgcccgacttcttggtttagtcgcagatgccccattcacagacccctgtgaaacttttccacgctccccccgctccacatcctccccgtttgctgtcggcccggcttcatcgaaacatacaggacgagttgttaaaggacgtagccggcgaggcccggggacgcttgcgcataaaacaatataatgaccaagaagagcatgtgagggaccagtaggtgtttatcccgagtgatttcagtgtttgtcaagtctcattaagcttgccaccttgctttttcttgagcacatagcaactgaagaagagatgaaggcaactgaacaacgtgctcgcaaagtgaagggttcttgcaagaagaaagaatcgttgtcatcttattttcatgatggcatggtgtctcgacatgtgatggattcactcacacggaggaagcttttctccgctactccggcgacaagcgcacaagcttttgggtccatggcgccaccggtaaacaagaacaactctgggtgcttgattgtgtctctggagtctggataagtgagaaatagctgatggcagcgaagttgaactggttttgcaaacactagcaagtatttcttcatcgcttccatcgtgcaattgattctgcgcaggttgcgctagcattgcgggcatttttcttcatatttgtgaagaggggatgaggttgaaaaatgaagctggtgatgaaaagaatggagggcacccgcaaagtgatgacgaggaaggagccctgcaggagacagctttcagagcttgaagaagatggtctcacatccacgttgatctatgaaaatagcaagcgacggcggcgatggactggtcaccccgcaacaccattcttccttcacggtaactagccacggcaagtgcttctgtcatttctttcgtgttgagaaggcagagtcaagggcgcgaacatgaggtattctgtgactttcttcggagaggcacgaaagtgcaaaggtcgtgatgtgtaacgatttaatcaaggagacaacccagtcgagctatcaagtattaggctatactaacctaactaagaagttttattatctcgcattgcatcttgcttgatcaacacatgccatggcctggctgttgcttgtcttatcttgccagggactgtctggccttcctttgggactaaagccttttgggtctatgtatagcttgattttgggactga

SEQ ID NO: 17179 - DNA, 324 bp, Triticum aestivum
  unsure (1)..(324): unsure at all n locations
  Clone ID: PAT_TA_17179
acttaatgtcggctgatcagagtcatctactcagcaaccaaataactangccactacatagttccttgctgcattatttttcaaaacagcatgcctgtcttcatcccgtgcannctngaatcacctctacccagtccaattgaataaccgaaactctaataacagaatctcactgcataggttaaaattttcagtgaatggtaaccgcactttctgctttgctgacaagtaacccaaaagctgagaaattgctgaagttctcctcctgtttccagcaccagcaggncgacctgagcagcaacatgagggagatggggctcgggt

SEQ ID NO: 17180 - DNA, 1456 bp, Triticum aestivum
  unsure (1)..(1456): unsure at all n locations
  Clone ID: PAT_TA_17180
ccgagcggccggccgggcaggtactcccttggaattacttgtcgcagaaatagatgtatctagactaatttgacaggtgcacagcctaatttgacccgttccaacacgggctttttcttccagcatttgccatgacccgggttgaggttcaagtttgatcctctagctttttcggttgcgtccgtcgattcgtctgccatggaagggaggaggcgttccttccgcccacggacgtgtgggactgggaggtgctgcctgacgagcactggagcttctacgccgattccagggccgcatcccgtggccacgacggcggcgaggtccttgccgatcacgaaaccgaggaaccgatcctgcctcgcccgtcacaagtcgccgctgataatgttgacgagtgcaaggacatcggcgtcgacgccaacgtcgtgccggccggggccagatcaacccaagaggatgaggaacccgcggcgccggcagctgcttagtctctgacggcgacggagaggagaagttccagccctgtgtcgacgccaaggaggtggacgatgatggcaagcagatggcggcggcagaggcagtggagtcagagcttcctcctcacgagttcgccgcgggagaggaggaagagggcaagaaggaggaggacggggcgccgccggagtgcgtggtgttcagcgtggggaagctgcgcgtgaacgcggtcggggcgctgtgctcgttcggggtcgcggcggccaccgtctgcgttttcctcgtcggcggcaggctgcagcaccagaagcagcaccagcaccaccagcagcagaagatccagctgcagttccttggcgatgataagagaattcagcaggtggtgcagcagacatcgaggctgaaccaggccatgtcatctatgatgggggcaggcgcgtccacaagggccaacatatcgttcggtggcttctacgacggcttctgatccacccgcccgtgattcaactctcggatcaagcacaagctgctggattcaactacgtagatctgatgaagaaaaagctagctcatgttatagcaaatcgacagccttgttagtagttgtcatgtactccaacgtataacatagatcacgccacctgcaaaaacaaaaaaagacatagatcacgtgtttgtacataatgcacgatatactggatgtaaataattgggagtgttggaccgtggccggggccggctgtatgtgtatgcacatgaggatggattcattaatagatttgttattaagttcataaaaaaagaaacacaagctatccggccatccttcttcggccacgtgcagcctgcctgttgcaacccttatcctgctcctccgtccttgcgccgcggctctatccgtcacacggtctnaacncnacaacnctcgacactcgtcaagngacgnaaaatnccnttcccgccccgtagaggatatnncngc

SEQ ID NO: 17181 - DNA, 611 bp, Triticum aestivum
  unsure (1)..(611): unsure at all n locations
  Clone ID: PAT_TA_17181
gcccgaacccgggcgcaaaacccgcttcccctccggctcgattcgatccttctccgtccccccgaccatggcgtcctcctcctcctcgcaattcgacgatccgtcggcgaggcgcccgccgccgccgcagaggaagccgccggtgctgatgctgctcccgctcatctacgcccccgttctgcccctcatcaggatcgggctgcggcataacccggtgtggagggaccgcctcttctatggcgtcctcgccggcgcattcgtgcatggcacctacctcatatcggaactgtacgacgtggagagcaagtgaatcaagccctccaaagctcaagctatgaatttgcgacagcaatttgtgacgattgcaagtctacgattgatgaaggggtgactggtttttcatattagcatgtttgccctctacctgtttctattaatttgattcaaggtttgtgtttgatatgctgatagaatgcttgggcacacaaaataatcttgactgccagagcaatgcacctggcaacacttgcaaattctctattgatctcagttatctattcctccttaaggtgttggtctgtttgttctcatgtgttgnnanttgttttcnn

SEQ ID NO: 17182 - DNA, 616 bp, Triticum aestivum
  Clone ID: PAT_TA_17182
cccacgcgtccgatccagccccgtatcagcaacagctgctcaaccgtacgcaccgtccctgtgtactcagaaacagagagttaaactaggaatacgtctatggcgacgatggtgaaggcgatggtggtggccgtgctgctggtccagtgctgcaacgtggtcctcgcggcgaggctgctcgagggagacggcggttggctacacggcgacgttggcgccgcaggggcgcttatcacgcagatcctggccggccactcccccggagcaggaacacccaacccctgcacccacgaccccatcaacaacaacccgcctggcgcggtatgccacggctagccgccggcagagttccattggtcaattgcatgcgtacatgcgtagataaagttcgtccggtttgaccgattttttgttcatttgttacttcattctctaaatgtaattatagggcttccgtgaaagtatggtgccctaccgctagtttttttcaaatttggttagttttagtacatgaatttgtaataaagtaatctttgctgtagatctgtaacaactgaccaaactgtataaagatcttcataattctattcaaaaaaaaaaaaaaaaaaggccccta

SEQ ID NO: 17183 - DNA, 617 bp, Triticum aestivum
  Clone ID: PAT_TA_17183
ttcaagctcgtcatttcatccatcactccatccgacgtacgtagatttcggcccgtctgaaacactcgctcaaccaatccgtccatccgtacgtactccgagactcagaagttaaaccaggaagatttgcatggcgtcgtcggcgacgatggcgagggcagtggtggtggccttgctgctgatgcaattctgcgacgtggtccttgcggcgaggctgctcgagggagacggcggttggctgcacctgcacggcggcgttggcgccgctggggcgcttatcttgcagatcctgcccggcggctctccgggagcgggagcacccaacggctgcaccaacaaccccaaacaccctcccggtgggaaatgccacggctagttgaccgccggccggcagagcacgattagtcaattagttcatgctgcgcatgcgcacatagagttcgtgttcattgattcgttctttctttagttgtacagttagagagcttccgtgaacaaatggagccctggaagcagttccaattttagttagtttgcgaaaatttgcattaataggtcatgtaaccatgttgtataggtgactttgatattctattcattatgactgacaatgaata

SEQ ID NO: 17184 - DNA, 724 bp, Triticum aestivum
  Clone ID: PAT_TA_17184
tttgcgtgacttatagaaggccggccgggccgggcaacaaccacttcaagccaggcattcatccatccagccccgtatcagcaacagctgctcaaccagtaaaaggaatacgtacgtatatggcgacgatggtgagggcggtggtggtggccgtgctgctggtccagtgctgcaacgtggtcctcgcggcgaggctgctcgagggagacgacggctggctgcacggcggcgttggcgccgccggggcgcttatcatgcagatcctgcccagcggcacccccggaccaggaaaacccaacccctgcacccacgaccccatcaacaacaacccgcctggcgcggtatgccacggcggctagccgccggcagagttcgactactcaattgcatgcgtaaagttcgtccggtttgactgattttttgttcatttcttccttcattctctaaatgtaattatagggcttccctgaaatgatggagccctggtagttgttacttgtttcagatttggttagttttcgtagtacatgaatttgtaataaggtagtctttggtgttggtccgtaacaactaaccaaagtgtataaacatcttcatatttctattcgtatgatcgtatccatgagtgaaagatgttgctcatggtttggaaaaaaaaaaaaaaaaaaaaaaaaaaaaaaaaaaaaaaaaaaaaaagcaaaaaaaaaaaaaaaaaaggccccta

SEQ ID NO: 17185 - DNA, 679 bp, Triticum aestivum
  Clone ID: PAT_TA_17185
gccggccgggccgggaacaccatcttcacacttcaactcttcaagcacgtcgtccattcgccgttcctccaacggacgcacgtagagctcaacctgtctgcaacattctctcaacgaatccgtccatccgtactacgagttcaactaagaagtagtatatggggtcgtcggcgacgatggcgagggcggtggtggtggccgtactgctggtgcagttctgtaacgtggtcatcgcggcgaggctgctcgagggagacggcggttggctgcacggcgacattggcgctgccggggcgcttatcatgcaggtcctgcccggcggctctccgggagcgggggcatccaacggctgcaccaacaaccccaaccaccctcccggcgggaaatgcaacggctaagccgccggcagagctccactagtcaattagcatctgatgcatgtacatgctgcacatgcgtagatagaggtcgtgttcattgattctttctttcttcaattgtaattacatggcgcccgtggaaattttggagccctggagttgttcaggtttagttagttttagtacagggatttgccataaaagcagtctcacacgtaggtcctgacgtcctgtaaccaagtactttgacacattattatattcattacgacgctaaaaaaaaaaaaaaaaggccccta

SEQ ID NO: 17186 - DNA, 676 bp, Triticum aestivum
  Clone ID: PAT_TA_17186
gccggccgggtcgggaacacttcaagcaaggccattcatccatcgtacgtgcgtacgtagcccagctagccctctatctgcaacatttgctccataccgtacgtaccgcaggtgtactctcagagactcaaaaagttacaccaggaagatttctatggggtcgtcggcgaagatgacgaaggcggtggtggtagccgtgctgcaacgtggtcctcgcggcgaggctgctcgagggagaccgcggttggctacacggcggcgttggcaccgccggggcgcttatcatgcaggtcttgcccggcggctctccgggagtgggagcacccaacggctgcaccaacaaccccaaccatcccccaggcggggcatgcaacggcgggcgctaagccgccggcggagctcgactagtcaattagtgcgtgacgcacgtacatgcgtagatagaggtcgtctctctttttcaggtctcttgctcgtctggtttggttgattctttgttcattggttccttcattctttcaaatgtaattattttagggcttctgccaaatgatggagcgcaagaagcagctcaaatttagttagttttagttcatgaatttgcaataaagttgtctctcacgcaggtctctgtgatcactaacgaatgtgcataaagatctttgcatttctttac

SEQ ID NO: 17187 - DNA, 734 bp, Triticum aestivum
  Clone ID: PAT_TA_17187
gcaaggcattcaccaatccacttcaagcaaggtcattcatccatcgtacgtgcgtacgtagctcggctagccttctatctgcgacatttgctccatatcgtacgtaccgcaggtgtactcagagactcgaaaagttacaccaggaagatttatatggggtcgtcggcgacgatggcgagggtggtggtggtagccgtgctgctggtccagtgctgcaacgtggtcctcgcggcgaggctgctcgagggagaccgcggttggctgcacggcggcgttggcaccgccggggcgcttatcatgcaggtcctgcccggcggctctccgggtgcgggaacacccaacggctgcaccaacaaccccaaccatccccccggagggccatgcaacggcggccgctaagacgccggcggagctcgactagtcaattagcatgcatgtgcgtgacgcacgtacatgcgtagatagaggtcgtctcgtgttcgtctggtttgattgattctttgttcattggttctttcatccttttaaatgtagtattttttggggggcttccgtgaaatgatggagccctcgaagctgttcaaatttagttagttttagtacatgaatttgcaataaggttgtctctcacgtaggtctccgtgatcactaaccaatgtatataaagatctttctgtttcttttcataaccatgagtggaagattgttggatttcggaaaaaaacaaataaaaa

SEQ ID NO: 17188 - DNA, 587 bp, Triticum aestivum
  Clone ID: PAT_TA_17188
agaatctagacacaggatcagcagccttggctctcctcccctataaaacgtcagctgaagaacactagaacagagtgagctgagagagcagaggaaagaaaggaagaaggggaaaagatagtgcagcattagctttagcagggcagctatgggattctgctgtgggccttccgatgtcaaggtgctcccaaataacacctcctcattgtcgtcaacgtcttcctcatcgtcatcacccgctaaagattctgccgacggtggcaagaagaagcaacagcaaggtgtgaagaaggagcgggggagggagaagaagaagagcaaccttgaccgtgccgccatggctacgccccgcctccccttccattctcggcccggtctcatgtaatgttaaccgggaacaacaatgtgtgcatgagatcccgtatgttctcctattagcttacgatcaaggttggagcttaggttgaatgagatttctactgtcgtcacatgttctatttattcattgatgattggttggttgtattccatgattcaaattgctggtgttttctgtcaatttacaaaggatgaagttcattgtcacc

SEQ ID NO: 17189 - DNA, 654 bp, Triticum aestivum
  unsure (1)..(654): unsure at all n locations
  Clone ID: PAT_TA_17189
gccggccgggtcggagaacatacacacacaccggatcagcagcggagaagagctgagttttacgtaagctgaagagagcagaggaaagaaaggaagaaggggaaaagatagtgcagtagtaggcagccatgggattctgctgtgggccttccgatgtcaaggtgctcccaaataacacctgcttgtcgtcagcgtcctcctcatcgtcatcgcctgctaaagattcgggcgacggtggcaagaagaagcagcggcaaggtgtgaagaaggagcaggggagggagaagaagaagagcaaccttgaccgggccgccatggcgacgccccgcctccccttccattctcggccgggtctcatgtaatgttaaccgggaacagtaccatgcatgcataagatcccgtgtgttctcctattagcttacggcgaaggttggagcttaggattgaatagtttcggctgctcggttgaagttgtgagatttcactgtcgtcgcatgttctatttattcattgatttgctggttgtattccatgattgaaattacgggtgttttctgtcaatctacaagatatgatattcattatctccnnnnnnnnnnnnnnnnnnnnnnnnnnnnnnnnnnnnnnnnnnnnnnnnnnnnnnnnnnnnnnnnn

SEQ ID NO: 17190 - DNA, 654 bp, Triticum aestivum
  unsure (1)..(654): unsure at all n locations
  Clone ID: PAT_TA_17190
aaaacataaactacgcacccggatcagcacagcagcggagaagacctgcgttctccgtgagctgaagaaggaacacaagaatagagtgagctgataaagcagaggaaagaaaggaagaaggggaaaagatagtgcagcattagcttcgggctttagcaggacagccatgggattctgctgtgggccttcggatgtcaaggttctgctgaagaacacctccttcttgtcgtcaacgtcctcatcatcgtcatcgcctgctaaaggttcgggcgacggtggcaagaagcagcaccagcaaagggtgaagaacgagcaggggagggagaagaagaagagcaaccttgaccgggctgccatggcgacgccccgcctccccttccattcacggcccggtctcatgtaatgttaaccgggaacaattagcttacggccgaggttggagcttaggattcaatagcttcggatgctcagttgaagttttgagattcctactgtcgtcacatggtctatttattcattgattggttggttgtattccatgattcaaattcctggtgttttctgtcaatttacaagagatgaagttcattgtcacccggatgctatttgtttcccnnnnnnnnnnnnnnnnngnnnnnnnnnnnnnnnnnnngg

SEQ ID NO: 17191 - DNA, 693 bp, Triticum aestivum
  Clone ID: PAT_TA_17191
gccggccgggccgggaacagagtgagtggtagtgaaacatacacaccggatcacggatcagcagcggagaaaagctgagttttacgtgagctgaagaaaccttgatcagagtgagctgagagagcagagggaagaaaggaagaaggggaaaagatagtgcagcagtagctttagcagggcagccatgggattctgtcgtgggccttccgatgtcaaggtgctcccaaagaacacctcctgcttgtcgtcaacgtcctcctcatcgtcatcgcctgctaaagattcgggcgacggtggcaagaagaagcagcagcaaggtgtgaagaaggagcaggggagggagaagaagaagagcaaccttgatcgggccgccatggctacgccccgcctccccttccattctcgacccggtctcatgtaatgttaaccgggaacaacaatgcatgcataagatcccgtatgttctccaattagcttatggctaaggttggagcttgggtttaaatagcttctgttgttaggttaaagttttgagatttctactgtcgtcacttgttgtattttttcattgattggttggttgtattccatgattcaaattcctggtgttttctgtcaatttacaagagattaagctcattatcacaaaaaaaaaatttgtttacctaaaaaaaaaaaaaaaaaaggccccta

SEQ ID NO: 17192 - DNA, 1678 bp, Triticum aestivum
  Clone ID: PAT_TA_17192
cccacgcctcccaaataatctcgtccactaactccctcccctgcctatccactctgctccatctccagctccaccgccatggatttatcctccctagcgaggccgcaggcgctccgcggcggctccacgggcgctctgggcgcccacgccgcccgacgccgctccgtccagctgctccacccgcgcaggcccacattccgctgctccgtcgaggcagccaagcagcaggtgcaggggacgctagcggcggaggcggaggcggcgcgcaaggaatgcttcggggtcttctgcaccacctacgatctcgaggcggatgaaaagaccaagtcctggaagaaattagtgaacgtttctgtgtcaggtgcggccgggatgatatcgaatcatctgctcttcaaacttgcctccggtgaggttttcggacaggaccaaccaatagcacttaagttattgggctcggaaagatcattacaagcactcgaaggtgtagctatggaactggaggattcattgtatccattgctaagagaagtcagcatcggcatagatccttatgtgatcttcgaagatgcagattgggcccttctaattggggccaaacccagaggacctggagtggagcgagctgcgttactagatatcaatggtcaaatcttcgctgaacaggggaaagcacttaacgctgtggcatctcggaatgtgaaagtcatagttgttgggaacccctgtaacactaatgctttgatctgcttgaaaaatgctcccaacctaccagcaaagaactttcatgcattgacaaggttggatgaaaatagagccaagtgtcagctagcgttaaaagctggtgtgttttatgacaaaatatcaaatatgactatttggggaaaccattcaacaactcaggttcctgatttcttgaatgccaaaattaatgggaggccagtaaaagaagtcatcaaagatacaaagtggctagaagaggatttcactataactgttcaaaagcgtggaggtgtgctcatccaaaagtggggcagatcttcagctgcatcaaccgctgtttccattgtcgatgccatgaggtccctcgtaactcctaccccggaaggagactggttctctacaggggtttatacgaccggaaatccttatggcatagcagaagacatcgtattcagcatgccgtgcagatctacgggcggggcttgctaggacaaaggtacgatggtggctatggaaactttctcaaagggtgtgggcgaaggaacgagattcttatcggggccggatcaaaaaagagtcacgcagaattgatggctagagtaaaggatttggtgacctaccttaggatacaagggtacctggtatgagaattagtgctactacaaacgatgatactagagatatgtagtgctcctccagtcgatcatattagcattatgctagcaacctgccaaatgctaccaggatgtcatgtgattattagaaggcaaccttcccaacgccaactggaagaaggatagttgagagaaacgactgcttgcaggctgcggcagctatttatcttgtgtgtatttaataagcacgcagacttttgttgtgcactagtaatatacgtataaagcaaaagaattttcataataaaaagggcaaaaagccatatggagcaaaaaaaaaa

SEQ ID NO: 17193 - DNA, 1219 bp, Triticum aestivum
  unsure (1)..(1219): unsure at all n locations
  Clone ID: PAT_TA_17193
ggtaactggtgttgccccctcccttggaatctctcagatttatggcatagccagttctccatcccgcagttttcgcatgttgcaacgcactggctcttttgtaggaccatcgtcgacatagacaagttctgcttcaaggacgagacatagaagaaggctcaacaagaggaaggaagcaggtgtggtttagcaacgtacctcatacatggttggttgctgacaaaggagggcagaattggattacaaaggctaaagggacatgaaaaagacaaatagcggactacatcagcttccactgctaacacctctaccattgttgaatcccatttgaagcacatgtttctctattttcccagatggtaccatctggctctcgcactagagtttttctggatgttggctttggagtaacaagttttgggccatacttaatttcacgtgaatttgagcatggtgttcctgcaatggtggcaactcatttgtcaacggctattatccaatgttcccactgtagaataaattcaacatgtgatggtgagctgagatatagtcatgcttcgtctaatacacctgaatccttttcttgatgatccacttaattatcataatttacccaaagatggacttagctggataaattatgataaaagtaattaaagtggaattctgctctggaggtaaatagagtgtcagaactggcgagtactttccttgttcagcacagcctgtttataagcatgacaagtccctacacgcggcagggaatgctatgctccttcatactatcatgtaagacatgtgatggtgagctgaaaaatggaggacctagctctcaaacggaccatgttgggagattgtgaggaaaatatgtttctatgtggaggaagccttttataattaactcatggtacatgagtcgtgatcctagggtcaaacatccactttgtgatactgatgataattccagataatgtctggtattttcaaccccacctggcatgcttttaattgttaagcctcaattcaaggactaaattcagaatatgtattaagaaagtagtccatactttttttagatttgttttgaacatttgcataattatgcaattatctcttgcaaagtgtagtctcatgatttcgacttatttttttgttgatgagtgaatgtgtgatacgtaaaaaaaaaaaaaaaaaaaaaaaaaanaaaaactcagactag

SEQ ID NO: 17194 - DNA, 805 bp, Triticum aestivum
  Clone ID: PAT_TA_17194
ttagtgaaaaggggtttgcacaatgggaattggatttactatacagacatcatgcatgttccaacctttttgtcatgtgtcgccaccttggaatctctttccagcttggtccaatcgctcccaagaatgattgttatggatgaaattgggaggcaggtagagctttcgcttgaagccgcaagcttagctcaaaggaacgccacacttggaataggtgactcttctgcagtgtctgcaacgagagcgagggctttggccgaggacgcatttttccatccgtccattatgtcaatcagttatgcttccgtggagcactacttcgccatttacatgccattctttgcgccagtgtgtttgcatgtgctgctggcggcgatcaaagagctgaaacggtacaaggtggagcgggccaagtactcggcgttcctcctcgcttcccagtcccgggcgacgacttcctcctgatcgatccatccatccatcaaacaatccatcatcggtgacaggctgcaaagcattgctgactgctccgcgcttggcatcgtcatccatcgtcccacggagtctgacaggtgaccgaaggcagtagataatgatgatctgtagtggcatcctaggcagacgagtagggcttgcgcgcatgtaaatctgtataacttgcaagtatacggtggattttgcttgcttatagtccgggctgaggacccacatttttgttcgtaaaagaagacttgccctctcacatgaagaaatccgtgtcaatttccaagttcgccgtttttttccccttttggttgaatcaatc

SEQ ID NO: 17195 - DNA, 469 bp, Triticum aestivum
  unsure (1)..(469): unsure at all n locations
  Clone ID: PAT_TA_17195
acagaggacccttccaacgtgccaaagattagcacatggagctnccggngccggacggcccaacctcaccgccaaccgaaaagcgcacgatggtgcatggagtcaccatccatgttggatcggtggaggatcacatcaccacacgttgtcacagcttcactttctgtgtttttgatatggttgatggcaccagcccttctcctttcgaagatggaggtcacgggtttgcagggggcaggcttgagatttttagatttaattgtttgaatacgtatatttcatttcatattgtgtcaagtcttgcgtactactccctccgctcnatccgtttcaaatttgtgaacggaggggtgcttcatatgagcttctatctataaacttttgtccgcaatntaaaaaaaaaaaaaaaaaaaactcgagactagttctctctctctctctctctcctcgtgccgaattcggcacgagg

SEQ ID NO: 17196 - DNA, 855 bp, Triticum aestivum
  Clone ID: PAT_TA_17196
gccggccggtgcggggtacagcacaaaaaccgcaagcaacgcacgcaacaaggactcgatcgacatcgaagctcgagctaaccttggcaacttgctacaatctctctctttctctctctctcgccgtcaaacgtgatcaacgtcgaccgagcaactacacccagctgcaaggtgcaagcaagctagctagctcgacagttagcaatggaggttaaggtgttgggctccaagctcgtcaagcccgcctacaatgccggcgccgcgccggcaccttccaccgagtacatccctctgtccatcttcgacaaggtgacgttcaacatgcagatggccatcatctacgccttcgccgcgccggcgccatccacggccgccatcgagaatggcctcgccacggtcctcgcccagtaccgagccttcgcgggccagctcggcgaggcgcccgacggcacgccgtccttcatcctcaacgaccgtggcgcgcgcctggttgaggcgaccgtagacgccgacctcatcgacatggcgccagcgaaacccacgccggagctgctcaagctgcaccccgacctggaggcggagcacgaggaggttgtgctgctgcagctcacgcggttccggtgcggctccctcgccgtggggttcacgtccaaccacgtcgtcgccgacggccatgccaccagcaacttcctcatcgcctgggggcgcgccacgagaggcctccccatcggcctccctcccgtgcaccacacaaggacctcttcaagccggtcgtcgcctcgcgtggagcacgaccaccgcaacaggcagtactacctgccgtcgcccaccgacgtcgtcggtcaccacggcgat

SEQ ID NO: 17197 - DNA, 286 bp, Triticum aestivum
  Clone ID: PAT_TA_17197
acaaggctcttctcttgtggaactagtaaccacggtgattcccacttggtcgagtggaatgagactgaaggagctattaagaggacatataatggcttcaggaaacggtcactgggtgttgtccagtttgacacaacgagaaaccattttttggctgctggagatgatttcgttgttaaattctgggatatggataacaccaacatactgacaacaatagattgtgagggtggactgcaagcaacgacccttctctattgattctcaagcacgggcttgcaggcag

SEQ ID NO: 17198 - DNA, 549 bp, Triticum aestivum
  unsure (1)..(549): unsure at all n locations
  Clone ID: PAT_TA_17198
aagacnttgcttcaccactttgggcgcgaagccccttttggtgcaacccacattgtttgtcagcaggccttgcagtgcaccaaacttgacgcgggatgcaaaccggatagccaatcagatagcctaatccgatcaaaaccatgtggttcaccctcgttatcccgtcaagcgacttagcaccggagaagagagaccttgctccgaatgcgtccccgaacgccaggctcagagtgtagaagctcggaaccaggaacgccgaggtaccaaataggagcagcagcgtccagatgctcgacagtgccataaacatcgagtggtcctcctgccctcggcgtctgcatacgccgactgccgcttgaggctgcagcgggggtattttacgaccgacggggagccgtagacccggagcttgagctcaactttgtcgaacatgtcgtccacaatcagaggctggccgccctgccaggaagccctggcctggcggtagagcgcctcgagcatctcctggctggcggtctcgatgggcccgacgtagaggcacgacggccc

SEQ ID NO: 17199 - DNA, 449 bp, Triticum aestivum
  Clone ID: PAT_TA_17199
ctcctccgtgggcaccatcgcgtacatgagccccgagcgcatcaacaccgacctcaacgacggcaactacaacggctacgccggcgacatctggagcttcggcctcagcatcctcgagttctacctgggccgcttcccgctcggggagaacctggggaagcagggcgactgggcggcgctcatgtgcgccatctgctactccgagtcgccggcggcgccgcccaccgcgtccccggagctgcggagcttcatcagctgctgcctccagaaaaacccggcgaagcggccgtcggcggcgcagctgctgcagcaccggttcatcgcctcgccgccgccgcagcagccgcaggccctcgccgccccgccgtgctgacggctcccccgccgtaaccaagttaaattcggagggatcatgggtggacggtggccggtggcgggacgtgggatct

SEQ ID NO: 17200 - DNA, 751 bp, Triticum aestivum
  Clone ID: PAT_TA_17200
gccggccggttcgggatttcttcttagtgagaaaccatcactttggcctgcattcatacaatcaccaactaatacacacttgtacaaccagccagcgactctttttatattttattcatcatgtcttctatggaaaaggaccgcgtcgacacagacgaccagaccatgtccagcgaggaagcccctcgacgagagcgccgcagcaagaagaagagcagcaagtctcgccgacaaggcactcagcagcagcaaggaggtggtggttcaggacctcttgaccaactccctcttgctggcgacctcggcaacacagtcggcggcgtcacagacggcgtgagcaacaccctgggcggcgtcacgggaggccttggaggtctcacaggcggccagcagggtggcggcggtggtgatgccggcaaggacactcttcgacttcgcctagatctcaacctcgacattgagattcaactcaaggctcgtattcacggtgatctcgagctctctctactaaactaagaagctggtctgtcttactggctgcttatcgttttgtctagttcatgtcatgatggtacccatgtaatgttatgttagctactgtctttgcacaacagctcgatcaacaaatggcggcgcaagatggtgtttttttattaaataatgatggtcttttttatatacatattttgggagatggaataaacacaatacaatacggttactacaaaaaaaaaaaaaaaaaaggccccta

SEQ ID NO: 17201 - DNA, 1184 bp, Triticum aestivum
  Clone ID: PAT_TA_17201
ggacagattcccttctgtgcttgcgctgttggaacggtcgatggatgcctctatgttctgggtgggttctatagagccacagcaatcaaaagcgtgtggaagtatgatccagctgtaaatctgtggcaggaagtaaactcgatgagcaccgcgcgagcgtttggcaggactggcctgttgaacaacaagctgtacgttgttggcggtgtcatcagggaagaaactggattggctccgcttcaatctgctgaagtgtttgacccagccacaggaatctgggcagatgtgccaagcatgcccttctctaaagcacaaactctgccgactgcattcctggcagacttactgaagccggttgctacaggaatagtctcatttggaggcaagctgtatgtgcctcagagcctatattcctggccattctttgttgatgttggcggggaggtgttcgatcctgcgacggactcatggtcagacatgcctgtaggcctgagcgagggttggcctgggaggcaagccgggacaaaattaagtgctgttgtggatggggacctatatgctttggagcccccaacttgttctgatagtggcaagataaagatgtacgatcccaacgaggatacatggaaggctgttgtcagccaggtgcctgttggtgactttgcagagtcaaagtgtccgtacttgcttgcggggtttcttgggaagctccatttggtgatcaaggatgcaaatagcatgatcagcatcctgcaaacggacgctctaaagcctatggatgcaactggctcgacatgccaaaacccagatgtctcttgggagcaagacgtcgatatttggagaatggttggctcaaagaaatttgcggctgccgaacttgttagctgccaggcgctcagcatatgaagtttggagaaaccatacatacattctgctctgctgtacgtaccctgtgaatcattgtgccttttgtaaagtagactttctatcatacatctgatgaagccatgatgaacttgttgggttcacctcaacagcacatgtgaatgtggattagaatgtaatcttgccagcagtgtacacacgatctgtgtttaaaccatatatgtaagtaaatgtttagttctgtctacacctatatataataatttcacattagagggagaaaaaaaaaaaaaaaaaaa

SEQ ID NO: 17202 - DNA, 429 bp, Triticum aestivum
  Clone ID: PAT_TA_17202
acaactcactcccatcgtcttctccgccgcgggtcatacggactccggccgtcgctcggagtgttgtaatagtcttgcttcccggcgccgctccattgccttgatgtgtcagggttttgggccccctggctggccgtgctccacggcctcgacggctcggcgggggtgtagccctgctgcactgaagggtcggatggggtgtagccctgttgcgccgagctccactgccttgaaggctctgctggggtgtagccttgctgcccggagctccggtggtttgaaggcccagctggagtgtagccctgctggccggagctccattggtttgaaggctcagctggagtgtagccctgctgcccggagctccattgccttgaaggttcagctggagtgtagctctgttgccccgagctccactgccttgaaggc

SEQ ID NO: 17203 - DNA, 642 bp, Triticum aestivum
  Clone ID: PAT_TA_17203
gccggccgttccgggaatattgacgcagcaaggatcgagccgggcccggccggacatcgtcaccgtcacagaaatcagtcaagatgcagattttcgtgaagaccctgacgggcaagaccatcaccctcgaggtcgagtcttcggacaccatcgacaatgtcaagtccaagatccaggacaaggagggcatccccccggatcagcagcgattgatcttcgccggcaagcagctcgaggatggccgaaccctctccgactacaacatccagaaggagtctaccctccacctggtcctccgtctccgtggtggtatcattgagccttcgctcaaggctcttgcctccaagttcaactgcgacaagatgatctgccgcaagtgctacgcccgtctccctccccgtgccaccaactgccgtaagcgcaagtgtggtcacaccaaccagctccgacctaagaagaagctcaaataaacgattacttcatggatgtggcgtctgggatttggcatttgggggtcgatggcgaggacagaggagagctttcttttgttcacacgaggctggttttttattaaaatagcatgtgcagctccggcaatacattctagatgatgcccaaaaaaaaaaaaaaaaaaggccccta

SEQ ID NO: 17204 - DNA, 738 bp, Triticum aestivum
  Clone ID: PAT_TA_17204
gccggccggttcgggaccatattgcacgcagaaaggaagtcgccggccggcgcgcgacatcgtcaccgtcacagaaatcagtcaagatgcagattttcgtgaagaccctgacgggcaagaccatcaccctcgaggtcgagtcttcggacaccatcgacaatgtcaagtccaagatccaggacaaggagggcatccccccggatcagcagcgattgatcttcgccggcaagcagctcgaggatggccgaaccctctccgactacaacatccagaaggagtctaccctccacctggtcctccgtctccgtggtggtatcattgagccttcgctcaaggctcttgcctccaagttcaactgcgacaagatgatctgccgcaagtgctacgcccgtctccctccccgtgccaccaactgccgtaagcgcaagtgtggtcacaccaaccagctccgacctaagaagaagctcaaataaacgattacttcatggatgtggcgtctgggatttggcatttgggggtcgatggcgaggacagaggagagctttcttttgttcacacgaggctggttttttattaaaatagcatgtgcagctccggcaatacattctagatgatgcccatatgacgatgtgccgtgccggaaggtgtcccggccagacccctcaaaagaaataaacagcattcaagcttggaaaaaaaaaaaaaaaaagacccctacccctatgtgggcaaggagct

SEQ ID NO: 17205 - DNA, 857 bp, Triticum aestivum
  unsure (1)..(857): unsure at all n locations
  Clone ID: PAT_TA_17205
ctttcacacgttatcaacactttgccctaaccgagagcgattaggccaacgacaggaaagncgggcagcgcagcggcgctcgcgcatctagtgcatcgcgcaactctcggccgtgggctgcaccggcgctatccggcgtttttgcggtgaagcagcaaaccccaacgcggatggcgacatcagtcgcagtggcgctcgcgtctgccgtttgcgcctgtacgcgcagcgtcgactcgcatcctcgcgacctcgaactcaaggcatggccctcgatcccgctcggcgagacatcggcagagaaaaagacgaacaaatagaaagaaggaacatgagaattggcacccacgatcgatggattgaacatccaaaccaagaaacggaagcacccacatggtatttctttagttcgtcatgttcatacctctaaattactttggacgtggaactgcgcgcttgttcatatagtgcggcggtccaagcagccatggccttcggcctcgacatggatgcgcttccacgcgtgatgggcggctcccgcggagcgaccagccatgacgcggttgctctcctgtaccaggctgaggcgcgaagagcttctaccggcaagacggcaccctccggccggcgatgcctccaggcgcggtcgcggaggccgtcgatgtccggctcgccgtaggcggcgtgccgtcgttctgcaatcggcggcgacggctgggtgaatccctagccgcacaggagaattggggattcttatcctcttcactattgtttgattaagtcctcagactttatcttgactacgtataagtccctgtaaattatgatacgggcccttaagcttactattttcaggattt

SEQ ID NO: 17206 - DNA, 958 bp, Triticum aestivum
  Clone ID: PAT_TA_17206
cccacgcgtccggttcgcgaactacagcccaagaaagaaaagaaggccaccatatatacggctcacgggagttgatcagcggccttcttttcctgcggctcgcttggttctcggttgatcgtaggagtttcgggttctgttcgatcgtcggcgtcgggatcatggtggcggcggtggatgcggtggcggagaaggtggtagcgcagctccgggaggagtgcgcgaccccggcgacgcggctggatggcgtggcgacggccatggaggaggagatgagggctgggctgcaccaggaggccggcagcaagatcaagatgatcatctcctacgtcgacaacctccccaacgggagtgaagaaggcttgttctacgcactggaccttggaggaacaaacttccgcgtgcttcgtgtgcagctcgctggcaaggacaagcgcgtcgtcaagcgtgaatccagggaggtctctattcctcctcacctcatgtcaggcagctctgcggagttgtttggcttcatcgcgtctgcgctagccaagtttgttgcagatgaaggagataacaaagtgttggacgacaagcagagggagctgggcttcacgttctctttccctgtgaggcagtcgtccatcgcctcgggcaccctgatcaagtggacaaaggcgtttgccatcgatgacgcgatcggcgaagatgtagtcatggaattgcagatggccatggagaagcaaggtgtcgacatgcgtgtgtctgcgttgatcaacgacaccgtagggacactggctgcgggcagctataacgatgaagacgctgtcatcggcgtgatattaggtaccggctcaaatgccgcatatgtagaaaaggcagatgccatacccaagttggaaggagagttaccaaaatcaggaaatatggttattaataccgaatggggtaacttctcttcttcatgccttccgat

SEQ ID NO: 17207 - DNA, 1945 bp, Triticum aestivum
  Clone ID: PAT_TA_17207
aaatgcaactactgaaaccttgtctcatagttatccaccattatttgtcaaaatacatgtttcctcttggcacagaaagcaaatttctacccataaaatatgttcaatgtgaggggaaaacaggtatgtgcgttgcactgccgaacaaaggtgcaacgaggtacaattcctgctgtgcagggtgtccccagttgacaaccatgaacaaaaaattcaacgtaacagatggacccaggcttacaaattagattgaatacagagattctagtattcgggctgctttatttcctcactcatttgctgggagagggaaaacatgatcttacaaaggaattgaaaacgacttcttcagcttctctacctccaaataagcattagagtatgggaggaactctgagaaatggctttgcataagatcattgatggccacagcgagctttggaatctccattatctcttcgttggtcagcttcctaacaaacctggcagggttgccagcccagagttcgccagtcggaatcctcctccctggggccaggacagagccagcttcaaggactgagttagtttcaaccaatgagccttccattaggatggaatgctgaccgatgatgcactcaggttcaatagtgcatgagcgcagaagacagtacgcacccactgtcacataccggtcaacaagggtctcagctggaagacctgtagaggccgaccaggcggcgtggaggacggaccgctcctggacgttggcgcagaacccaagagtgatcttgttgaggtcgccccgcagcacggagccgctccagacggaggcgccgtcgtggacggtgacctgcccggcgagcacggcgtcgggagcaacgtacgcgtcgacggccaccttgggaagccactgcccgagtggtactagctgccgctgcccgcggtaatcccaccgcacccgatccgcacctgccgccgcggctgcgacggggggtggtgaggacgatggcgcagcgggggcggtggcggtggaggagaggatccggcggagggaaggcgccgcggcggcggaggcgcggcgagagaggcgagacagggaggcggcggccatggtggcgtggtggtccgggaggtgcgtgggtcgggcgagcaggcggtcttcgtcgctctcccatggaggctcggatgggcgtcgtcgatatctgcgacattgtgaccagcaggtctgcccggctggccgctgccgggattgtggggataatcaggaagattggtaggggcaccccaggcgacaagaggaggacagtcatcgcgatcgacggcgggctgtttgagcattacaccaagttccggcagtgcctggagagcacgctggtggagctgcttggcaaggaggcgtcggagttggtggcggtgaagctcacaaaggacggttcgggcgtcggagctgccctgattgctgctgctcactctcagtacctcaactgatcaagttacaagcttttctcagacagtggctgatgttatttgactctagtgttctttgtacatttcaaagaagccttatgtgcctctgtcaaactaatttcttatcaaaatacatacgtttgctgttgcaagctccagcgtcttaagttcgtaaccggaccactgtggtgttgcatagaaaccaatttaggacattgcctacatatccggaaggtttgtgaaagtggaacagggcttttctttgttttccgaacggctgaaaatagagctggttactaaatttctggattttgtggaagaccttgtgtagcccaaagaaagtaatgctcaaggcactgccaaaacactctagataactttattgtcattggatgttgaacttctaaataatcaataaaaggttgtctgcatcactcgatgcagaggctgaggggtaccccctatttcagaaaaaaaaaaaaaaaaaaggccccta

SEQ ID NO: 17208 - DNA, 678 bp, Triticum aestivum
  unsure (1)..(678): unsure at all n locations
  Clone ID: PAT_TA_17208
agttatgtntttaatgtgttgggagtttttttatatggttgatttgtangtngttgngaatttattagtgattttgagtggttgnttgggtaggtagcgtgcgtgtgatcatggtgtgaaggggcgcggtcactatgctcatattggcatgtgtgtgataatcatccctccgtgtatttgcagttcactatattctccagntagctcaactactactcgtcagcgttggctgcctcctgtcggccaaatgaagggggagcggtttacagtccacgcgtcgccggcgtgcagttcgtgtgtgcgtggtctagcccaaccacggcatgatcctctccattctcacaggcatcgacttggccaatgacggcgtgcagtgcggccaacgacgacttgcaatacggccaatgatggcgtgcagtgtcgccaccagcagcaccccaggcgtgggggccgcgccgggactcgccgcgccttgctcctccagtctgctggagacgcgaaaggagcagctcctccgccaacattcgcggcctccaacctcctctaccttcgaactggctgaccccccttctccacctgcttcgtctgcttgccggtcagccgccggcgacgtagctctgccatggatccacggtggggtagcacggccatgcagtccggcatgcacgtgtgtgcagt

SEQ ID NO: 17209 - DNA, 338 bp, Triticum aestivum
  Clone ID: PAT_TA_17209
actctccacgtttcccggcaagtcaaaaccattctcaaacctcaactgcatccaatatggaactaaagttcctcgaatccttcttcatcagcgtcctcctctgttctttcaaaatgcgtccagaagctctccatctgtgcatctgaaaaccgcagctgttctgcaacaaaaagaactctaccacattgttccctttgaggagctagatctaagccgaaatcctttgcaacattttcatagagaacaaagctaacccggaaaccctgggtaaagaaaaggttttctagcctgtcttgttcggagaccatgtctgctgctgccgtccagtctggaaaatg

SEQ ID NO: 17210 - DNA, 792 bp, Triticum aestivum
  Clone ID: PAT_TA_17210
cccacgcgtccgcccacgcgtccgcccacgcgtccggcacccacacaaacacacggccgaagcaacccaagcgagtcctcgtgttcccgtgcacacacgcctaagctcgaaccatgtcgtcgcagcggatggggcgtcaccagcgccgggcgtctcagagcgtgttcgcgctgccggagaacttcgcggccctcgacgacgtgccggcgtccgacgagcaccggaaggcggacggcggcggcgcgaccgagcagcagcagcagggggcggggcgccaccggcgggccatgtccatggccgtcgcctcctccagggacctcgagatgatcaaggaggacgtcggcggctacagcaactacaagattggcgcctagattagtgccaccggcggcgcgcacggccggcgcggctcagagcacgcacgtgtacggtgttcgtaatacgtgcgtgcgcgcgtgctcggtggcgctctcggcggagctggggcctcgcgcgcgcggctgagctttgctgccgccggtgccggtgccggaggccgtggcgcgtgctggttcgttgcttgtatggtcaagcggccgagcctggttgaggtcttgcttgcttcgattcccttttcttttgctcaagacatgcatgtaaggtgtgatgttatttgcgagtttaaagctcttcaaattactaagtttaaacattagcggctgtatgcatctattgatgcagaggccggggaggcggggattttaacctcctttttcaaaaaaaaaaattagcgttaaaaaaaaaaaaaaaaaa

SEQ ID NO: 17211 - DNA, 429 bp, Triticum aestivum
  Clone ID: PAT_TA_17211
ttttttttttttaaaccaccagaacatcacggaatatatgtgttacccaaaggatacaatagttgaataccaaattaggtttggaaattgtacttgcgtggtaatagcatggtacctttttgccgacacacccctcttgttaacaaattgacgccgggctaatcgccaacagttttcatcttgatatatccatcacaaatattctgtaacccagcatgccgacgaggacctttaccgcagcacaaaagcttcggtgaccacacgtgctgccgaatggagcgaagtaacactccatccttatttacctttatggactaacgatagcgatcctccggcaattgctgcgcccccgccggggcagagagagataggataccacggcggattcatcacggcggaaatagactagggttcgttcgttcgttcatg

SEQ ID NO: 17212 - DNA, 429 bp, Triticum aestivum
  unsure (1)..(429): unsure at all n locations
  Clone ID: PAT_TA_17212
agcatctaccagccaacccctgcaggtaacagtggcgttggaagtgcctaccagccgcctccaacaggcaacaatggcgtcggaagtgcctaccagacacctccgactggcaccaatggcattggaagcacctacgagacacccttggctagcagcaatggcgtcggaagtgccttccagccgcccctgacgggcgacgacaatggcgtgagaagcgcctaccagccggggatgaccccgtcgtcggcgagcacgcgatacggtcagctatggtttctgctacctgcagcgctcgtgttctttaaatgatcaatctccatgaaaggccagccagtgtttcatgtcgagccggccttcgagcttccgaatacatgagggattggatgatcttaggcgcggaagaaagaagaggctcgaagcagagttana

SEQ ID NO: 17213 - DNA, 406 bp, Triticum aestivum
  unsure (1)..(406): unsure at all n locations
  Clone ID: PAT_TA_17213
acctgnactttaattaacatgtggtnggggnggcagcaacatgataaanaaccacatcacttgcctctctcatctgacacatgacaccctctcaaaangtctnaaaaattnccacaaccagaagattaacactgataatctgaaccagcaagctaaagcttatatgccacattgctcaatcctgttgatggcaagttcggatagtatctccatcataatcatgtgtgtatgcattttggatcaaataggaagatacattggtagttcctgacgactggggcaggccattgatgatgttaaccctgccatatgggccaaatggcatcagacacattactgaagctgatgagaatagtttgcttcgaccgatctccatgaggtatccatagattgtatgtaaaaaatc

SEQ ID NO: 17214 - DNA, 1141 bp, Triticum aestivum
  unsure (1)..(1141): unsure at all n locations
  Clone ID: PAT_TA_17214
actagttttcaatcacccgttgtagcttttgatcagcggtttgcaacttttctaatcgccggttccagcttttctaatcgatggttcgagcttctgttcgtttgcatctttttttgactgctggtgctggaacaacatggcgacgagctggaaggggcgcccaaatttggtagaaccagccacccgttttgctggaaccggctcccctttgctgcgtcggacattgttggagtttgctggtgtgccttttcttctggaaccttggttaaatcaagctggaaccggacaatctttttgctacgtcctgccgaaaacagagtaggaactgatgggatttttgtttaagacctggcggcaacacatttttgctggaactgtattacttttttgctggaatagtttttggtttatgctaccaccagtgaaaaccaattttttgctgttgaagctttttttgctggaaccggcaaccacagaagctacaaccggttgacaatttttgctacaacggcgatgatgggcagcatgggcgagtgttcttttgctaggacggatgcatttttttgctacaactggaccggtgaccggcgcacgcgggaatgcggtgaccatcaccggagttgcggccttcgcaccggagctgtggccggcgccccggggggcggcaaccgtcggcgcaggctactgcatgcacgaagccggcgacggcgaccggcagcgacgatggcgaccaacgacgaggtcagtgacggcgaccgatgacgaggacagccacaggcgagaacgcactggtggtgcttcaaggccgggcgcgtctccttaatggcggcacggatgggaattttttcctgaaagaagacatttgcgggaaggaaggaaggcaatcgtgcggctaatgcttgtttaatcgaacgttggtggtgcgaccgacccaaatttgggccggcgtaccggcgcntatcagtcgccagcttataggagctccctaacatgcgtccattgttcttacatgcacgacattgtcgtgtcgtcgcaggccgcttcatcgntgnccgnttctacgtatatggacgtgggcctcctgtgtaacaaccgagagtgatacccgacattattgacgctatccgatcaaaaaaaaaaa

SEQ ID NO: 17215 - DNA, 962 bp, Triticum aestivum
  unsure (1)..(962): unsure at all n locations
  Clone ID: PAT_TA_17215
ccccgcgtccgggcatccacagcaggagnagcaccggcagaagtgatacctcatcagatgataggattttctgatccagctatgtctactgtaaaggcagctgaaactttcattcatgattcaaatgaatcagtgtcactcatatggatttagatcacagctttctgccagtaccttctgcagtgaatgcctgtgcctttgaaagttttgtcaggcaagaacagggcaccttgcttttccccttgggcaccaatggccattacatctctgcagcaaagtttgtgaatgcaagcaccttgactatacctacaactttcagttcaggattcaagattgagccaaaggttctagcttttttgcgaaacagcgaaaggttctagctgacactcttaaaaatgtatctcggccatgggtgtacatttgtggccccacgatcaaccctactggttttctgtacagtgacagtaatattcaagagctgctctccgtttgcgctgaatatggagctactagggtagcgatagatacctccttttaggcctggagtggtaatggatggctggagtcggtggaatctggaaggatgccttttttctttaaaatgttcaaagccctcattatctgtagtcctgctaggagaactgtcttttgagctgattgcagcaggacatgactttgagtttgtaattttgaatgacccatccttggttgatgcgtttcatagtttcccgagcttgagtcggctgcacagcacattttcaaaaagctacttggcctgaagaactagaaggatcagcatttctctgatctaatggcggagcaccagtacgagctgatgatcattcttctgtacatgctgatgatcattcttctgtagtttctatgctttcaagctatgtttgccaaaaaaaaaaaaaaaaaaaaaaaaaaaaaaaaaaaaaaaaaaaaaaaaaaacacaccc

SEQ ID NO: 17216 - DNA, 1733 bp, Triticum aestivum
  unsure (1)..(1733): unsure at all n locations
  Clone ID: PAT_TA_17216
tcgagcggccgcccgggcaggtactacaaccggcgggacgtgcagatggccctccacgccaacgtcaccggtgccatgatctacacgcggacgacctgcagcgacaccattaacaccccatggcaggttcctcagaggtcctgggatcccagacccagcgtccctcttcaacctggactgcgggttcgggactgtaggggaatcctattagcgtattatatcaaagtcgcatttattcccctctcatttgagagtgcgaatacaaggaggtattttgtgtttgggaaagtccgaagaaaaaagattttgaatctgccttttccttctttcccttaaaaaaataactcaagaaaaatccaattatttactctacaagaatgaaatgcttgttatgcctaatatacttagtttaacctgtatctgttttaattctgttctttatcctactagttttttctttgccaaattacccgaagcttatgctattttcaatccaatcgtggatattatgcctgttatacctctattcttttttctattagcctttgtttggcaagctgctgtaagttttcgatgaaatctttagtactctgtatgccaaattgaatgatgtgttcattccaaaaaaattttaaaatgggtaaaagccgagaagttttatatttttatattatgaaccttcgattctcaaatttaaattcttctacattgaatgggtagctacagcaataaatttggatcagcctttctactcccctgcacctaggttgagcaggtacctacacaatacctaaccacctaaccctatttttgctaattgataagagtgcttattataaatgaattcttgcaatttttttcaagaattcatttttgcattttaggtatcaaaaaaaaaccatccctagtggatccgtgtggtaaggaaaaactggtaatctattccttaaaaaaaaatattagagattatgtaatggctactcctcaaactttttgtttatacagtatttttattctttgtttcactctttatctttggattcttatctaatgacccaggacggaatcctggacgcgaggagtaataattccgtttttttttttttttcttattggatttgtttcgtacatttatctatgagaaaatccgggggtcagaattctttccaattcgaaagtcccaaatgatccaagggagcggaaagagagggattcgaaccctcggtccaaaaaaattgtgcaacgggttagcaatccgtcgctcctgcccggcaagccccttccactcgtgtccaacagaggggccggcgctgaggtacacctgcatcgaccgaggcaagagcgcgtacagtttgaggtacttcctgcagggcgagcccatgccaaaccaatacaagcatgcgacggtgacttagcaacaaagggatggaagtcaaatagtaatttcgatgtgagaaaacaagagtgatcatcaataaagcaatagatgcttcttcaccaattagatttcaccttaacgggcactccgccgcggctcccttaatctaatccgccgccgcttgtagccgggacaccttcttgcnnatatntcaanaaancaaaaggtctacaatccncataaattggaaaacataattatttcccggaccntaagagcccacccntcgaaaaaatcntttanaattgtaanaatttttatcctactaagggccggncatnccaagnncttacnc

SEQ ID NO: 17217 - DNA, 849 bp, Triticum aestivum
  Clone ID: PAT_TA_17217
gagaactatgacccatcgtctccccccagctgtggctgcggtggccgtggtcttggtggcgctgacgtgcctccaccggccagctgccgcgagcggccatgccgcggaccgcatagcccggctgcctgggcagccggcggtggacttcgacatgtactccggctacatcaccgtggacgagggcgccggacggtcgctgttctatctgctgcaagaggcgccggaggacgcccagccggcgccgctcgtgctgtggctcaacggcggccccggctgctcctccgtcgcctacggcgcgtcggaggagctcggcgcgttccgcgtcaagccccgcggcgccggcctcgtcctcaacgagtaccgctggaacaaagtggccaacgtgctgttcttggactcgccggccggcgtcgggttctcctacaccaacacctcttccgacatctacacctccggcgacaacagaacggcgcacgactcgtacgccttcctggcgaaatggttcgagaggttcccgcactacaagtaccgcgacttctacatcgccggcgagagctacgcggggcactacgtcccggagctgtcgcagctggtccaccgggcgagcaaccccgtcatcaacctcaagggcttcatggtcggcaacggcctcatcgacgactaccacgactacgtgggcaccttcgagttctggtggaaccacgggctcgtctccgacgacacctaccaacgcctcacggaggcctgcctccacgactccttcatccacccctcgccggcgtgcgatgccgccaccgacgtcgccacggcggagcaaggcaacatcgacatgtacagcctctacacgcc

SEQ ID NO: 17218 - DNA, 631 bp, Triticum aestivum
  Clone ID: PAT_TA_17218
gattcggacgctccttgatgcaagtcgtagcagaaaattaacctgggatctgagggttggtatcattcaaggcattgcagaggggctttcttatctccatgaggagtcagaaacacggattatccaccgagacatcaaagctagtaatattttgttggatgataagtataagtccaaaataacagattttggtcttgcaagagcatttgcagcagacgtaactcatcttacaactggtgtcgctggaacattgtaagctccatttttcatattcttaaccattggtacggtattgccacacgattcttaaccagcggcgttgcagttgccacatgatctatttcactgtcatgtcgaatggacacagcgtggcttgttgatcttgcagtcactgaataagtttgttgcgaagcatacatggctcctgacaatatcgtgcatgatcgatctgatcatctacaaagacacgatccggcatatgttcttgttcttagtgcagatcgggctactatgcaccctggctaaccctggtgacaggcctacgatgaccaaggtcgtcgagctgctgagaagccacaagcatgatgtcgagattgtcctgagtgatcctccatttctgaatgttgagggg

SEQ ID NO: 17219 - DNA, 744 bp, Triticum aestivum
  Clone ID: PAT_TA_17219
agcaaccacgccagccagagcgcgccgcacctccacctcgccgccgagcacccagcacacgagccgcccggccatggaggtggaggcgttcccgattgggttcaccaagggcgtgcgcgcgcactggcgccgccgcaagtaccagcgcctggaggccggcgagggcggcggcagcaggtcccagggcacgcagcgcctcggcggctccggcgcgcgtcgcgtcgggtggcgcgtgcggctgcgcgggcttctcatccggcgcgcgcgcgccgtccgcgcgatcgtgacggcgccgcggcggctgctggcgcgcgcgcgggacgcgtacgtgggcggcatgctggccgtggcccggaaggcgtcggccacggcgctgcccggcggcgggcccgaggggatctgggccaggcgcgtgccgcggcggaagcagctgccctcggcgacggcggcgcggacgtccgagttcgagcagcggctggtcatggagatctacaagtccatcgtcgcgtccaaggagctcaccaccatgctccactcctccaccgcgcacctgcagccgccgcccgcgcgcgcctagcttccccaagcggttgctgaagcgaggtttttcaagatgatcgtcttctctctctctctcagcaggtgctgctacgaagcggcggcactgttcattagttgtactgtagtaacttgttgtaagaattgtagaaatcgatcctgattaagctgttcaaacaatttggt

SEQ ID NO: 17220 - DNA, 1277 bp, Triticum aestivum
  unsure (1)..(1277): unsure at all n locations
  Clone ID: PAT_TA_17220
ttgcctcggatcggtaggatacccgctgaacttaagcatatcaataagcggaggaaaagaaaccaacagggattgccctagaacggcgagtgaagcggcaacagctcaaatttgaaatctggctttcgggcccgagttgtaatttgtagaggatgattttgatgcggtgccttccgagttccctggaacgggacgccatagagggtgagagccccgtctggttggatgccaaatctctgtaaatctccttcgacgagtcgagtagtttgggatccaccaccaaactcccatttcacccagcacctacgcaagctaaacacaagcaaagctgcaccaaactcgatcgattctccggtcaagcagcacgccagccagagcgcgccgcacccccacctcgccgccgagcaaacacgcaacgcacgagccggcccggccatggaggtggaggcgttcccgatcgggttcaccaagggcgtgcgcgcgcactggcgccggcgcaagtaccagcgcctggaggccggcgagggcggcggcagcaggtcccagggcacgcagcgcctcggcggctccggcgcgcggcgcgtcgggtggcgcgtgcggctgcgggggcttctcctccggcgcgcgcgtgccgtccgcgcgatcgtaacggcgccgaggaggctgctggcgcgcgcgcgggacgcgtacgtgggcggcatgctggcggtggcccggaaggcgtcggccacggcgctgcccggcggcgggcccgaggggatctgggccaggcgcgtgccgcggcggaagcagctgccctcggcgacggcggcgcggacgtccgagttcgagcagcggctggtgatggagatctacaagtccatcgtcgcgtccaaggagctcaccaccatgctccactcctccaccgcgcacctgcagccgccgccctcgcgcgcctagctttcccaaggcggtcgctactggcaaccggatggaagctgggatttttttctcttgcagccgtcggccagcacagctgcatgtaccacatcatgttgatcgatggatggatgtgaagcgaggtttttcaagatgatcgtctgctctctctctctctctctcggcaggtgctgctacgaagcgtggcactgcgcatgagttgcactggtaacttgttggtaagaattgttagaaccactcttgattaagtttttcaaacaattaanaaaaaaaaannccnagggggcccggtcccattcccccnanaggancctntacnccccnanggcgtctttaaa

SEQ ID NO: 17221 - DNA, 417 bp, Triticum aestivum
  Clone ID: PAT_TA_17221
gccggccgggccggggttgacctcggatcaggtaggaatacccgctgaacttaagcatatcaataagcggaggaaaagaaaccaacagggattgccctagtaacggcgagtgaagcggcaacagctcaaatttgaaatctggctttcgggcccgagttgtaatttgtagaggatgattttgatgcggtgccttccgagttccctggaacgggacgccatagagggtgagagccccgtctggttggatgccaaatctctgtaaatctccttcgacgagtcgagtagtttgggaatgctgctctaaatgggaggtatatgtcttctaaagctaaataccggccagagaccgatagcgcacaagtagagtgatcgaaagatgaaaagcactttgaaaaaaaaaaaaaaaaaaggccccta

SEQ ID NO: 17222 - DNA, 829 bp, Triticum aestivum
  Clone ID: PAT_TA_17222
gccggccggtccgggataattgctgcacatatcacacgtgttggaagcacagttgctatgagaggttctgttctaagattgaatagacaacttacacgtagctcacatcgactactatccgcgcctctcacgagatatcacatctcatatcaaggatcaatcagactttgttcctcctgtcattctccaagcaactcaatctcatcccctcaaacacactcagccaaaatgagcgaaagcggagcttggggtgcctggcaggttgagacttcatccttcaccaaggccgttgttgcatctatccagaagctgtacccagaagaaatcgcagacagaagctgggacaatgttggactgttggttggaaactcggaagaagacaccaagaagaagaagcgagttctggttactaatgacttgacctaccaagttgctatggatgcaattgagcaagatgtcagcgtcattgtcagctaccatcccttcatctttggcggcctcaagtctattaccaacaacgaccctcagcaagccacccttctcaagctgaccaaggctggcatcgctgtctattgcccccacactgccgttgacgctgctcctgaaggcctcaacacgtggctcgccgatattgtatctggtcctcacgagagcaaacgctctgttgccaatcctgctgtcaacgccccttccagccacgctggtgcaggctacggcgcaattggtcgctttgacagctccgtttctctttctgagatcatcattcgccttgctgagaagctcggcggtctcaagcatgtcatggtagcaagccctgtgggtgctgata

SEQ ID NO: 17223 - DNA, 1437 bp, Triticum aestivum
  Clone ID: PAT_TA_17223
tcgccgccggccgggcgggggctatcaacagatcttcatcttctttcattcacttcagtctttctttcgaagagctagtctctcgtttctttcgttcactacaatcaccgagccagtctccagcaaaccaagcaacttttttaccatcctcaacttttcgaatctttcaaaatgaagttctctactatcgccctcgctgcccttacccaggtcgcctctgcccactacttcttcgacgtcgccaccgtcaacggcaaggactctgctcctttccagtacatccgagacttcacccgtcctaccaagtacaaccccatcaagttctcttccaacccttctgccgatatccgcgacaactccttcgctgatggcgaggacatcgtctgcaaccagggtgccgccaccaagggtgcttctactgaggttgccgatgtcaaggctggtgatgtgatcaccttcaagctcggtgttggtgccaagatgggtcaccccggacctactctggcctacatgtccgccgccggtagcgatgtcaagtcctacaagggtgacggtgattggttcaagatcatggaggagggtgtctgcaacgccggcggtgacttcaccaaggacgcctggtgcaactacgactctccctccgccgatgtcaagatccccgagggtacccccgatggccagtacctcctccgtgttgagcacatcggtgtccaccgatcccacgtcaaccagcccgagcactacgtctcctgcatgcaggtttccgtcaccggtggtggctccggcaaggtcgacgccgagatggtcaagttccccggtgcctacaaggccaccgacgagtacgccaacttctccatctacaacggtgctaaggccttccccatgcccggccccaaggtctggggtggtgctacctctgccggtggcgctactggcggcaacgatgctcccgcttccactcccgctgccggtaacgacgctcccgccaccacccccgacgctggcaacggtgccgccgctcctgaggccggtaacggtcagcagcagggtggtgagcagcagcaggctcctcctcagggcaaccagggtggattccccggtcagcagcagggtaaccagggtggcttccctggtgcccagagcgctggctctccttgctccgcttaagcgtgtgctttaaagattcgattcaaatattgtttggtattgtcgatgtgttgaacggaggaccaagaagtggagggaagaggttgcagatttctggtcaactttcatgtataaaagagtcctgttgatcgcatcaagtttatctgctagatgaggaaggggatggtctggaactgtgctcgtagtcattttagctttgcttaatttatctgaagcaatctgaggacaaaaaaaaaaaaaaaaaaggcccctaaaaaaaaaaaaaaaaaa

SEQ ID NO: 17224 - DNA, 675 bp, Triticum aestivum
  unsure (1)..(675): unsure at all n locations
  Clone ID: PAT_TA_17224
gcaggtagcacaccggcatgttgcttgaacgcccgcagccagcaagattttgcatgcaggaagtcgctcgcgccccgttgcagagcgcancgccagatcccgtcccctcccctcgcgccccgttccagtggagcacagccaccagatcccgtcccctctcacacctctgtgtctctctaatttccttatctcgatctaatttctatcgagtgcgtgcatgtaggctgacgtgaagccaagtcgtcggcgccccgttccagttccatagtcacggtctcacagaccagcagatctggagcgccgccgccggatcccgccacggacgcgtcaactgaccgctgcaggaaccctcctcctcgccaactcccggcaagaccgggacagcgcccttacccgttaccaatgctccagttgcccgcgcatttcattctgagttatttctttttcgcctttgatttctcatgtctgattctttttcacctctgattctcaatctttgggttaattcgtttccgtgccgaggatctctcccatgtaatcagttgaagggagcaaggtgggacgaaaaatcgaacgtaatcaaacgcacggactacccgaagcactgcgttaatagggactgcgggtggattttgcagaaaccgagggacttttttgtaaaattggtgacgacgt

SEQ ID NO: 17225 - DNA, 709 bp, Triticum aestivum
  unsure (1)..(709): unsure at all n locations
  Clone ID: PAT_TA_17225
gnttttgggctgagtgcactttcagaatcgaagagccaagatggcatgctccacaccacctgtggatcgcctgcatatgtggctccagaggtgatcagcaagggaggctatgatggtgcaaaatcagatatctggtcttgcggtgtcatcctcttcgttcttgttgctggttacctccctttccaaggtcagaacttgatagagatgtaccggaagattgagaaaggcgatttcaggtgccctggctgggtttcccaaaaacttcagaagctgttgtacaagatcatggaccctgatccgaacaagaggatatcaatccagaagataaaggagtccacctggttccggaaaggtcccggggagaaccttacagtgaaggagagactgccaagtgagaatgccaacacggatgctgttccaacacttggtgtgaggcgcaggaagaacagtcacgaagacgcgaagcccctggcggtgacaaatttaaatgcctttgaaatcatctctttctccacagggtttgacctctctggcctattcgtcgagaaggagagcaaaaaggaagcaaggttcacttcagaacagcctgcctcagccattgtctcgaagctggaagctgttgcgaagacgctgaatctcagggtgaggaagaaggataatggtgttgtcaagatgcaagtgaggaaggaaggcaggaatggtgttctta

SEQ ID NO: 17226 - DNA, 1984 bp, Triticum aestivum
  Clone ID: PAT_TA_17226
ccaacacactcggaacccgactcagccccgcaagccccaagaaaaggagaaccagaaccccgcgtgccgcgccggcgcaagtctctcggctcccgcctgctcgtctccgcggcggcgccggaagggaactcatccaaaacaagaaatcaaagtctcaaggaatgctgaaagatgtgcttgcatagaagagatttcttctgcgagaccaagaacatcaccactctgcgtgggcccatttggtcacctcttgatgtgagcaaccaccttgcctgcatcaactccacgccattcagactccgctatgacgaatccaccagagtgctggatcatgacttcggggaggctggctgaagtgttcgtagcatatttaagtgctagccacaagaatattagtggccgtgacttatactcttgaaggcatggagaacagtgggaagatcgtcatggggagggtatgagctggggagattgttagggaaaggagcatttggcaaggtgcactacgccaagaaccttgagtcaaaccgaggtgtcgccataaagattttggacaaggagaaggtgctcaaggtcgggctcgcggagcaggtcaggcgtgagatcacaaccatgcggttggtagagcacaaaagcattgttcagctccatgaggtcatggcgacacgaagcaagatctacttcgtcatggagtacatgagaggcggtgagctctttgagacggagtccccaaggctcgcgggctcagagagtgtgctgcacacaagcatcccgagcaagctcatcagtgcggtggattgctgccacagccgaggcgtgtatcaccgggacttgaagcctgagaacctactccttgatgagaatgaaaacctgaaggtttctgattttgggctgagtgcactttcagaatcgaagagccaagatggcttgctccacaccacctgtggatcccctgcttatgtggctccagaggtgatcagcaagggaggctatgatggtgcaaaatcagatatctggtcttgcggtgtcatcctgtttgttcttgttgctggttacctccctttccaaggtcagaacttgatagagatgtaccggaagattgagaaaggcgatttcaagtgccctggctgggtttcccaaaaacttcagaagctgttgtacaagatcatggaccctgatccgaacaagaggatatcaatccagaagataaaggagtccacctggttccggaaaggtcccggggagaaccttacagcgaaggagagactgccaagtgagaatgccaccacagatgctgtcccaacacttggtgggcgcagcaagaagaacaacgatgacgcgaagcgcctcgcggtgacaaatttaaatgcccctttaatcatctctttctccacagggtttgacctctctggcctattcgtcgagaaggagagcaaaaaggaagcaaggttcacttcagaacagcctgcctcagccattgtctcgaagctggaagccgttgcgaagacgctgaatctcagggtgaggaagaaggataatggtgttgtcaagatgcaagtgaggaaggaaggcaggaatggtgttcttcagtttgactcggagatctttgagatcagcccctcgtaccatctcattgagatgaaacaaacaagcggtgattcactggagtaccagaagttattggaggagagcatccggccagcactgaaggacatttgtctgggcatggcatggagctgatggtcagcaggaacatcaagggtagctttagatgtctcacttattatgtttagttccgcaattttttttgcttttcagctcaagtaattgtgttatatactatacatgagtgtgctctttgtcacaaataaattgttccttcttctgtatttgacaagtaataactgttgctaagctgaggccatggattaagctgtttctttgctgtaacatatatcataatgaaatacatattgatatgctttgt

SEQ ID NO: 17227 - DNA, 693 bp, Triticum aestivum
  unsure (1)..(693): unsure at all n locations
  Clone ID: PAT_TA_17227
nactaacaacttattantaccccatggtaaactncttncacccaatcaataacacaacgcaacgcacgcacgcaccggcccatncccgccgtgcgcacgncggcgggcggttgatatatatgtatgtaatgtaaatcctgtaagatggtacacaggaaggctacatggggaagacacagaaaagctaaggaaaacaaacagtaagatgaagaagaagcaggggtcttgcttctttcttttcctccccggtgnngggaccgagcctcccgcgccaaaacttccgactgttgttgtataatttacagcaccgcgtatgcccggaccacctccacgatcggcgcccggcacagcgggcacttgccgccgctgcgcaccagctcgttcgcgcatttcgagcacgtgcacatgtgcccgcatctgtagagtagagaatcgatttgtgtgtcgcagcatacgcagcaggttcctttcctcacctggtcccatctcgttccgtcatcgtgtagatccagaaacatgccttcaggtcccgggaatctactcaaggctgcagacacttcttgtctcactgaacgttgcaactccagttgcatgtccatgcacgcctccagcatcctttgcatgctgctcatcccttgttgaagtttattcatgtcggctttcaaatcattaatggcgtccaattcctgatgt

SEQ ID NO: 17228 - DNA, 671 bp, Triticum aestivum
  Clone ID: PAT_TA_17228
ctgaagctcaaattctttttgagtccttctcactgtctctccatcggcaaatgtgttggcctcgccatggcggaccagaaagtggactcagccgagtttgagatcttgacgcccaggaatggtcatctttgcaccgaagcctaccgcctgttctttgctcagcagttcaatgatttttttcgtgattgtcccgacgcatttgctggcctcacggggctgcatctacaatacatgaggtttggtgaatcagacataaccaacatcctaagctattgcaagcagctggagtcactatctttgttcatgtgtgacgagggggtctcttcggtgctgcgtgtagaacacgcacgactcgtggagcttgttatctcctattgtgaattcaaaacagtggagctcacctttctaccaaacctccagcggatgacctttaatagttggccctcctgtgctgaacatcccttggctcttggttttgtccctgagctttcgaagctaagccttgctaaggcatgtttttcacacaagacactcaagctaagccagctgcttgctaatgtcctctccgtaaacgatctatccctagaatttcaaagtgaaaaaatttggattcgaccagaatccccgaaagtgctttcaccttggcttgccaaactacggtttgtgaatct

SEQ ID NO: 17229 - DNA, 425 bp, Triticum aestivum
  unsure (1)..(425): unsure at all n locations
  Clone ID: PAT_TA_17229
actgcacgcacggtatcccggcctcctcgcagaatcgtaagatctcctcgttctgctcctccaggcgcctcagcagctggcggccaccgtccgtcgacgcnggcaccgacgaccgcagatccccacggtgtagaacaccgtcctcctcccccgggagcaccgcggacgtgtcggcgtcccacctgttccggttcatggggtagacgaggacgggtcccatggcgccggtggtgctgtcacggcggaggatgccgtggaagacgccggcggcgaagtcgaggacgcgggagcgcngggaggaagaggttgagccagggatgcggcacgtcccagaggccggaggcgcgggagcttgagctcgccgtcgcgcacccggtcaaggaaccccgcgtacgacacgtcctgcacgaacgcgaacccgcgcg

SEQ ID NO: 17230 - DNA, 1009 bp, Triticum aestivum
  Clone ID: PAT_TA_17230
ccgagccgccgcccgcccgggttcgaggacggtcagatctggggcgccggccagcgcccttagtcgggtgaggaggtctggttctaaaagcgtgaactcgactcaccagtgatcgagaacggagagaactggagcgtgggccagcgccagctagtctgtcttggaagagtgattctgaaacggaccaagatactggttctggacgaagccactgcttcagtggataccgcgacagacaacatgattcagaaaacactacgtgagaacttctcggaggcgacggtcatcacgattgcgcatcgaatcacctcggtcctcgacagcgacatggttctgctcctcgacaacggtgtggccgtggagcgtgacacgccggtccaagctgctggagaacaagtcgtctctgttctcaaagcttgtggcggagtacacgagccgagagacgcatgcgtggcgatcgatgagatccgcccccggattcgttctaccacggggggcgtcttgcgtgagcctggccgtcgataattcccgaaaaattacttggtagatgtgatggtgaagtgctctccggatctgccacgggtgttggtgctactggatacgcgcacggtaactttacattttctgaaggaaaaggctgaaggtggttaagagtcggtcaaagtttagtgtttgaagaaagtagttcgttaaggatagcaagacctgaaccatggtagtagtcactcactttacggcggaccatacacgccgaaaaagttttggggcttagtaatttgatgatgtactgtgtgataccgggataaataaatgaagtggaagtggttcagtttagcactgttatatcagggtcccctccctgactgtccctctcgctctcgtgcgcctttgctcgctcgccctctcgctcgccctccctctcccgctctcccgctcccctgcccgggcggccgctcgcattctcttgccctctccatcttgcaagtcaaattcctctaaaaaggggggg

SEQ ID NO: 17231 - DNA, 1177 bp, Triticum aestivum
  Clone ID: PAT_TA_17231
cacaagtcacacaggcaacaacaaagctcgtttaccatctcgtctgtcgagcttccagcgagcccgaggagagagcagcgcacgagaaacacgcgatcgagctggtgaccgatggctggaacggagtggtgctggccgctgccggcgtggatgggctccggcgcggcgtggttcgtggccctcaacctcgtcgtgggcgccatcttcgccctgtcgtcgcgtgcgcagccgcagtcgccgtcgccgcgccgcggcggcagcgggggcgggatcacgcgcagggcctcgtcggcggtgctgcagcgcatccgctccttcagcatcttctccttcccgtcctcgtccttccacacggcggagcctagcccgggcgccaccgccgcggccaccttccgagaaacagaggacgccgggacgccgaccaggaggtcgccagctacaccgcgtgaccgtgtaccacgcccacacgcgacggcagagccggcgaaagaggacgccgtggaagacgagaactcgatgagcatggacgaggcgtacgcgctcgccctggcagggcggcagcgggcgccgccgacggaggaggaggcggccgggtccgaggtggacgccaaggcggaggagttcatccaggggttcaaggaggacctcaggcagcagcgcctcaactccatcttcaactacacccagatgctcaagcgccgcgccgccggcggccagccgcctgccgcaccagaatgataccgtcgcatcgcaagtatggttgttggtctgatcgttccgcctccgtgatggctgaaagttcaggccaactcaggattgacttgctgtcctggacgtcgctgccggcacagcggccctgcctggtccaccattgatttcacatgttcattgctcatttttatttttattttctttataaaggattgcgtcgtgggcttatttttaaaaaagggagagctagcctttttgagttgcttgctcccgtgcacattggctttttggttgtgggtttgtgcagattgcttcttgtgggtttcgtatttattggcttgcactcctgtacataggcattttggattggcttatgtgcactccatgccagttttctttgtgttgtaagcacattcttttatttgtttgtatgtataacctgaaagtccacagtcgtatgcactgc

SEQ ID NO: 17232 - DNA, 519 bp, Triticum aestivum
  Clone ID: PAT_TA_17232
ttttgaatgtaacaagagataataataatggtggcctaagggtctacaaaacaacaacgtctgggcggccccccgggctggtacaaacaaaaggggaggctttcttttaccatagtcagatattgacatcttctacagcactagcagtagatgacaggagacggcaattcacactggcataggaattcctttgtctgggcagatgaaccaaacacaagctcctccccaaggaaacccatggtttgaagtcttgaaaggaaagaaccatctaaaacatgctaactggactctgaatgccaccagcccctactcatcaatgctcggatcaggatcagccgaggtgcgagcccgaattctgattctcttgtccccaactgttcccccacatagcagatgctgatcaaggggatacatatagtaaggtgccaaactgcttcaacagcaaatgccgcctcatcatcagcgcaatcagtgaatttgtttccagagatacgcataaccggtggatgctccttcagt

SEQ ID NO: 17233 - DNA, 916 bp, Triticum aestivum
  unsure (1)..(916): unsure at all n locations
  Clone ID: PAT_TA_17233
atcttctctcttctccccgtccatctcttgttcgaattagaagaaagctactagtattaacagtgtaattagcgacgggcttaaccagcggtgcatgagccgaatgggcagcaacggcggcggcaagctggcaagctggctgtggcgcgcgccgcggcgggctctgggccgcgcgcgcgacctctacgtgcggagcctcaccagctgcgcgggccaattcccgtccgacgcctccttcggctacccgtccttcgccgccgcccctgcgccgtgcagcagggccgccggctaccacagcttctccgcctccgcctccccctcatcctcctcgcggtcctacgacggcgacggcgacctgcgggagctcatgcgcgccgcgtcggagaggcgggaggccccagagcggccgccggcggtgcccaggagccggagcgtggccatggcgaagatcgacgaggacgggccgtgcgactttggtctcgccggcgccggcgtgccgtttgccaggagccggagctgcgccgtctccgccggccgggccagtgggcagagggggagggccgcgcatgtgcctgtggcttgatcgattgttgcactgggaagcttgcctcgtgtccagccttcctctattttcccccttcgacttcgagtgtgcagaaatctgcagtcggtgctgtaaatagttaatccttctcgcaccattctgttctgtatggaaattattctggcgcattcgcttgttgtaatctcttccgcgcagcagtcgtccccttttcttatctatccttatcttcgatcgtatttagtccgtgtcacggcgtatccggatccgtggggcttctgtctgagctagnttggagctcaaatagcttaaaagtatctaaatataaacattagttggagctaaaaaanaaga

SEQ ID NO: 17234 - DNA, 363 bp, Triticum aestivum
  unsure (1)..(363): unsure at all n locations
  Clone ID: PAT_TA_17234
cgcggcggcggnggcngngggnggggaagcaacttcaagaccaagntgngnganaanttcacgaaaggatcgtgcacgtttggcgacagatgccactttgcccatggcgagaacgagctgcgcaagtcggctgccgcgtgaggttgatctacccncccaacgtgatttntagtagngattagtcggtgtaactntgaaccttgagggctgatgatggattttctgactntccctgagattatgccatcgattttttgggtttcaaaaaaaaaaaaaaaaaaaaaaaaaaaaaaaaaaaaaaaaaaaaaaaaaaaaaaaaaaccctcgagactagttctctcctcgtgccgaattcggcacgag

SEQ ID NO: 17235 - DNA, 1095 bp, Triticum aestivum
  Clone ID: PAT_TA_17235
atctcactccaccactcgcacccgtccccactccccaccgggcagccctccccttcgtcggcagcccaaaaaccctcgggagcgaagcgaggagaggacggcaatggcggaggcgcggcgcagccacccgtcgcagtacgtgaagctgaccaaggaccaggacgcttccgcctgcggccccggcgtggaggacatccgccctggcgagctcaacctgcccgtcgccgtcccgcagctggagcggatgaagtgcatccagtgtgggcaggtgctgcctgagggccaccaggcgccggccgacgagccgtggacaaccggcatcttcggttgcgctgaggaccccgagagctgctggactggactattctgcccctgtgtgttgtttggacgaaatgttcaggcccttagagaagatatcccatggacaagaccctgcacttgccatgctgtctgcgttgaaggtggcattgcattggcaattctcacggctatattccatggtgttgacccagacacatcgatcctgattggtgaaggcctggtctgcagttggtggatatgctctcaatatactggtattattcgtgaaaagcttcagaagaagtatcatcttgagaactctccatgcgatccttgcatagtccactgctgcttccactactgcgcgaactgtcaggagcatcgtgaaaggaaaggccgacttgcagaaaacagtgttgttccaatgaccgttgtcaacccaccgccgctgcaagagatgagcatggctgagaacaacgctcccacatccgagaatgaagggtcaaaggcagcatgagaactgaaactgacatggagtctgctcgcccttttagaggccactatatatacagtatattgttaaatgactgtcatctggcaggtaccgtatgaaacattggtctgatccagattttagtttatgaccattactacctgtgatagaatgttgcccgtgggcatgtgatatatatgtgtggagaccattactacctatgatagaatgttgcctgcgggcatataatatatgtgtggatatatttacgaaaaaaaaaaaaaaaaaagcccctttgaaaa

SEQ ID NO: 17236 - DNA, 730 bp, Triticum aestivum
  Clone ID: PAT_TA_17236
ccggtccggaattcccgggtcgacccacgcgtccgcggacgcgtgggttcactcagagtgaacaaggtggtgaaaacagtaacactaacgacatgatggctttctacaggcgatcactacttagtcagtcaacggtagtcctgccctcgagataccaagatgtctctgataattctgtttccagagctggaagtgcaagctgttcatcagggaacttgcacaatcctatcgagactccacaagggattcctcaaatatatggtaccactgacccaagtcctataggtcaccagcaaatgtccctggagagagacagttcgataaaggagcagggtgaagcaactgtggtcaattgcgaatcaaccaccaaaccagatagcagaaagagaaaactaagcttcgagcatgccgcctcaatccctgtcataaaccttgaaccggaaccagcaccaccttcctcacatgttgctactgaagtcggtaatgacatatactgggacgatgctttctttgagaaccttgattttgatgcaattgaagcacaagcgaccgagcaacttagactccagaaagcacaatcagcacaaaaaccaacggaaactaagcgagcatctgatgtcagcttcacgcctccttcgtttgatcttgggatctgatagcctctgttggtgaatggccattcaaaaatgttgatgtgctgtctgccgtgtcacctgatcctgtggggtca

SEQ ID NO: 17237 - DNA, 531 bp, Triticum aestivum
  unsure (1)..(531): unsure at all n locations
  Clone ID: PAT_TA_17237
ggggggagtatgattaccaggggnttcattggcggagtctcgtacactttaatctggcagtctgcccttggctcttctctaccatttcttcagtnttagcctgttgatgactggacgggagcacgcaactgcctatcttcggttgctggtagacgacggagccagcgccgttgaagttgcacgaaccgtcggcccggccgttgcgctggtagaagtcgttgaacgcgtaggacgcgtgcgcgaccttggtgtcggggtcgaagcaccgtgcgcccggcgcccggccgccgcgccccccgccgcggccccgcccccgcccccgccccccctgcagccgtgcgtctccggccgccgcgttcgccacgcaccagctgatgctcgggtcgcagatgcctgcgggctgctggaagacgatggaagcggcgccgctgaaatcgcaggtcccgctggcccgtcccttgcgctggtagaagtcgttgaacgcgtaggaggcgtgcgccaccaaggtgttgggctcgtagcacggcttcc

SEQ ID NO: 17238 - DNA, 815 bp, Triticum aestivum
  Clone ID: PAT_TA_17238
ttttacaaagttgagagactttttttaaggcaaaattgagacacttactttgatacggagtgagtactagttgtcactagatcgattttagcgtggtcgcggccgaggtacgacttgctactggccaagcgatacgttcaacagttcgacactagattcttccttctagctacatgcggcgtcccttgtcagcgatcgatcgatcaagcgcagctaaaaattcgccgactccatgcatctttctttcaccatcatccatcaggcacacggttgattactctcaattcaccttttaatcaagcacctgcgtgcctcctcttgatcctggccctgaagccgttcttgatgtggaggatgatggagatcttgggctccacgacctgcccgggcggccgctcgaacttgaagttcctcaccacggcggccgccaccgccttgagctgcaccaacgccaatgtccttgcccaggcacgtccgcggcccggcgttgaaggacgcgaacctgtacgacggcacgtaccgcggcttgccgtcctccccgatccaccgctccggccggaactcccggcagtccttgccccacacggcctccatcctccccatcgcgtacagcgacccatgcctcttgtcccctggccgcacctcgtgcccgctcggcagcgcctcggcggcggccacgcccttgtgctcaatcggcaccggcgggtacagccggagcgactcgcacagggccgcgtgcaggtacaccagccggccaagctcgtccgggtcgtaggtcaccatgcagtccagggtggtggtggcggtggtcttga

SEQ ID NO: 17239 - DNA, 757 bp, Triticum aestivum
  unsure (1)..(757): unsure at all n locations
  Clone ID: PAT_TA_17239
atttctacagacggcagccaccaagttttttttcaagcaagcgcgccgtccacgagagttcagccaggaggaagagcaattgttgccatcgaccgatcttgggtcagctcgaagcacacggagggcaacaagaagtcatctgcgggcagctacgaaacgaagcaaccgccggccgtcgaccgatcttgatcgtctcggagaagatgggttcgatggggcccgccgccgggaagccgcacgcggtgtgcctgccgtacccggcgcaggggcacatcaccccgatgctcaacgtcgccaagctgctccacgcccggggcttccacgtcaccttcgtcaacaccgagtacaaccacgcgcgtctcgtccgctcccgcggcctcgccgccgtggccggcctcccgggcttccgcttcgccaccatccccgacggcctgccgccgtccgacgacgacgacgtcacgcaggacatcccggcgctctgcaagtccaccacggagacctgcctcgggcccttccgcagccttctcgcccggntcaacgaccccgccgcggggcacccgttggtcacctgcgtcgtctccgacgtcgtcatgggcttctccatggaggctgccaacgagctcggcctcacctacgtccagctctggaccgccagcgccatcagctacctcggtaccgccactaccgcctcctcatcgggccggggcatcgtcccactcaaaggtacatatgccgagcagctgacgaacggatacct

SEQ ID NO: 17240 - DNA, 1175 bp, Triticum aestivum
  Clone ID: PAT_TA_17240
gccggccgggtcgggacccatccgcatccgtatccatatccatatccagcacgatttgatttgcaccaaccaaatcgtgggaatactctacagtctacacaaaaggcatacgaatcccacagcccttttgccatttcggagaaaaggatcatcaatggccgcggagacaatgccaccccagcatcatcagcagcaagacactagctactggccacaatagcccattgccgtctccgccggaaatggcttcctctccggcaccggcgggcgagaaagcacacgccgtgtgcctgccggcggccgcgcaggggcacatcatccccatgctcgacgtggccaagatgctccacgcccgcggcttccacgtcaccttcgtcaacaccgagtacaaccacgcccgcctcgtccgcgcgcggggcgcggccgccgtggccggcgtcccggggttccgcttcgccaccattccagacggcctgccgccgtcgaacgacgatgtcacgcaggacgtcacgtcgctgtgtaagtccctcacggagacctgcctcgggcccttccgccgcctcctcgcggagctcaatgacccagccactggccacccgcccgtgacttgcctcgtcgccgacatcattatggacttctccatggaagcggccagggagctcggcctcccctatgtccagctgtggacgtccagcgccgtcagttatgtcggtgaccgccattaccggctcctctttgtccgtggcatcgccccaatcaaaggactccaagccgctgacacatcagtaccttgacacgcccgtggatgacgtcccaggcatgcaagcgccgaacagttgacggatggataccttgacatgccggtggaagacgtccctggcctgaggagcatgaggctcagggacttcccggccttcatacgcaccactgacccggacgagctcatggtgcgcgtcggcccatgggggcccggccccacggccggcgcggccgccgtcgcccgcaacagcctcgccgacctggacggcgggtccgcggggcccgtgggggccctcggcctgcccagggtgtcttcgctcggccctctcccgctgctggcgcgcgaggagccgcccacgccgcgctcccgccatcaacctcagcctgtggaaggagcaagaggagtgcctgcagtg

SEQ ID NO: 17241 - DNA, 895 bp, Triticum aestivum
  Clone ID: PAT_TA_17241
tgtggccggctcgagcgggccgggacgatcaaaaagaccttagcgatttcaaggtccgcggctccagcaaacaaccaactaacgggacagcataatcgacaactgatcaccgtcacaatgggcgacgcagtcattgagggttcaaactggcgcctcgttgaggttggccgagtcgttgttatcaacggcgaccaccccttcgctggccacctggccacgatcgtcgagatcatcgaccacaagcgaattctcgtcgacggcccttccgcgaacgctagcctcgccactccccgacaagctgttcccctcaacaaggttctcctctcctctctcgttgttgagggcctgaaccgcggttcccgaactggtgttgtccgaaagctctgggagaagtccgagatcgactccaagtgggagcagaccaactgggccaagaagcgggaccagatggagcgaaggaaggctcttaccgacttcgagcgtttccaggttctccgactcaagaagcagcgacgattcgaagagcgcaaggctctggccaaggtcaaggcctccgcataaatgggttatttagctggagtcacggaggtgcttgaaagtcgggtttagatcaagtggcacggaacagggtacgaaacacaatcacggctgtatagaggctgctggattcacttttcgctacgttctggaaggctgtatgccacatttcatcgtccagatgaacggcgtcaatacggaaattctgagatcaactgaattcaaagcatgaggagcaccaaaaagaacatggattcattgtgaagtgtagccaaaataaaaatgaaatgaataccccctataaaaaaaaaaaaaaaaaaaaaaaaaaaaagaaaaaaaaaaaaaaaaaaggccccta

SEQ ID NO: 17242 - DNA, 665 bp, Triticum aestivum
  unsure (1)..(665): unsure at all n locations
  Clone ID: PAT_TA_17242
tgagctggcccgcncggggcaggtacccagtcgccaggtccatgccttcatcttgtccattgcccacaacacatcgagtctgataggagcaaggcgaggaaataacaaagtgttgntgcagctgggnaggatcttggcgaacccctcgctggtgccggtctgcgtgccgaagaagagggctacntgttagctgccgtcgtcgtggtcgggctcatgctcnttcttggcggcgagggtcttggccgcggtggccttgtgggccacgggtgctgtgccggggggggngcggcggaagagaagcgggncgccgcanccnacaancgcanagngnaagcggtgaantangntggcnaaggtcgccggancaggttaccagcggggagagatccacggcctggtggcagggaagttagccggaggtcagcgacgacgggaatctccatgcaatggtcgctgcaccactgggcgatgcaggattggcacggccgtcgcggtggccggatcccgcggtggggcggcgcagcggccggatccgtgggatggtggcggcgcggcggacggttccgagtgacagtggtggcagggtagccgatggcggcgacggccggatccggtggccggtggcggcgcgactgccagatctagggggtggcggtgcctcgtgc

SEQ ID NO: 17243 - DNA, 752 bp, Triticum aestivum
  Clone ID: PAT_TA_17243
ccggccgggccgggatttccgatcccaccaacagaaatcacttcccaccccgccaacaaaaacagacttcccattcgatccgccacaagaaaatactcccaagctttcggtcgctttagttgttcaacagccaacaccatgagctctcggatggccggagccacgctgctgcgccacctgggcccccgcctctttgccgccgccgagccggcctccgggctcgccgccagcgcgaggggcatcatgcccgccgccgcgaggatcttccccgcgcggatggccagcaccgaggccgccgccccgcatgccaaacaagaagatgatgccggaacaccccaggcggccgcgactccagagcagcagagcaagaaggccgtggtgagctactggggcatcgagccgcggaagctcgtcaaggaggacggcacggagtggccgtggttctgcttcaggccgtgggacacgtaccggccggacacgtccatcgacgtcaccaagcaccacgagcccaaggccctggcggacaaggtggcctacttcgtggttcggtcgctgcgtgtgccgcgggacctcttcttccagcgccggcacgccagccacgcgctgctgctggagactgtggcggcggtgccgcccatggtgggcgacgtgctgctccacctgcgctcgctccgccgattccagcacagcggcggctggaaccgggcgctcatggaggaggccgagaacgaaagcatgcacctcatgacctt

SEQ ID NO: 17244 - DNA, 828 bp, Triticum aestivum
  Clone ID: PAT_TA_17244
gccggccgggtcaggtatcggtcagttaccagatcaacaccaacagtaaacagaaatcatttcctagcccgccaacaaaaacagacttcccattcgatccgctcacaagcttttcgatcggtttagttgttcaacaatcaacagccaacagctcccggatggccggagccacgcttctgcgccacctgggcccccgcctcttcgccgccgccgagccagcctccgggctcgccgcgagcgcgaggggcatcatgcccgccgccgcgaggatcttccccgcgcggatggccagcaccgaggccgccgccccgcatgccaaacaagaagatgatgccgcgagcccccaggcggccgcgactccagagcagcagaacaagaagcccgtggtgagctattggggcatcgagcctcggaagctcgtcaaggatgacggcacggagtggccgtggttctgcttcaggccgtgggacacgtaccggccggacacgtccatcgacgtgaccaagcaccacttgcccaaggccctggcggacaaggtggcgtacttcgttgtccgatcgctgcgcgtgccccgggacctcttcttccagcgccggcacgccagccacgcgctgctgctggagacggtggcggcggtgccgcccatggtgggcggcgtgctacttcacctgcgctcgctccgccgcttcgagcacagcggcggctggatccgggcgctcatggaggaggccgagaacgaacgcatgcacctcatgaccttcatggaggtgacgcagcccccggtggtgggaacgcgcgctcgtgctcgccgcgcagggcgtcttcttc

SEQ ID NO: 17245 - DNA, 1002 bp, Triticum aestivum
  Clone ID: PAT_TA_17245
gcacgtggacctgttcacccccacccgtaacctgtgatcacccccgcgcccacaaatcatttcctagcccgccaacaatccgagccctacctttcggtccgctctcgtggttctagagccgccgccgcgctccatgagctcccggatagcccggtccacgagatcaacaccaacagaaatcacttcccagccaccaagacttcccattcgatccgatcaccacaaaaacctcaagcttttctaccagatttttagtcgttcaacaccaccatgagctctcggatggccggagccacgctgctgcgccacctgggcccccgcctcttcgccgccgccgagccggcgtccgggctcgccgcgagcgcgaggggcatcatgcccgccgccgcgaggatcttccccgcgcggatggccagcacagaggctgccggcccgcgtgccaaacaagaagaagccactgaaaagccccagggcgcaacaacgccggagcagaacaagaaggccgtggtgagctactggggcatcgagccgcggaagctcgtcaaggacgacggcacggagtggccgtggttctccttcaggccgtgggacacgtaccggccggacacgtccatcgacgtggccaagcaccacgagcccagggcggtggcggacaaggtggcgtacctcatcgtgcggacgctgcgcaagggaagcgacctcttcttccagcgccggcatgcgagccacgccttgctgctggagacggtggccgcggtgccgcccatggtgggcggcgtgctgctgcacctgcgctcgctccgccgcttcgagcacagcggcggctggatccgcgcgctcatggaggaggccgagaacgagcgcatgcacctcatgaccttcatggaggtgacgcagccgctgtggtgggagcgcgcgctcgtgctcgccactcaaggcgtcttcttcaacgcctacttcgtcggctacctcatctccccaaagtcgcgcaccgcttcgtcg

SEQ ID NO: 17246 - DNA, 674 bp, Triticum aestivum
  Clone ID: PAT_TA_17246
gccggccgggttgggagcaaccacttcaagctagtcattcatccaactgccagacgtacgcagagctcggcctgtctctgtctgcaacattcgctcaccaccaatccctccatccgctcaactaagaaggtgtatatggcgtcgtcggcgacgatggcgagggcggtggtggtggccgtgctgctgatgcagtgctgcaacgtggtcctcgcggcgaggctgctcgagcgagacggcggctggctgcacggcggcgttggcgccgctggggcgcttatcatgcaggttctgcccaggggcggcggctctgcgggagcacccaactgctgcaccaacaaccccaaacaccccgcctgtgggaaatgccacggctagcaagccgcccgcaaagctcgactagtcaattagcatggggtaatacatgtacatggtgcacatgcgtagatagagttcgtgttcattgactcattctttctgtaactgtaattgcagggcttctgtgaatattttggagccctcgagttgttcagatttacttagttttagtatataaatttgcaatataaaaaactcaaaaataggtccctattttttttgcgaatagtctcaagcgtaggtcctgtcaccaagttgtatataagattttgatatactatttcattacttgtgtatga

SEQ ID NO: 17247 - DNA, 728 bp, Triticum aestivum
  unsure (1)..(728): unsure at all n locations
  Clone ID: PAT_TA_17247
gccgcccngggcaggtacacatgaggataacctgtggggatcacngggcttncagttcctgccatcgtagcaagttcagcaaaacgntgctccagcctagcttttctgtcctctttcctttgagcaatagcaacatacaatggtttgccgtaaaacatgacaccacgcatgctgcttacggcacactttgcttcatcgggtgtgctgtaacatacaaatccgaatcctttgctaatgcccttgtcatcacgcataatctttactgatgtaatgtttccaaattcagcaaagcgctcgcgaagagtgtcatcatcaacttcatcactaatatttttgatatacacattggacccattgctcttagtgattatttcattccgcttttcctcatgtaagagctgcaaatattgctttctttcagcctttttctgagcccttgccacgtacaaagttttcgctccaagagccatcccattcatggcctcttttgctttcttggcactttccggatttttgaaactgacaaacccaaaacccttggatgtcccatcatctctcttcattatcttcacactagttacttgaccatgctgagaaaacttcaatttaatgagttcttctgtcatgtcatcatctatattcttcatatacaagttagtgtatttgtcatcattattggctgatcgttcgctcttcttaatgaaatgagctacaagcaatcctcgtgc

SEQ ID NO: 17248 - DNA, 1121 bp, Triticum aestivum
  unsure (1)..(1121): unsure at all n locations
  Clone ID: PAT_TA_17248
gccgggctgaatactcaaaccatatcagagctagtcactgtaataacaaggatcaactatggacggcacgcgggcataagtggtctagccggcgctgtgtctttagctggctccgagtctggactgtggtctatcaaaggaggcaactggcagctagctgctgggttgctcaaggctgctaacgccactctgcatctccaagaaggcatagagtcaatctctgatgctggggattactatgttctgaaatcgaataaaggtcatgagtacaactgcacggtgacggttgttgcaacgcccctcgatgaggtgaacattacatttatccctccgatctctattccaccaaggaagatgcagcatacccatacaacctttgtcagaggcctcttggaccctaaattctttggtctgagctcagtgtccgacattccagagctgataggaaccatggagctccctgatatccccttctcgtgcatctcagttcggaagaagcatggcgaacatgacatgacttacaaaattttctcacgtgcgaagctggaggatgctttgctggatcggatcttcagcacaaggaaggagaccatccggatagactggcccgcctacccccactaccaggccccggaggatttcgcgccgatcatactggacggcaggcacctgtactacgtgaacaccttcgagagcgccgcgagtgccatggagacgggcgccgtcgcggcggagaacgtggcgaggctcgtcatctcgaggctgcctctcgggctacgagctgggctctcgacggcagcggcacctgagcctcatatcgagtcgtttcccagtgaggaggaagtttcccggcgtgtggacctgtgagtgaatgtggaagatgcatactagttttgatgcctgggatcactgcagttttctttcagtgccagttgtttcctcatgtttcagtaacactagacagcaattgggttctggatgtggatgaatgctactgtgtattagacccaagnaatgtatacagaaatgaaagtggggtgtgttctttttttagccttggaccctatttttgtaaccctacggcgtgaatgattttggttcaaatcttcataaactgtata

SEQ ID NO: 17249 - DNA, 549 bp, Triticum aestivum
  Clone ID: PAT_TA_17249
ttttttttttttttttttttggcaaaaaatcagctgcatcttcagtcaaatcaagaatttaacttgtttagacgttctgaggataagaacaaactaaagcaaaaggaaattacaaggtacttctactactacagcgaccgcccccggcctggacatttaaaatgcaaaatgtgaagcttccacttgccagaacttcttatgtgcttcctccagaggaaatattacccaaaagtttgatgtttttttattgtaaccaaagaaacagaacttgaatagcaactacaatagaaggtctcaagaagaaatagagtaagaaattgcatcgtcctcaatgtagtgaatcttcttgcgtggaaatggtcgcataacgcatcttacaaagcgactcaaaggatcctgcaagccttctatttcatagtggccaaatcgccagtcccgcaatacaaaagctcgctcaataggccgatctagaccccctgcatacatacgactatgtttatctacttccctgtaaaatgggcgtgttttcttctgaatcgcagcttcttg

SEQ ID NO: 17250 - DNA, 569 bp, Triticum aestivum
  unsure (1)..(569): unsure at all n locations
  Clone ID: PAT_TA_17250
tntattgcgnatcctacaagacccttgagngcggcacgcaccgacgngcgttgtgacagcgacgcgagcccngcgacgtgccgggctgaccccggaggtgccgttgagcagatgtgctccggcgnttgagatgagagcgacgaggaggacgacgaggagagcagcgacgccagctccgacctgttcgagctggagaattcgccgcggccgccgtgccgccgggcgcggggtacagggacgagctgccggtgtacgagacgacgagggtggtgctgaaccgcggcattgggcacgcgcagcacgggcacggccggagcgccagagtcgtctgacgtcgctcggacgatcggaccgcgcgcgcggtgactgtaaaatgcaaattagttagcgagatgggaggtggagtaagcgttttattacgtgctctctcttttaaccgttggtgttctctctgagattttctttggttttggggcgtggagtgtactcagatggtactgtaatttctagccgcaggagatcaatcagtaaaatgttgttcctagtgccaaaaaaaaaaaaaaaaaaaa

SEQ ID NO: 17251 - DNA, 309 bp, Triticum aestivum
  Clone ID: PAT_TA_17251
accaccaagtgctgttaagagaccaaatccaaattttcattttacactttctatggtcttcatatacaagacgaatttaaaaatcctataaacaacatatgcctctgctgcagatgcaaatcctactgatcaactaaatcatgcgaccaccccgcagctgtggaatggctggacttcactgttgtggtggcacaatggctggaaatccgctcggtgagtgacctcaagacaaagctgggtcatgtaatcgtcctggttctgctggttggcatctccgagaagagcaagagggtgaccatcacgtcgtgt

SEQ ID NO: 17252 - DNA, 1041 bp, Triticum aestivum
  Clone ID: PAT_TA_17252
ccacgctgtccgcacaaaataatttctttaagatttcattttccattgcttgtttggtattaatatgataactgacatagacacacaacaagctaacaatgacatcaagttgtcggcagcggcgacatcaacggatggagggtacgcctgctgcagtggactttgtcatctcatcaacatcctcgcccgtgacagtacacggaagctttctcttgctgttgaaatctctgaagaattttatggaagattgcatcaagggggatatattggttttgaggcaccagcacttttttgcttaggagtagttttgctgctttgttgataagcatactgaaggtattatttctttttcaccacgagggcggtggcgggggttgctgcagctccagcgtggccctggagctcatggtgtgcctcatactgtacctcaactacctgtacgtctgatggagcaaaagggacggtgtgcatcgaacggggccgggtcgatgaggaagaggaccggcagagggggctcgacaaggtgtcacattcaaaaggcgcggacgcatggttgcgacagcaaggtcggggaggagtgtgcagtctacctgggtgccatgcaagatggatacggcacggtggtcgggccgacatggagcattctcattattatggaaaatgatggatagcaaaatccacaagatcaccagccgaggggggagggtggcttgacaaggcggtgctggcagctatgcccatgccagtgttcagattcaagggggtcgcgcgatggcgcaaagattggtagccactgcatatgtgttgcttcatcatcatgccttggaagcatgggtggcttccgctgcttgatggttagccatccagtacacaattattttttgttagcttgtttcaattggaagcaataatttcttgctatgacttctagattgtaatccttcttgacttttgaatcagtgataagtgtaatcctacttgactttgcatcagtgataaatgattcaatgagtttgtaattaaaaaaaaaaaaaaaaaaaa

SEQ ID NO: 17253 - DNA, 707 bp, Triticum aestivum
  Clone ID: PAT_TA_17253
cgatgcaagatcacatccagatgccgggcggtcgctacgacggccgcgagtccttctccaacgagaccgaccagctgcccgggcccttctctaatctcacggcgctccaggggagtttcgcggccaagggactcacctccgacgagatggtcacgctttccggcgcgcacaccattggccgcgcccgctgcttgttcttctccagccgcttctctgagatggactcggcattagccgccaaactcagggcccagtgcggcaacgacaacgataatgtgaaccaagacgatgtgacccccaacgtcctggataagcagtactaccagaatgtggtcgacaagaaagtgttgttgacctcggatgccgtgctcaactcgacggaaacgataacgcaggtgacagaaaacgcgaacatggatggggcgtgggagaggaagttcgagaaagccatggggactatggggaaaatcggggtcaagaccataggcaaccagcaaggcgcagagatcaggaaggtatgctggagagtcaacaactaatgttggccagcagtaacgcccggtagttggccggctccatgtcttgatcccccgatggaggagatctaatttcgcctatctagtgccgttgttgtatttctcatactaaaactctgtatgtgtgtgttttgatgtattaataaagatataataatatattctctctgt

SEQ ID NO: 17254 - DNA, 1374 bp, Triticum aestivum
  Clone ID: PAT_TA_17254
cgccaccgccactacaccgccggcccgtcttgtgccaaaaaaacagaaaagcaaacagggccgcgctgcaacgaaacgaccctctctcgggctactggtgcgaaaggaagatggcgactaagctcgcagcgctcatcgtcttggccgcgttcctcgccgggccggcggcgtccgaggccgccagcatttgcttcaacggctggctgaggctacccacctacaacccggtgctctgtcgccccaggccggacgttcagacgcggcaggaggagacctgctccctcggggtcagggctcacctccggctattacaacaccaggtgcgcctagcgcggataagattcgtcacggatgccgtgaagaaggccgtggatgcgaaccctggcattggtgccgggctcaatccgcctcttcttccacgactgcttcgttcggggcgtgcgattgggttccgtccttctcaacacgaccaacctccaaggaacaggcgacacggaaaggagaaggccctcccaaccagaacagcctccgagggttcgagggtggttgacgaggccaaggcggccgatcgaggccgcctgccccgacacagtctcatgtgccgacatcgtcgcctacgccgcccgcgacgcgtcctactttctcagcgaccgtcaagatcaacatccagctggccggggcgggtcgctacgacggccgccgagtccgttctccaacgagaccgaccagctgcccgggcccttctccaacctcacggcgctccaggggagtttcgcggccaagggactcacctccgacgagatggtcacgctctccggcgcgcacaccatcggccgcgcccgctgcttgttcttctccagccgcttctctgagatggactcggcattagccgccaagctcagggcccagtgcggcaacgacaacaacaacgtgaaccaagacgatgtgacccccgacgttctggataaacaatactaccagaacgtggtcgacaagaaagtgttgttcacctcggacgccgtgctcaactcgacggaaacaataacgcaggtgacagaaaacgcgaacatggccggggcgtgggagaggaagttcgagaaagccatggagactatggggaaaatcggggtcaagaccataggcaaccagcaaggcgcagagatcaggaaggtatgctggagagtcaacagctaatgcggctccatgtctggttccccccctcattgagatctaactttgcctagcaaagtccgtgtgttggttttctcatagtaaaactctgtatgtgtgtgttgtggtgtattatactaaaactctgtatgtgtgtgttttgatatattaataaagatataataatatataagtaacccgtgt

SEQ ID NO: 17255 - DNA, 1336 bp, Triticum aestivum
  unsure (1)..(1336): unsure at all n locations
  Clone ID: PAT_TA_17255
ggcggccgacgcgccctacccaacccccaggcccaccgggtcccttctacctcccgtgtcacacactaaaccaaaccaccgatcatttccacccgacgcttccaccgcccgaatccagccagccagccagccaggcgaagctgcgaggatgtaccgagatcccaatcccttcgacgagggcgccgacgacagcgccttctccaatgggggaggacgcggtggtgccgctggtggtggtggcggcaagtcgcagttccagtttcgcccgacggagcccgtcggattcggcgccggtggcaacggggacgccgccgtcgacatcccccttgacaacatgaacggttcgaatggcaagcaaagtgagctctcgcagtggcaggcagatctcaagaggcgagaggcggacatcaagaggagggaggaagctctcaagagtgctggggtgcccatggaggacaagaactggcccccattcttcccaatcatccaccacgacattgcccatgaaataccaagccaacgcgcagcggttgcagtatcttgcttttgctagctggctcggcatcgtgctttgcctcgtttggaatttcattgctgtcacagtctgttggatcagagggggagactctaaactgtttttcctggctactatttatggtatgcttggagtacctttgtcctacttgatgtggtataggcctctgtaccgtgcaatgagaactgacagcgcattcagctttgggtggtttttcctttgttacatgctccacattggcttttgtataattgctgccattgctccgccaatcgtatttcgtgggaagtcattaacgggtatactggctgcaatcgataccttctctgatcatgcattagttgggatactttactttgtcggatttgccttgttttcactggagacagttgtgagcatttgggttcttcagagagtatacatgtatttcagagggcacaagtgaagcggcaacggaagaaaatacagaagtccaccggtgtcatcggagcgtgctgcggttctgtgcatacatatgagtacatgccattctttgtatgttatggtagttatgggaataatttgcctcagaagttcagaagtttgtttatttgttggaagagagtagaagtgtaacaaccgttgtattagtgttatctctggaactatctgttgtttaaagccttggatcttacctatataaactgcatgttgtttgaagcctagcatttttgttcgcttgtttgcttccatagtgatccctaaagttaggatatatggaaccaatcaagttgtgatacatgttacngctggaaaaantat

SEQ ID NO: 17256 - DNA, 528 bp, Triticum aestivum
  unsure (1)..(528): unsure at all n locations
  Clone ID: PAT_TA_17256
ttttaagattcatggaagctataaagggcaacgaaaacataacgaaacatggccggacagggccacctacaaacagatacatggagcaagtctaggccaagtacagccgggttgagacccacagctgcaactagacgtgaaagtagcaaaggaaagaggctgcgaccaagctcagaagagctaagacctatggtcggagcaaaggtaggactaaaacgggatacagacgacagactgatacaagccaaagcgcgatggcaggagaaggaccgcgagggggatccgggggcttgacaagtttgaangacgcaacattangacacaatgccggtggtcatcaanggagagcccgggcaggcacgtcacaggcagcggcaagctccagcacgtcctgccgagggaggggcgaggagacctcgggcgccaagtcgatgagctgaactgggaggagcgcctttccaccagcaaaaatctttccttccttcaagacacgcatgcgctgagtggccntctggatgatggagacgt

SEQ ID NO: 17257 - DNA, 608 bp, Triticum aestivum
  unsure (1)..(608): unsure at all n locations
  Clone ID: PAT_TA_17257
caccaagtcccaaagcaatttggaagcaccatccatcctagccaggctcccagtagctagcagcttactcaaggaagcagcggcggcaggcggcagcagcgcaacgagtgctcaggacaaggagacatggcgtccatgatgggaggagacttcgtggaggcctacgtgctcaagaacgcctacaaggagaagctgaggcgcatggaccaagccgaagccgcggcggcgctcgacggcgcaaagagcagcaaggacgccgccggggccgctggagagaagaaggaggctggtggtgcgagcaccagggggcgattctttggcctcatgaagaagaaggtgcaccccaaacccaaagcggcggcgggggcggccacttcctcttgattatattgctactgtatttgccatgccacgaaattgtaagccgcagctttcttctagctaggagtgtgtgtgtaggtttgttctttcgatcagcttctcttggaggagtgtgtaaagcaagttcttttgttaattgttcaaaacaagtcgacggaaattaagtcaaggataatccttcaaaaaaaaaaaaaaaaaaaaaaaaaaaaaaaaaaaaaaaaananng

SEQ ID NO: 17258 - DNA, 602 bp, Triticum aestivum
  Clone ID: PAT_TA_17258
gccggccgggggccggaaccctcccacgcaagtcccaaagcaatttggaagcagcaagcagcgcaagaagaatttgttagagaaactgatatggcgtccatgatgggaggagactttgtggaggcctacgtgctcaagaacgcctacaaggagaagctgaggcgcatggaccaagccgaagccgcggcggcggcgctcgacggcgcgaagagcaggaaggacatggaggccgccggcgccgctggagagaataaggctgctgttggtggtggtgcgagcagcaggggaggcttctttggcctcatcaagaagaaggtgcaccccaaacccaaagcagcggcggctacttcctcttgattatattgctgttctgacatgccacgaagttgtaagccacagctgctagagctgccgcgcctttcttctagctaggatcaggagcgggtgtgtagagtttgttgtttcgatcagcttctcttggaagagtgtgtgtaaagcaagttcttttgttatttggtcaaaaaaagttgacaaaaactaagcgaagagtaatcctgcatcgattgagttgacctcaaaaaaaaaaaaaaaaaaggccccta

SEQ ID NO: 17259 - DNA, 836 bp, Triticum aestivum
  Clone ID: PAT_TA_17259
gcctacgccgtggctttggaggccgtgtgtaggccgcgcgcggccatgcgcgatgtccttcaaaagctctgaggattgaacttcttggcatcacttgtgtacagtagtttccagtagcatcgtgtcgtatgcatggcttgatactgttttgatgtattgaataaacttgttgcgacttcagagcaaaaaaaaaaaaaaaaaaaaagagacgctcgacgggcccggggacccacccacacacaagtcccaaagcaatttggaagcaccatccatcctagccaggctcccagtagctagcagcttactcaaggaagcggcggcggcagcagcgcaacgagtgctcaggagaaggagacatggcgtccatgatgggaggagacttcgtggaggcctacgtgctcaagaacgcctacaaggagaagctgaggcgcatggaccaagccgaagccgccgcggcgctcgacggcgcaaagagcagcaaggacgccgccggtgccgctggagagaagaaggaggctggtggtgcgagcagcaggggaggattctttggcctcatgaagaagaaggtgcaccccaaacccaaagcggcggcggcggcggccacttcctcttgattatattgctactgtatttgccatgccacgaaattgtaagccgcagctgctagaactggccgcagctttcttctagctaggagtgtgtgtgtaggtttgttctttcgatcagcttctcttggaggagtgtgtaaagcaagttcttttgttaattgttcaaaacaagtcgacggaaaataagtcaacaaaaaaaaaaaaaaaaaagcctaaaaaaaacaaaaa

SEQ ID NO: 17260 - DNA, 669 bp, Triticum aestivum
  unsure (1)..(669): unsure at all n locations
  Clone ID: PAT_TA_17260
cggccgctcgaggcggcggggcgggatctcacacaaagtcccaaagcaatttggaagcatcatccatcctagctaggctcctggtagcttacttaagcaaggaagaagaagaagcagcagcagcagcagctcaagaagagttgaggagaggaggagctgataagaaatggcgtccatgatgggaggagacttcgtggaggcctacgtgctcaagaacgcctacaaggagaagatgaagcgcatggaccaagtggaagctgcggcagcggcgcccggcagcgcaaagagcggcaaggacaaggaggctgccggcgccgctggagagaagaaggctgctggtggtggtggtgcgagcagcaggggaggcttctttggcctcatgaagaagaaggtgcaccccaaacccaaagcggcggcggcgcccacttcctcttgattatattgctactgtatttgccatgccacgaaattgtaagccgcagctggtagaactggccgcagctttcttctagctaggagcgtgcgtgtgtgtaagtttgttctttcgatcagcttctcttggaggagtgtgtaaagcaagttcttttgttaattggtcaaaacaagttgacagaaattaagtcaaggataatccttcattaataaaaaaaaaaaagacccgtttttann

SEQ ID NO: 17261 - DNA, 844 bp, Triticum aestivum
  Clone ID: PAT_TA_17261
acatggcgtccatgatgggaggagacttcgtggaggcctacgtgctcaagggccccgtctaggccccgcgcggccgcgctcgcgtccggcccggcgtccgctcccaccaactacacgagtcccaaaccatctgcaagcatcgttcatcctagccaggctcctaacttacttgtaccttacttagacaaggaagcaacggcagcagcaagaatagttgaggagaaggagaggaggagctgataaggcatggcgtccatgatgggaggagacttcgtggaggcctacgtgctcaggaacgcctacaaggagaagctgaggcgcatggaccaagccgaagctgcggcggcgcaaagagcaccaaggacgccgccggtgccgctggagagaagaagaaggctgctgctggcggcggtggtggtgcgagcagcaggggaggcttctttggcctcgtgaagaagaaggtgcaccccaaacccaaagcagcagccgcggccacttcctcttgattatactactgtattcgccatgccaccaagttgtaagccgcagctttcttctagctaggagcgtatgtgtgtgtatgtttgttctttcgattagcttctctgaggccaaagaaactttgtgttggaggagtgtgtaagtcactggctgtaatgtttgcaagttgttttgttcattggttcaaataaagttgacaaaaaaatgaatcacaaaaaaaaaaaaaaaaaaaggcccctacaacatctaaacaactatcaccgttctcaatttgatcctttcagaactccaacaaatcatccaaatggaaagcccctatcgtccctcgctccttctgccctcg

SEQ ID NO: 17262 - DNA, 921 bp, Triticum aestivum
  unsure (1)..(921): unsure at all n locations
  Clone ID: PAT_TA_17262
tctgcagcgcagtgaacgggctgctcaagaagngctatgagctctccgtcctctgcgaagccgagatcgccttgatcgtcttctccgcccgcggccgcctctacgagtatgctagtaacagcacgaggacgacgatcgacagngtacaagaagtgcttccngcaagcgcttctggctctgctccagctatagacgtcaattctcagcaatactttcagcaagaatcagcgaaactgcgccatcagatacagtccctgcaaaatgcaaacagngaacctgatggngcngaatccngtcggcaacttgacactgaaggagctcaagagcctggagaacanggctcgacaagnggcatcngggccggatcagagcaaagaagcacgaactgctgttcgcggagatcgaatacatgcagaagctggaggcggatctgcagagtgagaacatgtatctccgagccaagtggcggacgcggagcggctggccctggcggcgccgccgccgtcgtcgggcggggcggagctggaggtgctcccgacgttcgacgcgaggacctactaccaccaccaggcagtgagcatgctgcaggacgcggcggcggcctcctcctcctcgcgctactcccagtcgtcccaggcggcggcggcggcggcgaccaccgctcttcacctcggctaccagattaaggggggccaactgaactgatcgaccgctagctagctccactcggcggctcgggacgcgcgcgcgtcacggcgggagatagcacccgcgctgtcgaccgatccatgtcctctactagttcgataggtttgctggataacctacgtacgtctactttattaccacagtactgtattgcggtatgctacctaaataattgcgtgatgtgtgcgaagcgaggaagtgtatgtagtacgt

SEQ ID NO: 17263 - DNA, 779 bp, Triticum aestivum
  Clone ID: PAT_TA_17263
gccggccgggtcgggacatcctaagttcctaactacttctgctcctgcgtccagcctcagcagaagctgacaagaatggagaagccgggcgtggacgagcaccccctgctcgtcgagcgggacgagaatacggcggcaccggaggcaaagcgactgctgcggctggctggaccgctggtggcaagcggcatcctccagtgcgcgctgcagctggtgtccgtgatgtttgtcggccacctcggcgagctgcccctcgccggcgccgcgctggccacctccctcgccaacgtcaccggcttcagcctgctggtcggcatggcgagcgcgctggacaccctgtgcgggcaggcgttcggggcgcggcaataccacctcctcggcgtctacaagcagcgggcggtgctggtgctggcgctcgcctgcatccccatcgccctcgtctgggccaacaccgcccggatcctcctgctcctcggccaggacccggccatcgccgccgaggccggcgcctacgcgcggtggctcatcccggccctcgtcccctacgtccctctcacgtgccacatccggttcctacagacgcagagcatcgtcgtgccggtgatggccagctccgccgtcacgtcgctgagccacgtcgccgtgtgctgggcgctggtgcacagggctggcatgggcagcaaaggcgcggcgctggccaccgcagtatcctactctgcaaacctggccatactgtccctgtacacgaggctgtccggcgtatgcaagacgacatggac

SEQ ID NO: 17264 - DNA, 781 bp, Triticum aestivum
  unsure (1)..(781): unsure at all n locations
  Clone ID: PAT_TA_17264
cgggaattacaaaaaaaaaaaaaaaaaaaaaaaaaaaaaaaaaaaaaaaaaaaaaaaaaaaaaaaaaaaaaaaccaggcaccccccactgctcctcgacctccatcccaccgctcgcagctcgaaccaaggaagagaccgtcagccatgtccgggcgcggcaagggaggcaagggactcggcaagggcggcgccaagcgccaccggaaggtgctgcgcgacaacatccagggcatcaccaagccggccatccgccgcctggctcgccgtggaggcgtgaagcgcatctcggggctcatctacgaggagacccgcggcgtgctcaagatcttcctcgagaacgtcatccgcgacgccgtcacctacaccgagcacgcccgccgcaagaccgtcaccgcaatggacgtcgtctacgcgctcaagcgccagggccgcaccctctacggcttcggcggctaggcttttcctcccccgcccgcccatccccaaagcttggtacaccagcgacttgtgtaactctgtatttgccctgtagctcgaacctcttcgggtaagaaagtaattcgcacctggcccccctcccctgcagatatcccaaaagcttgatggaaccgcggcttgtttagctctctatttgctctgtagttcgaactgaatcgtggaacaaagtggttcgcatatgttgctggaaatcaaacttgtctcagtgaaaaaaaaaaaaaaaaaaaaaaaaaaaaaaaaaaaaaaaaaaaaaaaaaaaaaaaaaaaaangggggcggccg

SEQ ID NO: 17265 - DNA, 626 bp, Triticum aestivum
  Clone ID: PAT_TA_17265
tgccggccgaaaatctgcctgaaatccgcgccgctccctccagcccaccaccgcgctctaggtcgtcgcggctccaatggtgaccaggtggagccagaagagccccggcctcaagatcctgtggatctggacactgggcaccgccgcgatcatgatcacgaacgtcgtccggacgcgcgtcaacgatatgcagatgatcctccgggaggaagacgaagccgtcggctctggcggcggcggcacgggcggcgggccctccggcgagcgcgtcatgagggacgacgagttgaattgagcagcaagtgaagaagagttcgcttgagcttgagcgactctacatagcaaaattcgcggaagcctgcgtttcgccagccaagactaaacgattcatcgtttgatggtctccagaaacttttttctagggcatgttattggtaaagcagtgcggtatgtacctgcgtgggtcatgaaactgtggaagtgcttggtcccaaatactgctgcctcatgtccctgtctgttgcttgaaaatgaacctgtaactttacacggtgaagttttttatggtaagaaagagtgccgaatgtttctgggcccttttccagtggaactgggcatcgttaaaa

SEQ ID NO: 17266 - DNA, 690 bp, Triticum aestivum
  Clone ID: PAT_TA_17266
tctgcggcggcatcagctttctcatcggcgcagcccttaatgcggcggctgcggacctcacgacgttgatcctcggccgcgtcatgcttggcgtcggcatcggtttcggcaatcaggctgtgccgctgtacttatcggagatggcgccggcgcacctccgcggcgggctgaacatgatgttccagctcgcgacgacacttggcatcttctcggcgaacatgatcaactacggtacgcagaaaatcagccgtgggggtggcgcctctcgctcggcctcgtggcagcaccggcgctgttgatgacggtgggcgggttcctcctcccggagacgccgaatagcctcatcgagcgcgggcacgttgaggagggccggcgcgtgctggagctgatccgtggcaccacagacgtcgacgctgagttcacggacatggcggaggcgagtgaactggccaacaccatcaagcatccgttccggaacatcctcgagcggcgcaaccggccgcagctggtgatggccgtgtgcatgccggcgtttcagatcctgacgggcatcaactccatcctgttctacgcgccggtgctgttccagagcatgggcttcggcgccagcgggtccctctactcgtctatgctcaccggcgccggactcttgttctccacgctcatttcaatcgccaccggcgaccgcct

SEQ ID NO: 17267 - DNA, 688 bp, Triticum aestivum
  Clone ID: PAT_TA_17267
gccggccgtgtcgaagaacaaaccatcatccctctccaactttcaaacacattgagcaacaacaatattacaaaattacactcaaaatgaccgtccacgtaatcaaaaacctggctgaattcagagatcatctcgaaaaacacgaagttgtcattgttgacttctgggcaccatggtgtggtccttgcagattcatcagcccagtggtcgaaaggatgtccgaacaacatggcaacgacaaagtctttttcgtcaaagtcgacgtggatgaggctgaagatatctctcaagaatacgggattcgcgcgatgcccacttttatggtttttaaagacggcgaaaaggtcggcgagattgtgggagctgatcctaacaagcttgaacaaatggtccgacagttcgccagttgaactatgtcatacaataagtaggaaaggcctgatgagggattgacgatttggattggttgactcccgctgctgattgttacaagactttaatggaggggccggcaagcaaggtgaaaggaaacactgtaattaggaatcaagactaagctctacaccgagaataccattccttgagttatcttgtcaaaaaaaaaaaaaaaaaagattgccagtgggctatcataaaaaaaaaaaagaaactgtcgtgtttgcaaaaaaaaaaaaaaaaaaggccccta

SEQ ID NO: 17268 - DNA, 544 bp, Triticum aestivum
  Clone ID: PAT_TA_17268
acaaagtgatctcatttcgcagaggagattataattagctatctagcactccatcagagcctcagatgtcaaagactttttgttgttgcggccgtttgcgtggtggtgttgtgtttctccttctacctccttctgcaatgggttgctttcacttcttgtcggccttcttgtcgtctttcttctcctctttcttgtcatccttcttctcctcgcccttcttctccgcagccggtgccggcttcttctcctccttggccgggccgaccgagacgatgtcgatcttgccgagcttcttgagcctcttggcgatggctacggtgtccatggcgccgatgacggtcatcttgttgtccttgaggtccgcggctatcgagtcgataccgtagatgtcggcgacggcctccatggctttctgcttggtcttctcgtcggtcatggtgggaatcctcagcaccaccttctgggccatctggcaggaggggaaaggccggccgggagagactcaactcaagagggacaggaaacagtgggaacttgtgaagag

SEQ ID NO: 17269 - DNA, 1586 bp, Triticum aestivum
  Clone ID: PAT_TA_17269
gcctcaccccgcacatacacatgcacgcacgcaacactcgcagaacacacgcacgcatgcaggcgtgcaacaccgccacgcacccattcaaccgcgacccaacccaccccgtcattctcaccaccggcgcctcccccctcctcagatccacgcgcgcccgcgcgcgaccagccgcgatgacggccaagggcggcgcgtcgccggcgccgggcggcgcgggagctgcggccaacgggcgcttcttcacggtcgggctcgtcaccgcctggtactcctccaacatcggcgtgctcctgctcaacaagtacctcctcagcaactatggcttcaagtaccccatcttcctcaccatgtgccacatgtccgcctgcgcgctcttctcctacgccgccatcgcctggctccggatcgtgcccatgcagctcgtgcgctcccgcgtccagctcgccaagatctccgccctcagcctcgtcttctgcggctccgtcgtctccggcaacgtctcgctccgctacctgcccgtctccttcaaccaggccgtcggtgccaccacccctttcttcaccgccgtattcgcctacatcatgaccgtcaagcgggagtcgtggatcacgtacctcactctcgtccccgtcgtcaccggcgtcgtcatcgccagcggcggcgagcctagctttcatctgtttggattcatcatgtgcattggagccactgccgcaagggcgttgaagaccgtgttgcaaggaattcttctgtcgtctgagggggagaagcttaattctatgaacctgctcttgtacatggctccgattgctgtcattctcttgcttcctgctaccctctttatggaggataatgttgttggcgttacaatagaactggccaaaaaggatttcaccattgtttggttgctgttgttcaactcttgcttgtcatattttgtcaatctgaccaatttcttggtgaccaaacatactagcgcattgactctgcaggtccttggaaatgcaaaaggtgctgtcgcagttgtcgtctcaattctgattttcaagaatcctgtgtctgtaaccggaatgcttggttacaccctcacagttataggcgtcattctttacagtgaatccaaaaagcgtagcaaaccctaagttccccagaaaaccgtacatatggccgtcctttctcagtccggtcggtgcccagagctaatatatgacggggaactacatccggggcgattgcaacagattctgtgctgtatgtagccggatgacaaggacagagaagtccaataatacctgtagttttcccttggatcgcagaggcactttgttttgctaatggaaatgatcaatagaatacaattttttgtgtttagagaattgtgagctgtggctcacactgccagcattggttgatacgcttagttttcggaaattgttttccgttattcatcagttattgtaagttcatgactccagttctcttcttttgaagattgcatgtaccaaactttgccaaagaacctcctaatatattatgacactgaatttgttgacaaaaaaaatttttgaaattaggcacaggtt

SEQ ID NO: 17270 - DNA, 619 bp, Triticum aestivum
  Clone ID: PAT_TA_17270
tcagcacggatacggattgcagacatacatcaagaacagaatcagcaggattatcaccatgagtttcttcaacagaacaacacaaagttttagacactagccccaaagctatgcctactgtggaagacactaacacacactccagttacaaaagccctacatgcaattagggtgctctaaggtctctacaaaattctcttgggatctttctcaccttgatagccacttcaactgggcaccccagccagcaaagaagcaaccaacctatctaaatccggaaaaggtacagccaaccataagcgtggggaaaccttccattccctcgttgtatacatcaacatctaccacatgccttttcaactgtgcaaaagggacttctcaaacacaaaagggtttgggtacaacagtgttaagttcctggagttggagagagtagtatggactgtcaggaggataaacggagtgctatctcgtggaggagcaatctcttctgagcagcgtcaataacaccattgcactcagcgttcacgaggacgtcactcatgactgccgcagcatgcccagtgagctcttcagatggcctcctcaacatgaacatctgtccacggtgagatatctc

SEQ ID NO: 17271 - DNA, 1071 bp, Triticum aestivum
  Clone ID: PAT_TA_17271
aattcggcacgaggggaagctaagtccggaggccatggacaacgaagttatcagcaacggcagcgccaaggactacctcgaccctcctccggcgccgctggtggacgccggcgacctgggtaagtggtctttgtaccgtgccgtcatcgccgagttcaccgccacgctgctcttcgtctacgtcgccgtggccaccgtggtcggccacaagcgccagacggacgcccaggcgtgcagcggcgccggcgtgctgggcatcgcgtgggccttcggcggcatgatcgctgtcctcgtctactgcaccgccggcatctccggcggccacatcaacccagccgtaacgttcgggctactgctggcgcgcaaggtgtcccttcccagagccttcctttacatggtggcgcagtgcgtcggcgccatctgcggtgcggcgctggtgagggccgtgcacggcggccaccagtacgtgctttacggtggcggcgccaacgagctcgcgccgggctactccaggacggcgggtctcatcgccgagatcgccggcaccttcgtgctcgtgtacaccgtcttctcagcgaccgacccgaagcgcatcgcccgggatccacacgtcccggtgctggcgccgctgctcatcgggttcgccgtgctcatggcgcacctcgccactatccccgtcaccggaaccgggatcaatccagcaaggagctttggcgccgccgtggtgtacaatggcggcaaggcttgggacgaccagtggatcttctgggttggcccgttcatcggcgccgccgtggccacggtttaccaccagtacatcctcaggaatagtgccatcttccggtccaactacgacgcctccgtctagctactcccattcatccatccattgatgcgttccatatctacttgttgatgagttgagatccacattatcgatggatctaccgtgtggctgttaaaattgatggttaattagtatgttgttgtgttactgaacgtatgtattgcattgtatgttagtgttgggtttacagtgtttgctagttactgcaagagatggcctcgtgc

SEQ ID NO: 17272 - DNA, 691 bp, Triticum aestivum
  Clone ID: PAT_TA_17272
gcggcgccaactccgtcgcgccggggtacaccaagggggacgggctcggtgcggagatcgtcggcacgttcgtgctggtgtacaccgtcttctccgccaccgacgccaagcgcagcgccagagactcccacgtccccattttggcgcctcttccgatcgggttcgcggtgttcctggtgcacctggcgacgatccccatcacggggaccggcatcaacccggcgaggtccctcggcgccgccatcatctacaacaagaagcaggcgtgggacgaccactggatcttctgggttggtccgttcatcggcgcggcgctggcggccatctaccacgtggtggtgatcagggccatccccttcaagagccgcgactagtcaatccagcagctgcgaatggaatcttatcgctgttcatcgtcggtcgatcgatcatgtggtggtggtggtggttgctggtgcgcgcgtacgtggatcatctctcggccgcgcacgctgtaataatcctccatccgccgtgctgttcctctcctcggtgtgtgtgcctgtcggcagcgtcacctgttcaagtctgcgagcttcagtacctgttgtactctccctcccttttgtattgtactacgcacgcgatttaatggagcgtgcatatctatgtaaattactactattaagaaggaacgccgatcgagttaatt

SEQ ID NO: 17273 - DNA, 969 bp, Triticum aestivum
  Clone ID: PAT_TA_17273
gtgtcgaaggtctgtagaaaagcactggtgatactgaagagcctcgtctcggagcctcaaaacaggatgcacctcttggttcacgagaataactttgctgagatcctgacgtcggaagggaaatactcggacacttttgctcggattctgtacgagctgactgcgaggccgagcaacaaggtgacgtctggtcaagctatctggggaaacataaactgatgcatgtgctgaccccttgacgtgtcgttaaaatctgtatcgttttagtttctgactgtatgtaacaagtactactacttagctccatatgatgtgttttttttttcaaagcaaatgggtgcaggggccggctgtattctagcaggatacatacatcacaggagacatgctgcgttctactgtagcacccaggcctgccttaaacaaagttctaaaacaaacacatcatatggagctaagtagtagtacttgttacatacagtcagaaactaaaacgatacagattttaacgacacgtcaaggggtcagcacatgcatcagtttatgtttccccagatagcttgaccagacgtcaccttgttgctcggcctcgcagtcagctcgtacagaatccgagcaaaagtgtccgagtatttcccttccgacgtcaggatctcagcaaagttattctcgtgaaccaggaggtgcatcctgttttgaggctccgagacaaggctctccagtatcaccgctgctttcctacagacctccgacacagggtgtggtgccttcacgatctttaggagcctatccacagcccatcgctcactagccagcttcagtctacaatccatgttcacttctgatacgttgtagagggcgctaacagcagcagcctgtgcatcaaatgctggcacgctcaacagatcaaccaatctcctgtatatctgtgaaatcacaggaacaagaaacgattcattgtctggattg

SEQ ID NO: 17274 - DNA, 680 bp, Triticum aestivum
  Clone ID: PAT_TA_17274
tcgtggggacctttgtgctcgtgtacaccgtcttctccgccaccgacgccaagcgcagcgccagagactcccacgtccccatcttggcgccgctgccgatcgggttcgcggtgttcctggtgcacctggcgacgatccccatcaccggcaccggcatcaacccggcgcgctccctcggcgccgccatcatctacaacaagaagcagtcgtgggacgaccactggatcttctgggtgggcccgttcactggcgcggcgctggcggccatctaccacgtggtggtgatcagggccatccccttcaagagccgcgactagtatactcaatcagccatgggatggaaatttggaatcctatcgttcatcgaccatcatttgtgctgatcgttgctcctgcgtgcgtactcctgtaattatcggtctgccgtactgttcctgagcgagcgtgtgtgtgtccttcagtcagtgtgtcaagccgttactagtgtggtcagtgcacttcttcaccgcacctacccaaaatgtgcaaactatcggtacttgtggttccctctcttttgtaagcaatgcgtgtataaaatattcccgcgaaaaaaaatgcgtgtataaaataacaaggaatgaagatcgaactaacgatcgatcttcaagtggagtgtatacatcatgaaaaaaaaaaaa

SEQ ID NO: 17275 - DNA, 1131 bp, Triticum aestivum
  Clone ID: PAT_TA_17275
cacacacacacatcatctcctccacctctctcaaccaagccaaggccaagagctgagtgaagcacccgcggccatggagggcaaggaggaggacgtgcggctgggcgcgaaccgctactcggagcaccagcccatcggcacggcggcgcagggcggcggcgcggacgagaaggactacaaggagccgcccccggcccccttcttcgaggccggggagctcacctcctggtccttctaccgggccggcatcgccgagttcctggccaccttcctcttcctctacatctcggtgctcaccgtgatgggcgtggtgggcaacccgtcggggtccaagtgcggcacggtcggcatccagggcatcgcctggagcttcggcggcatgatcttcgtgctcgtctactgcaccgccggcatctccggcggccacatcaaccccgcggtcaccttcgggctgttcctggccaggaagctgtcgctcaccagggcggtgttctacatcgtgatgcagtgcctggggcccatatgcggcgctggggttgtcaaggggttccagaccacctggccacgatccccatcacgggcaccggcatcaacccggcgaggtccctgggcgccgccatcatctacaacaagaagcaggcgtgggacgaccactggatcttctgggtgggtccgttcatcggcgcggcgctggcggccatctaccacgtggtggtgatcagggccatccccttcaagagccgcgactagtccaccaatcaaccagctgcatgcggatggaatcttatcgctgttcatcgtcggtcgatcgatcatgtggtggtggtggttgctcgcgcgcgcgtaggacgtggatcatgtctcggccgcgcacgctgtgatcatctatatctaccgtgctgttcctcctctcctcggtgtgtgtgcctgtcggcagcgtcacctgttcaagtctgcgagtttcagtactccctgttgtactttcccttccttttgtattgcacgcggtttaatggagcgtgcatatgtatgtaaattactattatgaaggaacgacgatcgagttaattaacgatcttctcgcctggagatgagaataatatatataaacattatgtgaaaaaaaaaaaa

SEQ ID NO: 17276 - DNA, 1301 bp, Triticum aestivum
  Clone ID: PAT_TA_17276
ctccaagccaagctaaccagctcaagctcaagcggcagcaatggagggcaaggaggaggacgggcgcctgggcgccaaccgctactcggagcgccagcccatcggcacggcggcgcaaggcggcggcgcggacgagaaggactacaaggagccgcccccggcgcccctcttcgaggcggaggagctcacctcctggtccttctaccgggccggcatcgccgagttcctggccaccttcctcttcctctacatctcggtgctcaccgtgatgggcgtggtgggcaacccgtccgggtccaagtgcggcaccgttggcatccagggcatcgcctggagcttcggcggcatgatcttcgtgctcgtctactgcaccgccggcatctccggcggacacatcaaccccgcggtcaccttcgggctgttcctggccaggaagctgtcgctcaccagggcggtattctacatggtcatgcagtgcctgggcgccatatgtggcgccggcgtggtcaaggggttccagaccacgctgtaccagggcaacggcggcggcgccaactccgtcgcgccggggtacaccaagggggacgggcttggggctgagattgttgggacgttcgtgctggtgtacaccgtcttctccgccaccgacgccaagcgcagcgccagagactcccacgtccccattttggcgccgcttccgatcgggttcgcggtgttcctggtgcacctggccacgatccccatcacgggcaccggcatcaacccggcgaggtccctggggcgccgccatcatctacaacaagaagcaggcgtgggacgaccactggatcttctgggtgggtccgttcatccggcgccggcgctggcggccatctaccacgtggtgggtgatcagggccatccccttcaagagccgcgactagtccaccaatcaaccagctgcatgcggatggaatcttatcgctgttcatccgtcggtccgatcgatcatgtggtgggtggtggttgctccgccgccgcgcgtaggacgtggatcatgtctccggccgcgcacgctgtgatcatctatatctaccgtgctgttcctcctctcctccggtgtgtgtgcctgtccggcagcgtcacctgttcaaatctgcgatttcaatacccctgttgtacttcccttcctttttgtaatgcacccgttttaatgggagcctgcatatgttatgttaatactattatgaaggaacacatcaattaataacgatctccgccggagatagaatatatatataacatagtataaaaaaaaaaaa

SEQ ID NO: 17277 - DNA, 1250 bp, Triticum aestivum
  Clone ID: PAT_TA_17277
gcacgaggcacgcacccatctacatcttctcctccgcgcagcaaccaagccaagctcgagcggcggcaatggagggcaaggaggaggacgtgcgcctgggcgcgaaccgctactcggagcgccagcccatcggcacggcggcgcagggcggcggcgcggacgagaaggactacaaggagccgcccccggcgcccctcttcgaggcggaggagctcacctcctggtccttctaccgggccggcatcgccgagttcctggccaccttcctcttcctctacatctcggtgctcaccgtgatgggcgtggtgggcaacccgtcggggtccaagtgcggcacggtgggcatccagggcatcgcctggagcttcggcggcatgatcttcgtgctcgtctactgcaccgccggcatctccggcggccacatcaaccccgcggtcaccttcgggctgttcctggcccggaagctgtcgctcaccagggcggtgttctacatggcgatgcagtgcctgggcgcgatatgcggggctggggttgtcaaggggttccagaccacgctgtaccagggcaacggcggcggcgccaactccgtcgcgcccgggtacaccaagggtgacgggctgggcgccgagatcgtcggcacgttcgtgctggtttacaccgtcttctccgccaccgacgccaagcgcagcgccagagactcccacgtccccattttggcgccgcttccgattgggttcgcggtgttcctggtgcacctggcgacgatccccatcaccggcacgggcatcaacccggcgaggtcgctcggcgccgccatcatctacaacaagaagcaggcgtgggacgaccactggatcttctgggttggtccgttcatcggcgcggcgctggcggccatctaccacgtggtggtgatcagggcaatccccttcaagagccgcgactagtcagccaatcaatctgcctatactgtggatggagtcttcttgttttcgttgtattttctccttgctcttgaaatgtattttccaacatacaccttattttctagttttggaagcttttcggtcacgctttccggtgcaaatttgcaaaacccggtaaaagtagatgtaaaatgtgtgtggattgcagagggctctatgcccatacaaggaataattcctgaaaaatccaaaagggccaatgtggatttataacatgcacatggtgagaatttagtgccaactgatttgaagaaaaaaaaaaaa

SEQ ID NO: 17278 - DNA, 1263 bp, Triticum aestivum
  unsure (1)..(1263): unsure at all n locations
  Clone ID: PAT_TA_17278
gcccatccatcatcatctcctctgcctaacaagctaagcagctgagctcaagcagcggcaatggagggcaaggaggaggacgtgcggctgggcgccaaccggtactcggagcggcagccgatcgggacggcggcgcaaggcggcggcgcggacgacaaggactacaaggagccgccgccggcgccgctgttcgaggcggaggagctgacgtcgtggtccttctaccgcgcggggatcgccgagttcctggccaccttcctgttcctgtacatcagcgtgctcacggtgatgggcgtggtgggcaacccctccggctccaagtgcggcaccgtgggcatccagggcatcgcctggagcttcggcggcatgatcttcgtgctcgtctactgcaccgccggcatctccggcggccacatcaaccccgccgtcaccttcgggctgttcttggccaggaagctgtcgctcacccgggccgtgttctacatggtgatgcagtgcctgggggccatctgcggcgccggggtggtgaaggggttccagaccacgctgtacatgggcaacggcggcggcgccaactcggtggcgccggggtacaccaagggggacggcctgggggcggagatcgtggggacctttgtgctcgtgtacaccgtcttctccgccaccgacgccaagcgcagcgccagagactcccacgtccccatcttggcgccgctgccgatcgggttcgcggtgttcctggtgcacctggcgacgatccccatcaccggcaccggcatcaacccggcgcgctccctcggcgccgccatcatctacaacaagaagcagtcgtgggacgaccactggatcttctgggtgggcccgttcaccggcgcggcgctggcggccatctaccacgtggtggtgatcagggccatccccttcaagagccgcgactagtaaactcaatcagccatggaatggaatggatggaatcctgtcgttcatcgaccatcgtttgtgctgatcgttgctcctgtaattaccggtctgccgtactgttcctgagcgagcgcgtgtgtgtgtccttcagtgagtgtgtcagcgttactaagtgtgggtcaagtgcacttcttcaccgcacccacccaaaatgtgtaaatttcggtacttgtggttccctctcttttgtaagcaaaacgtgtgtataaaataacaaggaatgaagatcgaattaatgatcgatcttcaagtggagtgctgttacancnatacttgncccgt

SEQ ID NO: 17279 - DNA, 1227 bp, Triticum aestivum
  Clone ID: PAT_TA_17279
cacacacatcatctcctccgcctctcaaccagagccaagagctcagtgaagcaccaccggccatggagggcaaggaggaggacgtgcgcctgggcgcgaaccgctactcggagcgccagcccatcggcacggcggcgcagggcggcggcgcggacgagaaggactacaaggagccgcccccggccccgctcttcgaggcggaggagctcacctcctggtccttctaccgggccgggatcgccgagttcctggccaccttcctcttcctctacatctcggtgctcaccgtgatgggcgtggtgggcaacccgtcggggtccaagtgcggcaccgtgggcatccagggcatcgcctggagcttcggcggcatgatcttcgtgctcgtctactgcaccgccggcatctccggcggccacatcaaccccgcggtcaccttcgggctgtttttggcaaggaagctgtcgctcaccagggccgtcttctacatggtgatgcagtgcctgggcgcgatatgcggggctggggttgtcaaggggttccagaccacgctgtaccagggcaacggcggcggcgccaactccgtcgcgcccgggtacaccaagggggacgggctcggagccgagatcgtcggcacgttcgtgctggtgtacaccgtcttctccgccaccgacgccaagcgcagcgccagagactcccacgtccccatcctggccccgcttccgatcggattcgcggtgtttctggtgcacctggcgacgatccccatcacgggcaccggcatcaacccggcgaggtcgctgggcgccgccatcatctacaacaagaagcaggcgtgggacgaccattggatcttctgggttggcccgttcatcggcgcggcgctggcggccatctaccacgtggtggtgatccgggcgatccccttcaagagccgcgactagtccaccaatcaatctgccgactgtggatcgagtcttcttgtttctgttggattttctccttgctcttgaaatgtatttcccatcatatagcttattttctagttttggaaggttttcggtcacgattcccggtgcaaatttgaaaagcacggtaaaattgatgtaaaatgtgtgtggattgcagagggctctatgcccatacagggaataattcctggtaaatcttaaaggtctctgtggggttttataacatggtgagaaatttagtaccaacctgattttgaag

SEQ ID NO: 17280 - DNA, 1326 bp, Triticum aestivum
  Clone ID: PAT_TA_17280
gccggccgggtcggatctctctctcgcaccccatccatcatcatctcatctcctctgcctaacaggctaagcagctgagctcaagcagcggcaatggagggcaaggaggaggacgtgcgtctgggcgccaaccggtactcggagcggcagccgatcggaacggcagcgcagggcgcggacgacaaggactacaaggagccgccgccggcgccgctgttcgaggcggaggagctgacgtcgtggtccttctaccgcgcggggatcgccgagttcctggccaccttcctgttcctgtacatcagcgtgctcacggtgatgggcgtggtgggcaacccctccggctccaagtgcggcaccgtgggcatccagggcatcgcctggagcttcggcggcatgatcttcgtgctcgtctactgcaccgccggcatctccggcggccacatcaaccccgccgtcaccttcgggctgttcctggccaggaagctgtcgctcacccgggccgtgttctacatggtgatgcagtgcctgggggccatctgcggcgccggggtggtgaaggggttccagaccacgctgtacatgggcaacggcggcggcgccaactcggtggcgccgggggtacaccaagggcgacggcctgggggcggagatcgtggggacccttcgtgctcgtgtacaccgtcttctccgccaccgacgccaagcgcagcgccagagactcccacgtccccatcctggcgccgctgccgatcgggttcgcggtgttcctgggtgcacctgggcgacgatccccatcaccggcaccggcatcaacccggcgcgctccctccggcgccgccatcatctacaacaagaagcagtcgtgggacgaccactggatcttctgggtgggcccgttcaccggcgccggcgctggcggccatctaccacgtggtggtgatcagggccatccccttcaagagcccgcggctagcatactcaatcggccatggaacggatggaatcctatcgttcatccgaccatccgtttgtgctgatcgttgctccctgcgttgagtacccctgtaactatcggtctgcccttactgttcctgagccgagcgagcgtgtgtgtccttcaatccggtggtgtcagcgttacaagtgtgggtgcacttcttcaccgcgcctaacccaaaatgtgcaaatttcggtacttgtggttccctctcttttgtaagcaaaatgcgtgtataaaataacaaggaatgaagatcgaattaacgatcgatcttcaaactgggagtgctattacatcgatacttgttccgttccaaaaaaaaaaaa

SEQ ID NO: 17281 - DNA, 1487 bp, Triticum aestivum
  Clone ID: PAT_TA_17281
gaattcggcacgagatcatatacatggattaagctagatcctcttaatccttattcacgttgcactggttaagctaggcgatgaattctctgcttaacagttcttcaacttcttctacatgttaatttcctttctttttagccacttcacatttagtggacaaccaaagccaagagctcaggagaagcaccggccatggagggcaaggaggaggacgtgcggctgggcgcgaaccgctactcggagcaccagcccatcggcacggcggcgcagggcggcggcgcggacgagaaggactacaaggagccgcccccggcccccttcttcgaggccggggagctcacctcctggtccttctaccgggccggcatcgccgagttcctggccaccttcctcttcctctacatctcggtgctcaccgtgatgggcgtggtgggcaacccgtccgggtccaagtgcggcaccgtcggcatccagggcatcgcctggagcttcggcggcatgatcttcgtgctcgtctactgcaccgccggcatctccggcggccacatcaaccccgcggtcacgttcgggctgttcttggcccggaagctgtcgcttaccagggccgtgttctacatcgtgatgcagtgcctgggcgccatatgcggcgcccggcgtggtgaaggggttccagaccacgctgtaccagggcaacggcggcggcgccaactccgtcgcgcccgggtacaccaagggggacgggctcggcgccgagatcgtcggcacgttcgtgcttggtgtacaccgtcttctccgccaccgacgccaagcgcagcgccagagactcccacgtccccatcctggcgccgcttccgatcgggttcgcggtgttcctggtgcacctgggcgacgatccccatcacggggaccggcatcaacccggcgaggtccctcggcgccgccatcatctacaacaagaagcaggcgtgggacgaccactggatcttctgggtgggcccgttcatcggcgcggcgctggcggccatctaccacgtggtggtgatccgggccatccccttcaagagccgcgactagtccaccaatcaaccagccgcgaatggaatcttatcgctgttcatcgtcggtcgatcgatcatgtggtggtggtggtggttgctcgcgcgcgcgtagtacgtggatcatgtctcggccgcgcacgctgtaatcatctatatctaccgtgctgttcctcccctcctcggtgtgtgtgcctgtcggcagcgtcacctgttcaagtctgcgagttgtactttcccttccttttgtattgcactacgcacgcgatttaatcgggcgtgcatatctatgtaaattattacgtattatgaaggaaggacgatcgagttaattaacgatcttctcgcctggagatgagaatgatatagatattgtgtgatcatcgtcctattttcctctttgaaaaaaaaaaaaaaaaaaggccccta

SEQ ID NO: 17282 - DNA, 1514 bp, Triticum aestivum
  Clone ID: PAT_TA_17282
tcgcggccgcgtcgaccagcgcgcgacccacacccggccatctgggcgagcgccatgccccgatgagtaggagggcgcggcggccgctgcaaaacccggggcgcgagcccgggcggagcggccgtcggtgcagatcttggtggtagaacatcatctcctccacctctcaaccaagccaaggccaagagcccagtgaagcagcggccatggagggcaaggaggaggacgtgcggctgggcgcgaaccgctactcggagcaccagcccatcggcacggcggcgcagggcggcggcgcggacgagaaggactacaaggagccgcccccggcccccttcttcgaggccggggagctcacctcctggtccttctaccgggcggggatcgccgagttcctggccaccttcctcttcctctacatctcggtgctcaccgtgatgggcgtggtgggcaacccgtccgggtccaagtgcggcacggtcggcatccagggcatcgcctggagcttcggcggcatgatcttcgtgctcgtctactgcaccgccggcatctccggcggccacatcaaccccgcggtcaccttcgggctgttcctggccaggaagctgtcgctcaccagggccgtgttctacatcgtgatgcagtgcctgggcgccatatgcggcgccggcgtggtgaaggggttccagaccacgctgtaccagggcaacggcggcggcgccaactccgtcgcgcccgggtacaccaagggggacgggctcggcgccgagatcgtcggcacgttcgtgctggtgtacaccgtcttctccgccaccgacgccaagcgcagcgccagagactcccacgtccccatcctggcgccgcttccgatcgggttcgcggtgttcctggtgcacctggcgacgatccccatcacggggaccggcatcaacccggcgaggtccctcgggcgccgccatcatctacaacaagaagcaggcgtgggacgaccactggatcttctgggtgggcccgttcatcgggcgcggcgctggcgggccatctaccacgtggtggtgatccgggccatccccttcaagagccgcgactagtccaccaatcaaaccagtccgcgaatggaatcttatcgctgttcatccgtcggtcgatcgatcatgtggtgggtggtggtggtggtggtttgctgggcggcgcgccgtaatacgttggattcatgtctccgggccgcgcacgcctgtaatcatctatatctaaccgtgctgttcctccccctcctccggtgtgtgtgcctgtccggcagcgtcacctgttcaagtctgcgagttgtactttcccttccttttgtattgcactacgcacgcgatttaatcgggcgtgcatatctatgtaaattattacgtattatgaaggaaggacgatcgagttaattaacgatcttctcgcctggagatgagaatgatataaaaaaaaaaaaaaaaaaaaaaaaaaaaaaaaaaaaaaaaaaactcctcatgccg

SEQ ID NO: 17283 - DNA, 1327 bp, Triticum aestivum
  Clone ID: PAT_TA_17283
cacacacatcatctcctccacctctctcaaccaagccaaggccaagagctgagtgaagcacccgcggccatggagggcaaggaggaggacgtgcggctgggcgcgaaccgctactcggagcaccagcccatcggcacggcggcgcagggcggcggcgcggacgagaaggactacaaggagccgcccccggcccccttcttcgaggccggggagctcacctcctggtccttctaccgggccggcatcgccgagttcctggccaccttcctcttcctctacatctcggtgctcaccgtgatgggcgtggtgggcaacccgtcggggtccaagtgcggcacggtcggcatccagggcatcgcctggagcttcggcggcatgatcttcgtgctcgtctactgcaccgccggcatctccggcggccacatcaaccccgcggtcaccttcgggctgttcctggccaggaagctgtcgctcaccagggcggtgttctacatcgtgatgcagtgcctggggcccatatgcggcgctggggttgtcaaggggttccagaccacgctgtaccagggcaacggcggcggcgccaactccgtcgcgccggggtacaccaagggggacgggcttggggctgagattgttgggacgttcgtgctggtgtacaccgtcttctccgccaccgacgccaagcgcagcgccagagactcccacgtccccattttggcgccgcttccgatcgggttcgcggtgttcctggtgcacctggccacgatccccatcacgggcaccggcatcaacccggcgaggtccctgggcgccgccatcatctacaacaagaagcaggcgtgggacgaccactggatcttctgggtgggtccgttcatcggcgcggcgctggcggccatctaccacgtggtggtgatcagggccatccccttcaagagccgcgactagtccaccaatcaaccagctgcatgcggatggaatcttatcgctgttcatcgtcggtcgatcgatcatgtggtggtggtggttgctcgcgcgcgcgtaggacgtggatcatgtctcggccgcgcacgctgtgatcatctatatctaccgtgctgttcctcctctcctcggtgtgtgtgcctgtcggcagcgtcacctgttcaagtctgcgagtttcagtactccctgttgtactttcccttccttttgtattgcacgcggtttaatggagcgtgcatatgtatgtaaattactattatgaaggaacgacgatcgagttaattaacgatcttctcgcctggagatgagaataatatatataaacattatgtgatcatcgtcc

SEQ ID NO: 17284 - DNA, 1352 bp, Triticum aestivum
  Clone ID: PAT_TA_17284
gcccacgcgtccgcccacgcgtccgctcacacacacacatcatctcccccacctctctcccaaagccaagagctcagagaagcaccggccatggagggcaaggaggaggacgtgcgcctgggcgcgaaccgctactcggagcaccagcccatcggcacggcggcgcagggcggcggcgcggacgagaaggactacaaggagccgcccccggcccccttcttcgaggccggggagctcacctcctggtccttctaccgggccggcatcgccgagttcctggccactttcctcttcctctacatctcggtgctcaccgtgatgggcgtggtgggcaacccgtcggggtccaagtgcggcacggtcggcatccagggcatcgcctggagcttcggcggcatgatcttcgtgctcgtctactgcaccgccggcatctccggcggccacatcaaccccgcggtcaccttcgggctgtttttggcaaggaagctgtcgctcaccagggccgtcttctacatcgtgatgcagtgcctgggggccatatgcggcgccggcgtggtcaaggggttccagaccacgctgtaccagggcaacggcggcggcgccaactccgtcgcgcccgggtacaccaagggggacgggctaggggctgagatcgtcggcacgttcgtgctggtctacaccgtcttctctgccaccgacgccaagcgcagcgccagagactcccacgtccccattttggcgccgcttcccatcgggttcgcggtgttcctggtgcacctggcgacgatccccatcacggggaccggcatcaacccggcgaggtccctcggcgccgccatcatctacaacaagaagcaggcgtgggacgaccactggatcttctgggttggtccgttcatcggtgcggcgctggcggccatctaccacgtggtggtgatcagggccatccccttcaagagccgcgactagtcagccaatcagtctgccgaccatggacgggtggaatcttatcgctgttcatcgtcgatcgatcatgtggtggtggttgcccgtgcgtacgtggctcatttcgcacgctgtaattctctatctaccgtcctctgtccctctcctcggtgtgtgtgcctgccgacagcgtcactgtggcgcacctgttcaagtctgcgagttgtgtactttccctcccttctgtattgtaccgctgcgcacgcgatttaacggagcgtgcatatgtatgtaaattattaattaagaaggaacgtcgatcgagttaattaacgcctgggagatgagaataatgtataatcattatgagaataatgtataatcattatgagtccaaaaaaaaaaaa

SEQ ID NO: 17285 - DNA, 1159 bp, Triticum aestivum
  Clone ID: PAT_TA_17285
ttttttttttttcttaggacctttattatgtaacaacttgcttaaaaatgaataatgtacacctacaatacaagaatgctacaggagacaatggccggcgacttggctcctcctgccctcaggcgtacggctttgttctaacggcagagtttagccggccccttaacaccgcgaaggaccatcaaccttggatcaatgtatgtaccgcaaacaatctttgacaggtcgaacatctccggtggcgtctgcgtacggacctcttgcagcacattgcgtgcagacttgacgttcaaagttgagccgcaactcatggacacgtcgacgtcgtcctcatccacgttaacgctagcggtggggaggctggctggcagctccttcatctttgcggcttttccccatttaccaccaagatatctggaagatgtaatcctactactactctctttaccatcctcggcattggtgtaaatcctcccaggagttatccttgccgatgtggtaactgacagatttccttcggttccagatttgtcgtggggccagtcggattccggcatgattttgaaacccaatatctgaggtcagagataaaatgggatccacagattctggggcttcggcgaatgtgaggaacgcatcactgatgaggactctgggggtaggctgacgaagtgttagaccgatgtgccttccagtgcagtataagaggcaccagcgaccaggtaggaggcgaagccaattctctgtacttgaattagggtttagcacctcccatcaactcaatgaaatatgctagccctctacgcggaccatcccctttactatattcttcagccaggcggacagcagtagatcccaagccccagcgtacgacattcactgttggacttatacgccatttaggtccacaaaggaaggggtgacgcagtgcatcgacacaacttatccttttgtcagattttgttgccagtaataaggccaaaagattccaaccagcaccccagtgcctatctagcatctgcagaccaatattcccagatggagaattttggcttagaatcggtaaaaggaactcacgcagacatgatggatcatttcccttattcaagaatgacttgaatttttggaatgtcgacccacgcgtccgcccacgcgtccg

SEQ ID NO: 17286 - DNA, 1354 bp, Triticum aestivum
  unsure (1)..(1354): unsure at all n locations
  Clone ID: PAT_TA_17286
gctgctgcccagcgcgcgccctcctcccgcatcgcagggcagctccgctccgcctccccccgccccgagcacaaaagagaagggagggaggccgccccgagggaagggaagagacgacatggacgactacgcgcgggagatgatggagctcaagacgctcgtcacccgcaccctcgagaagaagggcgtcctcgccaagattagggctgaactgagagcaagtgtgtttgaggctatagaagaggaggaccgtgtgatagaggagaacgaagatggcgggaatcctgctttacttggtagctgcaacgaccgtgctaagcagctgcatgcttcaccgtcaggtaggttattaacagcacttataggtgaatacttggagtgggcccagctaagtcacacgatgaaagtttatttgccagaatgtaatctgcccaaggacttttggaagaatgagctaaaggatttctctaacaaaaatggggctgaagggagcaggagcgccgagagtggtcccatgcttctagatgttcttgaaggatatcttaaatatgagaatttgtctcaaacgaggatggctggtaggagaatgatcaattctgaacctgagccaacattgaatactgagcaccggaacatgaggaggccaccatcttcatcttcagtcgctggcatgcctcctatgggaaggcaaatgccaccatcgcagacatcagaccgaagagggggctcttccgcttccaatacaaggaaagatgagtacaactggggatatgatgcggatgatctttcggaggaagtattgcgtacatccactgctctagagaacatccagttagaccggaaagcccgaaacctgacaacatcttggaggcatccaggcaatggtgccgagtaaaatcttaaggtggaagagctccaatgcgctgttggcttgcttggttccccctgggatttctgtatccactttcggttgatattagactgcgtgtgtgtgtgtgtgttgtaatccagctaattatgcacctgagatgagattttatagtgagctagacctattcattgtaatcttgtgcctgatacttgcgtgtgggacaaattgatttgattcaacgagcttcttttgttgcgtgttgtaatccagctaattatgcacctganangngatttnnnngtgngcnanacctattcattgtnatcttgtgtctgatacttgcgtgtgggacacaagattacaatnnataggtctagctcactataaaatctcatctcaggtgcataattagctggacctantcantgtgatcttgtgtctgatacttgcgtgtgggacaaattgnnttgattcancgagctt

SEQ ID NO: 17287 - DNA, 364 bp, Triticum aestivum
  Clone ID: PAT_TA_17287
gaggtcatcctctcccatcattcccctcctccacccgcctgcgctgcgcacaggcacctgcgctatgtcgccatggatggctcgccccaagcagcaaggagcaccgacgcatgtgctgcgtcgccatgcccgcccgagcagcagctgatgtgagaccaggaggttgtctcctccccagatcctggtgacggtgagatccagcagatgcggaccaggttgtcttcgccacggcacgccgccctcctctccggtgacagagctggtcctttccaacgcgcatctggatgggttcatcatcgtcgccccggcctcttccttcccctgcgtctgacaagatgttgattgaagtattctgtagacgcgt

SEQ ID NO: 17288 - DNA, 490 bp, Triticum aestivum
  Clone ID: PAT_TA_17288
caacgtcacttatggccaaccgggaacccaatttctcctataaaaatgtgtagaaaggccacatgcggaacatgcaacaagacctcctggtggggttgcggcagccacatcccatctgtcatggacaatattcctgacgctgaccgctgcgcctgcgagcccaaggtcgaagtcggcggtgtctcgtacccgcccatggccgcgtctccaaactgacttatcgagagggctgctgcgctggttctctggacgcgagggaagaaagcgacgtggtcgcccactggcgtcgttgaggaacctttgaagtcatgataacgacgatgctgtgatgagctagaggattgtacagtacatgagatatggattggcgtggcgttgagagagggggtttgagggggttggtatcagggcagactaaggtatattatacgagtttttggaaaaaaaaaaaaaaaaaaggcccctatgatacggtgctgcatgtgggttg

SEQ ID NO: 17289 - DNA, 1420 bp, Triticum aestivum
  Clone ID: PAT_TA_17289
gccggccgggctgcgagcggggatagcaaccagtacgtggcatagtcctcactagttaagtcactaagcaacccctggaggtaactaattaatgggttctatctccgacgacgaggcggcttgcatctacgcgatgcagctggcagcggcagctgtcttgccgatgacgctcaagaacgccatcgagctgggcatgatcgagatcctcgttggcgctggcgggaagatgctttcgccgtctgaggtggccgcccagctgccgtcgacggccaacgcggaagcaccggccatcgtcgaccgcatgctgcggctgctggcatcgcacaacgttgtgtcgtgcgaggtggaggaaggtaaggacggccgcctcgcacgccggtacggcaccgcgccggtgtgcaagtggctcagccccgacgaggacggcgtgtccttggccccgatggtcctcttgaacgacaaggtcatgctggagagctggtaccatttgaaggacactgtccttaacggtggcctgccattcgaaaaagcgtacggaatgacagcgtttgattaccaaggaacggacccgcgctttaatcgcgtcttcaatgaggccatgaagacccactccatgatcatcaccaagaagctcctggagttctacaagggcttcgatggtgtgggcaccctcgtggacgtcggtggcggtgtgggcgccaccatccacaccatcctttgcaggtacccaagcatcgagggggtcaacttcgacctccctcacgtcatctccgaggcaccatcctttgcaggtgtgcaccacataggtggtgacatgttcaagaaggttccctctggggacgcaatcctcatgaagtggatactccacgactggaacgatgagcattgcacaacgctgctgagcaactgctacgatgcactacccgcgcatggcaaggtggtcatagtggaatacatcctgccagtgaagcccgacgaaacggccacagcacagaggtccttcgaagccgacatgattatgctcacacacacacccggcggcaaggagaggtacctgagggagtacgaagagctcgccaggagcgccgggtttgccagcgtcaaggccacctacgtctacagcaacatatgggtcattgagttgaacaaatagaacctgcatgtgtgctagtatgtggagtttccactgctcccttaaatttctcttactctgaatcagcaatatacataataaaggattggctacaagaaaagttgtctcaagagctgtaatttctaaatcaacaaaattacttcttttttgcgatggtcaaaaaaattacattgtcaagcctagtttgtgtagctttggggcttaaacgtgcaagtgactagttgcatcgtgaccttgttttatacatgtatggaatgcatatgaatg

SEQ ID NO: 17290 - DNA, 1156 bp, Triticum aestivum
  Clone ID: PAT_TA_17290
ggtcgatggcgtgcatccccaacagccgcgcgcggaacccgcccaacatgtgctcgccggacctggacgagctcttcgcccccttcaacagcaaggtgaggggcatggtcgacggcctgcgcgccaacctcccgcccgccacgcgcatctacctccgcaacttcgaagggatctccgtggtgctcagaagcccgtcgcgggacggctcccgcggagccgacggcggatgctgccgggtcggatcgcaccgccggcgcaccgccggcccgtccttcctacgcccccccccccaacgctccaccttcggcttggggcccgccttcctccccacggggggcggagacttgcggttcggctcggcagcaggcgccggcggaaccgctaccgcatcccccacgaccaccccgccccccacccccacgcagaccggccctccacgctccttgagcaccgccctacccatccgctccccagcccgcaaccccagcgcgtccgtagtttcgggatcgcgggggtggggtcggtggcgtgcatccccaacatgcgcgcgcggaacccgaccaacatgtgctcgccggacctggacgagcttatcgcgcccctcaacagcaaggtgaagggcatggtggacaccctgaacaccaacctcccgcgcgccaagctcatctacatcgacaacttcgagatgatctccgaggtgctccggagcccctttaactacggcttcagcgtggtggaccgcgggtgctgcgggatcggccggaaccgcggggtcatcacctgcctgcccttcctccgcccctgccccaaccgcaacacctacatcttctgggacgccttccaccccaccgagagggtcaacgtgctcctcggcaaggccgcatactccggcggcaccgacctcgcctaccccatgaacatccagcagctcgccgcgtggcagccgtagtttctttgagtgaggaactaagtatctatagctagctagctacgtgacagtgtttcttctgtgagtgattaccaggttagatctggagtaccgtgtgttcagttcagtgtgtctgttttgatccgtcagtcatatgagtgtgtaaggatcgttcaatggtgttgtggctgtcgtcaatctaatgataaattaagtaattacattagt

SEQ ID NO: 17291 - DNA, 572 bp, Triticum aestivum
  unsure (1)..(572): unsure at all n locations
  Clone ID: PAT_TA_17291
cgggacgaagcacaaattggccacgaccaacacccacaacccggatccagatcttgttccagtagcatcttcttctccgccggctcaccagggaaggggagaaccctgccgtcgatcgagccgattctgtcatcacgtgatggctcgcgcggcgaacgtcgacgtgcccgctgccggcgcggcgcagggcggagcgagcaaggcggaggggttggcggccgtggccggcgacggcaggagggtcgaccaggccgtggcctacctgctcatggccgccgcgctcgccgtcacctacctcgtgcactgatcgaccggtcggtcgacggacggcggctaggagagttcatattcgtgtcgcttcatctttgtataaatctttagcgaggggaaaactaaagagatgcttgctacagtaccttttgtgtgtagctagtcggaatcacataaattcgttggtgaatcgtctgtacgtgtcgtttcatccatgttcggtctgaaggtctcacacgctcatggtcaggtccaattaattgaagaattaggtcaaaaaaaaaaaaaannaananaaaann

SEQ ID NO: 17292 - DNA, 699 bp, Triticum aestivum
  unsure (1)..(699): unsure at all n locations
  Clone ID: PAT_TA_17292
ccccccccccctggagctctggcttggttcttgtgaagctgtagtctgtattaactagttgttcctgtgttggtggaatgggtcctcgcgggcctggaggtccagcattggggaggccctggccttggttcttgggggccttggtttggtggcttcttcggatcctgcttctacctcctctgtgcgccccgccccccccacccccgcgcccgcccggccctccgcccccccccccctggcggctccccaccacctcccccccgacggctgccccacgcctccacctcggcgcatgagcctgcccgtgtggtcggccggcctgcggacagtccccctggcggcagtagtacacacactactgaaaataattgtcctgtatctcttggagatgactgtatgcagtcttacctagttacgtggcacttatattgtttgtactgactaaatgcaattatcggttacattttgttggtgctatttctagatggtttttgtagattcagttctttacataaaaaaaaaaaaaaaaaactcgagggggggcccggtacccaattcgccctatagtgagtcgtattacaattcactggccgtcgttttacaacgtcgtgactgggaaaaccctggcgttacccaanttaatcgccttgcagaatccccctttcgcagctggcgtaatancgaaaggnccgacgattg

SEQ ID NO: 17293 - DNA, 399 bp, Triticum aestivum
  Clone ID: PAT_TA_17293
actttcggcttccagggcggctccatcctcgccttcttgggccgctcctcagacaaactcaatgccatcggcgcctacaaacttggggtttgatccatctaaccatcatggccagcatacgtgtctgctgacttccgtatggttggcttcggtggatacatgtgttcgacctatatctactgcttgtatttgcagctaaataaaatggggatccctcgctgatgcatcctatggatggatggatccctgccgtccgtacaatgttctgcctttacggattggcggatcaagagtgacaaccgcaaaggtatggggactgtttggctggaaagcacaaccatgcaatcgaattatttacatatctaggatcaaccaatacaatatcacaataattacagt

SEQ ID NO: 17294 - DNA, 1068 bp, Triticum aestivum
  unsure (1)..(1068): unsure at all n locations
  Clone ID: PAT_TA_17294
gcacgagtctcagcctggatcttgtggcttccgcggcggcggagcattcggcgcgcggcggctcagctacagcctatagctatatcctccgtactgtaccactacaagggaaaagaggacaagtattgctctgaagtgagatacgcttgggggcagattttggagaactcttggtctaaagtgtgagagatttggaggtatattttggacaacttgtggcctaaagtgagataggtctggaggcaaactattgtgcccgtcagcgtgctaatgtgggacatcggatacaaatgaggcacatcacacttctttactggaggaccgcagacagataacattatggtagccgctacagctacagaaatgtttcttgtgtgctttgaatccttgtgcccctgttttcgctcgaaaaggaaggatggaagtgaagatcctgttcttgcaaaagacggaaattccttgagttcttctgaaatgaggtcaatttctgacagaattccctcgagccctcttcgggtacctgcaagtccatctagattttcattatcttcaccgccaagtagaaatgatccattgaacctcagtcttgaaactgttattaaactgacacgtaacttttcaccggccttgatgattggcgaaagttattttggaaaggcctacagaatggnacttgcaaaatggccttgttgtggctattaaaagggcaagaaaggaacattttgcttctttacatgcagaattcaaaaatgatctgcactactaanaaaaatcgaacacaggaatctggtccagttacttggatatattgacaaagggaatgaaagaattgtcataaccgatttgtgtcaaatggactcctanggaacatttggatggcaacatgggctaataatgggcttcagtcagcggcttgaatagcataattgccatggattgacttatcgcatcatatcagagaagccatatcaccgggatgtgagtcacaacattcactactgangctcaggnaaaataccactcgnttcaaattgtcacagtnaagcatccggatcaacgagtgaagga

SEQ ID NO: 17295 - DNA, 664 bp, Triticum aestivum
  Clone ID: PAT_TA_17295
gaattcactagtgattagcgtggtcgcggccgaggtccggcacggccgtgcagaagagcgggggatggttcgggttcatctccgacgccatggaggtcgtgctcaagattctgaaggatggtctctcagcagttcatgtgccctacgcttatggatttgccatcattctgctcaccattgtcgtgaaggctgcaacattgccgttaacgaagcagcaggtcgaatcaaccatggcgatgcagaatttgcagccacagctcaaggcaattcaggcgagatacgcaggcaatcaggaaagaatacagcttgagactgctcgtttgtacaagcaagctggagtcaatcctcctagcaaggatgtttgccaactttggcaacaattccagtctggattgggactttaccaaagccctttcaaatgtagcaaatgagggtttgttgacagaaggatttttctggattccatctttgggaggccctacaactattgctgctcgtcaaagtggtgctggcatttcatggctccttccttttgtggatggtcatccgccaataggctggcatgatacgatatgttatcctgtgttgcccgtgctactcgttgcttctcagtttgtctccatggagatcatgaaaccaccccagagtactgatccatcgcaga

SEQ ID NO: 17296 - DNA, 266 bp, Triticum aestivum
  Clone ID: PAT_TA_17296
acttgtatcctgaagatgctgctctctccgtgaaatacgggtccaacaatatctcgactggttcaactttctcagattgctttttttctgcttcgtcataaatttttcctagtatggatgttgaatggtagctttcctttcgatccatgtagtgcggatacttttttggtgtcagctcagcagggacattgatcttggtcccggcctttggagcgtccagggccaaataataaagatcaaccaacttctttatctttttttctagt

SEQ ID NO: 17297 - DNA, 641 bp, Triticum aestivum
  Clone ID: PAT_TA_17297
ctcgtgccgaattcggcacgagccgatgctctaccttcctcgcgccactttcggccggagcaaccccttctgtcggtgaggaaccatgagattttggagctcctccatcgtcgttcgatctagcctcctgctcagccgccgcccatgctccggacgtccagcagcctcgcccccgaccaacagcctcggatccgtcccgatttggacgtccacagcctcgccacctgcgccaggcatgcttcccttccaagtccggccgaccccgcactgctcatcctcgctgcttcctctgctcgcggctcgcgttgactgcaaggagggtaagcgcctcgtccagccgcggcccacttgcctcggtcgggcctgcggcgggagggcccagcgcgtggtggcggggagcagcgtccccatgccgtggtggcggagcccctctctggtgggtgggtggccgacgggggctacatggtcggtttgcagtgggtggctcggttgctcgccaaatctggcagcggttgattggagacttcgcgttcgtcggccttcctctccggcgaaagggaagtcggggacgagccggcagccgcggcagtagggggattcgtggggagcagcagccgcggcccgcgtggtggcggtggtgc

SEQ ID NO: 17298 - DNA, 305 bp, Triticum aestivum
  Clone ID: PAT_TA_17298
ctggctggggcgctactggtccatcatcctcgcctgcaccctctacgtcctgggttatggcatgatcactctagcatccacactcctgactcagcgaccatcatcgaccctcgacaacgactcttcttctaaccctatgtcaccacagtgccggcagcatgtccatggattggcgcaacagctcctggctctcccggcgtccccctcccttctccgcttctcggtgggcgttggcggcgcgatggagggagagattagcgatatctgcctcggtgcgtggctgcgtgcagcgtgcgtagtcaagt

SEQ ID NO: 17299 - DNA, 850 bp, Triticum aestivum
  unsure (1)..(850): unsure at all n locations
  Clone ID: PAT_TA_17299
acgaaagcgagcgcaaaccaaacccaccccacaacgcaacgcgacgcacccccgttccaccccgtcccgtcccgtcccgcccccctcctccgacgattcgaggccccgggctcccgcgcggcggcggcggaggaagcatgaggacggcggcggaggcgcaccagtcgcgcctgctctacgagctgggcgcgctgctgctgacgatcctccggtcgccgctcgggccgggggaggaggggcaggggccgccgcggcaggtgacggcggccggggtggcgtccatgatgctcggcgcctccatggcgctcatgctctgcggctccgtcaccttcatgctcggcttcttcctcatgccctgggtcgtcggcctcgcctgcgtcttcctcttcgtcggcttcctcaccaacctctccgggatctggagggccatcctctgctggcccgccgcctcctcctcgccccataaggacgcctccacatggcatatatttcccaagcctccattcatgtagacgtgaagtcgaatgcggagcagcgatgtacagaagaagcacatgagtttgggcagcagtattttccttcctgggcaacttttaccatgtaacaaatgcaacaagtctaaatggttgtatacttataactaggaggatacatcttgacagcaaaccttgtacatatgggaaaaatgctctggggtaattgttacgtgaggcttatgattgtttgacaaatgtaaattcctctgtttcttcccagaattacaagaaagataatgtgtccccgttagtttgtaatggccncaattggnnaccccntcgggnggaatgcttgccaagtaaccttcaatttg

SEQ ID NO: 17300 - DNA, 669 bp, Triticum aestivum
  unsure (1)..(669): unsure at all n locations
  Clone ID: PAT_TA_17300
tctttctgggtttcttgtgggcgttgcgtcgtcaccacatcttattctcatagtataggctaagcaacatagaagagactaatactctgaagtctcagttacctctacggtttctctttgacactctccgagtgtttgacgtgctggtttcaacgacaggctttgatactacaaagcttgcactaccatgtgcggagaaccaatacattttatacggctcatcaggttgttggacgaaagactcgatcgcctccgtttgtattgcctcctccgcttgctgcaaactccggtcactgagggctgcgttcgagcaatggggtgcgcagctaatggtcaactttagatatgggtgggtgtttctgtgcgctctagttctagttgcgctgctccggggagctgaaatatggcaagttaaaacccatggcgatgactgattctggaaatctccgtgttaattccgatgggacggccttgttctcacaaaaatagatcccatctgctttgcagcaaaatgggtcttgacggcatattctgccgaacttggcgagatcaaccttcgcatattgccacggccatggtgaantaaggacttgtgaagatatctgagcaatttccccaaccgctagatcggccaaggacgtgaactggggnccaagtggttgaagtgac

SEQ ID NO: 17301 - DNA, 308 bp, Triticum aestivum
  unsure (1)..(308): unsure at all n locations
  Clone ID: PAT_TA_17301
acaacttctccgatagcaaagattccacctccagttatggtatccaaacaatgagaaaatatcttcttcacttttcctgcagcagctagctgtgatagcattgatgtatttgattggccaaacccaataattccatcaagggcctggtttgtatttcctaaatccccaccttgctgagcaccacacccgaatgtgnacactgccattgccatgccgtgtttgcccatccccagcgacttgattatactgcagcaagtcactgacgaaatagcccgtggtggtgctaccgtcaccatacatgacactgt

SEQ ID NO: 17302 - DNA, 969 bp, Triticum aestivum
  Clone ID: PAT_TA_17302
cggcgggcgggaatcaccactcctagttggacaagggactctttatattactatcgacggtcaacggccaacacgcgacaaggctttgtttcaacttccttgcgagccacgttgtttcaatcacgctagcagttacagtaccaaatttattcctacatcgtggatccaatacagccgcccactctggctggggtactttggaagggctcgccggacgctcagaaagagaagtctttgcgaccaagtaatatcatgactcaaccatcagcacaaccccaacttacgccacaattttgcttttcatatgggacattgcgagactttctacgattgtcaagatcgtcgatagatgattcaatcacccagaatctcaatgcactgttgacgccgtcgcgattcggattcgacccatcttctaccttgcaacgcacttcccgcccggtttcgaagcagatcgactctcgatcatgctcggagtttaaggaaaaggttctgtttccttcctgggaagctcgggctcaagtcctgaattattgtgctttggtagcggcaagtccggaccccgatgatcccgaccgtacaatcagagaacttgaaagagagcaagaccgcgaccgaattgtagacgagcgattagacccatattccggtagattcttcccccgcgaagcccgcaccgagaggctagcctcgcttgttagacaagaacgaggtgtcgaggatatcgtgcgacatagaacatgggaggtggtgcaggaaagatgtggcggcgagcctttcaaaaactgggaagataacatcagcaaatggaggaaggctcaaaattcgaaaccatctgtttaataccaccgacatggcacgacttcgtactcttgtaatgagaggcgaaactgtatgattaggtacgacacgtgtataacaccatcaccccttatgataataataattgaattgagacttaatccggtg

SEQ ID NO: 17303 - DNA, 550 bp, Triticum aestivum
  unsure (1)..(550): unsure at all n locations
  Clone ID: PAT_TA_17303
taccaacccatttccctcntgcactgtcaactttgacagtgacattctgttccatgaagtcaaaggataccttcatcgaccaccatcaagaagcagaacaacttttgagagcgaaagctaatatttgatggctgatgaggaacgtcataaccatcaaaaatacccgaggcaaccacgaatttgcatttctgtatgtactcgacatcaacagcatccatatctgcaccgctgtttttcataaatccacagtgcaccttcatggtagcattcagtttgaagctttcctccctctgcttccaggtttgacgtcctccgaacagcggcggagaatctttgtcccgcttgtcaaccgtgatgtaggacagcttcttcacgatcgcattgggagttcgctttggaatgacgacagcgtctggatcatccgccacaggtatcgagcagcggtggagcggtttggacggggttcccatcgggtccaacgcgcggacaactccaccgtcttttctacagagcgctgagctcgtgccgaattcggcacgagcggcacgag

SEQ ID NO: 17304 - DNA, 208 bp, Triticum aestivum
  Clone ID: PAT_TA_17304
actctccttccctctccaatctttatcggtcgagaatgccagtgttgtgttcgtttaagattagtgtgctctggcatttgttgaacaaattttttttgttacgattgattcaagttgaagttgtcttatggtttaatacaggcggtctaacaaacacaaaatgggaaagcttatgtaatatgtgttgacttgctgtgtgcagggcaag

SEQ ID NO: 17305 - DNA, 679 bp, Triticum aestivum
  unsure (1)..(679): unsure at all n locations
  Clone ID: PAT_TA_17305
gccggcgccggccggtgaaggaaacctagccgccgtcgtcttcctcttcctcttcgtcgaagccatcttctggtctggtgctgttggtagctatggcgctgcgcaccgttgccgcgaagctgaaggcccccgtcgcctctctcaagcaggcttgggcggtctgccgtcctcaggctaagcatcctttggagggcctgaatgttgatccgctcaccctccaggagatgaaggccctcgagagggcagttagggcaggcgaaatgaagcagaccttggttaccattggcttcatgggttgtttgactggtacggttgtccatgtgctccattcagacttagctgcccgtgaggcgacggcggaggcggacgcggaggcggcggtacgtgaggtgcttgaatcgcttgattcagatgtcaatgcggttggtacaaacaaagactaaggcgcccaaggaaatggcgtttggttagcctcgctgttatgtgcgttaattttaagctggtgcggatgtcttatatgtttaactagtctgtatttggcttgtggcaagagtactatttatgactgggtagtctgtggattgatccgagtaatctctgataatattgaggtttcatctgtgtaatatgttaaaaaaaaaaaaaaacaagcgtaaaaaaaaaaaaaaaaggcccctan

SEQ ID NO: 17306 - DNA, 828 bp, Triticum aestivum
  Clone ID: PAT_TA_17306
gccggccggggtagggagaaggaaaccctagccgccgtcgtcttcctcttcctcgtcctcgaagccatcttctggtctgttggtagctatggcgctgcgcaccgttgccgcgaagctgaaggcccccgtcgcctctctcaagcaggcttgggcggtctgccgtcctcaggccaagggtcccaagctctctaaaggtcttgacgtggatctttcagatgccacacatccgccgggtttttgtacgagaacgcaaagctattgaacaggaagcggacgaaggagactgctgccgttattagttttcatgactggcacgacaggcagtgctctccttgccatgcgttactgatcctaacgagaatccctaacctatcgtttatctgcctatcaagctaaaaggctagctatctccctacctatcgtttagctacctatgaaggtaattaagctatcctgtctgctgtcattttgtatttaagggcactctatatctgaggcattgtctatctgtggtgtctgggcaggatgtgaaatctctatctaattatgtataagacttaatgtaggtctgttatttgtaatggtactttgtgatatttgtaatgttagatctctatattgcatgatataagcaatggtcttagtgatctgtcacttaattaataactcctatcacacataagacacatttttgtctgtttcaccatcacaatcactcccgttccatctaaattcaatggttaaaccccagattcgttacagaaacattcaatggttaagttatttgtgaggttgggaaaacaaaaaaaaaaaaaaaaaagggcccta

SEQ ID NO: 17307 - DNA, 626 bp, Triticum aestivum
  unsure (1)..(626): unsure at all n locations
  Clone ID: PAT_TA_17307
acagataagagctctgaagcgtgtatcattctatgttgtgaaagagangntcagtcatgcatgtgcgctctctttccatttcccgaggacaaatctggtgaagttgctgcaattgctgtatctgaagaatgccgaggaagaggtctgggggataagttgctcgagcgcccgcccgggcaggcattatcccttggtcttggcagactattcttgcttactacacggacagccgattggtttgtgcgacgtggcttctcagagtgttcgattgaatctattcctgagcagagaagaaaacgcatcaatctgtcacgtggatcaaaatattatataaagcagctccagccaaagcatgctggtgtccctgtcaacaattttgctggcagatgataggacttccgaagaatttggtgagagacagacgagatatctgcacttacatcgaggcttttatatatgttagttgtaatttcagatggaaatataactgcagcctgtgatagcggctctaaaattttcttttacttatggatgtaaaaagggcactttgtgacacaacagaaaacaaatatcagaggaatttctatacagaaaccatctgcatgcgatataatgatgctcccccg

SEQ ID NO: 17308 - DNA, 742 bp, Triticum aestivum
  Clone ID: PAT_TA_17308
tagcgtggtcgcggccgaggtacataaactcccgatgataaaattcggtcggctttgcaaaaaccgatccacgaccaaagttataagaattaaagctcttttgagggtctgcctgaaatggccagtcaacctgaccgtgtagagtttgcgaattgctatgtaatcgcacaaccatgacacgacgacattccagtgatagccagattttggcccgagtcaactgatcttttgctgggccgcttcaacatactgcagagcaagctttttcaccttgtcaccctccttgatcaggaagttggcattcttagcctccgagtggtgcttcataactttttctgctgttttggcgacagcccacctgtattgctcgacggtgattacgccgctcttgcaaagtggcctgatgttctctttcacaaacatttcaaccttcttatgtaccggcccgggcggccccgcggtgctgttattgcctgggtcaggtgctggtttcttccaactgtctacactttctgctggatgggtggatgacttgtctcctttggaatgtttacgattcaactcttgattgccactggaagacttctctttaccaagctccagtttcactgcttgactgattccttcaccttctttcggcacattattcccatgactagatttattatgcaaatcgctcactgttatgtccatttcttttgagtcctccacatgcccggtacctgcccgggcggccgctcga

SEQ ID NO: 17309 - DNA, 507 bp, Triticum aestivum
  Clone ID: PAT_TA_17309
gaggatttggctgctctcgactcgagacgccgccgccgacgctgcgccgcctcctccccaagacgccgcgctgcctcccccccaagtcgccgcgccacccgacgcctcgacgccggtgatctcctccggcatactggacttctcaccggtgggttattacgagtatttgctgctttccaggctggagttagatgctttccgagggcaccatggccgtcacacctccgcctaattcggctgtccctgtgtcttctttggtggatgagatcgatggcgctctgtagttagctgtttgtgctctgtcctcttgtaacttgtgtgggatcacactgattcatgatctgggagaaataacaacagcgcttatttcagttcttgccatgatcaagtttgtgctactttgttttggttgggatctgttgtgcaagcttgtgtttctctgtaaatcactgcatatgacggctataaacttgctgagatgtttctgacaagtacatgtttaattaa

SEQ ID NO: 17310 - DNA, 601 bp, Triticum aestivum
  unsure (1)..(601): unsure at all n locations
  Clone ID: PAT_TA_17310
actgtatcagcnaactcgtggcatgtgactgtcttctacatacagtatatgctgtcaaaattttctaccccaaaacttggacatgcttgtgttccgaaatatcaaaaggnggcttagttagatctaagaacaaacctatacacctattagtcagcatgaagtatctccaaaagaagttaaggcagtcagcacacataatccaccaaatggcgcaagtattgacttcacattatgatatctgctagtttctctccaagatatatccagcttcctgggtagtttatacgacactgccccaccttataatgatgaacgaaacaaatcattcctgctcggagtttttgttgttaccacgaccgataacagagttcatccgtcaagagtccagaaactagtatacaaatttggtaagggtatgaaacccccacagctccaatccatcggcagcactcctcggtgtaatcaagcagctagctgggtgctctttttcgagcacgttacagtgcgttagtgtgagctaacatagtatacactggagcagcccttcggtgctcacgttttgtgcagccgtgatatcttgttgaaactggcctcaaagagt

SEQ ID NO: 17311 - DNA, 766 bp, Triticum aestivum
  Clone ID: PAT_TA_17311
cgagttttttttttttttttttttttttttttttttaaccaactcttttcagatttatacatcaaactgtgcattcacaagagctgccgcctatgccttccccccctttctgatgcatatcgggcagcatgctgatcttgcactatgttacaattttagtgaaaccactgatgctcctgaactgccaacagcaggggtttggacttctaagatctcatatgagatgattatctttggtcagttgtcctgggcgaaaccgtctgcaggtgaagagttgctaaccagccattacacaccaccagatgaatctattctattcctagaacaggggaatcaggcgtgttgctccttatgcaattgccctcggaattttgcaatgttcttccgcagttcaatgtttgacagtcgctctgcctccagtgcccgttcaagctttgctgctcgagaactccattctccaagaatagctctgagtctatcattttcttcaacgtactgactgttgctcaaacgaatacgctggatctccgagtccttttcatcaatcaggccacgagcaagctgaagctctgagtgcacttgattcatctcggcggagagtgctcctcgtgccgggtcccgcgcggctaaaagatggacaagatcaacctgaggagtgttcccaacatcagttctctggtatttgctcaaacattcttgcaagcgcacacctcctcactcaggtaatgaatattctccctttggtattgaagtaacgccatccgct

SEQ ID NO: 17312 - DNA, 808 bp, Triticum aestivum
  Clone ID: PAT_TA_17312
acgaggaggaggcaggagctaggtctcgacaacaagccgcagaaccagcagctaaaccaacaacaacaacaccaacaacagcagcagcagcagcaacaacaacgagaagatcacggagaggcaacaagtgcagtaaaagacagcagcagcagtagcaacaacaaaagcagtaacctccaagtggtgaagaagaaaaggacggtctcaatgggggtggaggaggctgcattcttgctcatggccttgtcctcctcatctacacccccactactacatggctgacgaccccccacaattggtgcgccgtgtacatacatacatgatatacaaggcagcctaaacagaccaccaagtgattccaaaccagtcatacagatttcttagatggattatcaggatggagcagcagggaaatgatgtctctttcaggctgatgatgttgatgtgatgggggggctggattttgtatttggatccacctgccccgtagatcttggatcgtgtcagtgtgtcgcattcggagaccgaaagggaaggtgctcttggggcaaatgtttgctccggagagggaaaaagctggtcagtggctgtatgtttgttggtaggctcaactgtgattagtccagagtttgttttaattttacccctgattcaatgtgttccctattttctgtttatttccatgtaagtgttttgtttccattgttaattcagaaggatgggtgatcaaaagcaagcattgccctccttcatgtgtaataaagatcaaagcaataaaaatgattcattcctttcaattcaaaaaaaa

SEQ ID NO: 17313 - DNA, 665 bp, Triticum aestivum
  Clone ID: PAT_TA_17313
gggaggaagagggggagtagcaagcggaggaggaggggggcggcggcaggagcggcaggcgctgatgctggcgttcgcggtggcgctgctgatgggcaccgccgtctacttccgcatctgggcgcgccagtccgacgacccctccttcaccgccgacgaccgcgaggagctccggaggcagttcgagcatgctaacctagaggcaatggatgaatccgctgaatggagaatgaaatacgacacggaattggcgaaaaacagggacctgcaagatgaacttttaaaggtcaagacctcactgtctgattcaaccaagagatttgaagagttacaaaaggataatgagatgttgaagaggcagactgaatccatgaaactggagtgcaattgcaccgttccattgaatattaatcaggaataagtacatttcactggcagattagcactagtttcgttttcatttttcttattattggtgtgaggacagatggaatgagcagctttgtaatagtacatatggcgactgcagcaaagaaacttgtgtttgcaattgttaatgacctatacacccgggcacaatttttgaagtaatcacttgtgagtagcaatgcataagtgtgttttcggctcacatttttgaagagaagttttgtgctggatttgag

SEQ ID NO: 17314 - DNA, 359 bp, Triticum aestivum
  unsure (1)..(359): unsure at all n locations
  Clone ID: PAT_TA_17314
ttaggtgttgacacggatgagtgcatcgtgatagaagatgcgcttgctggagttcaagctgcgaaagctgcggaaatacgatgtattgctgtgacgacttctctagatgaagatgcattacaacaagccagtcctgtgttcatcagaaaagacattggagatatttcaattaatgacatcctgtatggtggttctaatgcttcccacagtatgtagttcatgcataatcgatttactttaataatacatctcttgtaggagaaaccggaaagaaaaacctgtgtatcttgtgcgcaaaattcacttgttttgttctatcaacttcaatgaataatatcctgtgtggttttctgnntntt

SEQ ID NO: 17315 - DNA, 652 bp, Triticum aestivum
  unsure (1)..(652): unsure at all n locations
  Clone ID: PAT_TA_17315
acatgacaccatggaccgccaactgcatcttgtgcacattgtatcatttattaaaaaggaaaaacatatcgtgcagattgtggagactggatatcgatgngtgatgtttcactggcatccgtcagagtttcagctctagtttagcaggattattcacagcgaacagtgaatccagaagttggttgttccatcctgagttccagacaacgaaactgatgtgagcctctctcttgatatctcgatggagttatttctgcataatcgaccctatcaaagngtgtctctcaccctccctccgtcttgagtcttgagtcttgaccaacctgaaccctgacgaggaggaagctacctacctcctcccggcctctccaccgccagtttttctccggccacctccccgactacatcctccactcctcccctgcatctgctctggccacatttggcactgacgccacacgtcccaggatgctcattacccgttgtcgggcaaggcctgagcaattgtctgctgaactagggccagcatctatgactctgagttactcagtgtcttgttggatctatcacattggtcctccgtcctctgaccatcacggcaaatcgatcgacaggaacagcatctgcaaaactggcacgtgagagatacagt

SEQ ID NO: 17316 - DNA, 633 bp, Triticum aestivum
  unsure (1)..(633): unsure at all n locations
  Clone ID: PAT_TA_17316
gcagtttcttatttgttcaggtcgctcctgccgattccaacggcggcctccgccgcagcgcgtgtgcgcttgtctcctcctgcagccgcgccggcaggtcgaaactttgaaggctatattcctcgcagctgctcgcgttcatcgttgcagatctacactacccggtcatcaccgctatctctctcgccatcttcagccctcatggtgtcggcccagcttccgccggctgatgtagcccagcggtcagaggagtggtttgctctgcgcaaggataagctcaccacaagcaccttcagcactgccttgggtttctgggccggcaacagacggtcggagctttggagtgagaaggtctttggaccaacagatgtcaagttggcggatgcagccatggctgccatggcctggggaaccaatcatgaaagcatggccgtagagcagtacacgagcatcacaggacggtcagtgggttcccttggctttgcagtgcacaccgaggctaaattggggtggctcggagcttcacctgacggcgttcttgggtgtgaccctgatggtgggatcctggaagtcaagtgcccgtnnncaagggtaagcccgagcttgctcttccatggcgtatcgtgccatact

SEQ ID NO: 17317 - DNA, 237 bp, Triticum aestivum
  Clone ID: PAT_TA_17317
caaggaggcacacatatggatgatcgggggggtcgctagagcttatgagaggggaatggattctctcgccacgatgttgaatgggacgcgcaccactttttttgtgaatcaaaaaatattaaaatgaatccccgtattggcgcttttcaaaaattctgaatttacatatccgtctcggcctgatactgatacacgtatccatatcggtgcattttagagaaccagtgagcgcgaggt

SEQ ID NO: 17318 - DNA, 675 bp, Triticum aestivum
  Clone ID: PAT_TA_17318
ctacaacaaagatggaatagtagtttatgatggaaagggtctatttagcgctgcccgtgtttggtggatgtttcgtgcttatggacatgacaaagtttgggttttggatggaggtttgcccgaatggcgtgcttctgggtatgacgttgaatcaagtgcctctagtgatgctatcttaaaagccagtgctgctagtgaagcaattgagaaagtttatcaggggcaatcggttggtcccgccacatttgaagcaaagttgcagcctcatcttctttggaatcttgatcaggtgaaagagaatatcgaggcccagacacatcaacttatagatgctcgagggaagcctagatttgatggtgcagttccagagccacgcaagggaataagaagcgggcatgtgcctgggagcaaatgcgttccttttcctcaggtgcttgacagttcacagaagctattgcctgcagatgatctccgtaagcgattcgagcaagaaggtatatcacttgatcaacccattgtgacctcttgcggcactggtgtgacagcatgtgttctagctttgggtcttcatcgcctcggcaaaactgatgttgctgtatatgatggatcatggactgaatggggtgctcaccctgacactccagttgctaccgctgtttagtctcccgtgcagtt

SEQ ID NO: 17319 - DNA, 1541 bp, Triticum aestivum
  Clone ID: PAT_TA_17319
gcacgaggcaacaccccaaccccaccctggggccctcgctcttctcgccccccccctcgcccacatccgccgccgccgccgcccccggccccccatcacgggaacgcgcctctcgcgcgcccgccccgccgccttccccctccgcggcgccgaccccctcctcctcgccaagggcgggggcggcggggcgccagcggacgtggtcgggggcctcggagcccccctgtgccccgcgcttaggcgcttcggtgccgccgaacgctactgccgcgcccggtgagccgtccccggcccccccgaggggccctgacgggagggcgccgtccgcgcgttgccgcgggcccggggggccgagcccgccgcttggcgacgagccggtctcgggtatccctagctgatggtacttgtttgctggtggtatatgcctcctggagaaatgtcatccacaccagctgccatctggataagcattttccgccgctgggtcttctcttggcatctataacaaagatggaatagtagtttacgatggaaatggtctatttagcgctgctcgtgtttagtggatgtttcgtgcttttggacacgtcaaagtctgggttttggatggaggtttgccccaatggcgtgcttctgggtatgatgttgaatcaagtgcctctagtgatgctatcttaaaagccagtgctgctagtgaagcaatcgagaaagtttatcaggggcagtcggttggtgggtatgaagttgaagcgaagttgcagcctcatcttctctggaatcttagtcaggtgagagaaaacatcgagacccagaaacatcaacttacggatgctccagggaagtttgaagcgaagtttgaagctcatcttctttggaatcttgttcagatgaaagagaagatcgagaccaagacagatccacttacagatgctcgagggaagcctagatttgatggtgcagttccatgagccacgcaagggaataagaagcgggcatgtgcctgggagcaaatgcgttccttttcctcaggtccttgacagtacacagaagctattgcctgcagatgatctccgtaagcgattcgagcaagaaggtatatcacttgatcaacccattgtgacctcttgcggcactggtgtgacagcatgtgtattggctttgggccttcatcgcctcggcaaaactgatgttgccgtgtacgatggatcatggactgaatggggtgctcaccctgacactccagttgctactgctgtttagtctcacgcggcgtgtatggaggaccatcttttgtacccgcacttctcagcgatgtatgaaggtcagaaggcaaaggaaactgaagagtgtgggtgggtgtaaggttgtggaagcgatgctgttcggcgttttcaatgtaaattatcgaaacagagaaaaattgaatacatactgtgtgaatcaatagttgatgatccacctttctgtgatctctttgccgcgccgaggggaataataaataacaaaattccgctaaaagtatttagccccgatttgctttc

SEQ ID NO: 17320 - DNA, 1084 bp, Triticum aestivum
  unsure (1)..(1084): unsure at all n locations
  Clone ID: PAT_TA_17320
gccggccaccgcgagagcctcctaaccctagaccacttaggcacagccgccgccgccgcggctcccaggacagcagccaaggaagaggaagccaagcctccgccatgccgaaatccaagcgcaatcgctcagtcaccttgtccaagaccaagaagaagcctggtctagagcgtaagggcaaggtggtcacggagatcaaagacgcgattgagcgccacagcagcgcctatgtcttcaccttcaacaatatgaggaatcagaagctcaaggacctcagggaccaacttaaatcctctagccggatattccttgctggaaagaaggtcatgcagatagcattggggcggtcacctgctgatgaagctaagacaggcctgcataaactctccaagttccttcaaggtgcttctggattgttatttacaaatctcccaagggatgatgttgagagattattccgagaatttgaggcgaatgattttgcgaggacaggaagtattgcgactcaaacggttgagctaaaggaaggccctctggaacagttttcacatgaaatggaaccctttctgcgcaaacaaggactgccagttcgtctaaacaaaggtgttgttgaattggttgcagatcatgtagtatgtgaagaagggaagcccctttcaccagaagcagcacacactctgcgcgtgcttgggaggaagatggcgacgttccgactgtaccttgtctgccgctggtcgtccgatgactttgaagtgtacaaggaaggcttggcgcacctgggaggtgaggaagctgacgagtcttcttaaggttgttggatcatggtggtgtgcttgttgtctagctgtgttcagacggttttgtgccatgcctttgtacccttaatttgacaggaatctcaaatatatgatctgacccagttgggcatattgttgagtgcaggtatttttgcgagctactattataggttgatcttcgtccctcctaacatgatcgtataccccgccnatggncgcgtttaaactctactggaaacctgcgtccactaanccttgcnaancccttccantggttattcaatngc

SEQ ID NO: 17321 - DNA, 698 bp, Triticum aestivum
  Clone ID: PAT_TA_17321
cggacgcgtgggcggacgcgtgggagcgtgtcgacgaccgggggatcatcatccgatcctgggctccacaaaccgccatactagcccacgcgtccggggggcattcgtgacgcagtgcgggtggaactccgtcctagaggcggtggccgcgggcgtgcctatgctcacatggccaaaggtgtacgagcagttcatcaccgagaggctactcacggacgtactaggaatcggggagcgactgtggccgcacggcgctggcttacgaagcgaggattacgaaaaacatgaggtgatcccggccgacgatgtggcgcgggcgttgctcacattcatgcatcctggagggcctggggaggtgatgaggaccagggtaatggacctcgcctcaaagtctcgtgcggccatggcagaaggaggctcctcgcagaatgatttgcaccgcctcgtcaatgatctcatcgcagcaagaggatagccagctggaaggacgcccatgggttaaagtcgtcgcacctacgtacaacattatgtggctttcagtctgttctatttttccttgtaccaatccacgacgtatgttttcgtctagtatttgttttgtcatctggtattttgcactcgtctgttttatcttgtaatcatgaaataaaatctctgcagccctgtattgctaaaaaaaaaaaaaaaaaaggccccta

SEQ ID NO: 17322 - DNA, 776 bp, Triticum aestivum
  Clone ID: PAT_TA_17322
gccggccgggccggacccacagacttgtgctcctagtaggaaattaagaaataaagatggcttcttctaccactagcagcggcagcaagactctgcgtgtcctgctattgccccactttgcgactggccacatccaccccttcaccgagcttgccgttagcctcgccgtgtctagcccaaacgccaccgtagaagccatcatcgcagtcacgccggcgaacgttccgatcgtccagtccttgctggagcgccatagcgcagcaactgtcaagatagttacctatccgttcccaacggtggagggcctgcccaagggtgtcgagaaccttgggaaggcggccactcaggcggattctatgcgcatcaacatcgccgcctcgaccgaatccctgatgcgccccgcgcacgagacgctcgtccgggcgcagtctccagacgccatcatcaccgacttgctcttcacctggagcgccgacatcgccgacgagctcggcgtgccatgtgtcacattccatgtcaccggcgccttctcgatgctcgccatgcgccacctcatgatggaggacgccgcgatcgacggagatgacacggtgacggtccctccgttcccgacccctcagatacgggtcccgaggaccgagctgcccgacttatcgatatttcgatacatcttcggcaaggttcattccatgcaagctgcatgcttcggcctggccgtcaacacgttctcaggcctggagcagcagtactgcgacatgtacatgggccaagggtac

SEQ ID NO: 17323 - DNA, 1920 bp, Triticum aestivum
  unsure (1)..(1920): unsure at all n locations
  Clone ID: PAT_TA_17323
caaccccatcctagtggtcgttgaaaataataaagatggcttctgccactagcagcggcagcaagactctgagtgtcctgctcttcccccactttgcgaccagccacatcgagcccttcaccgagctcgcccttcgcctcgcagcgtctaggccagacgccgccgtggaagcgaccgtcgcggtcacgccggcgaacgtcccggtcgtccagtccttcctggatcgccgatggcacgggcgtagcgcagcaaccggcacagaccgattgacctatgagaataataaggaagcctacgtaggaaattcaagaactacagatggctgcttgtcccactatgcccccgcagcagcactctccctgccctgctattgcccagctttgccactgcccccatccaccccttgaccgagcgcccccttggccgcgcccgcgtcgtccacgcccaaacgccaccggacgatccaatcatcgcagtgaccccggcgaacgttcggatttgaccagtccctttctgaggatagtcaggtatccgttcccaacggtggaggaaaggcctgctggcgccgagaacaatgggaaggcggcgactgacgaggaggctatgctcatcaacctcgccgcctcgagcggggccccgctgcgccgagggcctgggaggcgctcatccgggcgcagtccagacgccaccatcaccgacatgctcttcccctggagcagcgacatcgccgacgcgctcggcgtgccatgcgtcccaatccatgtccctctcgccttgccgatgctcgctatgcgccaccgcatgatggaggacgctgcgatcgacggagatgacatcgtgactgcccctccgtacccgacccctcatatacgggtcccgaggaccgagcctgcccgacttatcgatatttcgagacagtcttctgtcaaggttcattccatgcaaagctgcctgcttcggcctcgccgtcaacacattctcaggcctggagcagcagtactgcgacatgtacacgggccaagggtacgtccagcgctcctactttgtagggccgcaactgcaatcctctgagagccccacgggtgactcaaagtcacagtgcatcggttggctcgacacaaagtcggaccattcggtcgtgtacgtgtcctttggctcgtgcgccctcgtatcggatgctcagctggaccaacttgctcttgggttggaggcctcggggaagccgtttttgtgggtggtcagggcggccgacaagtggactccaccaaaagggtgggagaagcgtgtcgaggaccggggggtcatcatcagatcctgggctccacaaaccgccatacttgcgcacccggcagtgggcgcgtttctgacgcactgtgggtggaactccgtcctagaggcagtggccgcgggcgtgcctatgctcacatggccaaaggtgcacgaccaattcgtcaacgagaggctaatcactgatgtgctaggaatcggggaccgactgtggccgcatggcgctggcttacggagcgaggattacgaaaaacatgagctgatcccggccgacgatgtggcccgggcattgctcacattcatgcatcctggaggacctggggacgttatgaggaccagggtaatggacctcgcctcaaagtctcatggcgccctcgcagaaggaggctcctcgcagcaagatttgcaccgcctcgtcaacgatctcatggcagcaaaggaggggcggaactagctagcttgctagctgccgtgcatgagttaatcgaactcatcgcaccaaagtaaatcattcctgttgcaatgcacgacgtatatatgtttccgtgtagtatttgttttgacattcagtcttttctacttgtctgttttttcttcaataaataaaataaaatctcttcagctctatannnn

SEQ ID NO: 17324 - DNA, 553 bp, Triticum aestivum
  Clone ID: PAT_TA_17324
tcagctggtacagtctgtgtcggtcctgcccgaccagctgacggagagatcgccgccacctcagagggaaggccgcagcggggcgatcgcccccacgctgcagccatctagcgccccggtggaaggcaccggcggccaggtcatggtccttaacgacgcttcttccctggccccgcagctgaggcggacgtctcccggggaaggcacaagcgggaggatccatcgtcagcttgccggacccaagcggcctgacccgagagaaggccgcggtggcggcggcggcgcgatccatgctttttcctcttgagttctactactacccataagccagatagttcgcagatggagggtctactgtcggatgtctagtgcgttagcacagagttgcaaagtttaaagttgttgaagtgcattagtaaattgaaatgttatgttttgttacattagttttctatacggcggttaaggcagttacagtggtcacagttgttagaagccataaactgaattttgtaacatgtgttaatctaatataatcattgcgtttatttcc

SEQ ID NO: 17325 - DNA, 619 bp, Triticum aestivum
  Clone ID: PAT_TA_17325
gccggccgggtccgaagatggctcagctagttagctcgaaagaggagtgcaggacatcgtctacgctctcgaccacgatcaccgagacggtgaacagtgaactgcctcgacggccacgcgcagcaatggcgtccgccgctccaccctctctcctcccccagctggttcagctggtacagcctgtgtcggtcctgcccgaccagctcatgaggccgcaggagacggagagatcgccgccacctccgagggaaggcgcaggcgggagggtccatcgtcagcttgccggacccaagcggcctgactcgccgagagaaggccgcggcggcgacggcggcgtgatccatgcttttcctcttgagttctactagtagccacattagccagacagttcgcagattcagcgtctggctaaagtgtacactgtctaagtctctagtgcgtccttcgtgaactttagatgaaattagcataaaaatcacactttgttgcgaggattataagatgtttttagtgagtttatttcaaatgtttaaatactaagtttgtactattaaacacggagttgcaaagttcaaaaaattgttgaagtgcaaaaaaaaaaaaaaaaaaggccctttgt

SEQ ID NO: 17326 - DNA, 705 bp, Triticum aestivum
  Clone ID: PAT_TA_17326
agttagctcgaaagaggagtgcagggcatcatctactctcgctctcgaccgcgatcaccgagacggtgaacagtgaactgcctcgacggccacgcgcagcaatggcgtccaccgctccacccgctttcctcccccagctggttcagctggtacagtctgtgtcggtcctgcccgaccagctgacggagagatcgccgccacctcagagggaaggccgcagcggggcgatcgcccccacgctgcagccatctagcgccccggtggaaggcaccggcggccaggtcatggtccttaacgacgcttcttccctggccccgcagctgaggcggacgtctcccggggaaggcacaagcgggaggatccatcgtcagcttgccggacccaagcggcctgacccgagagaaggccgcggtggcggcggcggcgcgatccatgctttttcctcttgagttctactactacccataagccagatagttcgcagatggagggtctactgtcggatgtctagtgcggtaacacagagttgcaaagttaaaagttgttgaagtgaaataaataaattagaaaagttatgatttgttaaattagttttataaaagggggttaaggcaaaaaaagagggccacaattggtaaaaaaaaaaaaatggaataatggaaaaatgtggtaaaattaaataaaatcatttggggtttaatatcc

SEQ ID NO: 17327 - DNA, 645 bp, Triticum aestivum
  Clone ID: PAT_TA_17327
gccggccgggctcccgacgaacgaaagaccccgacaatttctccctcgcagtccctacctctcttcttgagactacgagcgcttcgactttttacacattcgccgacaaaaggactaacattcacatttcagccatgtcgtcgaccaagaagccctccggcaagactcagcgctccgccattgcggatgtcgtcgcccgcgagtacaccatccacatgcacaagcgactccatggtgtcaccttcaagaagagggctcccaaggccatcaaggagatcaaggcctttgccaccaagtctatgggtacctccgatgttcgcatcgaccctcagctcaacaagaaggtctgggagcagggtatcaagggtgtcgactaccgaatccgcgtgcgaatttcccgacgacgaaacgacgaggagggtgccaaggagaagctgtacagctacgtccaggccgtgaacgtcaaggaccccaagggcctccccacggttgttgttgaggaataaatataaaaatttctcttgggacaaggttctagggtggcatggcatttggagttgtactcggcattctggctttcgacgctgaaaaatacacagagggaaaatgtgattaaaaaaaaaaaaaaaaaaaaaacctacccta

SEQ ID NO: 17328 - DNA, 1755 bp, Triticum aestivum
  Clone ID: PAT_TA_17328
gccggccgggtccgggcggggccgggacaaacctctcaacgaccgaccttgaagagacgagccgcagccatgtcgtcgaccaagaagccctccggcaagactcagcgctccgccattgcggatgtcgtcgcccgcgagtacaccatccacatgcacaagcgactccatggtgtcaccttcaagaagagggctcccaaggccatcaaggagatcaaggcctttgccaccaagtctatgggtacctccgatgttcgcatcgaccctcagctcaacaagaaggtctgggagcagggtatcaagggtgtcgactaccgaatccgcgtgcgaatttcccgacgacgaaacgacgaggagggtgccaaggagaagctgtacagctacgtccaggccgtgaacgtcaaggaccccaagggcctccccacggttgttgttgaggaataaatataaaaatttctcttgggacaaggttctagggtggcatggcatttggagttgtactcggcattctggctttcgacgctgaaaaatacacagagggaaaatgtgattaaagcttgaagtcaacccaaacgacaatcggtgcctcggcgtgaagtgactggtctctggtcaaaggctttttttatgagggcgaaaaaaaatttacgttctgacgtggtgaacactggatgttatgaactgtcgattagagggtctgctatcgacaacggtctatttatttctgaccccatcaatgcctccctcccattgctgtttgtccagctgtagaaatgccatgcaatcgtgtaatcctaacaagtcatcaaaccaaattccatacacctgctactcctgttcccgtattcaagtataaaagcacccaaatccccgtaaaaactatttattcgtcctcgatatctacgtgacgtgccagcaccttcttctggaactcctcggcgtccttgtcccacaactcagcagcctcaccgttgaggggggaggcattgttgggcttaccgagtaagctctgcagactgaggagaacagtctggatgttgtaagcggcagtccacttgtccttgaggatatccaagcagatacggccggagaagtcgacattagggtggtagatgggcgtcttgaagagcaccgtgggtgccgcataggggtagttggaagggaaggcgaagctgagctttaaggtcagaccagagtaaggggtatcttcaggaccctcgatagtggcagtccatgataggaggtcgccatctgcagaggggaaggcagagacaccgggagcgggcgatgtcatgagctgcatcaactcggtctggagtctcttggtggtgctctgagagtcgggacccttggaaccagcgttaaccttggcggcttgaggagcagggttctggctgttttccatagtgtactccattgtgttatgttgatggttatggttactcgagtatgaagtatgaacagatgatgacaagcaagagaacaccaggcaagagatgcagtcgtaggagaagggaagcgagtaggaagttgtttatgtacagtacgtgcagacaacaattccgcaactggcaagagatgaagttggacgaatgcaggggcgactgggggaaacaaagaccctttggcaatggcgttgtgacgagaggcctaaagatgaaagcgggaagaaaggtcttggactaaagtgactttcaagcgagaccagacgacgaatgatttgcttgcttgcttgttttggattgcgacagaaattgt

SEQ ID NO: 17329 - DNA, 393 bp, Triticum aestivum
  unsure (1)..(393): unsure at all n locations
  Clone ID: PAT_TA_17329
gccggccggngtccagcgtagctccccaagacgccaaagctgagcaaagcaaagcagagcagagcgctcccctccggccggctgacacgctgccatggcgatgagtgacactggctcgagctccgccaactggactgacgacctctaccgctacgacacgcccagcctgggcgccgcggcggactcgacgatcgtcgccgcctccgcgacgccgacgagcccggcgtcggcggggtccggcgacgggagcccgtcccgggcggcgggcggggccctgggcccgcgggtggcgggcaagccggcggcgaggaagcgggtccgagcgtcgcgccgcccgcgcccgcagcggttttttttttttcccgccccccccccgcccgtgtcgctgtgctc

SEQ ID NO: 17330 - DNA, 914 bp, Triticum aestivum
  Clone ID: PAT_TA_17330
gccggcgcattcggccttcctcgtagcaccccaagacagggggagagctgaggctgagcaaagcagagcactctcctccggccggctgacccgctgccatggcgatgagtgacactggctcgagcttcgccaactggaccgacgacctgtaccgctacgacgctccgtgcctgggcggcgctgcggcggactcgacgatcgtcgcctccgcgacgccgacgagcccggcgtcggcggggtccggcgacgggagcccgtcccgggcggcgggcggggccctgggcccgcgggtggcgggcaagccggcggcgaggaagcgggcccgcgcgtcgcgccgcgcgccagtgacgctgctcaacacggacgccagcaactttcgcgccatggtgcagcagttcaccggcatcccctcggcccccgccggcccgttctccggcgctcccgtcatcaacttcggcggggcctccggcctacggcttcgcgccgcagcagcaacccggacggccgccgtgtccttcgaccaccacctccaccagcagcggcagcagtacaccggcgcggcattcggctacgggaaccacctgcagcactccctctccggcggcgacgcgttcgcccacgggctcggcgcggcggacgaccggatgctcctccagagcatgcaggcggcgcagatgcccggggcgcgcgccgctcacaacagcgccaatggctactttgcttgatcgatcaagtgattattaactaagttgcatgcacggagtgaaagattttagaaacgcggagaagaattggcgtccgatcgagcttctgtttgaatttcttggcttgtttgttcactgttcagggtagttcatccatcacatggagcgctatatgtaaatatttgaacggatatttggattttgcctgtg

SEQ ID NO: 17331 - DNA, 594 bp, Triticum aestivum
  Clone ID: PAT_TA_17331
acttcttgctgctaaatccgtcgttttactgtcatcatttctagggagtcagccactcaacaagtgttgtggtttgtggtttcaaaggaacgacagaacaaaaccgcccatgttctcacgtctgcgcatctcattcgtgaaaaggatccctccgtgaagaaccattggaaatcgcagtggacaggaaaatatcatcgtggcgctggggtcaatgttcacttcctcgacaaaagagttgtaccaggccaactcgtctatcttcaggagcattatgaacttgctctttatgaggttgaagtgaataaaccagttcagctgcccacttttaatgactgtgtgcgttctggtcaagatgtttttcgacttggaagagatgaaaatctagatctgaagataacacatggtatgacagcctatgaggttccatcttggtatgaaagatgccactacatgtatttttgtcgtgatgcatctagtcgcaaactgcttgatgatgatggaggaccgatcattgacttagaagggaaggttgtgggtttagttaataatcatatcaatgagactttcataccttcgtccatattgcataagtgc

SEQ ID NO: 17332 - DNA, 572 bp, Triticum aestivum
  unsure (1)..(572): unsure at all n locations
  Clone ID: PAT_TA_17332
ggcggggatcccggtgatcgacctgctgctcgccccggcggcgccgngagaggctgcgcggctgcgggacgcggcccagcgcctgggctgcttccgggtggcaggccacggcgtgccgcgcgcgctccaggacgacatgaaggccgccgtgcgcgccctcttcgacctgcccgacgacgccaagcgctgcaacgccgacgtcatctccggcagcggctacgtcgcgccaaccgccacgaacccgctctacgaggcgttcggcctctacgacgccgcctcccgcgccgacgtcgacgccttctgcgcctctctccacgcgccaccgcacatcagggagaccatcaggagatacgcggagaagacgcacgagctaatcgtggacgtggcggcgaagctggccgcgagcctcggcctggaggagtccgagtcgcaccgcatgttccaggactggccgtgccagtttcgcatcaacaggtacaagtacacgccggacaccgtgggggagaccggcgtgcaggtccacacggactccggcttcctcacggtgctccacgaggacgaccgcgtcggcg

SEQ ID NO: 17333 - DNA, 639 bp, Triticum aestivum
  Clone ID: PAT_TA_17333
ccccccacccggactccggacggggagcgtgagtgacgccacccggtgatctccgctgtggtgcgggtattttacctttggtgcacttggttgattccttgacaaggagctcgtgcaatgtccggccggtggtggtgtgctgccaggtgcgcccccctcccaggacgcctgagggggcggttctccccggtcaccttgtggcgagagaggggccaccccctttacctgggggtggcgccgagttttgccttgtggggtgctttgaggttggcaccaaagataaagctccttgcatgtttcttcgattgacgatgttttctctcaagtgcagcaagagcggagacttaacattgggtgagagccgaccgggttcggtacttcaagcttcctaagaaggaaattagtgaatcattattcttgcgtccccaggcgttctggctataaacaaactgcatcataataacaccctgttggtgttaatttgcttatctatcagttcctcttgtggaagttggtgttgcatgttagacaagcagttgtttttgtgactcctatgatattatgctcacgcaaaattaagacattgtttactgtactagataagtgcttgtgcgttgcaatggggaacattaaaaaaaa

SEQ ID NO: 17334 - DNA, 567 bp, Triticum aestivum
  unsure (1)..(567): unsure at all n locations
  Clone ID: PAT_TA_17334
tggtcgcggacgaggacggcggggaccggtagtaccatgggtaccatggcaggatggggttggggggcggtggcgccggcccgaagttgnngcncccctcctccgcctccgccaccaccaccgcccccgccggcgggaggctggtagaagccgggaatgtagccaccggacggtggcgggtagctccaggacgacggcgtcggcggggagttcccggaggaggacgggggcgggtacacgtagccggagcccgatggcgaggagggtggcggcgggcagtcggcgctggaggccgggggcgtgggcggcggcagcaggcacgggtaggggcagtcggccgggtaggtgtcagcgaccgcgacgtcgaggaggagcgcggagaagaccaggatcacgagcagcctgtaggacgccatggccgagagggacgggagtgcagtgctgtgtggctagctagtgcggtgctgtgcgtgagagagatgggagtgggagtgtggctagcaagctgcgtgcggtggtgtgtaaatgcggggggaagaaggtgaaggagacgtgagggggaagaag

SEQ ID NO: 17335 - DNA, 1249 bp, Triticum aestivum
  Clone ID: PAT_TA_17335
tttctgcacgtggctcccaatcccccaaatctcctcagcctccctgccggcgcatctccgactccatggcccgcaccaagcagacggcgaggaagtccaccggcggcaaggcgccgaggaagcagctggccaccaaggccgcccgcaagtccgccccggccaccggcggcgtcaaaaagccccaccgcttccgccccggcaccgtcgcgctccgctagcaccgcaagtaccagaagagcacggagctgctcatccgcaagctccccttccagcgcctcgtccgtgagatcgcccaggacttcaagaccgacctccgcttccagtcctccgccgtctccgccctgcaggaggccgccgaggcctacctggtgggcctcttcgaggacaccaacctctgcgccatccacgccaagcgcgtcaccatcatgcccaaggacatccagctcgcccgccgcatccgtggagagagggcctaggctgcagtctgcaatccatgcgtcgtctgttagatccctgttagcctgagttcgtcggtggaagtgtgtgtgtgctagcagtagggtttcagactgtgcctgtgttgttcttgtcatggtggatgtggtatgcctaatgtgatggtaccgtcttgttgccattagcaagggaaatgaaaaatgtttctcattcataccaaacgtactcccacattatggattgcagctccatcctggtcttctttgtcctctcaatgatgtcagacagtgcactgtccttattggcgaccctccgccccggggcgcgcccattgctcggcgggacgaagatccgcgcccgcgagccccctgcggtcggtggggagctccagggcgcccgcggcgggtgggagtgctccccgcaggacggaggtgggtacgcgtagccagagccggagccggatggcgaggagggtggcggcgggcagtcggcgctggaggccgggggcgtgggcggcggcagcaggcacgggtaggggcagtcggccgggtaggtgtcagcgaccgcgacgtcgaggaggagtgcggagaagaccaggatcacgagcagcctgtaggacgccatggctgagacccgagagcgacgggagtgcagtgcggtgtggctagctagtgcggtggcgcgtgagagagatgggagtgggagtgtggctagctagctgcgtgcggtggtgtgtaaatgcgggagaaggggatggaggcgtgggggccgtcgcggggaagaagcctcgtgc

SEQ ID NO: 17336 - DNA, 1177 bp, Triticum aestivum
  unsure (1)..(1177): unsure at all n locations
  Clone ID: PAT_TA_17336
ctcaattatccccttcttccttgtgcttcttcgttcacctgcgactgcgagtgagtgcgagtgcggggtggctcaaagcaagtgcgtgggattggaggagaaggagatggagctggtgtcctcctcccgctccaccctatcctcttgcagccgactggttgctccctccaggtccagttccacgacggcatccgcagctgctaggcgccacgggaagaggctattatgtgtcttgggtggagacaggaatggtgagctcaagatcgggaagcgggcggctcttgctctgctcctggctacgcccacgctctcactgcccttctccgcccacgccaagaccaagaccataaatccttatgacgaaagacgcttgcttcagcagaacaagaagatccaggaagccaaccgtgcacctgatgatttcccaaacttcatcagagaaggttttcaggtcaaagtagtgacacccgacaactacataactcgggactccggattaatatatgaggacgtcaaagttggtacaggcgattgcccaaaggatggtcagcaggttatatttcactatgtgggctacaacgaatcaggacgaaggatagatagcacctacatccagggttcgcctgccaaaattcgactaggcaacaaatcattagttccaggttttgaagaggggattcgggacatgaagccaggggggaagagaagactaattatacctcctgagcttggtcctcctgttgggccatcgacgttctttagcgcgaaacagtttgaagtattcgacgtcgagctactctcagtgcaggactgccagcggaggacaatagctttctactctgatgttgtctgcacttgatcatctggtctgttagtcccgaccggtgcagcattctcctcctacaaccctgtaggaaaaaattgttagctattgtttttcgtgaaaacgcaggggacccatgcgtctcattccattgaaaagagagagtttgtaatcaaaaaactgcctagaaccttgtttctgacttctaataaatgatacagcacaaaaaaaaaaaaagcagcacaactctaagcccagcagcgccagcagtagtccagagcctggcttcggctttgatcctactcactaaggtgggcttgatcctactcactaaggtggaacggagngttgcgc

SEQ ID NO: 17337 - DNA, 793 bp, Triticum aestivum
  unsure (1)..(793): unsure at all n locations
  Clone ID: PAT_TA_17337
ctcccaagactctgttcggctatccagccatttctccctccactatcggtgtttgtgactgctttatgtgttggctcaccattggctataaatatcaaggctgttttgtcaccgtatggactatccattgtgtttctgctttttgcattccatacaacatcttttgtagctgggtatcatcttgctggtacttggttccgcaagtcagctgatgtgaaggccctgcaaagaacgatatcttttgagacagggatgcaaagtagccttcttgctcttgctttagcaaacaggttcttcccagaccctctggtgggagtgcctccagcagtatcagttgtgctcatgtccctgatggggtttggtcttgtcatgctatggtccaagaaaacacaagtgtagaccccgcaaaaccactgggctggatctacggcccagatacttctctgcgattttttcgatggcgctgaccaaatcgccaagaacaacccgatccttgggcggaaagatgacgactgcagaccgtagacggccagggtgccatgccgagtgaggcaccacggtcaccgtgacacgtctggttccttgtcactctcgtttcctttgatccttgggtggaaatagatgtctgtgtaacgttgtgggggtctcaggaggttatcgctccccaggtgattctgacagaagatagaaagggagaagaaactactgctggtggatttatcatccgatgatgataaccgtctgcnttcctgtgacaaaaatgatataccaccatgctgctaagcaacgtttn

SEQ ID NO: 17338 - DNA, 711 bp, Triticum aestivum
  Clone ID: PAT_TA_17338
cgcatcaccgccgctgccgtcgctctccgtcccggattcggccctacccctgccgtcgctctcactccccccatctgacccgacagtcgagatggaagttccttttggtgacattcctcttttcctggagcctaatgaacaagtcaggaattatgccattcgtgcaagtcgtcgcgcagctggtgccaaggtgtcatggactaccaacattctgcccctgtctgaagtgtcagacgatatcatgaatgataagtttttcgttgagaccattttccgcaaccacaatggagggacaagaagattctcttttattctcaatggaggttctaccattgaccatgtggattcgtctgtcaaatctaatattcgtcccttgttgaacaagcaattggtcaaaactctgcctgcaacgactactgaactctatttttgtctatctgaattttgtcatgtatgactttggtatgatttttggttggttatgcactgatcattggttgcttgcttgttgaacaagcaattggtcaaaactctgcctgcaaaagtttgtcatcgtaccgctcctctacttttgtttagggttagagaatagctttatgatcgcctaaaacagctcttgccaccggcgtacatccacgtcccaacctgggctcattcacgttgaacttatcaacttggcaagctcgtgtgcagcacggttatcatctctac

SEQ ID NO: 17339 - DNA, 2018 bp, Triticum aestivum
  unsure (1)..(2018): unsure at all n locations
  Clone ID: PAT_TA_17339
cgcgggccctgttcggcacgtgggcctgcccaggcggcccccccgcactctctctgtgtctcctcgttctatcgtggtccccctccaacagtagaagaggtagccgggttgatcattggcttcccgctcgctcgctgccactccgcctcccagccgagttcgcggcccggagctggtcttcgcgcccacccacccttcttctggcctgcccttgcggggccgcgtcaggtcgccaagaagttcctgcgcggtccggtctactatgcctcctcagggatcgttgccctgcctcatcgcctctggggggcgctgcggctcttccctgcatcaccgctgctggtccccagggtccacaagcgcttcacgctgcaacacggatgcacgccgtccatctggcatcccgccggcctacgtcgttgcaactccctctcctgtggactattacctccccttctgttgtacggtccaccacgtgtgtgattcaaatcggtttggccagaaagaagagaggacaaagtgggtggcaagttctcttacacatcattcggtggtgcgggccactttgcactggagaagctatctacatcaactcaaagtgatatcgtgcaacgaccccacgtctgggccgaattggccacccgcccccccccacgggctagtctgccccccaccccgaatgcctcgattccgcttccctctgtgtcccccctgggcgctcccctgtttaaggagccatgtttcctccaatgcttcaagaagtggaggatttctttgcaaagtggggagaggaaggcgtagttgatctaaagcttgagttcgagcagctacgttatgttgatatcaggctgatgtttgcttggaaaagaggtccgggagaatatgtttgatgaagtctacacactttttcgcgagatcgaaaagggtgtgaccttgatcagcttcttgttcccatatctcccaactccagcaaactggcagcgtgatagggcgcgtataaggctaacagagatcctctctaatgttgtcgaatcccgtaagagctccgggcgagtggaggaggacacgctgcagaaactgattgactccaagtacaaagatggtcgccctacaacagtagaagaggtagtcgggttgatcattggcttgctgtttgctggaaaacacaccagctctcatactagtacttggactggagcttgtcttctcagccatccagccttcttaagagctgccattgaggagcaacatcaagtcgccaagaaatacaaggacggactagaatacaatgccttcttagagatggatacgctgcataattgcatcaaggaggcgctgcggaagaaccctgcgacaccacntgctggttcgcaggggtccataagcgcttcacggtgcagacgaaagaaggccaacaatatgacatcccgcaggactacatcgtagcaactcctactatagtaaacaacaatatcccttacatttatacggaccctcaggtgtatgatccaaatcggtttggccccgaaagaagagaggacaaagtgggtggcaagttctcttacacatcatttggtggtggaaggcacgtttgcaccggagaggcttatgcttacatgcaactcaaagtgatatggagccatttgctgaggaactttgatctcgaattggtctctcccttccctaacacagactggagcaagttcttgccagatccacagggaaaattactcgtgagatatacgagaaatggaatttaatttgcagtcgcttaactatatgatctacttctacgtgtattcatgcaatcaatatgtactgtatgcatatgtcttttcatatgtgtaacctacaaaaaagcatgtttgtatttgtgtgatgcatacttgtattgggagacaatcatgttgcgttgagtagcggactaggggttgagtatggtcaatacccacaactatgtccataataaataaataaatatattgtgtttgttgcaaaaaaaaaaaaaaaaaaggccccta

SEQ ID NO: 17340 - DNA, 821 bp, Triticum aestivum
  unsure (1)..(821): unsure at all n locations
  Clone ID: PAT_TA_17340
gcgccgtcgacggcctggccggccgnagcctctgcaaggcggacatcaagccctggctcttctccaagaagaagggctccaagagcctcgacgccgacggcgccaaggtcgacatcttctgggacctctccgccgccaggttcggcgcgggtcccgagccgctcgagggcttctacgtcgcgctgctcttcgacctcgagctggccctcctgctcggggacatgaagaaggacgcctaccgcaagaccggcgccaaccgcccggcgctcaacgccgccttcgtcgccaggaaggagcacatctacggcaagaagatttactccgccaaggcccagttctgcgacaatggccagttccacgaccttgtcatagagtgcgacaccgtcggcctcaaggacccgtgcctcgagatacgcatcgacaagaagccggtgatgcaggtgaagaggctggcatggaagttcaggggaaaccagacgatcctcgtcgacggcctgccggtggaggtgttctgggacgtccacagctggctcttcgggccgacgacggcgagcaacgccgtgttcatgttccagacatgccaggcgcccgagaagtcgatgccgtggtcgtactcgcagatttttagggagtcccagctgcagggcctcggcttctcgctcatcctacatgcatggaagattgagtaggtgcttgcagaccataagttgcttctgcggccgcctccttcccagtgctaacaagatgttccattcagtgtctgtctcttcttccgagtgctatgggaagctccaatatatgttctttcaatttattctatt

SEQ ID NO: 17341 - DNA, 567 bp, Triticum aestivum
  Clone ID: PAT_TA_17341
gtcgggtcggaaaagagtatgcgggatgcaacctccctttccaaaggattatattcatttgcttaaggccacttctaggggccgttcgtactatggcggcccggatttgtgttgccagaggtgcggggctttattttggtttcgtgaaggatctatacaccatgctgaagcaacttctcactctcctatttacatgggatgttgttgggcgggcatgatttcgctgccgaagtttggtgactagcctactcctttggacaggctgatgcgctttgatggggatgcggtttcttcccagttcatgtgattaatacgagagtacaattctatgttctgttttacatctttggggtgcacaggttgatcgtagtatcaatgttggaggtgctccatatgttttcaagattaatggggtggtctaccatcgtattggttcgttgtttccggtggagggtgcaatccccaagtttgtgcaactgtacatggtggattctgccgatgaggtggactgtaggctgaatgtgtttgacggagaagaaactgccctcgtgccgaattcggcacgag

SEQ ID NO: 17342 - DNA, 543 bp, Triticum aestivum
  unsure (1)..(543): unsure at all n locations
  Clone ID: PAT_TA_17342
cggcnggtgtcttttgttgttactttccatgttttccatatatctattgcagtccatattgtggtgccaaacatgngtggcgggcgggagtgccnggggtggcgggagacctggcatctacctaggtntggtatgaaatcctgagctggctaagggntccctacancccgcttgatggcgagccatcaaccagcacctggtggntctccgtgcgggcacacgcccaagcctatgcgcaagggcctcgcctcggcgacactactcattccttggatgctttggaagcatcggaacgactgcgtctttgacagagctagcccttctatacctacgctcctggataaagatcaagggggaggcgaccctttgggccagagccggcgcgtcgggctgcgtgctctcattccccagacctgggatgtacgcctgctcctgcaccccctctccgcccaaccgcccccgcgccggagggtactgaaaccccttccttttcaatgcaatgaaacgcaaatcttctgcgttttctcgaagaaaaaaaaaaaa

SEQ ID NO: 17343 - DNA, 623 bp, Triticum aestivum
  Clone ID: PAT_TA_17343
cccgcaccattagctgaataatacacatcccagcagtcagtaaccttcgctagctctctcagcactccccaaacaacctcgcgaagtcaggatgaggccgttctacacgatgctactagccctcgcccttgtggtgctatgttcagatgtggcgacgaaggtggtgacggcgaacggcgatggcgccactgcgacggtgaccccatggactgcaaggtgctcccgaccatccccggcatatgcactcccaagaagtgcatggaggactgccagggcggcatcggccgttcctcggtgggcgagtgcgtctccgacggatgccagtgcacgtactgcactatcccgcctaggggtcgtcggaactgaacggagaacaggctgacgctgctgcatccttctttttcctgatgaataatgatatgttgacgacgatgttttggtcgagataggatattgacctccttcactgttactctcaaataatactcctgttttgtacatgcgttaaaactagagtttgttcaacagaaatcctatttttatctcaaaaaaaaaacggcagttgttccaacagcacatttttcaatttcagtatcaataccatgtggtgatttataatcttc

SEQ ID NO: 17344 - DNA, 1028 bp, Triticum aestivum
  Clone ID: PAT_TA_17344
gttccccattcctcaagacttggtgcttctactactagcaagtaggtagccatggctagggtccgaaaccctctcgtcgtcggaaaggtcatcggggaggtcattgacaacttcaaccccacggtgaatatgacggtgacctacaactccgacaagcaggtgtccaatggccaggagttcttgccgtcggcggtcgtgtccaagccacgcattcaggtcccgggcggcgacatgagatcttttttcactctggtcatgacggacccggatgtgccagggcctagcgatccatacctgagggagcatctccactggatcgtcactgatattcctggcaccactgatgcttcttttgggagcgaggtggtgagctacgacagcccaatgcccaacatcggcattcacaggttcatcttcgtgctgttcaaacagaagaagcggcaggctgtgaaccctcgagctccctccaccagggactggtgcaacactcgccgcttcgccgacgagaacgacctcggcctcccggtcgccgccgtctacttcaacgcgcagcgggagacagccgcgcgccgccgctgatgtgaaaaatgcaacaagcctctggatcaagctatggcttagctactggtattagctatatatatatggctccgttcaaataagagtttgctcgtggtcttgtgtccactgtttctggtagtcttcctactgtccactgttactcctactagtcaacctgtgagcttgtgtacgccacaagagtgaatttagttcaactcctattttgtacgtacgtgttcactgggactctgggagcagaatgatagctaggagaagaccgtcgacgtgtctggtagtagtaggctagtgaaaggtggaaaaggcaatggctttgtggcccacctacctgcgctactgttgttgccctcagggcctataatctttcttacccgttttggaagctcgtactattttcattccctgtaaagacctcatcttttaaggccgggcaagcggtccccgctctt

SEQ ID NO: 17345 - DNA, 1041 bp, Triticum aestivum
  Clone ID: PAT_TA_17345
ggttatactacctcattcctctcgtgcttctactagctacctgcaagctgtagatatctgtcatctatcatcaccaacttttcagttcaagctaggtagctagccatggctagggtgctggagcctctcgtcgttggaaaggtcatcggggaggtcatcgacaacttcaaccccacagtgaagatgacggtgacctacagctccaacaagcaggtgttcaacggccacgagttcttcccgtcggcagtcgtgtccaagccacgcattgaggtccagggcggcgacatgagatccttcttcactctggtcatgacggacccagatgtgccagggcctagtgatccataccttagggagcatctccactggatcgtcagtgatattcctggcaccacagatgcttcttttggaagggaggtggtgagctacgagagccccaagcccaacattggcattcacaggttcaccttcgtgctgttccaacagaagaagcggcaggccatgaaccctccctccaccagggactacttcaacacgcgccgcttcgccaacgagaacgaccttggcctcccggtggctgccgtctacttcaacgcgcagcgggagacagcggcacgccgccgctgacggaaacaatcagcccaacccttcttctcttgcatgcatggcgcatgcaacaagcctatggatcaacctatagctactattagctaccatctacatatatctccactcaaataagagtttgcttgtgagcgtcttgtgtgtgctgtttccagtagtctttctactgttcagttttttcttcggtcaatttagttactagttgatctgtgaaccagtgtacgtgcaatctacaactaccactagtgtgaattgaattcagctcctatttgtggccaccctacctgcgctactgttgttgccctcaggccctataatctttctcacccgtttggaacctcgtactattttcattcctgtaaggacctcatctttaaggccgggcaagcgtccccgctctaaaatatatatatatat

SEQ ID NO: 17346 - DNA, 779 bp, Triticum aestivum
  unsure (1)..(779): unsure at all n locations
  Clone ID: PAT_TA_17346
gaattcactantgattaacgtggtcncggncgangtggccattcctcnacggncaacggtgcatcnggagaatgttgcgcaccaacgcgcacaaagcagcatctatgatgaccggcaccaccacaatgtggagcccagccctctgctccggtcactgcggcatgcgcaccaccaccatcctggtgccaccgaattcgactttgtctaccctccttcgccaatggggcgtggcctgatccactcgacggccggaggggtgcttggagggatggcagaggcagtgcttccgtgggcgttccgcggccaggtgccgccgagcatgtactacacaagcccctacgctgtcgcggaccacacgttgggtccccggctgaggaggcagcagatggaggtggagaggtccctgcaccagatctggttcttccttttcgtgtttgttgtcttgtgtctgctcttgttctgaagcagggcgagaaactcttgttctgaactgaagaggcggtatacggcttgtgtatatattggaaggcgtgatatactgcctctcgaggaaaaagaaggcaagatactaatgaatgggtgtcacttatatagtgatggagagagggtaaggaagacttgggaggtgaaatgctcttgtctctgctgcgtctgtaccaggaaatccattacctgaaccatacatatggcctgttnggttgcctgcatctgtcactaccatgtaatgcnaatttnccccncaaccggnatttcctttccagaatcnaaaaagggggggn

SEQ ID NO: 17347 - DNA, 502 bp, Triticum aestivum
  Clone ID: PAT_TA_17347
acctcccgactcgaggctctgccgcgtcacgtaatcttctctcgagtgatctaatcatgcgacgtgtcctttcctcctggtgtgcagcagcacggcccacatcctcgggtctgtccaaaccacgtgtcacgcagatctgcttcatcagcgggaatgccctccttccccggtctctccaaaccgcctaggacctccacgagattatcaatgaatctacctgcctcctcatcgtagctttcttcttctatgtcgagatcgagatacacagcattgggacgggtgccggaagcctgcctcagcgcttgcttcgcttcctttacttccctgtagctgctgttagtgcagtcaaggcaacacccgacaaacttcagcaaaggacagctatttctcctccacggcaccaagctggcagcgtcctttctttcagcgcttgcactgtatctcagccattcaagcatcggcaatgctccttctccaacagcgatctctatcttcttcgtgt

SEQ ID NO: 17348 - DNA, 612 bp, Triticum aestivum
  Clone ID: PAT_TA_17348
tttgatttgatctgagaatggaatcactagcgatatgtattttcgatttaggtcttcagaaagagtatgggatgtctgagcaagctttttatccatgcattttttcctattgcaatatttagttgatttcgcaatagaagatttggacatattccttgtagatctaggcctgtaatccacgtgtttgtcactctgcaacattcagatcaagaagtatttatatcatctttttcccaaattacacacaattttcaagttctttcattttctttaaggagctccttcagtttgtatgcttgaatatctgaggtagttctgcattctgacatgttctcctgcatctctctttatgttctacagataattgatgaaaaaactttgataaagaaataccggcgtcgtctcattgtcttcatcgacatgagcatctctgtcagaccacgcgtccatgccttctcatctaccttgctggagtggccgcctcctcgctgatgtattgcgctgcatcgaccttcctctgctgccgctgcccgggtccctccgctcgctcctgccgagaacttgcaggctgaggtgagcaccatgaggatgaggaggtcagtggctgatata

SEQ ID NO: 17349 - DNA, 1189 bp, Triticum aestivum
  Clone ID: PAT_TA_17349
gtgggacacggcggcacgacggcacgaggaggcggggatgataaaaaatgcagtgtcctcgctgatggtgcgcctcctccacctgccccgcgccgcccccaccctcacctaccgccccctcctcccgctccctcccccgcgcctgcgagtggccgcgtcggcctcggcacccctcgccgccatgtcgacggcggcgcagcaggcggtcgctgaccagaagcgcgcggtgcggtccgacgtgcgcagggcgctcaaggccctctccctcgatcagcgcaccagcgaagatctggctattcaaaacaatattttgaactcttcttggttcaaagcaagcaaacggttgtgtgcctatataagctgtgcgcaattgcgagaagttgatacatcaaaaataatagcagaagttctatccttaggatcctgaacatgatggacaaagcaaatgggatagtctaatgttcctcggatgtggaaagataacgaccgcaagatgcgcatcgccatatgcgcgtccacggatgctctaccttggatgttttaggtacattcttcgagccgcctccttgggaccgccacctggggatgctcgggggagtgctggtggtgctgcgtcgtccccctcttccccctttgtgctgttgcctggtacaagcttttgacagaactggtccgggccgctgactaggtggtggaggatactatgacacttccttgtatgagatacccaagaacttgcttaagagaaaggggtggagtcagcctcttctagttgcactttcgtactccgtgccaatttcggggggaggcctcctccccggttaccccaccggtggtccctttggtgccccgggcccctccccctggaataattccaatcatgtcctgcagcactggagggtgtgtaaatgaagctgattggtttccgctatggccgtgtagttcctggcagtggcacactctttcctgaactccgatagccatgggctgggtatggtgtgttttgctcgtggttttgtgtttctttttcggaccgactgtaattctggttggacagtagcatatgtactcaaaacatgagcaaagtttagctgccattgtaatgacgcctttgtttggtcaaacaattgacaaactcagtataatattctgaaattgtgtgattgcttcaaacatgctctgttaaaaa

SEQ ID NO: 17350 - DNA, 466 bp, Triticum aestivum
  Clone ID: PAT_TA_17350
accaccttcgttaccaagcatcatgtgttttgacatgtaaaccacagcaacaacaaagacattcaatgcattgagaccagcgccagccaacaatgtgatagctttagaaacctcaatgaatgactttttacactcagataacgcatcgaaaggcgactccatattaagctccttcaatttctcgatggcttcaatgagcctcagagtgactattgggtccatctctatctggtttgatttcttgataacttctgggttcaatttctcgatggcttcaatgagccttagagtgtctgctgggtccatctttaaatttagagaggtcacaagtcttttacttcagaaagaatcttccttccttccacagctcgcccaccctctccgtctctgcgcctttggagggaaagaagtgaaaagggaaggcggggcgaaggacgcgagacggcggcgggtgggaattgataat

SEQ ID NO: 17351 - DNA, 758 bp, Triticum aestivum
  Clone ID: PAT_TA_17351
aaatcccaacaccttccggcggcgaagcaacccacccacccttctctccctcccgaagcagcgatggcccccaaggcggagaagaagccggcggcgaagaagcccgcggaggaggagcccgcggcggagaaggccgagaaggccccggcggcgaagaagcccaaggccgagaagcggctgccagccggcaagaccgcctccaaggagggcggcgagaagaagggcaagaagaagagcaagaagagcgtcgagacctacaaaatctacatcttcaaggtgctgaagcaggtgcaccccgacatcggcatctcctccaaggccatgtccatcatgaactccttcatcaacgacatcttcgagaagctcgccggggaggcctccaagctcgcccgctacaacaagaagcccaccatcacctcccgggagatccagacctccgtccgcctcgtcctccccggggagctcgccaagcacgccgtctctgagggcaccaaggccgtcaccaagttcacctcctcttagattgcgtcgcctgtatctagtagcaaatgcagttccttcctgttggtttagtgcttgtctgtggactctggttatctgcaagtaatattagtcctactgttggatgaaaattgccgaatcattgccaatgcttttttggctcgtcggaaacaatgttgcgttgttggttctatttatactgatttccgcggtgatttacttaaaaactaaaaaaaaaaaaaaaaaaagcggccgct

SEQ ID NO: 17352 - DNA, 637 bp, Triticum aestivum
  unsure (1)..(637): unsure at all n locations
  Clone ID: PAT_TA_17352
ggccgcgcacgcatcgttgttggtcgacttccctcccgcagctccgcctccgcctccgtgcccggccaccgcgaccccacaggtagcgtgggccgcgccggcgtcgtcgttgttggtcgccttccctcccgcagctccgcccccgcctccgagtccggcgaccgcgagcaacccagccggagacagctgcgggcgagcgaaccgcgatggggctgtgctcgtgctgctgccggtgcctggagatcatgtgcgccatcctcctcccgcccctcggcgtctgcctccgccacggctgctgctccatggagttctggatcagcgtgctgctcaccatcctcggctacctccccggcgtcctctacgccgcctacgtcatctgctccgtcgaccccgaccgcgtccgccgccgacgacgacgactacatctacgtcgcctgagcagcactcctctcctcccccgccgtgtggtctttctgtgggattaggttagtggaatgaaccagccctgttcctgcccccctgtatatgtacatttcgggggacaggttatatacctgaaattggatccagatttgctggtaccgtgtattgcaattactgcagtactactgcttacttgcctggttcggnnnnnnnn

SEQ ID NO: 17353 - DNA, 442 bp, Triticum aestivum
  unsure (1)..(442): unsure at all n locations
  Clone ID: PAT_TA_17353
aacagggggnggtggatgcggaggcggcgacggtgatggctcagcatctgcttgctgctgctgacaggtatggactggacaggctcaagctcatctgcgcccgcgagctctctggtggcatcaacatcgacacggcagcgacagcttttggctttagccgagcagcacaactgcccggagctaaaggcgacgtgtgctgatttcattatcagaacctctgccactcttgatgcncgtgttggcgacggaggggtttaagcacctcgaggaaagctgcccactggtggtgattgaccttctcaagtccgcgcgaggaagaaaaacttgaagcatatcttggagtcgtggggccaagatttgatagtccatggtattgtatctgtttgaagtctagtatactgccatatgccgtctttcaataaaatttaaaaccttcctatgt

SEQ ID NO: 17354 - DNA, 319 bp, Triticum aestivum
  unsure (1)..(319): unsure at all n locations
  Clone ID: PAT_TA_17354
actcgtatgtagtgcttggattgactagtttaggcagcgacgtttgctgaaggagatgctggattacataataannagttatttgttaattcattcaatgcatgcagagtaactatgcaatagaattcaggaaggcctttctatatttgatggcaatagaagggtaggttctccaaggaatgacaaaactgagtcgcatttactcaaatcatgctgaatggccaacctttgatcaccataaggtgaaaaataagtgagataacatcaaaattgggcatcgataaatgcttaccggtgttatcttgtccaactgtttctt

SEQ ID NO: 17355 - DNA, 360 bp, Triticum aestivum
  unsure (1)..(360): unsure at all n locations
  Clone ID: PAT_TA_17355
accactctttacaaaagatggcatctagctccactctttacaaaagatggcatctagctccactctttacaaaagatggcatctagctcagtaactaggactcacaaaatgtcatctatacctaggattgccaattagtagcctggaataatacagcatgcatcatataagtcactgatccaagacatcacaaccgtaccgaagtgcatggccaaaaggataattgtccatttgcttccaattaatcaacaaaaaaagttcagaccacttccttcaccatgatgagagatataaaanatgtaggtaaatcatcactaggtggggagaaagttccagtagcaacaccattcgcatcattac

SEQ ID NO: 17356 - DNA, 414 bp, Triticum aestivum
  unsure (1)..(414): unsure at all n locations
  Clone ID: PAT_TA_17356
tagattttttgaccaaatgtatggtgggtattcatttgattgtagtgtgaacgaaactcttcagtcttaagttttcatgcatatacttgttgctgtgtgccaactgatgcggagacagttctgtccactttttagaaaatatactcgtatagagcatcaaaacttcgattctagccccgctttacctctacgtgaattgataagacgcgtatcctgtcaatctaatcacacttggactgaagccatttcctcttgcagacagagttatcatgtcaaggttgttactttcgtgcgtgatttaattattagtaacctctgtcgaggcttgaacttcccctgttacttatcagtttagcacttgtttctgcagtcacaccattgtccacgtagccagccggacatctcgtaggagtn

SEQ ID NO: 17357 - DNA, 874 bp, Triticum aestivum
  Clone ID: PAT_TA_17357
ccacgcgtccgccggttgtttcggcggcggcgatggcggcggaggacgtggagttcgtggactacgagcgggacgacggcgacgaggaggacggcgggatggaggacggggaggtctcggcccgcgcgctccccgtgccccacatcgccgcccccgccgtgccgcgcaccagcaggggccgcttcgtcggccgcagccgctccgtcatcgcctccacccgcgaccgcttcgactccctccccttcgccggcacctccgcgcacggcggcccgcagcgctcaattgaaggatggataataattgtctcaggagtcaaagaagatgcagaagaaagtgatctgtatgatgcttttgctgagtttggtgaggtcaaggacttgcatctcaacctggagcgccgcactggatatggcaagggatatgcattggttgaatatggaatttttgaggaagcacaaactgcaatcagaagaatgaatgggacagagctgctaacaaagactatccatgttgattgggcattcaacagaggtcctatacagaacgtcatgagtgcagggccagcacagcgacgatcgaggactccgcctcgaaggcttgctgccatgacatactgagagggagctgctaggcctgcaaccttgggccagcattggtcagtgtttttttggtagtcgccagggatttgctatgtcgtagtagatgttagtcttattaaccgtcgtcctccggcagtaagcggtaaccggaccatgaaccgggtatgtattgtccagaaaccgagtcctgattctgctagcctgtactgagcttgttcagcggcttggctcacgaactttggtatattgaatgcatgatgcaaattggatggatc

SEQ ID NO: 17358 - DNA, 865 bp, Triticum aestivum
  Clone ID: PAT_TA_17358
gccggccgggcctggaaagcgctactgttggcggacggcatctcgagacccggcacgacacgacatcttcacgaagtaacgccacactaacccttcagacacaatggccaagatctcgcgtggtgcccctggtggcaagctcaagatgaccctgggtctccctgtcggtgccgtcatgaactgcgctgacaactccggtgcccgaaacctctacatcatcgccgtcaagggtattggtgctcgcctgaaccgattgcccgctggtggtgtcggtgacatggtcatggccaccgtcaagaagggaaagcccgaactccgaaagaaggtccaccccgccgttatcgtccgacagtccaagccctggaagcgattcgacggtgtcttcctgtacttcgaggacaacgctggtgtcatcgtcaaccccaagggtgagatgaagggctccgccattaccggccccgtcggtaaggaggctgctgagttgtggccccgtattgccagcaactctggtgtcgtcatgtaaggtgcttgcttgcgaaaggaaatcaaggaaagacaaaagggcgtgcggtgcgtggtggttgggtttctgtcccgaatgcgatcagatagagcgcggtaaagaaacattatccccccttccccaagactcttattcttttttcatctgcccgggtcaaggggagggtgaaacggggaatgttctttttatctactacttttaaagtcgctggattggcacaaggctcttgcatttcggttgcggcgtgtaaggatgattcacataccaggcattcacatcaaggacaaaacaaaagtcactttcaaacgatactccctgcgaaaaaaaaaaaaaaaaggcccc

SEQ ID NO: 17359 - DNA, 246 bp, Triticum aestivum
  Clone ID: PAT_TA_17359
gaacaaataaaaaaggatggaatcacaaaacttgttgtactacctctttacccccagttctccatatcgaccagtggttcaagtctccgtcttctggagagcatattcagagaggatgagtatctggtcaatatgcaacatacggttattccttcttggtatcagcgtgaaggatatattaaggccatggcaactttgatcgagaaggagttgttgaaatatcataaccttcgttctagatcgcga

SEQ ID NO: 17360 - DNA, 1133 bp, Triticum aestivum
  Clone ID: PAT_TA_17360
caaacttgttgtactacctctttacccccagttctccatatcgaccagtggttcaagtctccgtcttctggagagcatattcagagaggatgagtatctggtcaatatgcaacatacggttattccttcttggtatcagcgtgaaggatatattaaggccatgacaactttgatcgagaaggagttgttgaaatttccaaaaccgcagaaggttatgatatttttcagtgctcatggagttcctctggcatacgttgaagaagctggtgatccgtataaagcagagatggaagagtgcgtggatcttatcatggaggagctcgaaaaaagaggaatggcaaatccatgtacacttgcttatcagagccgagtaggaccagtggaatggctgaaaccctacactgacgagacaattattgctcttgggcagaggggggtaaagagtcttctagcagttcccattagttttgtcagcgaacacattgagacgttagaagaaattgacgtcgaatacaaggagctggctttgcaatctggtatcaagcactggggacgagttcccgctttaggttgtgagcccacattcatttcagatctggcggatgctgttatcgaaagcctgccttatgttggcgcaatggcagtttccaaccttgaggctcgacagtcactggtgccacttggaagcgtggaggagctgctagcagcctacgactcgaaacgcgacatgctgcctcctccggtgattgtgtgggagtggggctggacgaagagcgccgagacatggaatggacgtgctgctatgctggccgtgttggctctcctggtgctggaggtaacaaccggacaggggctcttgcaccagtggggtattttgccacctttcccttaacaagcggggatggatggatggatggatttcaggtctccccttgaggggatctgatcgtaattttggttcatttggggaatgtcctgatgctatatatgatggatcgatttgccttacgccaagaaaggaaaatatggactcaattcgccggtgtaaatatgctagactgaagagagctttacattattattaaccaataagagctgtcgaatcgttggctacaagatcacaaacacaaaaa

SEQ ID NO: 17361 - DNA, 673 bp, Triticum aestivum
  unsure (1)..(673): unsure at all n locations
  Clone ID: PAT_TA_17361
cgtatttnntttgggattgtatcttgttctctagaatcccaaagttttggtaaacttggaagcgccactaaatcttaggagtgacaatgacacaaaaatcacaagaccattctgtcaaaactgatgcaagtaagtaattgtctgaagctacacagcacaggtcaggtgcaatgccagtttgttgctcctccacaagttgaacaacacagcctacacgtatgtattctcagaagaagacggcttttgcggataacagctggctagtttacaaacaaagcgcaaatgagatgcacatttcaatccggtcatggattcatcttgtggaatgctacgggaagacgatgcatcacgacaacgcggctatgatttccttggtccgcccttgcgccttctccttctcttccggcccatccaggtccccgatgttgtcgtggtactcctgaagcctgcccgggcggccgctcgatgtcaagcttgttctgtctcaggagcaactctattcttgtcctcatctgtgagttcccggagtgccagatatgcccaagaataagcgccactaagctgaagcgtgtaaagcccaacttcaagtttccggttgtaccgctcatcatcgtccatctctaaatcaactaaatcgaggctttcaaacctttcggtnctcagctttcactcc

SEQ ID NO: 17362 - DNA, 451 bp, Triticum aestivum
  Clone ID: PAT_TA_17362
ttcgagcggccgcccgggcaggtacagaacagtcatggtattcttgcgcagaataatgtggatccagtatttgatgatcccaatttgaactggaaagaggttttccacaaaaagcatgcagagcacataagctggagtgccgcatcaaatagagcaatatgcaggcaatgccgttcagttctctggctgagcaacttgacgtgtgctgcgcctcaccattgtcctaagaaaggaaaagatgaaataaaactaatgcccctgctaccttatgcagttgcttgttacatattaaatgctcaagatcgaccatcttcatcgtctgacagtagcgattcagatagtgattctgaaaacaatgtgcccagacgactttggaattctcgtgtttgagtgaattcgattgtatagctgtgtaagctagttttgttgtacctcggccgcgaccacgcta

SEQ ID NO: 17363 - DNA, 507 bp, Triticum aestivum
  unsure (1)..(507): unsure at all n locations
  Clone ID: PAT_TA_17363
tttttttaccttcaaattttccaatcacgacatgatgtgagctcttgccaaaagtaaacaaaaggctgagattctgtaagctggtcgttggacacaacttggtacacagggttacggctacgacaaatttttataaccaagtttttcttaggaaccaggaggggtgcaattaagcgtttaccctatataaataagcactgttatttaagaaaaaactgatttatttttctaagcatcttgcattgtagaaggccttaaagttccatcttcattcccgcccttgggaccccgcttgttttggcccccaccccagtagtctctttggtttatcataggcccttcgntccctgagaaatacaaacataacttatttaggcagcatcatattcccaatgaacactataactacttaggaaacaaaagtacctcaaaaaatcaaattgcancncccngtgcctcaagtanaagggtcaaccttttccngggaatttgcacatttaaatttgt

SEQ ID NO: 17364 - DNA, 1124 bp, Triticum aestivum
  Clone ID: PAT_TA_17364
atgatcagaagaagaaacccgaagaatggttggtttgagcaagcggtagaaacaagcgtgtcttgtcgttgctataaaggcacacggctgagacgcagaattgttcagtgaagtgcaggggctacactacagagcatcgaccaaagcagagcaaatggaggcgatcgccggcgacgtccacgcccacggctacggctgggccggggtgtggtcggcggtggccagccttatcttcctctggtccatggtgcagcagtacctccccgcccagctcgaggagtacctcaccgccctcacccgccgtctccaagcggccatcaccccctacgtcaccatctccatcgacgagcacgtccccgactccttcggccgcagcgaggcatacctcgccgccgaggcctacctcagcgccacctgcgcctcgggcgcccgccgcctccgcgccgacctcgccgccgacagcgaccgcatgagcgtcgccgtcgacgaccacgaggaggtcgccgacgacttccgcggcgccaagctctggtggcgcaagaccaagacgctcccccgcggcaacgtcatcagctggtccgcgcacgaggaggagcgccgcacctactgcctcaccttccaccagcgccaccgcggcctcgtcgacgcgctctacctcccgcacgtcctcgccgagggccgcgccgccaccgtcaggaaccgccagcgccgcctcttcaccaacaaccccagcagcgactggtccggctacgacgcgcgcgtctggagccacgtcaagctcgagcacccctccaccttcgccacgctcggcatgcacccggacaagaagcgggacatcatcgacgacctcgacatgttccgcgacggcaaggactactacgcctccgtcggcaaggcgtggaagcgcggctacctgctcttcgggccccccggcaccggcaagtccaccatgatcgccgccatggcaaagtacctggactacgacgtgtacgacctggagctgacgtcggtgaagaacaacaccgagctgcggaggctcttcatagagaccaagggcaagtccatcatcgtcgttgaggacatcgactgctccctcgacctcaccggcaagcgcaaaaaaaaaa

SEQ ID NO: 17365 - DNA, 370 bp, Triticum aestivum
  unsure (1)..(370): unsure at all n locations
  Clone ID: PAT_TA_17365
cccccccntttttttttttttttttatgccacgaatagaacttattaatttattttagtcggagtacatgccgagcgttcatgcatgcggtggctggagggataagccgcagttcttgtagcagatgcattcccaggtgttatggcaatggccgttgtcgtagccctcgtcccggcagggcccgttgcaggtgcctgctatgatgcaagtgtcgttggtccacctcccgctcttccgcttttcgcagccatgcgcccccatttttccagatgacagcacgagcagcatcaacatcgccaggcatatgaaagccttgccggttcccagtggtccttcagcaaccgtcttcatgtatgatgccatatcgaag

SEQ ID NO: 17366 - DNA, 172 bp, Triticum aestivum
  Clone ID: PAT_TA_17366
acatcatagggtgcatggccgccgaagccgcaccatggaccgaccttgaccgggccatcattcttcccccgcacggatacgtagaagccgatggcgggtgagactgcccccggaggcgccaaagaagcccaccacggcgccgttgccagcacccccatcttccttgctgtag

SEQ ID NO: 17367 - DNA, 658 bp, Triticum aestivum
  unsure (1)..(658): unsure at all n locations
  Clone ID: PAT_TA_17367
acctgcaaaatntttggcatgtttagcactttagttatgcttcttgagtagcattggaatgttctcagactactttcttctatgacagacttggcaagaaaggcggcagctgacgaaaggaggacaccaccaagatgagcgagaccgtgccaacggactcaggatgaaaagcaacgaccaacggcgcatcatccacagaagcggccagcatggggctaagcctgccattcctccgcgtcaatgaacaacaggacctaagatagctgaggtgcgctcctgcaagagatgagggagcagctggtggtccggatggcgaagatcaggtcaacgtcggctgctttcctgtgccattgccacatttcagctgaacatgctcggacgggcatggcgccggcgccatttcttcatcttctctggagccacaccatttctgcaggataagcgagttggaggaagatgggagatgagtcgcttactcactgacagaaaatcatttgggcagaacctccttttcacgagagatgattgattgtttttccaccttcgcttttgtgccccatgtgtngcttgtgaaccactgttgtttatgtcgtcggtcatgtaaactataaggacatnttaatatatttgctctcccacgccttttaaaaaaaaaaaa

SEQ ID NO: 17368 - DNA, 1223 bp, Triticum aestivum
  Clone ID: PAT_TA_17368
atcggccggctatacaccgtgaactgcgccactagactaggaagaaaatggggtggaagggcatcctggggttcgactacggcgtcgtgcaggcaccgctcggccccgacatctccggaccggagctcgccgccgccgtcgccaacgctggcgccataggcctcctccgccttcctgactggccggcgccggaccacgtgagggagctgatacggaggaccaggagcctgaccgagaggccgttcggggcggccatagtgctggccttcccgcacgaggagaatctgagggtcgtgctggaggagaagctcgccgtgctgcaagtgtactggggcgagttccccaaggagcgggtcgacgaggcccaccgtgccggcgtcaaggtcttgcatcaggttggtaaccttgaggaggcagcaaaagctaaggaagctggtgtagatggaatcatcgttcaaggccgtgaagcaggggggcatgtgattggtcaagagggtctgctaccgttgctgccgagagtagtggatctagtttcagatagtactgtttcggttatcgccgctggtggaatcgtagatggccgtggctatgctgctgcattggcacttggtgctcatggtgtttgcttaggaactaggtttgtagccaccgaggaaagctttgcgcatccgctgtataagaaaaagctaattgagatgaattgcacggactatacaactgtgttcgggcgtgctagatggcctggtgctccacaacgtgtcctgaagacacctttctatgtcgagtggaagaatcttccagatcacgaaacagaggaaaatcaacctattataggtcattctatcatccatggtgtgcacaaggatatccatcggtttgctggtactgttcctaatgcgacaacaacaggcgatatcgatagcatggccatgtatgctggccagggtgttgggctaatcacggggattgtaccagcaagggaagttgttgagaggctagttgccgaagcacagcgcgtcattgggacaaagctttctggtttccccaaatcatcagagtagtgctggtgaagtccttggtaattaactgttaaggtatctagtggtgtacgctgtgtgttatttgtaggcaatagccaatgaaaataaatgggttttccaaggtattccctttttaccacagttttgtacttgtatgtgttattttgtaagtatatattcaat

SEQ ID NO: 17369 - DNA, 1574 bp, Triticum aestivum
  unsure (1)..(1574): unsure at all n locations
  Clone ID: PAT_TA_17369
cccacgcgtccgcgcccgccactgtcaggatcggccggccatacaccgtgaactgcgccactagactaggaagaaaatggggtggaagggcgtcctggggttcgactacggcgtcgtgcaggcaccgctcggccccgacatctccgggccggagctcgccgccgccgtcgccaacgctggcgccataggcctcctccgccttcctgattggcccggcgccggaccacgtgagggagctgatacggaggaccagggagcctgacccgagaggcccttcggggcggccatcgtgctggccttcccgcacgaggagaatctgagggtcgtgctggaggagaagctcgccgtgctgcaagtgtactggggcgagttccccaaggagcgggtcgacgaggcccaccgtgccggcgtcaaggtcttgcatcaggttcgggtaaccttgaggaggcagcaaaagctaaggaagctggtgtagatggaatcatcgttcaaggccgtgaagcagaggggcatgtgattggtcaagagggtgtgctaccgttgctgctcgttgaagggcatcaagcgggggggcatgcgatggtcaagagcgtctgctgtcgtttcggccgagagtagtggatctagtttcaggatagtactgtttcggttatcgccgctggtggaatcgtagatggccgtggctatgctgctgcattggcacttggtgctcatggtgttttgcttaggaactaaggtttgtagccaccgaggaatgctttgcgcatccgctgtataagaaaaagctaattgagatgaattgcacggactatacagctgtgttcgggcgtgccagatcacgaaacggaggaaaatctaacctgattataggtctattcttatcagtccgatgggtgtgcacaaggaatatccgatcggtttgctcggtacttgttcctaatgcgacaaccaacaggtcgatatcgcatagcatggccatgtatgctgggccgagggtgttgggctaatcaatcggggaattgtaccagcgaagggaagttgttgagaggctagttgccgaagcacagcgcgtcattgggacaaagctttctggtttccccaaatcatcagagtagtgctggtgaagtccttggtaattaactgttaaggtatctagtggtgtacgctgtgtgttatttgtaggcaatagccaatgaaaataaatgggttttccaaggtattccctttttaccacagttttgtacttgtatgtgttattttgtaagtatatattcaataaaggtaaatgatttcaataagatgagactaaaaaaaagagatgttcgtaggtatatactcaataaaggtaaatgatttccatacgagttgtttgtaagtatatattcaataaaggtaaatgttttcaatacaaataggtgangtcgtnattacaaattcaactgggccgttcngttttaaaaaccgtccntgacctggggaaaaaccctgggcggttaccccaacnttaacccccttgcananaanatcccccctttcnccaanntggggntaaaaccgaaaaaaggccccccacc

SEQ ID NO: 17370 - DNA, 431 bp, Triticum aestivum
  unsure (1)..(431): unsure at all n locations
  Clone ID: PAT_TA_17370
aaccccgccagtaatttttcagntcatatataagctcacttcatcgcgaagtgagaacagattttagttacatcatcagcgttgatgcatgattacattgaaagcattaggaataagaatattgttaaataatattctcatttccaaagagcagtctgaattacggtggagttattccttcttcagttcgacactccttttccctttcctgattgaatctggcacgcgcgaaatcctcacttcagaatcctgagctcttattgtcttccacaactcttcataagacttgggtatagtgtaatactcatgaaacattagcccagttgcccattcacgatgattgcagtaggtgagaagatgatcagcgatggtgaagggccggacggacgggtgaatcttctccttcacgtcgtggacctgacacaacgtcg

SEQ ID NO: 17371 - DNA, 522 bp, Triticum aestivum
  Clone ID: PAT_TA_17371
cggtggggttcatggtcagcggacgaatcgcgcaagcatggccgccaccatgaagctggcactcaccttcgtcctcctcctctccgcgctggtggtgttcggggacgcgctggcggcctccgccatcatccggtgcgtccagggcgggtacatcccctgcgagatcttccccggccagaagcccgacggggccaacgggcgggcgcccgcccccggggggcaagggctgcgtgccccactcccatgccgcatccacccccgccaggagctcgaccggtgcgactgcgcgtgcgctccggacgaccgcaacggctccgggctccgcctcggcgatggcgtgacccagaccaactgccgcacgcccaatatgtagctgaagtgttggttcgagtttgagttcagtaatgctctgcaagcttgttgtcgaataacgaaagtgttcgcgtgtctgtagtttggcagtgtaattcaacttacatgcttcgaataaaatttcctagctaaaaaaaaaaaaaaaaaaaa

SEQ ID NO: 17372 - DNA, 689 bp, Triticum aestivum
  unsure (1)..(689): unsure at all n locations
  Clone ID: PAT_TA_17372
gcaaacacaaatcgcacggcgcaaacgcaacacacaatcatggctgccacattgaagctcacagtcgccttcctcctcctcgtctccggtacgtccccagccgtgtccatatgcttcaaccatgcacgtacacctgtgtgatgcgctctctctgacgctctatgcttgctctgcttgttcttgtcgcggatcgagcagcgctggtggcgttcggcgacgccaagaaggcgccgtgcgccgtggtgtgcgtgcagggagggcacatcacctgcgacaactaccccgggcagaagctcgacgggtgcgactgccagtgcgcgcccaaggacggcaagggctgcgtgctccacctcaacagcggctccaccaaccagtgcaccaccccgccggagtactgagatgaattacacgcggttcggcatgctggctcgagtccgagctctatgaagatgcaagtgtgtgtgtcgtggagcaactatagatacacttcctatcaaaatgtaagaccatttttgacattatgatagtgtcaaaaaagcatcttacattttagtaatacaaagggagtatcatgtaagtttgtgtcgtggaataaataacgaaaggaatgcagtctgtcgatcaagtttcatatcagggccaggcacagcaaaggaaaccggcaaaacaccaaaaaaaaaaaaanaaaa

SEQ ID NO: 17373 - DNA, 551 bp, Triticum aestivum
  Clone ID: PAT_TA_17373
cgcacgacgcacagagacgaacgcgtaagcatggccgccaccatgaagctgtcactcaccttcgtcctcctcctctccgcgctggtggtgttcggggacgcgcaggcgacctgcgacaacatccggtgcatccagggagggtacatcacctgcaagaactaccccggccagaagctcgacgggtgcgcctgcgtgtgcgcgcccgaggacggcaagggctgcgtgctccacctcgacagcggctccaccaacaaatgcaccaagtactgaaccggattacacgcgttcgtcattttcatctctgctctcgagtttgagttcgagctaaataaagctgcacgtgtgtcgtacgtacatggagtaaataacgaatggaatgtaagtttgtgtcgtggaatgaaatggaatgcaatccgttgatcaagttttgtagcagggctaagcaccggggaaaaaagcattataaggaaagaaactgaaaaaacaccgaactagctcagtttttggacccaggtagttggcgaactcgtttgctgtgagggacgactttg

SEQ ID NO: 17374 - DNA, 549 bp, Triticum aestivum
  Clone ID: PAT_TA_17374
gccggccgggcctcggcaaacacaatcgcacggcgcaaacgcaacacacaatcatggctgccacattgaagctcacagtcgccttcctcctcctcgtctccgcgctggtggcgttcggcgacgccaagaaggcgccgtgcgccgtggtgtgcgtgcagggagggcacatcacctgcgacaactaccccgggcagaagctcgacgggtgcgactgccagtgcgcgcccaaggacggcaagggctgcgtgctccacctcaacagcggctccaccaaccagtgcaccaccccgccggagtactgagatgaattacacgcggttcggcatgctggctcgagtccgagctctatgaagatgcaagtgtgtgtgtcgtggagcaactatagatacacttcctatcaaaatgtaagaccatttttgacattatgatagtgtcaaaaaagcatcttacattttagtaatacaaagggagtatcatgtaagtttgtgtcgtggaataaataacgaaaggaatgcagtctgtcaaaaaaaaaaaaaaaaaaggccccta

SEQ ID NO: 17375 - DNA, 634 bp, Triticum aestivum
  unsure (1)..(634): unsure at all n locations
  Clone ID: PAT_TA_17375
cccacgcgtccgcccacgcgtccgcaaagacaacgctacacgaagcgcattatggtttccgccatgaagctgtcggtcaccctcgtcctcctcctctcagggctcgtggtgttcggggagatcgcggacgccaaggccaaggcgccgtgcgccgtggtgtgcttccagggaggccacatcacctgcgacaactaccccggccaggagctcgacgggtgcgactgcgagtgcgcgccggccgacggcaagggctgcgtgctccacctcgacgacggcgtgacccacaccaactgccgcacgaccaaaaagttagctgaattgttggtttgaatttgagttcaataaggctctgcaagcttgttgtcgaacaacgaaaaaaaaaaaaaaaaaaaaaaaaaaaaaaaaaaaaaaaaaaaaaaaaaaaaaaaaaaaaaaaaannnnnnnnnnnannnnannangggccccnnnnaaccaaaacnncccccccacccccaaacctccccccaaaaagggttttttggaacaaaaaagcccccaattatttttttcggggccctaagggtggccccccattccaaatttaacctttaaacccccaaagggcgtaaaaaaagaaaggggcaaaccgggggg

SEQ ID NO: 17376 - DNA, 983 bp, Triticum aestivum
  Clone ID: PAT_TA_17376
cgggatttctcgaatccgtatgctgtgtgtggccattacgactgccgatacatggttgggttcgttcatcattgcgcgatcgacgccttatatgatttccgatcttggttatggagcttacttcttctttggctcgattcttgtcttgatgggtatttggtcactctttttcgtccccgagacaaagggtattactctcgaagacatggacgcgctattcgccaagcccgtgtacaagacagtctgggcccaaatgcgaggcaaaccagtcctggaaggaaacgcggccaatcgatccgactcgccatttgacgaggacgacgaaaaggctcgcgagctgaggataccttagctggctcccgaccagggttcttttgcagctgtgcccttagataacgaaatgcgaaactaaaaaaatatcggctgaaaaaaaaaaaaacagaaaaaaaaaaaacagatcgcaccgcgcaaacgcagcacacgtaagcatggctgccaccatgaagctcacaatcaccttcctcctcctcgtctccgcgctcgtggtgttcggcgacgccaagaaggcgccgtgcgccgtggtgtgcgtccagggagggcacatcacctgcgacaactaccccggccagaagctcgacgggtgcgactgccagtgcgcgcccaaggacggcaagggctgcgtgctccacctcaacagcggctccaccaaccagtgcaccaccacgccggagtactgagatgaactacatgcggttcggcatgatgctggctcgagtccgacctcaatgaagctgcaagtgtgtgtgtgtgtcgtggagttagtaaataccccctccgtatcaaaatataagacatcttacgttttaatacaaagggagtatgatgtaagtttgtgtcgtggaataaataacgaaaggaatgcagtctgttgatcaagtttcaaaaaaaaaaaaaaaaaaaaaaaggcccctaccaaaaccacc

SEQ ID NO: 17377 - DNA, 546 bp, Triticum aestivum
  Clone ID: PAT_TA_17377
gccggccggccaaaaaaaaaactcaaagcacacacaaagacaacgctacacgaagccattatggtttccgccatgaagctgtcggtcaccctcgtcctcctcctctcagggctcgtggtgttcggggagatcgtggacgccaaggccaaggcgccgtgcgccgtggtgtgcttccagggagggcacatcacctgcgacaactaccccggccaggagctcgacgggtgcgactgcgagtgcgcgccggccgacggcaagggctgcgtgctccacctcgacgacggcgtgacccacaccaactgcggcacgaccaaaaagttctagctgaattgttggtttgaatctgagttcaataaggctctgcaagcttggtgtcgaacaacgaaaatgttcgcgtgtctgtggtttggcagtgtaattcaactttacacgcttcgaataaaatttccgagcagaatgtgataaaactcaaaaaaaaaaaaaaaaaaaaaaaaaaaaaaaaaaaaaaaaaaaaaaaaggaaaaaaaaaaaaaaaaagggccccta

SEQ ID NO: 17378 - DNA, 470 bp, Triticum aestivum
  Clone ID: PAT_TA_17378
gcacccgcctgccagccggcgtcgtctggcctccgccccaggggcggaccctcctgttgccgccggtgggtccttcggcctttccgcgccaggtggcctcctcgtgtggcccgccgcggctctccctgcctctgccgagtggtcaggtcgccttgccgctccgcgaggccccctgacggcgggctcctcggctggccacacctggcctgtgccctccggtcgcttctccctccgcgtgcccgctctgcttcgcccatgctccgctaactgcctggcctgtaatcaagggaggcagtccagtcaggagacacaggatgataacacccagagagtagacttcagaagcaagatctgcaactttggtatgttaaccctgtttcttcagcccggcgaccaccaaccagctctgacagccagactgccatacctggagccggagctcctcacgacgggagagctcacaccccttt

SEQ ID NO: 17379 - DNA, 365 bp, Triticum aestivum
  Clone ID: PAT_TA_17379
acatgatacagaagttatttccttttcctcgagttatagtgcttcttgctcatcgatcttcatgtgcaaaaagacaacatgtcaccctgatatctccggaatgatgtctgcagtggctgattgggtgagacgaagcaatgatggttgcgagtagtagcgagctggataaaagataggtttgtccttcaaagttccttgccagttgaatgggctctccctcatcaccttccgagcctccctttcatcatagtcaatggggtccaaatggatcgacgccatttgcttcatcgtgtccatcatcataatgtgtagatcatgccccacgacatggacataccggctgaaactagaagtaacaaggtctg

SEQ ID NO: 17380 - DNA, 637 bp, Triticum aestivum
  Clone ID: PAT_TA_17380
caggacatcacgctccccttcgcctgccgccatgggttgctgcaccagctgtgctgttaggataaaatcaggggcaaataagacagcttgaagctcttggaatatccgccgacttaagagagcagggctatgctttgttatgtgttggctacccatccctctgatcttgaagttgacacgcaagatgaagatgaggtatattggctccagtttggaagatactttgcgcgggggcctgttgatagagatgattacgcgctagagcttgcaatgggagacgagtgaaacgtgactgacagcggtacggtttttaagctgcggtttgtaggttatatagagttgcaaaaaagacttgatttgcaagtggagaaagaaaagaaaagaaaagagaaagacccctctgctcaatgttctctgtgtttttgcaaatttgctgtgcaaatgtatatgcttcttgcagagatgccatcctttttgctcctctgtattcacagtagacaaagaacgctatggactgtatgtatgtaaaaagctgtgaacttgtagtacctacttatttagcacctcaactcgatcttgagtgcaacgaaatgatgcttctggctgtgaaggcgggacgtttcagttgatgttgatt

SEQ ID NO: 17381 - DNA, 913 bp, Triticum aestivum
  Clone ID: PAT_TA_17381
tgccgctcccgcccccgctcctcgccggcccggcgaccacaggcaggcagtccacggccaggatggcggcgtgccccgccgcgaccacggctcgcgtgggagcagcgcacggaggaggcctctggaggagaagcgggaggagcccgagcttccccgcgcgcccggcccgtggcacgagcacggcagcgcgcgcctcggagctgcagcaggcccccgcccccgccgccgccgccgccgtcccgacccacaaggtcaccgtccacgaccgggagcgcggggtcgtccaccacttcctcgtgccccaggaccagtacattctgcacaccgcggaggcgcaggacatcacgctccccttcgcctgccgccatggttgctgcactagctgcgctgttaggataaaatcagggcaaataagacagcctgaagctctcggaatatctgccgacttaagagagcagggctatgctttgttatgtgttggctacccatcctctgatcttgaagttgaaacgcaagatgaagacgaggtatattggctccagtttggaagatactttgcgcgggggcctgttgatagagatgattacgcgctagagcttgcaatgggagacgagtgaaacgtgcctaacagcggtacggtttttaagctgcggtttgtaggttatatagagttgcaaaaaagacttgatttgcaagtggagaaaggctctctgtgtttttgcaaaacttccgccgcaaatatgcttctggcagtgcggccatccttttgcctccgctgtatcccctgtgccccgagtacgctctggactctagcgttgttgtaagccgtgctcgtctcgttcctccttctctagcacctcggctccttcgggagtgcaacgaaatgatgcttctggctgtgaaaaaaaaaaaa

SEQ ID NO: 17382 - DNA, 266 bp, Triticum aestivum
  Clone ID: PAT_TA_17382
accttgctcatcctcgtcctccccattctcttcctcctcttcataatccttctccgcttgcttatcatgctccatttcggaggaggggccgcggatgtggtcatcggcacagcgccgcatagcggaagttttccaggacatggtcggcttggtaggcagaggtcttgagatctgccgtccagcggcggacggtggggttggtgcggctcttggcatcggcagggtcagcgagacgttaaggcggaggagctttttttacccgtaat

SEQ ID NO: 17383 - DNA, 545 bp, Triticum aestivum
  unsure (1)..(545): unsure at all n locations
  Clone ID: PAT_TA_17383
cgccggagccccgacaccggaatgctgcgcttccaccgcaccccttccaccaccaggagcaagacccaaggcaggaggcgtctcaacctctttgctgctcgcagtcacagacatcagcagcaacaacattagctgtttcatgacagagaaatgtttctcctgctgcaagcacaaccacaatgtgtcctgggtgtaaagtccctcttcaatcaagttaaccaaatgctgctcttccatgttgtcgcgacgatgtttcaaggttcactagcctgcctaggtaatttggttgcagttgcatatgagcaagatcacagtgcgtccatagccctccacaatcaattcagaatttgttgtcctccgtttgtgggtttgccgatatttcgctgctggcgacagttatgaggctaccataatggacaacatcgcaacggacggtgcctgggagtggaaagatgcgcaccgnaatgtccccgcgtccgtaacttgtaggtgttaatatcgccccccctttggcctaagtagtttnacaataaacggctggtcaa

SEQ ID NO: 17384 - DNA, 501 bp, Triticum aestivum
  Clone ID: PAT_TA_17384
acagtcacaaaaacagaggacagcgctaaaaggacgccaaaaacgggccaggcaaaatatttgtcccggtaaccctggtcaacaaaccactccagaaaaaatagggacctacccctctctcgatctccagggcaacacagcatgtgcccaacttgcaacccacgaaaagggccaaacctctcccgcaaatcgcaggacagatctcacctgacgagcagcaagaaagaagatcatcagaggggaatcagcatcaccaaccacaggtcagcatctcaactgctcaccagcttctctctgcccctctcgcatgaacaaatcagggaggaaatttcttcattttgcagacattggagggagacttgcatcatgaagtggcagaaagtgaagatggtggaggagaatctaatccatgggacagaaacctgttctacaacttgaatttgtgaggaggaatggctcatcttccctgacgaggagcaaggaggaagaacaacctgcccg

SEQ ID NO: 17385 - DNA, 1068 bp, Triticum aestivum
  unsure (1)..(1068): unsure at all n locations
  Clone ID: PAT_TA_17385
acgcgtccggaagaagattgaacagctgtggaaagactctccactagtttgaaacaatttgccacgcagcgctagtgtgcagcgagccagtgaccgacacggacaataacaagatggtcgccggctgtgtcatcaccgacgagtgcaccctggcggtgtccgcacgcgccggatgtggaaggggcagtcttccctcttcaatagtttgaaacaacttgccagcagcgccagtgtgcagcgatccagtgaccgacacggacaagaacaagatggtcgccggctgtttcatcaccgacgagtgcgccctggcggtgtcgacggagcggatgtggaaggcggtcttctccggcgaggacacggccgtcctgcccaaggcctgcgcgggcttcatcgacgccgtggacgtcgagggcgacggcggacccggcagcgtctccaccatgacgctcagcccggcggcagcggagctcgccggctcgggcgtgatgaggagccgcctggtggcgcgcgacaacgcggcccgggtgatcaagacggagctgctggagggcagcaaggtgagcgcccagctcaagtcgcaggtggccgaggtgaagctcgaggcggccggggagggtgcttgcgtggcgaagctcagggtggagtacgagaggctcgacggcggcggcgcgctgtcggcggaggaccaggcgacgctcgccgcggggtacctcgacgtgctcaagatggtcgaggcttacctcgtcgcgcaccccgccgagtacgcctaattaaaccagcacgagaaacatcagaaataaatcaatctgcctttacaagacagaaaaataaatctactattgtggcaagtacatgcctctattatggtgagtatataccggtgttatttgcttcatgatcgacttcgtgagaataatcgagggaggatctttagtacgtacaaaaaattgtttgaggtgtatatgagtgtttaatccctgttttaagctcgtattttgtgtgtaagttgcttcaagcattaataaagataaatattttagcaaaaaaaaaaaaaaaaaaaacgannca

SEQ ID NO: 17386 - DNA, 1194 bp, Triticum aestivum
  Clone ID: PAT_TA_17386
tatacagaaaagggcagcctctaatggttgccaattctggttctgttcggcaccgcttccacatgcctgaattaacttcatgaaaagtatttttagcgtcgagtcacctccaaggacatcagttgcatcaagtagcacgtcactaaccgcatatctagcatatctgaaatccctccggtcttcctccgacacaggctggaacccctcagggtttgccactcggcctctaaatgcaaagtccatatgtttaaggtaaggaaatcgtgccacccaaccaaaattggcatacaatggcttgtctgctgaaacacccaccaaaatgaccagtgtaaaacttgtcaatatatggaggttcgacaaacaggacttattacatatatatcatcactccagcaacttgtcagaccttcaaaacctccagagcaacttgtagatcttccaaacctccaacaacttgtgtatcttgagaaacctcctcaactggcttgtggtcacattactgcatttgctagacttatccacttgcaccttaaatgagtctttcagctgctctttgaggcccataacatgagggatgagaatttggatcagcggaaactgttcagggatgccacaagaatctcgagacagtaaaatgtatcaactctcagaggtaactcctccgcctgcctccagaaattgatctgtgttcaacgaagagagtgccgtatggaccaaaggatgtgaagcaagggtagctgcggtaattccatgacagaaacgaagccaagaagcaaaaccctccaaaacctgttcttttagctcgtcaaaacccaagcaagcagtcaatagactaagagcaacattagctgatgaacaaaggtcgttctcaaactgattgcgcctttcaggacgagcagctattttataactagaagtttcctgtggcaagataataagcagttcaaggaaacttggaatgaactcttgttgagatttcatttcatcgcctagccagttcacgatgccaccacctccccagtcctccacaggtacatgcacagccagagcagcaattgcaatacaaatctgtgttctaacttttggtggtcctttattaaatttctttagcaatccatatagagagtcttgcaatggtcgaaaagcttctgacggtaactcctcaaaatccctttgcaccttgcttcctcgtgc

SEQ ID NO: 17387 - DNA, 540 bp, Triticum aestivum
  unsure (1)..(540): unsure at all n locations
  Clone ID: PAT_TA_17387
ttttttttttttgcaggacaggaatttgaacgggtgaaccgtgaccagcatttacaaaaacttgggtgcacctgaccaccgggccccctctccgaacggctgatccaggcccagcattttcctgctctctggtcctcctcacctctgctcacaattcacaaatccattctggtgcaatttcaaaaagaaaagtgagcacaaatttgctgactataccacactttgagatccacatttgcctaccacttataagtttcaacatttgattgaggcactggtcaagacgaccgatgacatcagccaaagagcagctcaccaacttggagaagagcatttccagaacacatcctgtggcgggtatcctcaaggatctctacccgcattcttgggagggtatacagtcagcaatccaagttgaggtcggcagcaggtcgcccgattggacgttttcaagtacctgccagggcgaacgccaagttgagatcggcagcaggtcgccagattggacgttttcaagtntanaacntctnggaaaatttt

SEQ ID NO: 17388 - DNA, 174 bp, Triticum aestivum
  unsure (1)..(174): unsure at all n locations
  Clone ID: PAT_TA_17388
ttggtcaaatgatatggtggatttgtatgaattttgctcatagtgcaaccataatgcacaattatgcaagccatacgatcagcctagggctcgattcctttttcatatctgtctacaatgaaatagggcccttaaacatatgattacaggatccagcacatcancctcaccagt

SEQ ID NO: 17389 - DNA, 603 bp, Triticum aestivum
  unsure (1)..(603): unsure at all n locations
  Clone ID: PAT_TA_17389
ngaacccgcagtttctgggtgtttgtgtgggaagctcttcaanataccactcttataatacttgctatttgcgcctttgtctcgttagttgttggcattacgatggaaggatggccaaaaggtgctcatgatggtctaggaattgttgcaagtatcctcttggtcgtttttgttaccgcgacaagtgactatcggcagtcgctgcaattcaaggacctggacaaggagaaaagaaaaattcaagtgcaagttacaaggaaaggtttcaggcaaagaatatcgatatatgatcttcttcctggagatgtcgtcaatctggcaattggtgatcaggttcctgctgatgggctcttcatttctgggttttctttgttgattaatgagtccagcctaaccggcgagagtgaaccctgttgttgttnaatgaagaaaacccttttcttttgtcgggtaccaaaggtccaagatgggtcctgcaagatgctttgtttacnacaagttggtnatgccaaaccaagtgggggaaaaactaatgggntactcctcaancgaaaggcgggggaaggatgnaaacccaactgcaaggncaaanttaatnggatg

SEQ ID NO: 17390 - DNA, 429 bp, Triticum aestivum
  Clone ID: PAT_TA_17390
gccggccgggttgggtcagccctcgtgatcgctctccaagacgccgcagtgcttctccagccccagcccgtggtcgcagctatagcaagtcaccggtccgtgccagggatgattctcctgatgctaaagggtatcgccgcagccggagttagacctgaagcctcgtgtccgatgcattgttctctgagagaagttactctttagctctgcctgctaggagtactgagacctgacgtcaacttcttgacttcggttaaggtttcaactttatctatagttatgttctgtcattaaaaaacttatgtggtggatgtggtatgcaactgagatctattacctttctttctgtgtgttaagaaggcatcgtcctgcacttctgcttaaacgactcagccaacttcggctcttcagttgttgtcttcgtggttt

SEQ ID NO: 17391 - DNA, 2035 bp, Triticum aestivum
  Clone ID: PAT_TA_17391
ccgggcttgagctgccctcctctctcccgcacgcgaacccggaagcctcgcttccgccgccgccgtcgccgccgctccgcgccgcgccgcgacgcagagctcgcccgtgctcccctacgcacggagctcccggctctcgtcggcgcagggatttgttcaccatggcccgcttgtatgttggcaacttggatgcccgggtgactgctggggaacttgaagacgagtttcgtgtgtttggagttttgcgaagtgtctgggttgcacgtaagccacctggttttgcgtttatcgattttgatgacaagcgggatgctgaggatgcacttcgtgatctagatggcaagaatggatggagggttgagctgtctcgcaatgaccgtggtgaccgtggaggtcgtggtggtggtgctggtggtggcggcggcggtcgtgatcgtggtgggtctgatatgaaatgctatgaatgtggtgaatctgggcattttgctcgtgaatgtcgtctgcgtattggttctggtggtctgggcagtggaaggcgtcgcagcaatagccgcagccgcagccgcagccctaggtaccggaggcgtccgagctatggcagaacaagttacagcccgcgtgatcgctcttcaagacgccggagtgcttgaccatcccgagcccgtggtcgcatctatagcaagtcgtcagtccgtgccatggacgcttctcctgatgctacgtattggcgctgcagccgtaggtagtggatgacgcctctgcaggagccatagtctcaggccgcagtcctaagttaacctaggactccgagctatagcaaaagaagttgcaaccctcttgacttgcgctccaggatgccgcagttcttctccaagctccagtccgtgttctgacctatagcaagttatcaggtccgtgccatagatgattctcctgattcaaaagggtatcgccgcagccgtggagttagacctagaagccttgtgtccgatgcattgttctttggagagaagttactctttagctctgcctgctaggagtactgagacctgacgtcaacttcttgacttcggttaaggtttcaactttatctatagttatgtttgcttctgattctgtcattaaaaaacttatgtggtggatgtggtatgcaactgagacctattacctttctttctgtgtgttaagaaggcatcgtcctgcactagtgctaacaagcacaaactacgaaagtaaccggagcatcgggtttgtatatagagccaggagtcaacaaggtattgaccgtgcagcacttgagtgaaactaattctacatcttgttcatagggagaaaaatgggccttgagctgcgctctgtagtagagcatcaaggaatttgatgaggctggcttcatcgagagtcatccacttaaacagttttgtggacttcatcttggcttcaccgagagtcaatccatttaaacagtttcgcggacttcatcagcagtcatattcttcgctgtctgaataagtctgcctgctgcctgcactgcactgcactgcacaggctcgacttcatcttcatctgcgcgcttcatttgttatcctcgacaactacactgcataatctccgtcttctacttgctgcgtgcactgcatagtcgccgtcttctgcctgctgcctgcactgcgtagtctccgtatgggaatgtcttgccatctccaagatgggatgcattcttgctttcaatattaggcaagtccttaattgttattgaagtacttgtgacctaatattgcatttagtatgaaactactgtgtactggccattcagcacagttgtacttgtacacctttttacattagacatcgaaagataaatttcatgtgctggaaattgctgtgaaaccaccttccgttttatcacaaaaaacccaccccaaaaaaaaaacaaaaaaaaaaagggcggccgctctagaggatccaagcttacgtacgcgtgcatgcgacgtcatagctcttctatagtgtcacctaaattcaattcactggc

SEQ ID NO: 17392 - DNA, 178 bp, Triticum aestivum
  unsure (1)..(178): unsure at all n locations
  Clone ID: PAT_TA_17392
tntttggcaaactgaaatatatttatgtgtggataatcaaaacagaatccacaatttagatatcaagagagaaaagcccacacagaaagctagaattaagccattgacaaatactaggtggctcaaaatngcaaccatggctcactccattaccaggacacaaaaactatagtaggat

SEQ ID NO: 17393 - DNA, 581 bp, Triticum aestivum
  Clone ID: PAT_TA_17393
ttttggcctcccaatttgccaggagctccccctccgggtctgcctcgttttgaggggccctggcgcaccggccacgcgcctcgggctgtgccgctgctcctgcttagaacatattatggcagacttagtctcagtttacctgctagtcctgaggccctcaaattgacctggaaaaaaggagcatcatctgatgagcaatattttacagggttcttctctctagctactactactaccgattgatgaagcgctcaggccgcttcaagaattaacgtacaactatatagagcggtaacggaaaggtcaatgattggcaaagcttcgactgtcggacttgccggttagatcgctgaactacgtcgccttcgcgtgccgactgcagtgttactgctaatcacttcctaagctgctacacatgccgtgtatttgccggtaccatatcatgtgactgctctttgctacgtgagcatccatcaaaatggttcaacatggatgattcttgccttaatgagttcatcttgtttcctggtggatcagctctgtcctgagctgatgttaggtgatgcttcagcatcaactcc

SEQ ID NO: 17394 - DNA, 946 bp, Triticum aestivum
  unsure (1)..(946): unsure at all n locations
  Clone ID: PAT_TA_17394
ggggggctcgagcgggcctggccggaggatcgcgaatctttctcttcagcccgttaaccctcagctcgccaacagactccaagacaagacacctgtagtcacgtccagtcccgacaacacaagtcctttttttcaagatggctcaccccggatctcagatctccaagaggagaaagttcgtcgctgacggtgtcttctacgccgagctcaacgagttcttccagcgcgagctcgctgaggagggttactccggcgtcgaggtccgcgtcacccccaccgttaccgacatcatcatccgagccacccacacccaggaggttctcggcgagcagggccgccgcattcgtgagctcacctcgctcatccagaagcgattcaagttccccgagaactccgtctccctctacgccgccaaggtccagaaccgtggtctctccgctgtcgctcagtgcgagtccctccgatacaagcttctcaacggtctcgccgttcgacgtgcctgctatggtgtcctccgtttcatcatggagtccggcgccaagggttgtgaggttgttgtctctggtaagctccgtgctgcccgtgccaagtccatgaagttcaccgacggcttcatgattcactctggtcagcccgccaaggacttcattgaccacgccacccgccacgtccttctccgacagggtgtcttgggtatcaaggtcaagatcatgcgcggctccgaccccgagggcaaggctggtccccagaagactctccctgacgctgtcaccatcatcgagcccaaggaggagcaggctgttctccagcccgtcagccaagactacggcgctaaggccgcccaggctgctcaggctgctcaggatgcccgcgttgctgangaagagggtggtgagnaggtccaggctgttgagcatagagtgcttaatcattaggctcggaaagc

SEQ ID NO: 17395 - DNA, 231 bp, Triticum aestivum
  unsure (1)..(231): unsure at all n locations
  Clone ID: PAT_TA_17395
actgtacttgtgtggtgntggccgccactgttagccatggtgtggtntggtggcagcacgtacagttcactgtaatatatactgttactgtgtgttactatttcgcatctttttacatattctatagagcagaacactaatggatgataactactagtggaacattgtgtgtgttggttgtcgaaaatgtaagtagaatgagaaatgggtgataactacactaatggatgc

SEQ ID NO: 17396 - DNA, 469 bp, Triticum aestivum
  Clone ID: PAT_TA_17396
ctcgtcctcgcctccgccctcatcggcgtgcacgccgcgttccgcatgaacgtctacctcgacgagagggactccttcgacggggacgccgccgtctcttcattcatggggagcacctacggctacagcacgctcccaaaatgagatgacgaattcgattcgatccaagccgtttcttcctgagtgtggctcctcttctcatcctctgttcttggcggatgtaatgctctgggattgcaatcttcgtagtctgtatgcggtgtataggatattgtttgctttcccttttgtggggagttttgatttgtttgtaagtcagtccacttggtgttcaagtgaaattcttaagctgattgtgatgatccgaatctgtttttcaagggaaattttgtaagatgttgctccaaggtgtaaatcatccctcctactgactagttgtgaaaataaagcttgtgaaattcaatgtaaa

SEQ ID NO: 17397 - DNA, 549 bp, Triticum aestivum
  Clone ID: PAT_TA_17397
acactaagttcggtcacttcatccctctggctcatccctactctgctcttcaagttgctcaactcttttacaaccacatctataagttacatggtctgccgtccggcattatatctgatcgggataaggtatttaccagcaatgtttggcaatctttgttcaagatgacggatgtgaagatgaatatgagttcggcacaccatccccaaactgatggtcagaccgaaaagcttaatcaatgtcttgagacctttctcaggggtacggttcatgcttcgccgaccaaatggtctcaatggttgccttcggctgaacattggtacaacactaattttcactcagcgctgggcaagtctccattcgaggtgttatatggctataaaccacgacaattgggcattgctcatattccagaatccacaccatctgatctggcgggttggctacaagaaagagaaatgatgcaagaacttgttaagcaacacctacttcgagctcagcaccgcatgaagcaacaagaagataaacatcgttctgatcgggtgtttc

SEQ ID NO: 17398 - DNA, 948 bp, Triticum aestivum
  Clone ID: PAT_TA_17398
ccccgcgtccgtgatctgtctcatattgggattcctggacttaatttgtattgtgatttctccatgttaaattatgccaggtcgttcctcgaggtgtcaattgtaagcgagtagatgcggatgtatcaagttctgctcttcatgaactcctttggtaattgcattcttcaaattggggttgctgcagcctctctacaagatggtagtgcagttactgtggatgcacagaggttcatccaaggctccctttacaagagtgccatggaatccaagaagcaatcgtatctagcaaatcttgctttatatcctggaaggactgagctgccatttctaccagctaacacacaggctctaatattgcagccaattggtgacaaaggaattgcagttattggtggtgacactataaggggcttcaccaatcttgatcaggcatggattggtatgattgcagacaaattggatgctacattgtccaaagtcttaagctcacattctcctctggatattcgattgatgatcatttctctctttaattggcccatacacccagaccatatttgcttggatccccggaagtcatcggggtacatgtgggagctgaaaccggagtttacaaaagaacatctcccacaccctaacattacaggctcggctatttggggaaatttggttgaccaaaattatgggattatatatatgcccaaccgctaacaacgtgcatgatccatcctttcaaagtttctgaaatgaatcacaaatgaggaagcagctgccctgcttttcaatctggcagttaaggctttagccctgattttagaaaacgcagagcaaggtgcgtttactatatgtgtggtgcctaatttattgatactgttaccatggtggagccatctgatcaaacattctagtacatttcttgctcttgctgtactactttaaggcagt

SEQ ID NO: 17399 - DNA, 536 bp, Triticum aestivum
  unsure (1)..(536): unsure at all n locations
  Clone ID: PAT_TA_17399
cctgattgatgagggncatctgtgtgncgncttagnttatgcaggnagtntccatcatgttagaacccanncccccctttnttgacngtttcagctccatcantaatgctcccggntggcctctatngtggnactgtaagctcanattgngtaaccgctcnttcatatctcttagatctcnttccagggcaaaatcntgtccccaccagcagattgctcntcggcaacgngatnttttgttggccccggtacatcttattttcctccaaagcctctgcaagcttagtttccagtatttgaatcttcgactgaagatctgtagaatctccaatctcctgctttctagtgagatcctcaatttcctgctcaagggattgtatcttcctctggtattcgctatttgatcttctgatcctactaagttcgttctttaactctgcttcatgtacatgtgatgctcccgatgctgatcgatcactctccaatctcacaagctttgcttgcntagatattntgcttcgnttttcttcttcacn

SEQ ID NO: 17400 - DNA, 534 bp, Triticum aestivum
  Clone ID: PAT_TA_17400
gaaatccaggaccgatgcagcgctccaggtctggagggacgcagagaagatagtcaataccccaaactgggcaccgcggccagagtttgtgaagagatttctgaagcatttcgaggaagcgaaggatgtggatgggatggagtcgttctgcgcgtgccttgagaagctggagtgcctcgacgcagatgctcgtgatgccctgtcccggacctatgtagctgcaggcagaacaaatccatcctctatcattcaccggacggaagaagaccaggttgagactagacctggctagaagcaaaggcgcgccgttgcgtcccaccgttgtcgaaacaacctttcccgccctttaattgttcggcgttgatggcctgagcatgagctttatgattttgccctttagtttcatgctgatagtctttagttcccctttagtttcatgttgatagccttgcccttgtggcatcagagagataaacatgtactctacttacaagctggttatatacatgttgaagatggcaaccaaaggggggg

SEQ ID NO: 17401 - DNA, 739 bp, Triticum aestivum
  unsure (1)..(739): unsure at all n locations
  Clone ID: PAT_TA_17401
ttttcgttcctcttgtgggcgacttgggtcccgggcccccccgcgcgtttttttttttctgttgttgttttccgctttggtcccgtctgctcggttgctcttccatcatccggcaagaaaagttgccctctccttcctgcctttctggcggctcccgcctggcaaccgatgctaggcgccggctggtgctccaactggggcttgcgctggttttgtgctccaggtggtgctagcgtggtgtcgatgcccccggcttgtaggacccgttctggaggacttcgcctggtgcgctccatcctggtgcaggttgctaggggccctccttccttgttcgggttgccctcctgcctccctgcccgtaacgaaaaaaccaccaaggtgtcccgcccaaaagtttttgctccccgacgcacataatgtctttgcaaatggtttcctagcccgcgatggcttggccgtctcctcttgccgatcgtccgtgtgcgtccccccctccaggcgctcctgcccgtcaacttgctgctctccccgctcgggtgctggcttcgcgcctcaactgtagtaacagccttcttcacatgatgattgtcagtgtatgtccttcccatcaggagctccttcccgtcaattatctttcattacattgcgggcattcaaaagccatcacaacgaccttatctcctggnagttgggaatcgtagtcagcagcaacctcatggtgccctgaccaaaagacagt

SEQ ID NO: 17402 - DNA, 557 bp, Triticum aestivum
  Clone ID: PAT_TA_17402
gctgagcagaagagggcgtgccgccccggtccgtggaggccgccaggttccggccggccgagagctgggtgctcatgatggaggacgaggagaaggagccggagctgaaggtggtgtcgcggatgaagcggcggccgacggtcggcgaggtggagaacatgatgtacaacctcatggccgccaactcgccggtgaccaagtccgccaggttcctcagggagctcgtgtccaacgtcacgggaaggaaggggaagccgtgacattggtttcattggccttgtgtgttcacggcgtctcctgaactttcaacactttgttgattgcctgaaaactctgaaatggttgtagtggtgcagcaaaaagtttgcatttgcaatgcatcttcggaatatgataggcaatgttaacctatggataatagaagttttgcgcgctagcaaatgacagaaatcaggtgtgcaacaacttgggattaacacccaatgttgataaaaaaaaaaaaaaaaaactcgagggggggcccggtacccaattcgccctatagtggctcgtattac

SEQ ID NO: 17403 - DNA, 862 bp, Triticum aestivum
  unsure (1)..(862): unsure at all n locations
  Clone ID: PAT_TA_17403
agacggaactcgataaaagtaattttgaatctcggatcaagaacaacaggcactgacaaccacaagtacgactttgcccaatattcattgaatgcttcctgcatctctctaatcatgctagcaacgtcggagtgttcagtacatgcttcttcttgcaaaannntnctaactttccatacttcatgnaagtacagatttgctgtcaggcaaacaggcccagacattacttcaccgactcgatagaacaccctcacaatcttatagataggctcaacaattttcatttcttccacagatccaaattcttcacaggcaagtaacttcttgaaacgcaacagcacctcaagtctaaagtaaattttatgccacccctgtgcatcttcatgggggcacttcataccaacatcgttagcaacttccaaaagttgctgctgagtcagcgatgaagatgcacatgcttgaataaatctctctagcagatcaccgacacggtaaagcaatgattgccctttcgaaagaacgctgtcaagcatatcatccacacaagcaatattgtatagctcacctctaataggaagacagttcctctgtataagcatgtcctccgcccgtggcctcctgccactgtttcttatttcgcttacagatgtcaagcagaaaagcttcctgtcaatattccactctcttatagcttccaatatgacattatacgccccaacctcagattctagcacacaagcttccttacagtgtatcatcctttncaaattagaaggngaggaccaagcacaccaaacttgattatnctcctttgnagctncattcagatcaataaatgcgcggtcaacacaggactggcccg

SEQ ID NO: 17404 - DNA, 630 bp, Triticum aestivum
  Clone ID: PAT_TA_17404
gtcaaggctgaactggcggaagaggctgagcaagcaggcccgtcgaccgcggtgcccaggagaagttcgaggatggccaaagccgaggaggcagcgtctgcagatgcttcacagccggccaggtcctcaaagagaaggaagaaatgatggctctttgtagcaagatcggcaatgcaatgctgcttttgtcctgtacatagcgtagctggtatcactatgcggtccttctgctgaagtagctggtatcactatgctggtggtttctgccttcctggtgctacttgctagttcggctctgcttgcccctttgccggctggcttgatccatctgggacagccggccaggtcctcaaagctgttagtttaagtatggctcttttttttatatatgcccaatgcaatgctgcttttatggtgtacatagcgtagctggtatcactatgctggtggtttctgccttcctggagttacttgcttgacctgctctgcttgcccgtttgccgcctggctttagccagctgggaagacaaggacaaggacggcccctgttagtttaagtactataattaagtattatatatgcccttcacggtgttgcttttaaaaaaaaaaaaaaaaaaaaaaaaaaaa

SEQ ID NO: 17405 - DNA, 953 bp, Triticum aestivum
  unsure (1)..(953): unsure at all n locations
  Clone ID: PAT_TA_17405
ggccgccccggccgcccccgccgggtctagagcactacaggccctcccggtccactcatctttctggcttctggccgcctctgccgtctttctgcggtctctggtgttctggtctgttcctgcgccggtctcgcccgtctcgtcttgcactggcccacacctcagtagacgacgtgccgccggcccggccgcatgggccggctagcgatgtgcactccgacgtagcgagccgaagccagcgcacccgctacaactcgttcccagtatctctcttgccctccggctgcggctgtgcccagaagcgttatgtccacactgtaccacactctcctctgacttccccgaccgcaaaactgccctttggccgtggctagttgacacgtttgcgacgggcgccagttcagtttcttgttctctgtcctagtgttgtttacccagttaacgtaccatgcacagatgattgtactcatatgccccaccttgtaactgatccacggccgcgtcctcgcattacgttaacccgcggccgcctaggcgcgggttgcctagcgtcgacgggcccttaacgcccatatgagtgacgataatcttaactcaggccgacgaaaatcttcgacgagtcagggttttcccaggcgaatcccttcaattacgccaagctgctctacccccaaacgcctgcaggcgatttatgcgttgtggcccgctccgtacgcccaacccttctgaagcgctncagtttaggcgttaggtcgcgcccagatgcggcgctaattgcgcggcgggagaggaggaatcgcgcnggtcccgcatctcaagcctgcgcccatgcncccgcaccaaacgcaaacaacccaaccaaacacgcctcgaacgccggcaaaccccgacttgcacatttncgggggcacccaaatggnaacgtaaatgagcaaatcggctcacgtcccctt

SEQ ID NO: 17406 - DNA, 668 bp, Triticum aestivum
  unsure (1)..(668): unsure at all n locations
  Clone ID: PAT_TA_17406
ttgcataaatggagtctcatatgttatcacttgcatagctaccttcgcgaagggtgcacaccctataggacgtccagctggcggccgcgttaactcatgagtaatgcgaggacgcggccgtggatctgtagcccatccgtggccctgtgcccccccccaacccaccacacttctccttcctgcacctccgcgctccccgcggcttaggtcgaggatgccaagctgtcgccttgctggtacccctagtgctaatccgtctgttatttggctgccggctgactttgcggtgacttccgattcaagttgctgtctatgtccctctttgttaggtgacagtgtacctgttgtaaccttgctccgcagttcgatgccttccctccgtaggtgccgcgggctgcctgggcatcgtgcctcctgcgaccctcccccgggtcctctccgcggccgggctgctaccttgctgccgcgcgggacgcgcccccggctccgatgcgggcccctgcggcttctgcgccgccttctcggcgccagcccgggtccacaacagacaagaaaggtcgctcagggaggtgggttcttacgctgtntatgctgtcccctgaaagggctggctcatcccctggggcgtggaacagtttagctacttctaagggcagcagagagacngc

SEQ ID NO: 17407 - DNA, 1661 bp, Triticum aestivum
  Clone ID: PAT_TA_17407
gcgccgcgaggcaagaaccaacaccaacaagagctgctgccaactcctgcacagcctgggctctcatcactgattgcccacctattaccttcatcttttgtgatttagaatcacccactctatcccttatatatctaccttttctcggtcctctgtaaactctctcgtcttctaggtttcacaggcctcaagataggcctctggggattgcccctccctaccgtagctttgctaagtagttgcttcttcttcttggtttcttttcttgattgctttgggtctccgattttttgggtcctcggtttcttggtcctcccctgaatcttgtagagtctgttcctttcgccgtcggtagccatggacgacaggattccgccgccgtctcacctgcagcagtactcgcagtcccctgtccattcttcgcctcatcaccaccacctcaattccatgaggtactctgcctcctctgatagagaaaggtatctggctgagttgcttgctgagaggcagaagttaggcccattcattcaagttcttccctactgcaccaggctcttgaaccaagagattttgcgggcatcttctttgccgcctaaccataattttgttgatgctgagagaattgagcatggtagcccgttaaggttacctggccacccagtgaatggtcaaccaatggatctggagggatggtcaggaaggcaagcagagcatatgggggttctgcaagcatcaccaatgagctggaatggtgctccagcacttggtggtactcctgttgtcaagaaacttgtgaggctagatgttcctgtggacaagtatcctaacttcaactttgttggccgtctattggggccacgaggaaactccctgaaaagagttgaagctacgactcaatgcagagtttacattcgtgggcgtggatcagttaaagactctgtgaaggaagagaagctgagagataagcctggatatgagcacctcaatgaggcactgcacgtgcttgtggaagcagagttcccagcagacattattgatgtgcgtctaaaccaggctgtgaccatcctggaagatcttccctctccagtggccgagccctgggtctactacaagaagcagcagctgagagagctggccatcctgaacggcactctgagggaggaaagcccaagcccccaccttagcccaagcgtgtccccctttaactccgccgggatgaagcgtccgaaaacggggcggtgatctaaaaaacttggtctgtctgaatctgatgacaagggtggagatgattggtgttgcatttgccgggatgatgagtgctggcctatgcctgtcatgatctgcgtgctttaccaaccgtagatgggtccgtgggcgaatgatgatcctcggtgggcttgattgatgtttgacgctgttcctattatttattctttctgtgcaatctgactttggaaaaaatgacattgtttattggtttggggtaagttaacaaggccaggtggccatccaagtgtcggacaataatcagccaggtattgtgtgcctggaaaaaatagctgtaatatgatattgtcatgtgctggtgcttttgtgtgctagtagtggtagtactagacaggcaggcagacaggctctgttaatgattgatttgcattcat

SEQ ID NO: 17408 - DNA, 673 bp, Triticum aestivum
  Clone ID: PAT_TA_17408
ctcaaagcaaggcaccagggaaagcaagcagtcagcagcgggtcaactgttagagtagcgaagaaagcagcggcagcacgctcccctgacccacccgcggtaacccccgagcccgttcccatcgccacctccgccccccagctggtcccctgggcctacgacctcctcgaccccggcaccggctccagcgcccgggccgacgacgaccaggatacacagagccagccgagcacgacagcgacctaccggaccgaggcagttgtggatatccggatcaggtccagacagctcccgtcgggacgatcagggccagacgtcaacgtgaattgccaggagagctacctagcctcttcaaacggcagcgtatggcatagaggtcgttgtggttttcgtaaggtcaagccgtagagaggggtggtggagtgtttcagtccgttaaaatgttgtgtttcttactgtgttttttggttttttttacgtttctgggtttgtgtgttttatttttacgtgtgtcttgtatcttgatttttttgcttgttgatctctcccgtttaagtgtttggtttctccctaaagaaatgaaaatcccccccgcgtgtgttgttgggctaataacggcaatgtttgttaatttttgggctaataaagcagtaagttgattaaaaaaaaaaaa

SEQ ID NO: 17409 - DNA, 1826 bp, Triticum aestivum
  unsure (1)..(1826): unsure at all n locations
  Clone ID: PAT_TA_17409
gggttctctgttagccccgctgcctcgccgccgcggctgcccggccgacgtcccacgcccccgcgagagggctcctgcccccgtttgatccctcccctccctcccccctcctcccatcccagcgccgccgccgcctcgaccccctccttcctccgcgctgaccgccccgtcgcaccagccgccgccgcggcgacattcattaccgcgttccttcgtttctcggcctccagctcggggcggcgccgggatcgcgggatctcgtcggggaagcgaggacgcttcaggctcgtagcatctgctcccgatcacggcttattttatgggtgaagaggctcctgagtttcgcgttgaccgcatcaccttggggtccaaggattgccaatagaatgccatagttgttggcgataaaacgtatgtaattggcagaacagatgatgactcaaagtcaacctttggcattaaaattctggacaaactaactcagacttggattgttccgacagtacttggagcgcagcctccgtacaagtcacactcagcaattcttataaatgatgagaagatattggttgttgagaagtgtctttccttaaacgcttttttttgacaccttcagatagataccccctttgttaaacaacagcggaaaatcaagggttcagaagttgtttcctggagcaagggagtacttggtgtcgcccaaaaaccagttgtgattagtgggccatctggtgttggtaaagggacgctaatagcaaaattgatgaaagagtacccatcgaaatttgggttctctgttagccacactacaaggtctccaagggtgaaggaaatagatggtgtccactaccattttgctggaagaagcaagatggaacaagatataagtgaggggggaattccttgaatttgctcatgttcatggaaatctctatgggacgagtattgaagcagttgaatctgttactgatgaggggaagaggtgcattctcgacattgatgtccaaggagcacgatctgtgagggcttcttctcttgaagcaatattcatctttgtatgccctccgtcattcgaggaactagagaagcgccttcgggcacggggcacagaaacggaggagcaaatccaaaagcgactaagaaatgctcgtgctgagcttgaccagtccaattcaccaggtctttttgatcatcttttggtaaatgataaccttgaagcatgctatgagaatttgaagaagatgctttcgttggatgatgaccacaaagattcagatggttgtttcatcgaggatgggaaagcaaccgcatgttattctatcctgtccaaaacagagtcagaagtttttttgcagtctgaaactggcgaagtagtaaaaggagctgcaagcttgctagcggtcgacttatcctctctcacaggtggcgctcctggacgaacaagaggtcttaagatacactcaattaactcaattgacaacgatctgaagggcattagataacccaaaacattcttacaaacgatgtcgcagaagtgttgactgatggattttggatcaattagtgagatataacagcttcagaaacatattagttagagaaaaaggaaaacataagtgggatttatttccatttatcatttgtttgccggagaggcgcttcgtttgttctttgtaccagaatgaggtgaagtcatgccagagggattgtacctcttattgttgaggggttgtgtaccttatatttgttcagtggaacatatgtcgagggcctatccgaaccatgttttngttgtctgcgagaatgaagaaatcaggtgatgttat

SEQ ID NO: 17410 - DNA, 648 bp, Triticum aestivum
  unsure (1)..(648): unsure at all n locations
  Clone ID: PAT_TA_17410
cggacgcgtgggctgaggcgaagggggcggtggcggcggcggcggagagagtcgagcaggcagcgcccccatctggtttcgacaactccgacggccatggcgctcagggctgttttaggtgctgccttcaggggcgttcgatctgcccgccagcactctctgggggtcaccaggactgtggaggtatctggtcccaagatctctgcgtcccgctccccttggctcgttggttcccggttcttctccactaaggaatcggacactcttctcagggaaagtattaagaatggagtccacagggggttaaaggaagcccttgccaaaaatgatggcaaatcagttttaaagctctctgtaattaaatctggtgtgaatgctggggttaaggaatctctgaaggaataccatgttttcattgactttgctgaatccgatttgcgtcctgaggttaagtcggccattgaggagtccgtgcttcaagggcttgataactttgtgcttcagttgcacaaggtaccaccccagggaggacagcnnnaggncccttaccttcttaagttagctcttaaggaagctattgatgaagggatggatgtgatttatcaaaagttcagtgtttatgttggtcgnnnngtggacnttctcgtn

SEQ ID NO: 17411 - DNA, 886 bp, Triticum aestivum
  Clone ID: PAT_TA_17411
ggcggccgcgtacctggaacttttcctgcccacagattcccaaaaattcgcggacggctctagataccctcaacccccgacatcaacacctcacagccggcaggatgaagtacattcactcccaggagctccttgagatccccgagggggtcaaggttgccattaagtcgcgaattgtcaccgtcgagggtccccgcggcaagctggtcaaggatctcagccacttggccgtcaacttcaccagcaccaagaagaaccagatctccatcgagatccaccacggtgtccgcaagaacgtcgctaccctccgaactgtccgaaccctcatcaacaacctgatcattggtgtcaccaagggcttcaagtacaagatgcgatacgtctacgcccatttccccatcaacgtcaacgtctcccagaactccgagaccgacttgtacgaggttgagatccgaaacttcatcggtgagaagctcgtccgccgaatcgtcatgcaccccggtgtcgatgttgaggcttccaccacccagaaggatgagctcgtcctctctggtaactctctcgagaacgtttcgcaaagtgctgccgatatccagcagatctgccgggtgcgaaacaaggatatccgaaagttcttggacggtctgtacgtctccgagaagggcaacgttgtccaggacgaataaacgcgaacacggacacggatcttgtttcttttgcgtttctgggtctcaggagtggcgaaggttcatcttgcatgtcatgtagcaaaaagaaagggctactaaacaaatttcaaaaagcaaagagatgatgactctggtgccgaccaaacacttgaatctcgtcagcgaatcgtgtatgtgaccatttaaggagcgaaaag

SEQ ID NO: 17412 - DNA, 675 bp, Triticum aestivum
  Clone ID: PAT_TA_17412
ggccaacccatctccaatattggggagttggcatggttttgcagggcattggagaggcatttggagggaagattatccgggttccttctggggtgatgcatggaaaaagttctccagtttattatgaggaagttctaggaaagtccatatgcgagggcttgtcaaacccttttaccgccgcaagatatcatagcttggtcatcgaggaggaaaccttcccgcacgatgaactggaagtcacggcatggactgaagatggacttgtcatggctgctcgccacaagaagtacacgcatatccagggtgttcagttccacccagagagcatcatcacccctgaaggcaagaaaatcatcctcaactttgcgagatatgtcgaggagtttgagaagcagacctccgaggggaagtagaggattcaggaagcagagcagttagaggaagtagagactattgttgagagatcaggcaggcaggaaggggcctaaaagccaagcagatttaggggaaatgaataagggaaaaagagcttttccattgccattcgtttggttcattgtaatatatcattgtggatctagatcccgtatgaacttcattcggtcaattatgttcgtcgtggtgctctttctcaaataataaatcggtggaagcagaagctgttagcatcttttt

SEQ ID NO: 17413 - DNA, 1326 bp, Triticum aestivum
  Clone ID: PAT_TA_17413
ccggcaccgcaccgctcggtttgcccccttcccttcccgaccccttccccgccacggacaaaaacccagcgagccgcgagccgcgcgcctccggaccctcctcgccggcatggcctgcacccacctcgccgccgcctcgtcaccggcgaccaccgccgccgcgctgcgtgcacgggcgacggcccccgccgccggtttcgcgcgccttcctgccaccctccatcctgagaacggtgggctggccctcaggggtaggagggcggtcacgcccgtggtcctcgccgccgggccggccgccgcggcgccggtggccgaccgtgacggaacaccggccgcggtgaagcagcccatcatcgtgatcgacaactatgatagctttacctacaacctgtgccagtatatgggggagcttggattaaattttcagctgaaccgtaatgatgaacttaccattgaggaggtaaagaggatgaaaccgcgaggaatacttatttcaccagggcctggttaaccacaagaatcagttatatcattgcaagctgttctggaacataggggccacgcacgcaggattccagaggtcaggcagagttatgcgaagtcaataggagaaaaagagcttgaggaaagccattcgtttggttttttggaatatatcattgtgaaaagagatcccgtttaaacttcattcggtcaaagaagttcgtcgtggtactccttctcaaatactttttcggcggaagcagaacattggagaggcttttggaggaaagattattcgcgttccttctggtgtgatgcatggaaaaaagctccccagttcactatgatgaagttttaggaaaggccatatttgagggattggcaaaccctttaaccgctgcaaaacatcatagcttggtccatgagaaggaaagcttcccacacgacgaactggaaatcacggcatggactgaagatggacttaacatagacgattcccaaaacaagtacaatagaggaagtagggactattgttgagagaagagtatcagcaggcaggaaggaaggggcctaaaactcaacctgattcgaagcgaggaaataagggaaaaggagctttccgttgccatttgtttggttcattgtaatatatcatagtggattgagatcccgtatgaacttcatttggtcgggaacgggcctaagccaagaagcagattcattcagagataaggaacaagtgaaaagagctttccgttgccattcgttggttcatgtaataataatatcaactttgtgcatcgtggtggctctttgtcagcgataaatcagtggaaggtgagg

SEQ ID NO: 17414 - DNA, 709 bp, Triticum aestivum
  unsure (1)..(709): unsure at all n locations
  Clone ID: PAT_TA_17414
ggacggaaactaacgaactggcaaaaggttggactgccttggagcaaggagggttgcttaatgctttgtactaactcccgtccaggtttataatgtccacacgtattttaacaatatcttctctcgatctagtactcttctcacgaattcgtgtagcaatttagggattacaatcacaggatacaagaattggggaaggaggaggaaggggaagaagatagccgccgccgccggggttcgcgttcccccccggcgccgggcgccttccccgcttccgagtacttgtaggctgttgccgagtggtgagcatagacgggcccggcccatgagctatcaaaggggaaagcccaggtatgagtatgggccaggggaggtccctaacatccctcccttcttgaaatgcggcttgcccccaagccgctatcacgaagattttgcccaggatcccatggtgcttggagatccttaatcatgccggaatccccatggtagttgtcgcggtanagccatggtcgagatggacttgaacaagctcggagaagttgtcgggcttgaggtagtagtagtcgtggccgacagagacccgattgaagttggtgttgtggttgatgaccttggagggaaatgcgacggagaagtagccatcacagtcgaagccgatgtagtgcctgtagccgaagcagccttgcgtgaatacgtcggcaaatgc

SEQ ID NO: 17415 - DNA, 1059 bp, Triticum aestivum
  Clone ID: PAT_TA_17415
ccgcggtccccgccggccgcgccccattcgtttgcagccacacacccagctccgcacgcggtcaaccgagggaacaacacatccggatccaaatctcccagcctcccacagctccgtcgccgctcgtcccgatcgatcgaccttgcgatcgactccgtttgttgccgcgcgtgcgcgcacagcagcacatccatggccgtcgccgccggaggaggagtggcgctgagtctgcgcgccccgggttcgccctcggcgccgcccgcccggatgccgatgtctccggtctcccccccgctccctcgcaggcgcccgccgacgcggacctggcgaccggttgcggtgctcgccgcggggggcgcgcacgacgcatcacttccggggtcggcgccggaggcggagtggtgctgagcctgcgcggcccgtcggcctcggcgtcgccggcggtggggcggctgcgtagggtgtcgtcgtcgccggcggtgaggtgcggggcgacgcgggaaaggaggccggcggcgcccccgtacggggtgctggaggaggaccactaccggactctgaggctgcagccgggcgcctccaggggcgaggtcaagaaggccttccaccgcctcgcgctgcagtaccacccggacgtcgtgcgccggggcggcggggacggacgccaagacgacgccatcgacttcgagcggatcaacgcggcgtaccagacggtgatgcgcaacatgcaggaggcggaggcgacgctcgagtactggcgccgccgctacggcctcgccgacgaggacctcgaccgctaccgccactacctcaacgacgacgacgaggacgactggttctccgacttctgaaatctcaagggccgctttgattcctgccatggcagaggcagcagcgctgtaaataatttgtgaaacgttgctctctgcttctctcctctgttttattgtggaggcgagctaaagacgcagaaattaagggttctgacaattgtaattggaacattttcatttccttgtcaatacaaataaacatacaaggatatctaaaaaaaaaaaa

SEQ ID NO: 17416 - DNA, 795 bp, Triticum aestivum
  Clone ID: PAT_TA_17416
ctccgcccgaaggccggaggacctcccctccccgcgcaagcgcactgaacagaaagaaagagatgaggtctcccgtccccgccatgctcaccgccccatcagcagcggcggccgtcgccaagccgctccccgcggctcgctccaacacgacggcggcgcttcacgcgacggcagccagcagcaggcgcgacgtcatcacgggcacgggcgtgggagcggcgctgctgctggccctgtggccgcagcgtgcgcgtgcggcgtcggatgacgagtacctgacggagacgacggaggtgatcgggaaggtgcggtcgacgatcagcatggacaagacggaccccaaggtggcggacgcggtgacggagctgcgggagatgtccaactcgtgggtggccaagtaccggcgcgagaaggcgctgctggggcggcagtcgttccgggacatgtactcggcgctcaacgccgtgtccggccactacatcagcttcggccccaccgcgcccatccccaacaagcgccgcatccgcatcctcgaggagatggacgccgtcgagaagtcgctcaagcgcggccgctgaagacttccatccacatccacactagcaaaatgtgcgtgcgtgcgtcaaacaggatagggtgagaacgtcgcgttgcttgtcccgtgggtcataagcgctccgattttgagcctcgagtttatcaattgtttgtacgacttgtctaatcggctgatgatcggcatggtgagaatattgttgggggcatcattgattaagtataaaaaaaaaaaaaagg

SEQ ID NO: 17417 - DNA, 975 bp, Triticum aestivum
  Clone ID: PAT_TA_17417
cccacgcgtccgcccacgcgtccggagcacactacacttttctgctcgcgcgcgacgccgcgtgcggacagtcagtctgtttccatccatctccaatggccgccatcgccaccatgacgcgcgacgcgtacccggcgccggcgcagcacccgctcctccgcctcaacccgcacgactgcatcccgttcctggacgagatcttcgcggacgggcaggaggccaagctggagaggctcccgtcgccgcgcctcatgaacacgcacatgccgcacaccctgctccccgagtcggtcaccggcgcggacgtcgccggctgtaaggtcgtgtacgtctgcagggaccccaaggacatggtcgtgtcgctgtggcacttcctccggcgccggcagccggacctcccgttcgcggagctgttcgagcacgtctgcgacggcgccgtggccgtcggcccgatctgggaccacgtgctcagctactggcgcgcgagcctcgcgcggcctgacagggtgctcttcctcaggtacgaagacctgctgctggacacgggcaagcacgtgaggcggctggcggagttcatgggccggccgttctcgcccgccgaggagggcgccggcgccgtggaggcggtggtggagctgtgcagcttcgagaagatgaaggggctggaggtgaacaagaagggatcggcgggggcgtaccacgccatgccccgggactctttcttcaggaaaggggtcgccggcgactgggtgaaccacatgacgccggagatggcgacgcggctggatgaggtcgtccgtgacaagttccgcggcacggggctcgcggctccgtgatctggacaatctgcatgcgtgattcgattgtactgtatgcttggctgctggtgcccgttgatttagaataaagatgctgttctcggcacaatcactgcttacatcatcgaataaaggtttaactacgattgtcgattgc

SEQ ID NO: 17418 - DNA, 1252 bp, Triticum aestivum
  Clone ID: PAT_TA_17418
cggctgctctccttgattgagcacactacacttttctgctcgcgcgcgacgccgcgtgcggacagtcagtctgtttccatccatctccaatggccgccatcgccaccaagtggacttccggccctgttccgttcacggacgtcgacgacggcacggtgccgaagcggccagccaaggaggagttcgggagcctcgtggcagcgctgccgcgcaagaatcaggccggcctggagctgcgcctgtaccagggcttctggctgccggaccactgggtggcgggcaccgtcgtcttccagcggcgcttcgtcccacgcgccgacgacgtgatcctcgccagctaccccaagtgcggcaccacgtggctcaaggcgctggccttcgccaccatgacgcgcgacgcgtacccggcgccggcgcagcacccgctcctccgcctcaacccgcacgactgcatcccgttcctggacgagatcttcgcggacgggcaggaggccaagctggagaggctcccgtcgccgcgcctcatgaacacgcacatgccgcacaccttgctccccgagtcggtcaccggcgccgccgtcgccggctgcaaggtcgtgtacatctgcagggaccccaaggacatggtcgtgtcgctgtggcacttcctccggcgccggcagccggagctcccgttcgcggagctgttcgagcacgtgtgcgacggcgccgtggccgtcggcccgatctgggaccacgtgctcagctactggcgcgcgagcctcgcgcggcccgacagggtgctcttcctcaggtacgaggagctgctgcaggacacgggcaagcacgtgaggaagctggcggagttcatgggccggcctttctcgcctgccgaggagggcgccggcgccgtggaaggcgtggtggagctgtgcagcttcgagaagatgaaggggctggaggtgaacaagaaaggctcggcgggggcgtaccacgccatgccccgcgactctttcttcaggaaaggggtcgccggcgactgggtgaaccacatgacgccggagatggcgacgcggctggatgaggttgtccgtgacaagttccgcggcacggcgctcgcggctccatgatcgggacacgtcgcgtgcgtgtgggtaaattaagcgaggcaatcagcatgcgtgattcgcttgtactgtatgcttggctgctggtacctgtcgatttaaaataagagatggtgttctcggcaaaactaaaaaaaaaaaaaaaa

SEQ ID NO: 17419 - DNA, 679 bp, Triticum aestivum
  unsure (1)..(679): unsure at all n locations
  Clone ID: PAT_TA_17419
ctcgtgcctgattcggaaacttccgggccgacgttggccggctcatcgatcgaaccttcgtcgacgtgcgtgcgtacttgcgccatggccgccgtcgtcgcgttgggtgacgtggatgatctcgacttcgacttgggttttatggacgggttcgagttcgacttgctggacatggacctcaccgagttctgcgacggcgacggcgagtgcttgctgcctgccgtggccgataaggatggcggtttgggtttggatccgggttctcgtgatggtggcgacggggggagggagagctcgccggactccgtggtgacggacgacggcgcgccgcctctgtcgttgagtcgcctggggatcgcgacgatggcgggatgtcgacctacgcgggcgagctggagaggttcctcatggaggacgacgatggcggggacgccggcgggccgctcgatctgaaggagcctgccgcggacgactacttcttgggtgatctcgacggccgttacgtcgagccggcgactccagcgaaggatctcgtcctcgacgactacttcttgngcgatctcgtctcgtacgactacttctacgatcttgctgctgcggacgatgctgcatcaccggcgacggagggaggaggatgattctgctcgcgaggacgactactacgaagcgacctcgagga

SEQ ID NO: 17420 - DNA, 2263 bp, Triticum aestivum
  Clone ID: PAT_TA_17420
ggcaggtgcgtcggcccgtgggctgtcggccgcgtgctcttggttgccgcaccgcgcgtattctgcggccgtcgccgcccctcctgctgaggggccggttccggtgcgcgcgctcttccgccccgtcctgctggcgggcctcgggacggcctctgtgagcccccgcgtgcagcgcaccccggggctcgtggaggtcctcctcgacccaactggagcggtcctggagtcagatatccgtggcaggatgcaggagttgaatgatcggctaatcggggcaatcaatcatccgcacaaagtcgcagcggttcatgtggttgtagccatatgccgaggctttcggcaccgtgtggggcaggatgtcttgagtctcctgggaaaccgcagcggccgccaggcctggtacaaaggcgcgagagttgcagtgtcggtgctcgatgacacatttgcatcccagatgcagcagttgctcggcaacacgctccagcagaaggagctggagccgcctaggtccatcatggaagtgaggtcaattctctgcaaagacgctccccgtcagaagaattcaggcttctactattgatcattttgttgtgtacctcggccgccgccatcctgtgtgcatctttgtaaaggatgaaagagactaggtggagctgtggcgttgtgcgtctggtgaaatacatgagctaagagtccgcaatagtagatcgggcctggggagccagacaagaatttggtcccctcgaatgtgcgctgtgctgaatgtggggttgaggtaatgtccctgttgcctctgggctgggtctgattgcgcaaacacgaagaacgacttgggcaggaggattggatcctctggaagcttctatcttggtgagataccacaaggcatatgacgacaccttttgtggatgagatgtatgatttactgaagaacacattgacggagtatgaggttatcatttgccgatggccagaatacatatttgttcttgagaatgctattgcagatatcgagaaagcggtaatcgactccctcgaaaagcagtatgtggatattttggccccacttaaagattgtatcgccccaaaaaaatttggcctcaaatatgtacaaaagctagcaaagcgcaattcaacgtgcccttatgttgtacctgaagatctagggatcctcttgaacacaatgaaaagactattggatgttctgcggccgcggatcgagagccatctgaggtcctggagttcctgtatacctcatggaggaaattcagctgccatcggcgaaagacttagtgaggttacagtaacattgagggcgaaattcagaaactacatgcaagcagtcgtcgagaagttgtctgagaatacccgcatgcagaacaccacaaagctcaagaagatcatccaagactcaaaaggattggtcctggagtcagatatccgcggcaggatgcaggagttgaatgatcagctaattggggcaataaatcatatgcacaaagtctcagaagttcatgtgtttgtagccatatgccgaggcttttgggaccgtatggggcaggatgtcttgagtttcctggaaaaccgcaaagagaacaaggcctggtacaaaggcgcgagagttgcagtgtcggtgctcgatgatacatttgcatcccagatgcagcagttgcttggcaacacactccagcaaaaggagctggagccgcctaggtccatcatggaagtgaggtcaattctctgcaaagacgctccccgacagaagaattcgggcttctactattgatcattttgttctgtacatatcaatgcgcattagaatgtgcagcttagaaatggtgaaatggccggagcgatgatgtggagatctttgtaaagaagacaagacaatggaatagtaagaaatagaaaatagggctactggtgaaatacatgagctgagaagccgcaaaatagcgctttgctggttaaccgggttaaaatatgttcccattgcctgtgggatggggctgaatgcggagactggttgtacttcatagggagtagtgtaagtttcactggtagcacctagctagctgagatttcacaattactaatattgatttttgaacatgttgactggattatattgatttcgtatcttgctaagagcctaagatgctaaggggcaaccttttgatggtcatcggttcatcaatgtgtttggagaggtaaatgaaacatggtgtgaagttcatgtcttccgctcgcgtggcaaaaaaaa

SEQ ID NO: 17421 - DNA, 612 bp, Triticum aestivum
  unsure (1)..(612): unsure at all n locations
  Clone ID: PAT_TA_17421
gtggagcttccgtctcttcagcttttgtcggatgggttttgcagaaagatggtattaagcaagctaggaaaatgtataagagatttttggctttaccgcgccccagtcttaagttcttccagttctgcatagagctggaagctagccttgcatcaatcggaaacaatgatggccttgtaaacgcgcgcaagctctatgattcagcaatcagcctctatccacaagaaagggaactatggaggaagtactacaatatggagttgacggcgggaacatcagaaacatcaaatgctatctactggcgcgcccgcaaggtgctcaatgactccaccgcgctcgacattccccgtagttagcaacctgtcctcatgtgtaccatgtaataccatttttgattgtattgattcgtctgttgctataggcatatgtaagtcagacttgacataagttttggcttttctttttttgtccgtccgaagaattttatgtgctcgtgggatgttccgagtaaactggaatagcttgtatttgcgaaaacagtcaatctatcagcagcagaggctgcagatacatgtccaccacctgtttatctactacaaattgttgcgngga

SEQ ID NO: 17422 - DNA, 1365 bp, Triticum aestivum
  Clone ID: PAT_TA_17422
gccggcctgagtgcgaactcaataaaaaaaattcctcccctcgtcgtcctcgctgccgtcgctcagtgcctcccccggcgcttcctcccctctccctctctctatccccctctctctctgctaatctgagttcctcgttgagaagaggaaccgaggggcgcggcagcggccccgcccgtgatggtcgcccgccgcgctctgtggcggacgcggacatgcacagctcctccccctcctccgccgccgtcgcgtattcttcctcgtctccatcacacctctccccagcagacggcttcctctgcgtgaaggagggggtcgacgagatgatcaagcacgtcgctaatgagccctccctcgggctctacttcgtccagcagcacgctcaggcatccatgcccatcctccttgacgtcaagggcaaggttacagaaaagactcgtgagataacattacacactgaagatatagaggattctatttgtgctgtgaggtccatggctgagtttggacttccaattgctgatgatatgataaaggacataaataaatctctaaagataatgtcgaagacccaaccaaagaaggggttaatccagaaccccatttgggggttccaatcagacaaaagctcggaagcatggaacgacttggacacaactaatggtggaagtagcaagaactatttgtcttccatgttgaacaccgcaaagcaaaaggcatcgagtctcagatggccacagactgatttcgctatgaacgatggcgttagtgagaagtcagtgtcatctacagctcaagagtcgtcacaagccggaggacatggtgcgtcaacaccctcggatgcagaaagggacgaagtctccatttcaagccgattgttggaaaataaaaatgcaggtactatgaaccagggcctgtctgcttctgatatctcccacacggcggagagctacaacaagttcaaagaagaacaggaactgaaactgcaagagtggctcagggagtcgaaagaagctgacgataatagaggttgagactgttgtaccagctccggtgtttccaccgctgtcggagcacgtcagaaatgaaaaacatgtccaaaccttggaatatgtttatgaccacagatctttttgtattgatgatgagtgtacatgtgcggcgtctctgtaaacattcgtgttcactttgcagctgttacattgatattcacaaggcagagagatctctctcaagtgtattgttgtataacagcctgaattacagcagaacatgtttgctattgtacttgggagcttggaagtggtttttatatataaactgatgtgccatatcggtggccgtccatcttgcgccgagattttt

SEQ ID NO: 17423 - DNA, 659 bp, Triticum aestivum
  unsure (1)..(659): unsure at all n locations
  Clone ID: PAT_TA_17423
gaacaacagtttcgccactttcttaatcatcatgcatcatccccggtcttccctcgggccttgtttgttttttttaaagatgaaaaaaagaagacaatatatatgaaagatacatattacatagccacatggtagcacaaatacacacatctcccatacacatgtcatttatttattccccaaacataggtatagtagcagaacaccacccttacccacatctccccatacataattcacactcggagtatgtctcgagagagaaagcaaccatgacgtacctcgttccaacattcatatttccttagggtcccatggatggaagagttgatcaagtagcttcaagcaggaaccactgatggcctcatacagagagggtaggtacaatagcaaccaggggtgtagcacggactaatataacatgtttccctgccgcaactgcggccttctaccggtgtttccagaatgaggcgttcaattgctatctttcctgtgcgcgccatctcctccagagccggcggtaagcgggccatggcatcggagctgccatgagcactgcagaacacaatgcagcacccacacccgagtacctctctgccatctcatctcgtgcaccccgcccgccggcgccgtgtcggtgccgcggcgcttgnggcggn

SEQ ID NO: 17424 - DNA, 1017 bp, Triticum aestivum
  unsure (1)..(1017): unsure at all n locations
  Clone ID: PAT_TA_17424
actgcgacgccccctacaagctccgcctcaccgcttcggcgacatgaccgcggacgagttccgccgcgcctacgcctcctccnnnnnnnnnnnnnnnnnnnnnnnnnnccgcgtctctcaccaccgcatgttcagccgtaaggagggcgatggcggcttcatgcacgggagcgctcgggacgtgccgccttcggtggactggcggcagaagggcgcggtgaccgccgtcaaggaccaggggcagtgcggcagctgctgggctttctccacgatcgcggccgtggagggcgtcaacgcgatccgcaccaagaacctcacgtctctgtccgagcagcagctcgtggactgcgacaccaagtccaacgccggctgcaacggcggcctcatggactacgccttccagtacatcgccaagcacggcggggtcgccgccgaggacgcgtacccctacaaggcccggcaggcctcctcctgcaacaagaagccgtccgccgtggtcaccatcgacgggtacgaggacgtgccggccaacgacgagacggcgctgaagaaggcggtggccgcgcagccggtggccgtggccatcgaggctagcgggtcgcacttccagttctactcggagggggtgtttgcgggcaagtgcgggacggagctggaccatggcgtgacggcggtggggtacggcgccaccgtggacggcaccaagtactggatcgtgaagaactcgtgggggccggagtggggcgaaaaggggtacatccgcatgaagcgcgatgtgaaagacaaggaggggctctgcggcatcgccatggaggcgtcctaccccgtcaagacctcagccaacccgaagcatgccagtgccaatgacgagctctgaatctctcatcgattgtcttacaaattattggccccaatatgcatgatcagggcattatcgctagggaaaaaaataagtagtcaatcgttatgcacccatcacatatagtgcactactacttaattgtttgtactagtaac

SEQ ID NO: 17425 - DNA, 1375 bp, Triticum aestivum
  Clone ID: PAT_TA_17425
ctcgtaagccagctagcatacactcccgactgtccactcatcaatggcgagagcgatcgtgcttgcggccaccatggccgcggccgcgctgttcatgctgctagcccatgcgccggcgccggcgagcgccatggacttcggcgaacacgacttggcgtcggaggactccctttgggcgctgtacgagcgctggcgggagcggcacacggtggcgcgcgacctcggcgagaaggcccgccgcttcaacgtcttcagggagaacgtccgcctcatccacgagttcaaccgcggcgacgccccctacaagctccgcctcaaccgcttcggcgacatgaccgccgacgagttccgccgcgcctacgcctcctcccgtgtctcccaccaccgcatgttcagccgtaaggagggtggcggcggcttcatgcacgggagcgctcgggacgtgccgccttcggtggactggcggcagaagggcgcggtgaccgccgtgaaggaccagggacagtgcggcagctgctgggctttctcgacgatcgcggccgtggagggcgtcaacgcgatccgcaccaagaacctcacgtctctgtccgagcagcagctcgtggactgcgacaccaagtccaacgccgggctgcaacggcggcctcatggactacgccttccagtacatcgccaagcacggcggggtggccgccgaggacgcgtacccctacaaggcccggcaggcctcctcctgcaacaagaagccgtctgccgtggtcaccatcgacgggtacgaggacgttccggccaacgacgaagcggcgctgaagaaggcggtggccgcgcagccggtggctgtggccatcgaggctagcgggtcgcacttccagttctactcggagggggtgttcgcgggcaagtgcgggaccgagctggaccatggcgtgacggcggtggggtacggcgccaccgtggacggcaccaagtactggatcgtgaagaactcgtgggggccggagtggggcgagaaggggtacatccgcatgaagcgcgatgtggaagacaaggaggggctctgcggcatcgccatggaggcatcctaccccgtcaagacctcagccaacccgaagcatgccggtgcccatgacgagctctgaagtctgaatctctcatcgattatctaactaattattggcccctaatatgcatgatcagggcattatcgcaagggaaaaataaataaacaatcaattgatatgtacccatcacatacaatgcactactatttaattgtttgcatacatgtactgcggtttcgaccgatttgtatctaaacggtttacattatatatcctgtcattttttttgtgaaaaaaaaaaaaaaaaaaaaaaa

SEQ ID NO: 17426 - DNA, 289 bp, Triticum aestivum
  Clone ID: PAT_TA_17426
tttttttttttttgcttttcggccgaaatgcagttttattcccggcaagactgagcttcaatggcgaatcagagttcacaaatggtgttcgagggcaagtaaccaccccccacacaagttacagaaccgacccaagcacgatgagatgaactactttttaggctctaaattagacacacacgacgaatccaacgaagaacgcgcatgcagatggaagcatataattttcctatgcttcgatgtgcatgctccacgtcatggtgaagctcttcccgagcggcaaggccag

SEQ ID NO: 17427 - DNA, 1833 bp, Triticum aestivum
  Clone ID: PAT_TA_17427
gcagctgtgtctggacgtcatggctcttgaagcagcgtaccactacctgcagcgcgccgtcggccatggcacatccacagaagcactactactcaccgttctcctgctactcatcatccgagtagcatgggtaagagccttcaccaccaccaccgcatcgacaaaatgcaagcagcagctcccgcctacacctccaggcaagctgcccatcatcggccacctccacctcatcggctcccaccaccacgtatccttccgccacgtcgcagcaaagcacggccacgacggcctcatggtcgtccacgtcggtgcggtgcccatcgtcgtggtgtcgacaccggccgccggcggggccgtcgtgggcacacacgaccccatggtcgcgtccgggccacggcaccccgacgccgacttcatccgctacaactccactgacatcgcattcgcgccctacggcgactactggcgtagggctaggaaggtcgtcaacacgcatctgctcagcgtcaagatggtctactccaagcgccatgaccgcgaagaggaggtgcggctcgtggtcgccaagatctgtgagttggccatggccgctccaggcaaggcgttggacatgacggagctcctgggcgggtatgccagcgactttgtgtgccgtgcggtcctcggagagtcccacaggaagcatggccggaacgagcttttccgcgagctcaccgagatcagcgcctccctgctggggggattcaacctggaggactacttccctaggttggcaaacctggacgtgttcctcagggtggtttgctccaaggcaatgggagtcagcaagaggtgggacaacctgtttaacgagctcatcgccgagtacgaacacggcaaggaagataatgcggaagactttgtacatcttttgctttctctaaagaaagagtacggtctgtccacagataacgtcaaggccatcttggtgaacatgtttgaggcagctatagaaacatcattcctggtgctggaatactccatggccgagctcatcaacaacaggcacgtcatggccaaagtgcagaaggaggtaagggagtccacacccaagggcgaaaagctggacctgataatggaggaggacctcagccgcatgccgtacctcaaggcgaccatcaaggaggcaatgcgcatacacccgccggcacccttcctgctcccacacttctccaccaacgactgcgaggtcaacggatacaccattcccgcggggacacgtgtcattgtgaatgcttgggctcttgccagagacccgtcgcactgggagagagcggaggagttctacccggagaggtttctccaagaaggccgtgatgcagaggtcgacatgtatggtaaagatatccgctttgtgccttttggtgccgggcggaggatctgcgcgggagctactttcgcgatcgctactgttgaggtaatgctggcaaacctcatataccatttcgactgggagcttccgagtgagatggaggccattggcgcaaaggttgatatgacggaccagtttgggatgacgcttcgccgaacggagaggcttcaccttgttcccaaaatttacaaataagtatcaacatcgtagctttgtgttatttgtatcggctgataggtcagctagccattgcccgttatgttagctgcctattactatcccaccttaatgtagtcgtgttgcatgctttgggagtttgttgcacatgagaggaacctgtgggatcctctacaaatgtaacagcgaataatgaagaaaagtatggttgtatggtagatcaaaaaaaaaaaaaaaaaaaaaaa

SEQ ID NO: 17428 - DNA, 1145 bp, Triticum aestivum
  unsure (1)..(1145): unsure at all n locations
  Clone ID: PAT_TA_17428
gtgggccgcccctcgaggccgccggccgggccgggaaaccacctaacgaaacacaagccaaaacaagcagctcaaccttacacacacagatctagagatggccggaggagatgacttgaagctgctcggcgcttgggcgagtccatttgtcgccagggtgaagcttgcgctgagcttcaagggcctgagcttcgaggatgtcgaggaggacctcagcaacaagagcgagctcctcctcagctcgaacccggtgcacaagaaggtgcccgtgctcgtccacaacgggaaacccatttgcgagtcaatgatcatcgttcagtacatcgatgaggcgttccttgtcggcccctctcttcttccctctgacccctacgaacgcgcaattgcccgtttttgggccgcctacattgacgataagctcgtcaccccatgggtacagtcgttgagggccaagacagaggaggagaagtctgagggggttaagcagacatttgccgcggtggaaacactggaaggagccctgagggagtgctccaagggagagggctactttggtggtgagaccgtcgggcttgtggacatttcacttgggagcctgctctcctggttgattgcgacagaagtgatgtctggaaccaagatctttgatcctgttaagactccactcctggcagcgtggatggggcgctttagcgagctcgacgctgccaaggcggcgttgccagaagttgatagggtggtcgaatttgccaagaagagacaggcacaggctgatgccgccgccgctgcttcggagaccaagtaaacgtcatggaaacataagtcccattgaataaaaaagagtgcatgttttctatatagcatatatgattgttgtttgtatatcgattcttgatgtaatggtgccagggaaaattagtgcatgtgatattttgtgaaggttttaagatcatttgtaatattttgtaaagttttaacatcatttagtacttgtattcttttggtggaattcgtgcccgncggcagagcattcaancgtgtcggtcaacatgctcttcacctttcgtcatcgcgcaggcgtttcctcaccatgctctgccacatgnagttcggcctcttctaacttcttcggccggntggggngg

SEQ ID NO: 17429 - DNA, 364 bp, Triticum aestivum
  Clone ID: PAT_TA_17429
tccccacgcgtccgggaggaaggacaacagagaaagaagagccatggagcactcctacagcagcaactacggcagcacaaaggagaggaggcctgcgctgaagagggggcagctgaagcggcagatcgtgaggaccatcagcaacctcatggcgccgaggaacgacggcgccggcgcggacaagagggcgtcaggccgcaccagcttcggcgcctacaactgaacctctcaaagacgccatcgagtgtctgtcagcttagcttttcgtttttacttggtagcttcatactgggttttcttcccaagtcttctccccggattgtacagagttctgcgattgtacagatgaatagagaggttatgt

SEQ ID NO: 17430 - DNA, 571 bp, Triticum aestivum
  unsure (1)..(571): unsure at all n locations
  Clone ID: PAT_TA_17430
cccnacgcgtccgagcaaagggaccaaacacaacacacacacacacacaagaagaagaagaagaagaagaagaaggagcacaacacaggtgggagccatggagcactcctacagcagcagcggcggcatcagcaactacggcggcgcaaaggagaagaggcccccgctgaagagggggcagctgaagcggcaaatcgtcaggaccatcagcaacctcgtgctgccaaggagcgacggcatggccgcggagaagcgggcatcgggtcgcaccagcttcggcgcctacaactgaacctctccaagtccaaaccacatccgtcgtcagtcaagtcaaggctctagaccggtacaagaagaaatgcttctacctacttgctgtacatgttaagttcccccctttccttcagaccttccataggtttccaactagctgagaggccgcttaatactagggtttttgagtgttgttttgggttgtgtttgtgtaagaaggaatagagaggttatgtaagtttcgaaaaaaaaaaaaaaaaaaaggcccctatgggatgtgtattacttggttattaca

SEQ ID NO: 17431 - DNA, 938 bp, Triticum aestivum
  unsure (1)..(938): unsure at all n locations
  Clone ID: PAT_TA_17431
gccggccgggctgggacattaagcaaggaagcaagcacaacacacacacactcagaagaagaagaagaagaaggacaacacaggtggtggagccatggagcactcctacagcagcaacagcggcatcagcaactacggcagcgcgaaggagaagaggcccccgctgaagagggggcagctgaagcggcagatcgtcaggaccatcagcaacctcgtgctgccaaggagcgacggcatggccgcggagaagcgagcatcgggtcgcaccagcttcggcgcctacaactgaacctctcccaagtccaaaccacatcggtcgtcagtcaaggctctagagcggtacaagcgaaaccctaaacccccgtattcccaaaccttcgatccgatccgatccgacccgaccggcggcgatggcgtctgcgccggtggagaagctcaagagcctgtggaactcccaggtcatggacgaggagcagtgggcggtcaactatagagtgctaaaggctgcggggatatttgctggatccatctttttgatgtgcacctttggtgacatgatggtagtttaagggagtcgtagtggctgagcagggtaatggtggttccatgcccattttcgttgtgtgccttatgatcaggcttgtggaatatttttactcagacttgtgggtttcttgttaaggtggtgtttgaagcatttctcggcagggttatttgacttgttctttttgagttgagcacttgtcttctatgagtaataagtaaaatgtccagtttgctgttaggtcgccacaaatctacggttgtgttaaaattaacagtctaatttcattgtttagatggaatgctttgattctaaaannnnnnnnnnnnnnnnnnnnnnnnnnnnnnnnnnnnnnnnnnnnnnnnnnnnnnnnnnnnnnnnnnnnnnnnnnnnn

SEQ ID NO: 17432 - DNA, 452 bp, Triticum aestivum
  Clone ID: PAT_TA_17432
gccggccgggtcgggaccacagacacactcactcacaaggagaagaagagcaaacaagaagaggaggaaagacaacagagaaagaagagccatggagcactcctacagcagcaacagcggcatcactaccaactacggcggcgcaaaggagaggaggcctgcgctgaagagggggcagctgaagcggcagatcgtgaggaccatcagcaacctcatggcgccgaggaacgacggcgcgggcgcgggcaaaggggcgtcaggctgcactagcttcggcgcctacaactgaacctctcaaagacgccatcgagtgtctgtcagattagctttttacctggtagcttcatactggtttttcttcccaagtcttcttccccgattgtacagagttctgtgattgtacagatgaatagagaggttatgtagaaaaaaaaaaaaaaaaaaggccccta

SEQ ID NO: 17433 - DNA, 505 bp, Triticum aestivum
  Clone ID: PAT_TA_17433
gtgcgccgctcgaggcggccggttcccaaccagactccactcaccataataagaagagagaaagcaagaagaggaggaaggacaacagtcaacagagaaagaagagccatggagcactcctacagcagcaacagcggcatgagcaactacggcagcacaaaggagaggaggccgccgctgaagagggggcagctgaagcggcagatcgtgaggaccatcagcaacctcatggcgccgaggaacgacggcgcgggcgcggacaagagggcatctgcaggtcgcaccagcttcggcgcctacaactgaagctcaaggcgccatcgagtgtcagatgcactcgcacggacgcccctttcttcagacctgactagttttttttacttggtagtcctagcttcatactggtttttgttcccaagtcttctcccccgattgtacagagttctgcgattgtacagatgaattgagaggttatgtgcaaaaaaaaaaaaaaaaaaggccccta

SEQ ID NO: 17434 - DNA, 1015 bp, Triticum aestivum
  Clone ID: PAT_TA_17434
tgcaggtgattcggcgcgagggcgagaaggagagaaaagcgaaaccaaaaaccaaaccctaaacagcagtattcccaaaccctcgatccaatccgatcgcagccgacccgcggcgatcgcgtgagagccggtggagaatatgaaacgcccacggaaagggcgggtagtagagggggggcaaagatggagcaacaaaagctgcgtaaaggctggggggatatgtcttggtgctacgcccgtggggggggcctctggtagcatgagggcgtcttagggacgtggcagcggctgaggagggcgaagctcgattccatggtcgtctttatcatcagccttatgatgctgcttaagactgacttgaagtcttcactgatgggggtcttggttcgtagcatttttcggcacctcctactagggctctcaaagtttatgccacagccagagtaagtcaattcaatggacgaaaacggtaaaagaagaaatgcttctacctacttgctgtacatgttaagttcccttctttccttcagaccttccataggtttccaactagctgagaggccgcttaatactagggtttttgagtgttgctttgggttgtgtttgtgtaagaaggaatagagaggttatgtaagtttccatatgtgatgtgtattactctgttattttgaagcattgctcggccgggctatgtgactggccttttgtaggtgagcacttagtctcctatggccatcccaagcgcagagccgccccgccggtttccaccaagaacagcgcccctgccccgaagtaccggtcccccaaaagcaactcgtcgtctcccccaacttcccccgccgccgccgcttgcctggcctcttccacgtgttccacccgtccatcgggcccctagggccgcggcaccgccgccatgcgcccccccctgcagaccccggggccgccacggggagttgcggtgggccgcgtcccggcgccgccgcgtagccggcctgccctgcctccgctgcgcttt

SEQ ID NO: 17435 - DNA, 416 bp, Triticum aestivum
  Clone ID: PAT_TA_17435
ttacagtaagaattgtgcaagtgtttggcgaggagtatttgagatctcccactgctgaagacaccgcaaggctattggcgatgaacaaagcgcgcgacttttctggcatgcttggctcaatagattgcatgcattggagttggaagaattgtccaaaggcatggcatgggcaattccacggccaaaaagaggttccactataatccttgaagcggtggccgattaggagacttggatttggcatgcattctttggaatgcctggatctttgactgacattaatgttgtcaaccggtcaccactgatgaataagattgcaaacggtgagttgccaccggtgcagtttgtagcaaatggccgtacgtacaattatggctattatctagtggatgggatctatccaaaatggcaaacct

SEQ ID NO: 17436 - DNA, 890 bp, Triticum aestivum
  unsure (1)..(890): unsure at all n locations
  Clone ID: PAT_TA_17436
cggccgctcgagccggcgggccggggctctgccacatccttacatccagccggcgcatccactcttggtcaccagccccgtctcgagtccgtcgacgtccacgggcggcatggcggcgagcaagggcgcgaggaagagcctggtgtcgaggacgctggagcgatgccggtctgggctgaacagcggtggcaggtcggcggcggcggtggcgccggggtgcttctcggtgtacgtgggcccggagcgggagcggtttgtcgtgcgcgccgaccgcgccaaccacccgctcttccggcgcctcctcgacgacgccgagcaggagtacggctacgcggcgcaggggcccctcgcgctgccctgcgccgtcgacgccttcctcgacgtgctctggcacatggaccacgacgtccaggacgacgacgacagcgaggcaaccgtggccccgtcgacgccgatatgcgggctgcagcgcgccggcagtgggaacatcaaggtccggccggcggggtaccgggtgctcagcccggccaagtccacgccggcgtccttcttcttctcgcagacggcggctggcggtaggaggtgagctataggcgcgcagctagctagctccagcgggtgcatgcagaagagagaggaatctgcgcgcgcatacacagatcgagcaagtttttaagttgcatatacttagacacatcaacccttcgctcacgccaagctgatttacattgcatgagtgccagccaagagcctctaccccgggcatgctgcggggcccgggtgcccgatctctcgtggaccggttcatggaatcaaantgggnttngccccccaatttngacccaggnaaaaanaaaaanncccaggggggcngntnccaatcccccaaa

SEQ ID NO: 17437 - DNA, 797 bp, Triticum aestivum
  unsure (1)..(797): unsure at all n locations
  Clone ID: PAT_TA_17437
cgagcgacgattcaggcagcccntatgccccattacaatggcaatgaaggtgttgcgttgctcgaagaagtaaaccttctgctcttcagattagctgagggggaggctctgcttccctccttgaagcttgtctagtagtcttaagaacatctaatagtccttcattacaaactttgtagaacatttagtctgacgagcgatgattcaggcagcctctttaccgttacagtggcattggaggtgttgcgttgctcggagagtgaaccttttgctcttcagattagctgagggggaggctctggcttccctccctgaagctggtctagtagtcttaagaacatcattatcagtatgtttctcatacccaatttgattttgatttttgtgctggtgaaatggttgttcaattctctggttggtgatccatgaaaacaaatgatgatagcaagacagggacatcagaaccctgaatttcagggttatgacagactacgtctataatgggaatctctctgatgttttcgctttcccnaagttaaattgatctgcttctctccctttccacctttcttctccggaattccgggccccctcccgttccctgctcagctcttgcttggctgggctctgcccaggctcggccggttggcccccgagcacagcttgggaggtccagctgttacacaattggcaactgaagctatacaggaacaatgaacatgttcaacgacccaaggcttccagatggccctttctgactgaaggaagcaaaacaacnatgtaaaaaaacataaata

SEQ ID NO: 17438 - DNA, 695 bp, Triticum aestivum
  Clone ID: PAT_TA_17438
cggccgcccaggcggccgggcagctacctataagctcgtctatctaccaatccagcaaactagctaaaacccacttccccaaaatggcgtcccagcttgtcgagagccaccgcgccggtgccgaggtccacaaggggaacgatatctgcaagaagaagacggtcgagcttctcgaagagctcggcctcccgaaaggcctctttcctatggatgacatcgaggaggtcgggcacaactgtgagagtgggttcgtgtggatacttcagaagaaggagaaagagcacacgttcaacaagctcaaccagaccgtctcctacgacactgaggtgaccgcttttgtggaaaagggcaagatgaagaaggtcaccggggtcaagatcgaggacctgtctttggtcgaggtctatgtggatgagtcttctgctgataaggttaccatcaagaccgacaccggtctgtctgacacccatgatgcggccgtgttcgctctcggagaatagggagctactagttaaaaaggcgagaagaataaagtcagtgaatggtttggcactatggttcacatgttatgcagaagtatatctttccgttttctatgtaatctaataaagaggctgctgcacaaatgttgcttcctttcagcccatagtgttcaccaaatgaatgaataacacttatacccccacctgtatcac

SEQ ID NO: 17439 - DNA, 1371 bp, Triticum aestivum
  unsure (1)..(1371): unsure at all n locations
  Clone ID: PAT_TA_17439
ctcgtctcaatccacaactagctaaaccccttccccaaatggcgtcccagcttgtcgagagccaccgcgccggtgccgaggtccacaaggggaacgatatctgcaagaagaagacggtcgagcttctcgaagagctcggcctcccgaaggcctctttcctatggatgacatcgaggaggtcgggcacaactgtgagagtgggttcgtgtggatacttanaaagaataagaaagagcacatgttcaacaagctcaaccagaccgtcttctacgacactgaggtgaccgcttttgtggaaaagggcaagatgaagaaggtcaccggggtcaaggtcgaggagttttctttggtccgtgcgccgctcgaggcggcgggcgggtccgtccacaagctcatctaccaatccacaaacctagaaaacccacttcccaagcaaacaattcccagctaagaaggtgctacccactgcacccaagtagcgccccagccggcgggcaaatggcgtcccagctggttgagagccaccgtgccggcgaccgaggccacaagggggaacgatatctgcaagaagaagaccgtcgcttcggctcgaagtgcttggcctcccgaaaggcctctttcctatggatgacatcgaggaggtcgggcacaactgtgagagtgggttcgtgtggatacttcaaaagaagaagaaagagcacacgttcaacacaccgaggtgaccgctttgtgagaaagtgaggtgacaagtgggggggggcaagaggagagtccttgggggtgatagatgttttctcgctaagactaccaacaaggtcttcccggcatctgacgccatgatgacccctgttgccctacgcgattagggagctattatggccaggggaataaggaaaagaagctcaaccagaccgtctcctacgacactgaggtgaccgcttttgtggaaaagggcaagatgaagaaggtcaccggggtcaaggtcgaggagttttctttggtcgaggtctatgtggatgagtcttctgctgataaggtcaccatcaagaccgacaccggtctgtctgacacccatgatgcggccgtgttcgctctcggagaatagggagctactagttaaaaaggccagaagaataaagtcagtgaatggttcggcactgcagttcacatgttatgcagaagtatatgtttccgttttctttgtaatctaataaaggctgttgcatgaatgttgcttcctttcagcccatgttatgcagaaatttatgtttctgttttctttgtaatgtaataaaggatgttgcatgaatgttgcttcctttcagcctgtaagcgtacaccaaatgtaatgaataacacttataccgcact

SEQ ID NO: 17440 - DNA, 787 bp, Triticum aestivum
  Clone ID: PAT_TA_17440
tcggcacgcccctgcattgtaatgtgcagagaggactagaaggcgtccgcccggctctgctgaccaacctccacttcagaatttcctcttccagatcacgggattttctccctcctcttcttccgtcattcttcgtcgctggcatagaatcttgtccccattctcgccggtttatttcttcgtaggagggattgaattggctatgcctagcacaaatgctggtgtccgggagaagacgactgctcgtcctgtgcacaagctttgtgattctttcgcttctcacgctgccgtccgatggctcgtcgaattccacggaggatcccgatcaaagccgcaacaagaccgggcatcctctcgagttgacgcctagaacagcatttcagctcaagctacacgcattgttccactggtcttctttcggtctcttgatgcctgtggggatattgctggtcaggatgtcgagcaaatcaaaaagcggcagatgcagcagaggccccctctggcgccttgtcccttctcccggcgcgccccgccttcgcccggcgggcggcgcggctccgtccttcccgtacttcgggcactccgtcagtttcagtcaccagtcagtaggattggcattgtatggattcatgtggcttcagccaatcatcggtttcttcagaccagaaagaggtgtcaagggaaggagcctgtggttcttcttccactggctcctcgggatcgcagtttgcgccactggcatcgcaaatgtctactctggcctccgcacgtaccacaagagaactgc

SEQ ID NO: 17441 - DNA, 1041 bp, Triticum aestivum
  Clone ID: PAT_TA_17441
gccggccgggcccgggacaccacaaaacaatcaagcaatactgattccatttcagccaccacaatgcgctacaccactgttcccatccttttcaacctccttctctcatccacgtccctcgccgcacccaacgaaccctgctatggccccagcggcatcgcaggtgtctgtatcaccgacgcagcctgcagttccgccggcggtacctccatctctggtgcgtgtcccgccgatacagcgaacatcaaatgctgttccaagcccaagtgctcctctggaaactgccgctggacgtctgactgtgctggcacctcagcagccggtcagtgtcctggtccatctcagatgaaatgctgctcatctgccgctactggctttggagggtactctgcgccaacgatcccagctgtgggagcttgcaaggcggtttctgtcaatgcggccaagaaggtcgttgctgcgttccctggaagaatcagggagatcggatgcaagagagactgctcttgtcctggaagttcagaccattgctgtggtctcgcaaccgactttatgtgttctgatggcggcggttctgctacactttccgggaaggagattgccgagtggtgcatgaagaaccgtagtgctctcaacctcaagtacgtcatctggggacaaaagatttggactacttctgtagacaagacagaagaaaagtgggagaactggcgaaccatggagaagcgagacggcttgacccaaaaccactgggatcatgtccatgtctcatacaatggatagaagcagacagttattgggcattacgtcaagacacgaatagttgtgtctagtcgtgacagttgagagaagtgacatgagtggtatgcagtatggtatcgtggccagtacttttctggttcaacacttcgtaatctatgttttaactttttacgcttcgtctcatggtatcatctaacgctgtccccaaaacgccaactactggtggcaatagatactataacccaaaaaaagtaaaaaaaaaaaaaaaaaaggccccta

SEQ ID NO: 17442 - DNA, 1255 bp, Triticum aestivum
  Clone ID: PAT_TA_17442
gctcagcaatttcagcatgttgatgccgtttctagctcagacatctcaaactacacgtcctgttgcgagttgttttgggctgaatcgctgccacccggcgcggaatttcggccgatattgtagatggtggggggcaagaagcaaggcaattcattcccctcgcagcatatttgggcccactaatggcgctccatctagtgatattgtgaagaaaagaaagatagtggagcacattattctgctcagagccaagccaaacatctcagatgctgaagaaaaggacatgcttgattacttatatacatctcagtatcagatgagagggatactcactgtgtcattaggccgcatagagggccctaacagcgagagcttcacgcatgctgtcttcatgcgtttccaacagaaagaagacattgcaaagttccagagtagctcctactattccaaagttctcgacgagcacgtcaaacccgtttcctatggcttggtttctgtagattttgagtctgaggtggaagatgacattatccctctctttcggaggggcgaggatttcaactacggtgtcgagtttatgttgttgatatctttcttggagactgcatccagagagtctgtggaggatgcattagcccatcttcaaaagctgatcatccactacagttctttcattgttcaggcaacgtcaggttgctgtctggatcatatggatggtctgtacagtcacgctgcagttatccgttttccatcaattgacgacttcaaattattcaaggagagcacggaatacaaggatatgtggacatccaaatttcatccggttaccgagagatgtctcgagctgcattttgtcgtcgacccggtcggcaaccagctgatgtagattctgagcccttgtgctctgaaactgaacctgaaatggaaccttgccacatccgaaagagagttcttgtgttagtgtgctgtgtatatcatttcatttttcttcggcttgggtgatcttctgcccatgtccagattgggctccacgaggcagtgactgatgagcgatgttgtaaggtctatcttcttgttcagcacggatgaatgtgtacaatgttataagaaaaatggatgtgtgtagtcggatatccagtagggctctagggagcattggctcctgcacgccaaaaaacatttttgcaaatgccaaaaaaaaaaaaaatactaaaataaaataaaaatgtagtattttctagttctagtagcgcgc

SEQ ID NO: 17443 - DNA, 1187 bp, Triticum aestivum
  unsure (1)..(1187): unsure at all n locations
  Clone ID: PAT_TA_17443
gttttaggtctcaaggctttgagctagaagagaagttccgaaaaagccaagaagaactagaacaaaaaaatcttgagttatctaagctgagagaggagcttgaaggcttggaaggtggtgaaactggtggtgcgagaggataccaatttagagaagatctagaggacaatgaatctgagacagatatactgaagactagagtccagctacaacagcaggaaaatgatgacttgcggcgctacaaagtcgaaacggaaaatttgatgtctgaaattcaggcagagaagagtctgttagaggaacgcttggcagcatcagttaaagaaagtagcatcacttccaaatgccgggcgcgtgggcagcaagacattttggtgctttctagcagcatagattcccatgtgtctgctaataaggttcttgaaagaaagataaatgaactcgagagctgcaaagcagaactagagttacatatatcagagcttgaacaggaaaatatagagttatcagaacgcatatctggactggaagcccaattatcttacattacaaatgaaaaggagtcaagtgagctgcagatgcacgactcaaaatcccttgtcatcagtctcaaagataaagtagagcgacaacaagtagagatggatactcaaagggttgagtttaaacaaaaacagcaagaaacgcaaagaaaactgtcggaagcacaggacgattcagaagttctgagaaagatctaattctaatctgcaatctcagttgagaccttattgaagagngcagttcccttcaaaatctgctgnagatctcaagaanaaaaagttggaattgctgggccgtttatcaacaagagcaggaattggttactntaaaaanggtccttgtttttnaaacagntgggttctanaaacaagcttnttnttttaaaaggactatnttccaagacaacattgttgnanactggggngnttttccgggccccccnncaggaaaaanntaacccggctttttttnttaataaaancnaaaaaaaaactttngggnnnnaatttgaggggggnggggccnnntncnggntntncccccnggggnnnnaaancccnnnnnnccncngggggntttnnnnngncnnaangcnncttgggtnnttnaaannnnggnnnnnnnaanttnnnnnnnnggggncn

SEQ ID NO: 17444 - DNA, 767 bp, Triticum aestivum
  Clone ID: PAT_TA_17444
cgaggtagatccctgttgccgccgcccctcccgcatctgctctctccttcctctctctgttgtcagccgccgctacaactcctcccttccccgtctttgtccgtgcagccgaccaacttagctccgcccggcgatcgctgcctccccagttcatcatccctcccttgccgctcttcgggcaccgggcgccccccggtccctgcaccccgtcgcctagaaccgctaggtgaagaagatggacgagcgcgagggtcggaggaggccacaaggcgacggatctagcgcgggattacgggtttcaagaccctcgtggttgacctcctcttcgcttcttcctcgtactactgcatcccttcggttctttcccctctataatgtgatgcagattacttgtgattttctgcaaaatcaacttgtcaaggagtggtgtcaatggaaggcgtgacagtcattctggtgacatatgcacatcaggtcggcaccgctgttgtcactgggcagaatggatgactggccatgggcaggctcggagccctctgcgaacaggtttgcatgttcagtcaatgggaaattggtagcaactttcctgcactttttggatgcattgctttgatagttttgcttgcggtgcctaatcaacttgtcaaggagtggtgtcaatggaagccgtgacagtcattctggtgacatatgcacatcaggtcggcaccgctgttgtcactgggcagaatggatgactggccatgggcaggctcggagccctctgc

SEQ ID NO: 17445 - DNA, 644 bp, Triticum aestivum
  Clone ID: PAT_TA_17445
ttacgggacagcagccaaccaagcaaactaccattgcacattctgcaacgaagcaaagcttaggtagagcaagagagatttgtgcgatgggaagtgggaagaagagggcggcgcttgcatccttgttcgggttcaagaacaagagacaggaggaggaagaggccacggcggcgacgcggcaacagcagcatgcggcggcaccaccgcagcagaggtaccatcatcacagggtgcggccgagcgacgacgacgactacgcccggcactggtacgccgagcgcgacatcgaccggaaggcctccgagttcatcgacaaggtccaccgccggatgctcgccaacgagcaagacggatagtacaacatgccgatggatccagccgtgtgggtggtctatctggtcgagctttgctgctagctaggtcgtgcatgcaggctatgtgtgcatggttgccttttgtgtgtgtgtgcgcgcgcgcgcgtgatcaattgctttgttttgactgggtacctgttactttgttgtttccatcttgtcggatgtgtatgtaactaactgatggtaggtattttcctaaattaacagatgcctgaaatgtatataaactaataaaaagttgagcagtatttttacccttagtgagcc

SEQ ID NO: 17446 - DNA, 778 bp, Triticum aestivum
  Clone ID: PAT_TA_17446
gcggccggagcgccccgcctgggaccctgcctcatccggggaagaccgctgtatgggcgtctcccccgatgcactcccatctccctgtaatctcatttatgaagcgaccccagcactgacacacattgacgaactggatccaacctcccacccgcgtccgctcgacagcgcaaaccatcgccttccgttggcgctggcctacaactgccaagagcctcatcccctcggctatacccaaggggcgcccgttgcatagcctggggccgcagtgcactccagtctggcctcatcatgcggggggacgccagcacagaagatccagcatcgactacctccagtagggcagtaccaactcccctgcaaaccccaacgcgcctcccagcatgggctccgacaatccaacgtttccctccattgattgcgctacccccaaccgccttgccgagatggctggggcccaccactcagccgtgccttacgacctgcccgaaaccagtgtccctcttcgcgctgttccgaagacgcttcggctctccctcctgagccctgcacgtgtgcgtagtccctctccttagcccctccctccacagtcgcagagtttctagagctatttgtttcacaccattgcttgattgcgccatctgttgaaggtgaggaacctgatgcagaaaagatcaaggatctgatgaataacattgagaagtacacactcgccagccatctcgtctggggcctctggggaataatttcggaacacgtcaatgatatcgacttcgac

SEQ ID NO: 17447 - DNA, 605 bp, Triticum aestivum
  unsure (1)..(605): unsure at all n locations
  Clone ID: PAT_TA_17447
cgaggctccacactccgattctggggaacggacgaagctaaccagcaacagcgagcgatgaggccatctactatggctcgagccctcgcggccgcggctgccatcctcgccgccgtggtctgcggcggcgcgaccccggagacgacgtgcagggcggcggcgcgcagcgacaggcgcgtggactaccacttctgcgtgtccaaggctgagccagcaccacgacaagccccgacgcccgatacgtgggggctggccaaggtggccgccgacgtcggcgtcctcatggccggcaacggcgcctacgacatcaaggccatgctcgccggaaaaaaggagcagccagcggcggcacgcgggccgctggagcagttgcgaggcgctgtacgacaggatgggctccgcgttcgccgaggcgttacgacgggattgacaanggcccgactacgcgacgggcaaggagaaggcgggcgaaggctgcgtccctcgcgcgccggttgcgccgcccgcctttcgcccggggccggcgtcccctatcccgtccccgcgggcgaggcacagcgcccccccgcccccggcgnaaaatgggcaatcntctggnaccgccc

SEQ ID NO: 17448 - DNA, 796 bp, Triticum aestivum
  Clone ID: PAT_TA_17448
tcggccgagggctcctcgttgcctatacagtacgtgtttcccttcttgtattttatggtgagcaacaggattcacaatatttttaaaatgtgcaatatgactgcacatttcttcaatcataacaggagaagatttataaataagagacctgaacattgctaaagaagaagaagatattggattttatgctggttttgttggtgcttcatatatgcttgggagagcactcacctctgtaatgtggggagttgtggctgataaatatgggaggaaaccagttcttgtaactacccttttttcagtaattatcttcaatacactctttggactcagctctagttactggatggcattaaccacaagaggtctgcttgggctgttgtctggtatgctcggaccaatgaaggcttatgcttcagaagtatgtcggaaagaacacagtcacctggcattatcactcatgtcctcctcacgtggcataggtcttattgttggaccagccattggtggttatcttgcacagcctgcagataaatatccaggcatattctctgtcaactccatatttggaaggtttctgtactttctcccttgtctttgtatatcactccttgccattgccgctgtaattgcttgcttctggcttccggaaacttttgcataaacacactgaagacacaatgttaaatagttcgactgaagctgttgaagaaccttgttctgatttaaatgctgaacaaagtggtagtgactgtctcagtttattcacaaactggccattgatgtccactcgtgc

SEQ ID NO: 17449 - DNA, 875 bp, Triticum aestivum
  Clone ID: PAT_TA_17449
tactaacagacaacgagtcctccttgctgtcagattagttttaccacacccgtgcagccaaagctagtgtgctagtaagcttaatttgggagtccaatttgggggcatttgcaaggaaaccacttctgcatccttggtccgactggaaagtgccaactactttcatagatggtcttggcgattggatgaattaccaaggggcgcagcaagcacgcaaggacttgcaagttccttgcataatcatcagagtcccaccgggaggacattttgtgttttgcttaaaccctgcggtttcccactcagcatttgcatacgcgtccacttctgcacagtgcatccgactgggaaatgccaactactttcatatatggtcatgacgattggatgaattaccaaggggcgcagcaagcacgcaaggacatgaaagttccttgcgaaatcatcagattcccacagggaggacattttgtgtttatagataaccctgtgggtttccactcggcgatcttctacgcgtgccggaaatttttatctggagatgcagaggagggtctctctcttcctgatggcttgatatctgcatgaggcgtcatctcgtgtgatctcataccgaatagtggtatgggcataaagcaaagctatacgactatagaaatgttcaatgactgctggcgtcgccaatttgtttttgtatgtatgaattctgtgaatatgtcattcatatgtgcttgcgtaccaacaacactagtgagacaattatgtttttgttgcgggtctagatataattatgtcatatgcgtaagatctccctagtcagtttttaggtcaagttactgtgagtgacgctctatattctttcagggtcaaaaaaaaaa

SEQ ID NO: 17450 - DNA, 418 bp, Triticum aestivum
  unsure (1)..(418): unsure at all n locations
  Clone ID: PAT_TA_17450
gccggcagggccgcgtcagggtcgcacggccgcagcgccgcgggcgagccgcgcgtcgcctggagggcctccggcgccgccgccgccctcgcggccgccgcgctcgttcggtggctctgagcggcgtgaatctcggtacacacgggtgaatttactgaattactagtagcagttagctgtggtagattggtgggtgtaatccaggcttcgaagaggatgtaatccaggaacttgactggntcgtgaattagtggtttggtagtactagtgctgatgcacgtgtaattatggcgaatttacggcacccttgaacagagctttgcgaggatcttttttactgctagttcatatggtgcttttttttccctttggttgcgagaatcgtgctgtgatgttttctgctggatttctgtttgct

SEQ ID NO: 17451 - DNA, 672 bp, Triticum aestivum
  Clone ID: PAT_TA_17451
gctggacatgaagcacagaataagaaaatgttggcataatcggcgcgcgggaaccatctaaggtggcagatttgaagacgagccctacaatcacattcaatttgaaaagagaagatggcacctggtttggataccgtgaggtggagaagcttgcttccttgtcaggaattcatctgcgtacgggctgcttctgtaaccctggcgcttgtgctaagtatcttggcttgtctcactcggatctagtttctaactttgaggctgggcatgtttgttgggatgataatgacgtaataaaaggaaaaccaactggtgctgtcagaatatcatttgggtacatgtccacttatcaagatgcggaggaatttctgaagtttctgcagtcttctttcgtgtctaaaccaatagcatccagtaatgggcacgcgttgagtatgaacactcttaacttactagacaatcagagtcagcaagttgttccagatgttcgctgaaagcccataattatttatcctgtgaagtcttgccaaggatttagtgtgcagagttggccactggccgctggtggcttaaaatatgacagagagtggcttcttcaaggatcaggtggtgaaattttgactcaaaaaaaggtaccagagttggcctctatccgcacattgatcaacctggaac

SEQ ID NO: 17452 - DNA, 1307 bp, Triticum aestivum
  Clone ID: PAT_TA_17452
ctttgtcgcttgctgtgctggcatttgacatccgcacgcgcacactacacccagtcttcttctccctgtcacactccacctgaccacctccctaggagaattccaaggtttgttggtcctagttggagttgaatttgcatcgagggttgacttgactggtggtatacccggcgccggagatgggcaagggcggcggctgcgtccccagcaagaagcgccagctgccgcccaccaccgttgccgccgcgccctcgtcgtcgtcagccaccgcggtcccgcgggacgcgcccgaggaggccctggacgcacccaccggggagtctaggcggacgctgcggctgtacatcgtgttctactcgatgtacgggaacgtggaggcgcctgcgcgtgacccggcagctgaaccggcttcggaagcaggaagcggagagtcggcgaccatccattagccgagagtctcgccacggatttgccggcaaaaatgcaggcgccatccaacgcaccatgcggtcccggtgatgccagtccccgcccatctggaatactcatattcggtcctggttgcgtcttcgaccaggtatggccctatggccgctcagttgaaggcattctttgactccacaggctccctctgggagaagcagaggctcgccgggaagcccgctggattcttcgtcagcaccggcacccagggcggcggccaggagaccactgcttggacggcaatcacccagctggtgcaccacgggatgctgtttgttcccatcggctacacctttggcttgggcatgtttaacatggacgacatcagagggggcagcccctatggagctggagttcttgctggtgacggtagcaggcagcccagcgaggcggaacttgccctcgccgagcaccagggcaagtacatggccgccttcgtcaagaagctcggccaggcctgattctgagccagcagatgaaccgtcctttcaacccgtaagcagccagtcagcgaccatccattatactgttgatcagccattgtttcctcttcagcaccgcctgttcctattgtccctacatgtgcacagcttttgctcttagattgattgttggaatagtcatataatcacgtcgaggtttctttgtacatttgttgacataaatgatgtgtattgtccatttgtaaaataagcccccatctggaacccgtgagcttttctggattgctgtgagcaatgaactgtttgatgtaaagattcatgcatttcaatcagatgccacaccgttcgtcaaacctcatcacttgtttcaaaaaaaaaaaa

SEQ ID NO: 17453 - DNA, 531 bp, Triticum aestivum
  unsure (1)..(531): unsure at all n locations
  Clone ID: PAT_TA_17453
gcacgaggccccgcctccccccccccccaccgcaccgcaccatcagaagccagcggccggcacgggcggtgcaaggatagccgcagacacgcgcccacacagacacggtgtgacagcaattgcctccggcgatgtccgtttcctggccggcgccgtcgacgtgcgcggccgccggggccctgctggccgccgcgtggctgctgtgcttcaggctgctcccggccgcggccaggccgaggaggcgggcgatgaagacgggggcgcagctccctcccggcagcttcgggtggccggtcgtcggcgagacgctggacttcgtctcctgcgcctactccccgcgccccgaggcgttcgtcgacaagcgccgcctccggtacggcggcgcggtgttccggtcgcacctgttcgggtcggcgacggtggtgacggcggacgcggaggtgaaccggttcgtgctgcagagcgacgcgcggacgttcgtgccgtggtacccgcggtcgctgacnnagctcatgggcaagtcctgcatcc

SEQ ID NO: 17454 - DNA, 616 bp, Triticum aestivum
  unsure (1)..(616): unsure at all n locations
  Clone ID: PAT_TA_17454
cgaccccgcgtccgcccacgcgtccgctatctatctatctatctggagctacccaaacaaagcaatcataccacaagatagagagttagttgtccatggatcggagcctccaatggagcaggccggcgtcgctgctcctcttgggggcggcgttcctggcggcggcggccgtagcgagcgccaacccggcgtacaaccccgacccctacagcgtcgtcgaccacttcaaccgcgccgtccacaggtcgactagcccgcgtcgtgcgctgtcgtcggagaagaagtcgaagaaggcaaagtacacgggcccgtgcatggcgacgaacccgatcgaccggtgctggcgctgccgccaggactgggcgacggaccggcagcggatggcccgctgcgccaaggggttcggccgcgagaccaccggcgggcctcaagggcaagatctacatcgtgaccgacgccaacgacgatgacttcaccaacccgcggcccgggtcgctccggggggggcgcggtccagncngagccgctgtggatcatcttcgcgagggacatggtgatcaacgcgtcccnnnngatcatcatccagnnngacaagacnatcgannngcgcggggcg

SEQ ID NO: 17455 - DNA, 833 bp, Triticum aestivum
  unsure (1)..(833): unsure at all n locations
  Clone ID: PAT_TA_17455
cgccaacgctgctcgccttcgtgctgcagctgcgcctccttcagctcgtgtggtccggccggcggaggccggcggaccagagcaagtccgccacgccgtcgcccgtcgtgtccgagaggatcgtgctgcagatatgcctgccgctgtacgtgctcggaggagccctggccgcggccgtccacgtgatcaacgtccgcgccgcgagcgaggagccgctcgtggtgcgcatcgccggagagccggccacgatctgggaggacctcgtgtcgtacggcggtctgatactggacggcttcctgctccctcagatcatcctgaacgcgtccttggcgggctccggagtgcgagcgatctcgccgtggttctacgcgggggtcaccatgacccgggtgatgcctcacgtgtacgacgtggtgaggcggcagatctacgagccgagcatgagctcctccgacctgtacgctagcccgcggggcgacctcttcggcgtcgcgtgggacatcatcataccgtgcggagcgggagtgctggccgtgctggtcttcttgcagcagcggcttggaggcagcgcggttcttccttcacagaggaggagatcaggtgggtatgagatggtctccagcatctaacagaaaacgggataatggtaattcagaacgagggcagccgtggtcgttgatgggataacaatgtgctggttccaagaaaaaagtattgtttgaaagcaaagtaaaggcccctcgtgtttcagtaaaggtccctcgtatttacggagttacacaagcagtcttgctaaatatcagtcgatttagacttggttatatgtcgcanaa

SEQ ID NO: 17456 - DNA, 1315 bp, Triticum aestivum
  unsure (1)..(1315): unsure at all n locations
  Clone ID: PAT_TA_17456
cctagccgggtcagcctaccaacccaagaaaccacatccgaaccccaatccgcccccctccctcgccctgcccccctcgtctccctccccctccccaccccgcagccgcccgccacctccatctccatccagctcccgcccctatccggccacccggccgccgccgccaccgcctccccatcttttgacctgcgccgctactcggacctcgctgatctcggaggtcgagggccgaggctcgattgccggcgatgcccatccgcccgccgggagagcatccacaacgccatgcgccacgccgtcctcccgggcgccggaaaggagggcgccgccaagcgcgcgcccccggttctctgcgtcgccgcctgcgagctcctcggcgcgccgcgcgccgccgcgctccctaccgccgccggcgctggagatgctccacgcggcgtccctcgtgcacgacgacttgccgtgctttgacgccgcgcccacccgccgaggtcgcccgtccacccacgcggcctacggcacggacatggccgtcctcgcaggagacgcgctcttcccgctcgcctacacccacgtcatctcccgcaccccctcccccgaccccgtgtcgcacgccgtcctcctccgcgttctcgcagaactcgcgcgcactgtgggatccaccggcatggccgccggccagttcctcgatctcgccggtgccagcgccctcggtgaagccgaggtcatgcaggtcctgaccaagaagttcggcgagatggcggagtgctcagccgcgtgcggggctatgctaggcggtgcgggccccgacgaggaggccgcgttgcggcgatacggccgcaccattggcgtcctgtacgagctcgtggacgacatgcggagcgcgtcgggaaacggcaagatgaggagcaacgccagcgtcctgcgctctctgggcatggaccgtgcgctgggcatcgtcgaggagctcaaggcgcaggccaagacggaggcggacaggttcggtgataagtatggcgaccgggtgctgcctctgtacagcttcgtggactacgccgtggagaggggctttgagctccaggatgcagccaccgcgaagctttaagcattggcacaggtgacatgtagagttatgtggtgctgaaattctgtgatctgaaactctaaatctgtaacatatgtgttcagaacattagatgcgtggttgctgtttctgtccaaaacgtagcaagttcataacatggtatcaaatgataaacttatttgataaaatgctagaaatatttttgagttcctaaaaaaaaagggggggncn

SEQ ID NO: 17457 - DNA, 1508 bp, Triticum aestivum
  Clone ID: PAT_TA_17457
gtatacgactactataggcgaatggcccgacgtgcatgctcccgcgccatgcgccgcggaatcgattagcgtgtcgcactggatggccacacaacaacagcaacaaccagatggacggcgccgccgccgccgccattgtcatcaccggcaccgcgaccgagcgggaggaggacctgggtaaaccgtcgtgcaccctctttgcggtccaactcaaatccaagggcaaggacgaagctcagaacattctctacgatgcaagcttctatgatccccggctcggaaaaccggccttgatagcgggacaaggcgaggacgaagaaggcaagcttcacggcgagttcgtcgtccgcgacttgtcggaccatgtagtgctgcctcgctacgtggccttcaagggctacaacgacatgtacctgagcgcgcggcaagtgcacggcggttcctacctgcagttctcgtaggtagagatcgccgcctccagggccatgttcaccacctaccacaaggacgacggcaccgtccgcctcaagtccaaagcctacgacaagttcatgaaattcgacaccaactgggtcacgccggtcgggcgcgacgacgccggcgacaagagaacactgttcaaggtgatcaaggtgggcgactactacggcctcaagtgcatggggaaccacaagttctgcaagagcctctccgccgacggcaagacagactgcctcaacgccgccgacagccacatcaccgaggaggtcaagctgtgggtgacggagccggtcctgtcccgggagatctacgacgtggtgtaccatggggtggacaaggccagggtgtacgacatgaagaccatcaacatggccacctcctccgccgtcaaccgcacctccgagaacaacaaggtcaagctatccctgtcgatcacgcagacgcagacgagcacctgggacgccagcgtctcgctcaaggccggcgtcaagaccaccgtcaccgccgggatcccggcggtgatggacgcggaggtggaagtcagcttcgaggtcacctccgagtaccactggggtaagaccgaggtgaacgagaccaagcagcagatcgtctatgacgtggtggtgccaaccaagaagaaagtcacggtgagtgccatcgcgtcgcaggccaagtgtgacgtcccattctcctacacggagaaggacgttctgcccaccggagaggtgaggattaccaagcatcacgatggcatatacactgggatgaataccttcaatctccagtatgagaccaaagaagaagacctgcccgccactgaataaatacatatatattgtcctttatttgtgctctactacttatcaacccaccacacaataaataataataattgaataaatgtaccatgacatggtactatcgtgggtgatactagccaagagcagtgtgtacgctttatgtacggacggattatcaagtgtacttgtattgtactttgttcctatatatatatatgatgaatgaat

SEQ ID NO: 17458 - DNA, 2903 bp, Triticum aestivum
  unsure (1)..(2903): unsure at all n locations
  Clone ID: PAT_TA_17458
tggctccacagcacctgcctgagccctaaacccccaacgcgcccaccacctgcgccgcagccgccgccgccggcgagatgggcggcgcgcgctcgcaggtcaacaaggcgcacaagacgcgcttcgcctccaaggcctcccgccactcgcacaagatcgataaggtcaggagcgggaagcctgcgggcagccaccgcgccgccctcaagggcgcccgtgcggcgcgcctccagcacagcaaagcgatccgtgatcagaaacgcgctgccttgctaaaggagaagcggtcatctaatggctcctcaagtgcaccccgtgttattgttctttgtggcctttcctcatctgcaaatattggaccacttgccgaagatcttttgacatttgcagcaggaggagatgagaaactgacttccaacaccgttgcttctcccgcctataaagttcgaaccacggtactgcaagcaccatatggcgatctcacttcatgcatggaactggcaaaggttgctgatttgttagcattcgtagtgtcagcaaattcattatacaacagcaattcaggcaatccaattgatgagtttggatcacaatgtctatctgttcttcgagctgtgggcttacctagtacagctgttttcattcgagatcttccatcagataccaaaagtaagcaggaattgaagaaagcagcagtttctttcctttctccagagctgcctgaagattgcaggttctatgcagcagaaactaaggatgatttgcatatgttcatgcggcttttcaaggagcaacatctttcatcaccacattggagaaatcagagaccctatgttatgtctgaggaggcctgcataaaaccaggtgacagtatgggattgtgcaccttgcttgtgtctggatatctgcgggcccacaatctttcagtgaatcagcttgtacatgtgtcaggtgctggtgattttcagttaggacaaattgatatcctcaaggatccatgtcctgttagtgggaggaaaaactccgatgtaatggattcagatgataatcaaattcagattattgataccttcgttccagaccccttgaatcaggaaccattacttgttgaaaatattccagatcctcttgcaggagagcagacttggccaacagaagctgagatggaggaagcctacgaaagcaataaacaaagaaaggttgtaaagaggaaacttcctcgcggcacatcagaataccaggctgcttggattgttgatgatacagatgatgaaggtgatgattctgagaatgacaatccagatggtgctggaatggtaattgatgagaaagatcactcagagcacgacagcgatagttcagatatagatgcagtgtctcacttcacggagaaatttgatcaagaaactattgggggttctgagatgggagatgatgaaaatcttaccaaagagcagattgaggaagacatcaagagaatcaaagaatctaatgctgatgatgaagaatttcctgatgaggtggagacacccttagatgtcccggcaagaaaacgtttcgcaaaatacagaggtctaaaatcatttaggacatcatcctgggatcctaaggaatctttgccacctgaatatgcaagaatatttgcattcgataagtttacacgaacacaaaagcacgtgcttgctaaaagggctgagctagatgaagaaagctcaaaggattgtgcccgaataggatcatatgttatgcttcacgtgaaaaatgttcctacagatgttgcctccaaactttgtcatccatcaagaagattacctgttgttgtttctggtcttcttgaacatgagtcgaaaatttcagttcttcatttcagcataaaaaagcatgactcctatgaagctcccatcagaagtaaggaacctcttattttcaatgttggattccggcagtttacggcaaggccactattttcatctgacaacatcaattgcaataagcataagatggagagatttttacatcatgggcgattttctattgcttccgtctatgctccaatttcctttccacccgttcctctgattgttttgaagaacatagatgggcaacaacctgtcattgctgcagtaggtacactgaaaagtgtggatcctgaccagattattctcaaaaaaattgttttgactgggtatccccagagagtctcgaaactcaaagcaatggtgcggtacatgttccaccacccggaagacgtcagatggttcaagcctgtcgagctgtggacgaaacatggcaaacgcggccggatcaaggagactgtcggcactcacggttcgatgaaatgcatattcaacagcagcgtccagcagcacgataccgtgtgcatgagcttgttcaaacgagctttccccaaatggccagcacaattctatcatcagatataagaatacttgcatgctttgcgtactggctaaaaagattgcaaacgagcttctggctctaggtggtttgtatcccgtagcccatagtagaagtggagcggtggcgcgcgcttgctgatgcatcagctcatatatggtcttggcgggaacacaacttgttgtaccaagacggaaggagatgcagctttgccttgtgttgtactgtcactgttttgatcgtttatgttgccaacatggctgaattttgggcatactgatagtatctctcaatatagtgtgttgttttcttgcaccagccatctgcttgtgtgtgacgcatagctctttctgaatttaatattggttcgcagttatgcagagaatggctttgtagcgttttcttggacagaaataaccttaaacaatgtactccctcatttcctaaatataagtctttatagatatttcaaaaaaaanaaanaaaaa

SEQ ID NO: 17459 - DNA, 1156 bp, Triticum aestivum
  unsure (1)..(1156): unsure at all n locations
  Clone ID: PAT_TA_17459
gccgcgttgcgccctcccctccctcgccacccggtctccccttcgtcttctctcctcctccccaccaacaaggggatccacgctcgcttgattttcatttcggaagaataaattttttttggtctcagagtagaaggtgaggagaagagatgggcggacgggtggatcacgagtactcctacctgttcaagatggtgctcatcggggatagcggcgtcggcaagtccaacatactctcccgattcacccgcaaccacttctccctcgactccaagtccaccatcggcgtggagttcgccaccaagtccttgcagatggagggaaaaacaataaaggctcagatctgggacacagctggccaggagaggtaccgtgcaattacaagcgcatattaccggggcgctgtaggggctctccgttgtatatgacatcacaaagaagcagagctttgacaatgttaataggtggctgcgtgagcttcgtgatcacgctgactccagcattgtcatcatgatggtcggtaacaagtctgacctgacacacctaagagctgtctctgaagatcaaggcaaggcactggctgaaaaggagggcctgtttttccttgagacatcagctatggaggctgtaaatgtggtagaagcctttcagactatcatcacagaggtctatggtattgtcaacaaggaaagcactggccgccaaagaagcagcagcagcagctgttccattgccttcccagggtaaaaccatcagcattgacagtactgccgggaactcaaagaaggcatgctgcaatacttgaaatgtagacatcataccgtagagaatcgggagcgggaatcatcagcagagcagcttagttgaactggtgcgaaggcatttctactctttttgtttctctgttgcgcgaacatcctggagtacactgccgtagggcagtttgttcagcatttctggaagttagatgtgtgtattaggattatgttccattttccgctatgaaaattacattatactacctcctgtaaacaaatataggggcccgcttatcancactactttaaatgatctaaacactccttaatatttcttttacgggagggaagtactacaaatatatgttgggattaaaccgtcaaaactttataaggac

SEQ ID NO: 17460 - DNA, 693 bp, Triticum aestivum
  unsure (1)..(693): unsure at all n locations
  Clone ID: PAT_TA_17460
gtcttcccgaaaaagaaaagaagacaaaccatcgacggctccgagctctcgcggggatagggtttgagccgccgcccctccggcctgcccgccggcggcgcgctgctcttccggccgccgctcttctccctcttcgttcgccgcccctcttctccctcgccgttcgccgcccctgagcaccacgcggctcgctggatcatgcgccgcccctgagcagcgcgcagctcaccggaccgattcgtgccagccccgccgacctgagctccgcctctacaggtagaaagatgcagatccagcgaggggatgttcaacctggaagctcgaatagaagacgcaaaaaaatgcgcataagtagcgaaaatatgattcgagtcaatcctctcgaagaggaattcggcacctcaagtgattctggtgaaggtgtctggaggctactcagtgaagaagtcgcagcacacatagatgacagtgttgtgtcgcttgcttcattccataaagataacgcaaagtcggtttattttgcgtgcacgggcataattattgagagcaattcaactactacaagtttcttgacttcgttaagtttgcttagatctattgatgatgatagcaagatctttcaagacatgatgattaaagtgcgccttccaaataatcatctttcaatgggatggttnggaatactatgactta

SEQ ID NO: 17461 - DNA, 655 bp, Triticum aestivum
  Clone ID: PAT_TA_17461
cccacgcgtccgcccacgcgtccgcggacgcgtgggcggacgcatgggccagcgcacaaccccttgcgcctgcctgtctctcctccctccccactgaaccccctcccctcttccttctccccatctccaccggccaccccaattgcaactgccgcctgatcagaattcccctccaccgcttctgatcattaagccagcacatcacagcgagctaggtttatatatggcagtgcgctccgccactgcctaggctgccatacacagcacagcaagagcgcgcgcactgagggcggctgcggcggcgcgccggaatcaaccaaccagttcgaccgtagcgcgcaagggagttcaccgaggtctagcaagatcgccggtcgacactccacgccagcaagcctccttcttgcgacgactcggagcagggcgtgcgggatgcggtgttgatggcggcgtcgtcgtcgaccgcgtcctcgtaccggtcgcggttcggcgacacgacgcagacgaaggtgttcgtgggcgggctggcgtgggagacgccgtcggagggcctccggcagcacttcgagcagtacggcgacatcctggaggccgtcgtcatcacggaccgcctcaccggccgctccaagggctacggattcgtgacgttccggga

SEQ ID NO: 17462 - DNA, 389 bp, Triticum aestivum
  Clone ID: PAT_TA_17462
agcttctccggcaagcaacaccacaatcactatactcaagacaatacattgaacatcaacaagcatgcccgagagaagacaatctcacccgaaggcaccgaccggcctcaacgatgagactgccgaagaggtgcatgatataattcatcgcgccgaggtggaggaacagaagatgcacggcaaggatgcgctgacacaggaggacattggggttgacgagggggaccaacaacaagaccagtcggcaatgggcaaggtcaaggaagcattgaacctgggaaaataagtgcttgatctttaatggtaattgcttggacgaatgtgtgtttacttgtaaggcggcgttgataccagattgtcataataattaattgatcttgtctttgacc

SEQ ID NO: 17463 - DNA, 803 bp, Triticum aestivum
  unsure (1)..(803): unsure at all n locations
  Clone ID: PAT_TA_17463
ggcacgaggccgtcttcctgccccgcgccgcgcgccttggcctgccgccttcgtcctggcgctcccggtgccccttccagttcccgccgccgctcgtgccctccgccggcatcgagccggcaccggagcggtggaccgaggccgagctccgggggtacgcgcagcggcggcgggctcggagggggcccatgaggacgcggccgccggtgtccatggcgggggtggtgctgacgaccgtgcccaacatcgtgatcatcgtggtcatcatgcgcgagctcttctgggtccggcctggccgcttctgtgccgtgcaggatcaggaggcacatggatctcaactgctccatcaagcacctgggtcatcttatgcattttagggcgtgtcgcttgctcctgtcattgcagtagttggtgttccctggttcgatcacttgccaatactcaacctatttacaggttgactccacacaccgcantggcactgccacaaacagctggaccctcttcangtcaagggaaactgccttgtcttccaacagcangnagattgatatatccacnccagtccgttagnatgctccatcccacagagatatttcgtggncaacatttaccctgcaacatttggngccccnaaaanggtagatganggganagtttacaaaggatacagcgtcnatggngcaaaaaagtcccnaggtccaantaatgtcttgcctncttccgccnntcgtgnactgngaacccnnattagggctgcgtcnttggacgtttaaacantggtcgccaagtngctttccctt

SEQ ID NO: 17464 - DNA, 810 bp, Triticum aestivum
  Clone ID: PAT_TA_17464
tcggcacgagggaatggaatattcaaatcgatcagaagtgctatgctttatgtaatcaggctgaaggctaacatctcgcgagtaggccgagctaggataagaattccaatcaaaaaataagtatgaattgggcccaaaatcactactttactacctatgtcgcgtgtcgcgccacctagtacgatagacttttttcgggaaaagagcaggttttgccccaacttggacccagggaaaccaaagaagagctagtttcgccctgtttagttagcggtggatgagctgatttcttttcactcctgtttcagagatacaaaacaaaagtaaagtgtagaacgcaatgtttgagctccaggcttttacgattcttccgattgacttctcttctctgctcctagctccgaatgccagtatgtagagaagtgatggaaagggttgtgctctttcatttgagaaacttccaaccaaaattggaatgttagaacagaatatttagatacaggtcccttatgaatactgtactgagtaagattcattgaagaaatgcttctccgaagcaataagtttgtggcacaagcatagtcttctgctaacctagcctttcccatctttctattaaaacgaatgtagctaacgtgaactaaaagcaagctcttgttcgaggaagtagaaattgttagttgttgctagcttgaactgagttgttcctgttggtgctagggttgccaagggagttgtagcgagatgctgctaatgcagctatttctgatgtccggacgatgcagcggaagtgaaaagaaaaaggtatga

SEQ ID NO: 17465 - DNA, 674 bp, Triticum aestivum
  Clone ID: PAT_TA_17465
ggcacgaggctccgcctcagcctcagccgcaccgcgccgcggctgccctcccgctcgcaccaccgggcagaggcacctccctccgcatagccgagccggcgccccctgcgcgcccccgacgccgctcggctccagcagctgccggccccgccccccccccctccccggtccccgtgctccccccctccccccccccccctccccccctcccccccccccccggtcggctgcccccctcgccgccccccccccccccccgatccccccgctctcccgcaccgccccgccccccgctacgacccccccccctccccgcggttggctgtccccttcgcctccgatccgtctccggggatccgattccgcacttccgcaccgcgccgtccctcccttcgggccccccccagtcccgaccgccgcccacccccccgcccccgccgcctccgcccacggagccgcgccctacctcccctcatcggggtgcggcggctcccggcagcgcgggatgcggcatctgctgcagctcctctcccaccccagccccctgccggaggtgctccgcccgcctgcgctccccgcgcgccccatgccgacgcgcccctacgccggctgcgggatctggaggagctcctctcccagctcaaccccatggcggaggagttcgtcccgccctc

SEQ ID NO: 17466 - DNA, 871 bp, Triticum aestivum
  Clone ID: PAT_TA_17466
cgacctacgacctcctcctcaccagtaaaaaaagtaagaaagcaggcaaggtggagtaggaaccatgtccaacgtgcccacctccctccgcgactcctccctcaccgtcttccgcctcgccatctccagctccgacccctggcccttctcttcctaaccccaaacccctcctcccgcctctcgagctctgccgtccgatctccctcccccgtctcctccttcctcgcaacagccagaagactcgtccggtcctcgcctccgatgcacctcaggcagcagcagcagcagcaccacagggcggagatggtggcgcccaaggggtgcgtgacggtgcgcgtgggggcggagggggaggagcagcgccgcttcgccgtgccgctcgaccacctcaagcacccgctcttcggggccctgctcgatgaggccgaacgcgagtacggcttcaggcaccagggcgccatcgccatcccctgccgcgtcgaccgcttcgtccacgtcgagcgcctcatcgaccgcgacctcggcgcgcacggccaccagctcgtcgacctcgactgcggcgccgccaccgcccacggccacggccacctccacctgccgcgcttcgtcggctgcttccgcgcctgacgatgatggcgacgcgtcgtcgaccgctggatctcttgctgtttctttgttagggttggttgagtagttctcttccgtatgctgctggctagtctccctcgccctccggtctcgatctcccgtacgtatgggtttgttatgcatggttgttctccattggtttgttttgtgctgggagaatcgatcggaggacgaattccatgttgatgatgatgatgaaaagttatgatccaagtgtaaaacc

SEQ ID NO: 17467 - DNA, 1060 bp, Triticum aestivum
  unsure (1)..(1060): unsure at all n locations
  Clone ID: PAT_TA_17467
caccaatcttcttcctccccacaacgacctcctcctccgcaccagagaaaaagaaagggaagcaggcaaggtggagtagctaggaaccatgtccaacgtgcccacctccctccgcgactcctctctcaccgtcttccgcctcgccatctccagctccgacccctggcccttctcttcctaacccaaaccccgcctcccgatctccctcccccctcctcctccttcctcaacaactcttctccggtcctcgccgcctccgatgcacctcaggcagcagcagcagcagcagcacagggcggagatggttgcgcccaaggggtgcgtgacggtgcgcgtgggggcggacggggaggagcagcgccgcttcgccgtgccgctcgaccacctcaagcacccgctcttcggggcgctgctcgacgaggccgagcgcgagtacggcttcaggcaccagggcgccatcgccatcccctgccgcgtcgaccgcttcgtccacgtcgagcgcctcatcgaccgcgacctcggcgcgcacggccaccagctcgtcgacctcgactgcggcgccgccaccgcccacgcccacggccacctccacctgccgcgcttcgtcggctgcttgccgcgcagtgacggtgacgatggcgacgcgtcgtcggcccttggatctcttgctgtttctttgttagggttggtgctctgattcgttctctcccgtatgctgctgtttagtttgtttcgccctccggtctcgatggatgtctctttcgtacggggttgttatgcatggttgttcttcattggttgggagaatcgatggtaggacgattgccaggttgacgaatgatgatgaaaagttatggtcgaagtgttaaaaagaatattaatcgatagtagttaattgatataatcttattaatactatccttttttcctaccaaaaaaaaaaaattagaggggggccggtcnaattccccaatnnggtntataccnccccagggcgggtttaaattcnganggaaaccngggtaaaataancnttgnaaaaacccnttccanggttaaa

SEQ ID NO: 17468 - DNA, 991 bp, Triticum aestivum
  Clone ID: PAT_TA_17468
gctcctcgaccaccggcggctaagcggatatggcggcctcgccggcaacagcgtcctcggccgcgggcgccaccgcctccgcctgggcatcgctcgcgcccctgcccgctcccaggcccggcgccgtctccttcccgtttcccaactccgcccgtcctgccccgctcgtcgcggttgctcgtgcttgccggctccctgtcgtcgacgctgccgccgccgccctagagccgctggggctgacggggtcgctgaccaataccgtggggttcagcttcggcgtggtagggtcacggttcaatgagatagtgatcctcttgctgcggcagggggagttattggcatccgagcgatattctatcaaagcagtataaatgacggttgttatgttttcatgtctgcttttcaatttctgttgcagcacagcatctggagaagtctggaaagtatgatgcaattttgtgcattggtggctgtgattagaggtgacacaacccactatgatgctgttgcaaactctgctgcttcaggtgtactcaatgctggattgtctgctggcgtcccctgcgtatttggtgttctgacctgtgatgacatggaccaggcgctaaatcgtgctggttggcaaggctggaaacaaaggtgctgagaccgccataactgctattgagatggcctcgctgtttcggcatcacttaacctgatgacaccgaatgctatggtcggcgagccagcaagattttctcccctgttcgcggctgtcggagtttttcccccacatttgttttaaaattccttttttcttgctgcaggctagtgtttgacatgtcgtttctaaattattttggtctgtaggtatgtactctgattacctgttcgccttgcctccaagatacccgcaagaaacttgcaagtctaaacgcatgaataaacatttttcatagaagcatgaataaactttttcacttgtgccctaaaaaaaaggaaaaaaaaa

SEQ ID NO: 17469 - DNA, 969 bp, Triticum aestivum
  Clone ID: PAT_TA_17469
ggcgggaactactcgaccggaggtctgcattttgatttcgcagtcctttcttctggctagatgtgtttctccagcaaaatcgtgtacactaaaacgaagtgaaacaaggtaagcaagactgccatgtcgcaaggctgtatatgttgggcctgtcgtacaagcatggaagaactgttgctgtcttgtttccttcgtgggcactatgaagaagtcacgaagaaagtaaagcttgaagaagattttggtaagaaaaacttggtgagtgtttggccaagttggatggtggtttgctgacgtgtcattgtcatgaataagccgggaaatatggtcagctggagcagcacagacattaagaaacacatccattggtactgcacagaagcttcgcattcggagaagtcgctacagaacaccggtgacgtgtacaacacgaagcaagatgagcagccccccaagctatggaaggtgtctagcgagccgctgcagaacaccgatgacgtgtacaacacgagcaagatgaggcaatcgccgaggaagagttgccctgccaacacagcccatacatcttcacctttcacgccattgtcgaggtggttggcggcggctaccgtgtcatctccgtgggacagtaggagcaccctcaacatgcaagaagcgtaatgtcagccaatctcgtgagatcaaagcggcatatgtttgctctatcggacatatggttcctctttgatgttgttgaggtttcgtggatatgctggtggcagcctggattgatacgacggtttcggtgcgtactctggtagtggcgaaagcgcgcgagtgcccggccgggcatgttgtgggatgttgaccttccggcgttttgtatgtctttggtgctttaggcctagtcttgccaggtgctgtttaggtctttgtccggttttcctcgataaaccgagcagctcctttttcatttcttcttttttagca

SEQ ID NO: 17470 - DNA, 529 bp, Triticum aestivum
  unsure (1)..(529): unsure at all n locations
  Clone ID: PAT_TA_17470
cancgccattcccgccgccacgcccggctgccccgtggncggncggaacccgtcctccgcctacagatccggccatcccaggctgattcccgccggatcccatcctcggcgccgctagccgcgcggggtgcaaggagctgcgaccccatgcctcggaggagctagccctgacgccattgacctgtgtgcaattcggcccggtatcttctggtttggtggagtgcctggcctgttggagtcgcaaatacgggccatcttacttctagattcaacccaaagcgcagcgccttcgaccaagccgagttgggacggtcangacacactcacgcatcttctccatcgacggcgcgccggcggcgatggcggngcggaaagctcaacctcggnctcanaagnaacaaaggngaggcaagttctcggggnctctgtactccctccgggcttcaacccctcctgggaaagnctccaaatttctggcctcccaangccaaccggccggccgcggaaagaatgggattnnccaaanggg

SEQ ID NO: 17471 - DNA, 796 bp, Triticum aestivum
  Clone ID: PAT_TA_17471
acgagggcagattcctctcttcctccctcaccaagctgcgactttgggagctttcgcgtgaagggatgaagcggttcaccaaggagcaagaggacgcccttcaactcctctcctccctccaaacactagagtttttgcatttcgaggaccttcaacaactccctgcagggctgcgtaaccttaccagcctcaagatattatcagtcagctgctgtccagccatctcgtcgttgcccaacgatgccctccctgattcactggaaatgctagatgtctacaactgcagcgaagagctaaaacagcagtgcagggggttagtgggaaccatccccaaaatcataatagacagaatacttctgatccaaggacaatgccttggagttcccttgtacattcttctagccttgtagagctcttcccttcccattcaaacacatgcatgacacaagggcctttgtggctgtggtcttccttcctgtacttaaatctggtgtttgttcgatcttgtaggcttcttccttttttgcacttaaattcggcttattctcattcatcaagacgtggcagtctactcccctattttgggtgtcacgaccaaaatagcactagggcatcaggccgctgacagtgaggcctccgggccaggcgctctactgctcgtctgcgtggcttccgggcctctcgtcgccacgtcgggtctagacctcatgtaggctcgtggtgttccgggaatgggcccgctgagccgccccagcatcggcgtgccctgttcggggtccccattgagttgtcagtg

SEQ ID NO: 17472 - DNA, 995 bp, Triticum aestivum
  unsure (1)..(995): unsure at all n locations
  Clone ID: PAT_TA_17472
ctagctcttatctcgccgccgccgggccccggatcctgccccgcgacgagacgcgccacggcctcctggtcctgggcacgacgctccctcctcccgctccaccttgcgtaaaggtggcagcattggggggataattttgttctcaccctgtgtggtacgtggcatgtagttttggtgttctgaagtatatgcggagggtataatccggatatattactattgattctgcaatggcaaggagatgaaagtatcgtgggtgtggcagcggggcagcaaggacatgacagccatgccacatccgcgccaccgcactgccaagaagcccatgtggataattgtgctactgtcaattgtttgtgtttcgttgatcggggcttatgtctatcctccacggcgctactcgacctgttacttctttgcttcaagtgtttgtactccctttaaggattggctccctgctgtgacccggcgggagctgaccgatcaagaggttttttcgtctgtggtcatcagagatttgcttgcaatgcctatgcccgtgtccaagaagccaaagattgcatttatgttcttgacacctggttcattgcccttcgagaaattgtgggagagatttttgcagggccatgagggacgatattccatctatatccatgcatcgcgtgaaaagcctgtgcattctagtcctttgtttgtgggccgagaaattcgcagtgaaaaggtagtatggggcagggtttcaatggttgatgcagagaaaagntgttaggaaatgcattgcagatattganancatttccgcttcttctacagctgtatccactacatacattgatacatcaaaatactgatggacaaatgtactcatgacagttccggatctggtctcatgaagtgaagtatctatagaatgttctgaangacacaggctcaggaaggtcncatggttcntacagagcatcntctgatatgcgnaccntcncgtaatcagtttt

SEQ ID NO: 17473 - DNA, 588 bp, Triticum aestivum
  Clone ID: PAT_TA_17473
tagcgtggtcgcggccgaggtacaacatggtttcacccagagagaaacggctggcatttttcattggagttaccaaggaggatggtcaagtttttgtgttctcattgacctgtagattcaactggaggtattttgtggcaatttttcaacaaccggccacccaaaaggaaggtggtcgcatttatttgctgggttatcttattatcccgatcaacggatttctcgtgtgtgcccttcgttaaaccgaaagcacttcagtagttaattcataccattggtggtgatggtgatggtcgtctgacgaagtgcagtactatgtagaagtgagacgaaagggaaccgaactttttgatgtgttcctttcagtaattgaatgccatgtctactgaagctagactgccttggcccttgattgatgattcgatttgttctggtaaactaagagatatattagatgagatagtgtttgccctttttgttgtctttgctctgtttggggctttctttgaactgtacatctctcagttaagcaaacagcgtgtgccgttttggaacttgacaaaataagctcggcgccatccatctcgt

SEQ ID NO: 17474 - DNA, 919 bp, Triticum aestivum
  unsure (1)..(919): unsure at all n locations
  Clone ID: PAT_TA_17474
nnaaaaaaaagcgagagagcgctgagaggcagagcatgagagggctcctcgggctcgggaggcagccgccgccgctccctcttttccccgccggcaagagggcctcgccggctaccaccctcctcctccgcctccgcccccgccttccgtccagccgcctctttcgtctgctcctcctcctcgccgccctctcgctcgtccctccggccttcttccacttccgcctccgccgcttcaaccgcatgcgcgagaggagttgcgggtggaccccgagcccgccgctggtgtgcgcccacggcggcgactccaccaacgcgttcccaaactcgatggacgccttcacgatggctctggatgcccgtgtagactgtgtggaggtggatgtttcgaggtcctcggatggcaccctcttagcactccatgacagttagggatctgcaaagaatgtctggtaattctacagcaaaagttggccactggagcactcatgagtcttcatagataaaagcggtgaccacgaggtttcagctatcgaaaacagtccgaaaccaggaagttcccaaagcagaagatgctctagagttgatatcacagtctgtaaggcaagtaattctggatgtcaaagttggtcctccttcatttgagaaaggtttggcggaagatgtaatgtctattgtaagttccaggtagctcatttcttgttttaccttaatagaagttatacctttatttacgtttcttggttcatgacatttaccttttgaatctgtatcatcattttctagaggttaaacggaattgggacctgttgattgtaatatgtgatttgtgtaacagtggaaatgctgtcatccatggcaaaatcatctattgttctatccatctacatctaattgaacttgtgcacttctttatttgc

SEQ ID NO: 17475 - DNA, 645 bp, Triticum aestivum
  Clone ID: PAT_TA_17475
accaacgaccgtagcaaattcctaaggagccagctggcccttcagttgctcaaaaatagcttctgccttaaagtggcgaatgttgaaaggatcctgaagtcggtcacatcgataaatgtgaaggagaaagaatgcaatttctttgtgctctacgtgcacatagttttggtggacaacctgctcttctctagcgacgcgttcagaaacaagaccgcgataatcgacgcttggcgcaattttctacgcaactgctcgacccagataggatgcacggactggaggttctacgcttcgaaggtccggaacaaggcgtcgtatctcctgcaaggtgcaatgctgaaaaggcctgctggcagtggtagcattcctgccaagtgatttgaaccaacctactgaaatgcctgctgctggagagcacggaacctacgccctgatttactggcacaagtagtatgtctagggtgaattgtaggctcattttttgggtacctgatgggtggctgacagtagtattcgcagcccatgtatagcgtagtccccagcactctcaagtctcaacgccgagaatgccacttgatgaactttttgcagcatcgacttctactgaatatacattatctgcgtgtttggttcaggggaattaaa

SEQ ID NO: 17476 - DNA, 968 bp, Triticum aestivum
  Clone ID: PAT_TA_17476
cgaattcgcggccgcgtcgaccatcccttcagatctgaaggtcggtgcatatatatagttagtacataaaattgtatattagtctaaacatgtgtgcaggtttgtggggaggacgtggatttggaggtcccagctcctggccgtgtgtgcaaggtattcatgaccaacatatctaatatagcatggcgaggcatttatcatgagaaatttcttcttattccagaactgcttaaattttcccgtacctatttcccatttgatctttgtaggagatattggcacaatgagttatgtttttagcagtattgtttatatttttcttttgcaataaatgctctaggaattcgactgtaacagtttggtctcttgagctcataagatctgttcttagcaacagagctgcttatgaacatacctgtctttaattaccaattaatggttgcatagtctaactgctttctttcctatggttcatgcttacagtttagtatccactgattcataaatgcttgatctggcatacatctccttttgtaaatcattctcccaggtcccagcccccttgctttctgtggatatttgggcaaattcagaattattattttctttgctttcttgcactcaggaaaaaacgaccacgctctacacaacttctgaggagagcaaggttgttttagctttttctcatctacagtatatgtaaaggttgcttattatatatgtggaatctcctacaatcttgttttttttgttcgttgcctcattactgctgtagcaattagttcttacaattccttttctaaatgaaagtacttacaattctaagtgaacttgtgccttctccatgtggaatttcctctcataagctaaaatgaaccctggaaagcatctgcggatgtttgttattcactgcctcaatagcactgtaacagaattacttgcaatttttggtgaacttctctatctac

SEQ ID NO: 17477 - DNA, 862 bp, Triticum aestivum
  Clone ID: PAT_TA_17477
gtagagcgcagcctctgaatctgatcggtggaagcgttcacagctaggagcacgcacgcacacatggcgaacgcggggctgaagccggtggccggcctcctcctgatgctcaacttctgcatgtacctcatcgtcgccgcggtcggcggatgggccatcaacttcgccatcaacaacggcttcttcataggttccgggctggagctgccgtcacacttctctccgatctacttcccgatagggaacgcggcgaccgggttcttcgtcatcttcgccgtgatcgccagcgtggtcggtatgggggcggcgcttgccgggttccaccatgtccgcgcgtggagccacgagagcctgccggcggcagcctcctccgcgttcatcgcctggatgctcacgctgcttgccatgggattggcagttaaggagattgacctgaacggcaggaatgctagactgataaccatggaggctttcaccatcatactgtcggggacgcagctcttctacatactcgctatacacggagggaggtgaagggccagctcaagtgggcaacatcgattgccgatggaatatttgcttccaagcgtgatgattcaaggccgatatatcaactacaactaggcgagcattggttcacggccgggttgcatgtatacatctttgatgtggtgttaaaaatttgtgtatcgtgtgtttattcctgagacggaaatgcacttgtgcatgtgtgagtgtgtgtgtgtgtttgtacgttgtgtgcgttagcgttagatgcgtgttcagatttccgcgtgatttgttgattggaaaccatacacgaagctatcgtattcatttgatttgagtatatcgtcttttt

SEQ ID NO: 17478 - DNA, 759 bp, Triticum aestivum
  Clone ID: PAT_TA_17478
aactcagataggaagctgcttcctcaagtttttcatacacagttccatggaagggaagtgcattctctttgcttcatagatccagcaagctattcaattcctcagaagagtacggatttgtggattgcaaccgggtgtgaagatggaacagtccggcttacagggtactcggctagtagtgctggaagatggtgttcatccaagctgctgggggagcatgttgccgcgcctccggtgagagatacgtgtttcatcccaaagacttacacattagcagataaatcgcgcaactccagtgtcagttctgccgacacttgggtcgaaaacaaggacaccacttacatattgatatctgttggatcaaagcaagttctgacggcttggattctagaacctaggattgcagagaacaacaaacaagtgtgttcgagtggtcgagatttagacaccaagcaaagctcggaatgctcacacaatagtggttcagccgttacatttcagtggctttctacccacatgccaccaaagcttgccaccaataggttgaaggctgatcttgtaaagcggaacttcgaggaaggcggggaaggaaattcctctgctcaacccaatctggctattatggatcagatggaaaatgactggcgttacctttctgttacagcatttcttttgaaacatccggctaccgagttgacagtttgttttgtggttgttgcttgctccgatgcaacagttattgtccgtgcgcttcttttg

SEQ ID NO: 17479 - DNA, 1133 bp, Triticum aestivum
  Clone ID: PAT_TA_17479
cggccgctcaggcggcgggcgggttcaaaagatggaggaaccttcgatcttgtctcgatcaacacaagaaccagcaaattagcttcggtttcatagtcgtatactgtcgtgtctagccttacgaccattagtggcggcgccatggaggagtcgcaggaagtagaggagctcgtcgacacaaggctgtccctcgtgatcggcgccgcgagccgtccgcccccgacggtcctggcgctgctgccggcggcatcaccggagaacgaagcggcggcacgcgggaagaggaagggagtcaagggaccagagaacggtgcgggcggtgccgctgctgcttcaagggagcatagcaagaggtccaagacggtgcacgacagcagcgacgtcgacgatgacgacagaggggacgcggccggcggcgacgggacgaggaagaagctcaggctcacggtggagcaggccgcgctcttggaggaaagcttccgtgcccacaacgtcctctctcacgtacgtccataccttctaatttctgtccttaattagcatcttcatgcaagaagattctgaccggattcttttgaattgcagggtgagaagcacgatcttgcggggcagcttgggttgaagccgaggcaggtggaggtgtggttccagaacaggagggcgcgcaccaagctcaagcagacggagctcgactgcgagctgctgcgccggtggtgcgagcgcctcagcgacgacaacgcgcggctccggcgagagctcgccgagacacgcgcggtcctcctcgtcggcggttcacaggactcgacgctcacggggtgtccttcctgcaacaggctcgccggcggccggagggcggcctagtcgatttcgactgcaagattaattaccgccgccataggactagtcaactagaagtgcgctgtcacggagtacttgttaactgtagcatacgataggctatagggtatagggtagtgaattatctaggcatgacggaaatatggagtgtgtggtgaggtttatctagacttacgttcacgtgagcctgacgagctgacaaaaaaaaggggatgcatcgtttgatgcatgtacttgctacggtagtactctggtaaagtttgatgtgtttaatt

SEQ ID NO: 17480 - DNA, 853 bp, Triticum aestivum
  Clone ID: PAT_TA_17480
tgattttcaaagaagttggcaggcaaccttcgatctctctcgatcgagtctcgatcaacacaagaaccggcaaattagcttcgggttcttcgtatactgtcatcatgtctagccttacgaccattagcggcggcgccatggaggagtcgcaggaagtagaggagctcgtcgacacaaggctgtccctcgtgatcggcgccgcgagccgtccgcccccgacggtcctggcgctgctgccggcggcatcaccggagaacgaagcggcggcacgcgggaagaggaagggagtcaagcaagagaacggtgcgggcggtgccgctgctgcttcgaggcagcatagcaagaggtccaagacggtgcacgacagcagcgacgtcgacgatgacgacaacgaggggacgcggccggcggcgacgggacgaggaagaagctcaggctcacggtggagcaggccgcgctcttggaggaaagcttccgcgcccacaacgtcctctctcacggcgagaagcacgatcttgcgaggcagcttgggttgaagccgaggcaggtggaggtgtggttccagaacaggagggcgcggaccaagctcaagcagacggagctcgactgcgagctgctgcgccggtggtgcgagcgcctcagcgacgacaacgcgcggctccgccgagagctcgccgagacgctctcctcgtcgccggccttcttgtccaggctcacgatggccaacgataaggctgtgtgttcgtcctgcaacagctcaccagcgcccggatgccggcataatggaccgcgcgcgagactactactgccgtctgccgcccctgaatggatgcgtcgatcatttgttgaaaaa

SEQ ID NO: 17481 - DNA, 543 bp, Triticum aestivum
  Clone ID: PAT_TA_17481
gccggccgtgccgggaaagaatggataacatgcggataaatagctgcgacggccacttttcgatggtagcgcatggtagataccaaattggagcttgcatacattgaaaaaaaaaaaaaaacggcacaggcgggaagcttactttcatccaacccaacaaacatcatcattacaaaaacaaacgacactatgcctggaattactattcgttgggaagaccctggtaaatggcagtctaccatggaacaggtagaccagctactcgaacagcatacaggacacaaaaactatccctcgacaaagagtattccgccgatcatattcggtgttaacatgccacagaaaggtattgatgagttaaagggattagacggtgtcatagcagtcatcaatgatgatgactgatgacattagcaacaagggaatgactgctcaatagtgtttatatcaataatattgattgaccagcaggtcatgttttgaccggtaaaaaaaaaaaaaaaaaaagaccacaaagacaaaaaaaaaaaaaaaaggccccta

SEQ ID NO: 17482 - DNA, 444 bp, Triticum aestivum
  Clone ID: PAT_TA_17482
gtgcggcgctcagccggcggtcggggatcacatgcgctattcactccaacacaaactcaacacttttttataaccttttcgaagttttcttcaccaacatcttcaacatgtctccctgctcttgctgtaaccacgccggcgcttcttgcaccagcgactgctcttgctgcaagcactaaatccattattatccaaacctgacaacacttggcttacatcacggtttcgtgacaatgtctcatcggagtacattatgaggacgtctctggatcggtctctcatcaagcaagtcagacagacatgggaatggacataatgaaagaaatggtataacatgcggataaatagctgcgacggccacttttcgatggtagcgcatggtagataccaaattggagcttgcatacattgaaaaaaaaaaaaaaaaaaaaaaaaaggccccta

SEQ ID NO: 17483 - DNA, 823 bp, Triticum aestivum
  Clone ID: PAT_TA_17483
ggccgctcgaaaggccggtgcggcgctcatgcaaagaaaaaaaaaaatccaacatgtgcggtgcgcggccggccggggcgggatccaacaagctattcactccaacacaaactcaacacttttttataaccttttcgaagttttcttcaccaacatcttcaacatgtctccctgctcttgctgtaaccacgccggcgcttcttgcaccagcgactgctcttgctgcaagcactaaatccattattatccaaacctgacaacacttggcttacatcacggtttcgtgacaatgtctcatcggagtacattatgaggacgtctctggatcggtctctcatcaagcaagtcagacagacatgggaatggacataatgaaagaaatggtataacatgcggataaatagctgcgacggccacttttcgatggtagcgcatggtagataccaaattggagcttgcatacattgaaaaaaaaaaaaaaaaaaaaggcccctataaatcttgtttattcgaaaaaaaaaaaaaaaaaaattcttttcaatcaatcttgtttattcgaaaaaaaaaaaaaaaaaaaacacttttcaatcaatcttgtttattcgaaaaaaaaaaaaaaaaaaaaaatacttttcaatcaatcttgtttattcgaaaaaaaaaaaaaaaaaaatacttttcaatcaatcttgtttattcgaaaaaaaaaaaaaaaaaaatacttttcaaacaatcttgtttattcgaaaaaaaaaaaaaaaaaaaacttttcaatcaacctggtttattcaaaaaaaaaaaaaaaaagcccctagggcccggg

SEQ ID NO: 17484 - DNA, 569 bp, Triticum aestivum
  Clone ID: PAT_TA_17484
gaattcggcacgagcacatgtacattaactgccatttatcaatttcgagggcctatttgattcgaaggattttcatagaattgctcagggatttagaatacttgggaggtttgcttatgtttggtagaatcgtaggattgtattccggtgggtaaaggacggtgaagtcagttgggtgccgaagctgtggtgtgataagtacttgctcggaggccaagggcgtcgtgaccgatggggccatgcttggcgatgaagatcctttgtctgcggggcacttgagctatcgtgaggatctgctccagggcgatggaacttttggccagctcaggaccatccctttggttctggaaatctaggtcgattgaaggccttcgctcctctttggccaaagttgggggcgatcgccagggaatcaagaacggggcagaaagggctgcgggataacagatatgtctgggacatggagcctcttgcccgccatggaatgcaggatgaaatgtctccatgctttgtttgcaatcaggacgatgacaacatcgaacacatcaccttgcaatgtgggggccccc

SEQ ID NO: 17485 - DNA, 933 bp, Triticum aestivum
  Clone ID: PAT_TA_17485
gccggccggggccggcaaagccggcgccgcctctcaaacatccctcaggttgacctcttgaaagttcgtcaatcaagatacccaccatcaagcaacgcttttttcagcaccccgcttgtttacgtctttcgcgcctgtcgctacaacaccacagacacaaccatcaaaatggctgagcagcagacccctaccttcaagctcgtgcttgtcggtgacggtggtaccggaaagaccaccttcgtcaagcgtcacttgactggtgagttcgagaagaagtacatggccaccctcggtgtcgaggttcaccctcttggcttcaccaccaacttcggtcagatccagttcgatgtctgggataccgccggtcaggagaagttcggtggtctccgtgacggttactacatcaacggccagtgcggtatcatcatgttcgatgttacctcccgtatcacctacaagaacgtccccaactggcaccgtgatctcgtccgagtttgcgagaacattcccattgttctctgcggtaacaaggtcgatgtcaaggagcgcaaggtcaaggccaagaccatcactttccaccgaaagaagaacctccagtactacgatatctccgccaagtccaactacaacttcgagaagcccttcctctggctcgcccgcaagcttgtcggcaaccctcagcttgagttcgttgctgctcccgctttggctccccccactgcccaggtcgacgagaagctcctggaagagtaccgcaaggagatggacgaggccgccgccatgcctctgcctggtgagctttccgacgacgatctgtaaatgactcgtgcgttcacggaaaaactttgttgaggaggatgctgccaagtgtccaaggaacggtgcatttgggcagcgttttgacgatggcacataggcagccgggacgaccat

SEQ ID NO: 17486 - DNA, 716 bp, Triticum aestivum
  Clone ID: PAT_TA_17486
gcctcccccccgctgtcgcgcccccggctctggggggattgtgcgcggcgtggccgtctcctgtggtctggtcctccttgcttcccggcacctgcctacctcaccgccgctgcctgtgattgcagctgcgccgatctgtgtgcgtcggagccccgccgtcgtgcagccttactttggggacttattcccagaggattagcatgagatgtgaagcacaccagaagaagtacccagacgccaaggtcatcagtttgggcatcggtgacacgacccaacacataccaagcatcttcacatctatcatgaccaaggtatctaggattattgatggtgacatggatgattcctgtggtctggacaaggccaatgcatgagatagcatttgcgtcaaactgattaagtcagagctactcagtcatgtaaacaaacttataggacatggtgagccaaggtgagctgccgccgattctccccattgctagcccccactcttcctctcttcttattgctcccttattttcttccactctggctacccatccatctacttgtaatcctttttcctgaaactataagacaatggcttaccctgacattttggtagttgtgtgagatgaaacatgatgctaagccgaacaatttattgttcttttttacgcctgagatcatattttggtagtagcgaagcctaaaccatgatgctttcttgctgctgc

SEQ ID NO: 17487 - DNA, 519 bp, Triticum aestivum
  unsure (1)..(519): unsure at all n locations
  Clone ID: PAT_TA_17487
agccgcgcggccttataccccgacccaaccacccgcccgacccgaccctctcgtctattcccagccgtttcccgttcccaaattcccaacccgattccattcccccccactcccactcgtcgccctcccgattcggtttgaaaagagacaaaagcaatgctcgaccggtccctccggccggcggaggccggcgccggcgccgccggcccaggcgaggtccgcgggaacgtggatcgggtcctcttcaaggacctggtcgacatggtgccgctcgtcgagtccctcatggatcggaggacgaacccgtcctactcgcggcgcgcctcgctggtgtacacgccggcgccggccaagaagggtggtgatttgaaaagcgcaaagacaccacaaaccgtgtcggcaaaaaagcggagggatcctggagacacaggaaataaaagcacacctgattcaaatgggagagaacgggtcgggtgcccccgaattgactcaatcgggagcaggaaaaataaanccnaa

SEQ ID NO: 17488 - DNA, 1040 bp, Triticum aestivum
  Clone ID: PAT_TA_17488
acaccaccaagtcgacgcagccttccattccgtctccaacgagacaaactttgctggtaggcaggatcgggatggcgaacgcggaggatgcgcccacggccgtggcggcgggttcttgcaggtggccgtccgcgctgcgctggatccccacctccgccgacggcatcgtcgccgccgagaagcgcctcctctccctagtcaaaactgggtatgtccaagagaaagttaacattggctttgctccacccgggtcaaaagcaagatggtttagatcaagtgaagagccaaggttcatcaacacagtgacatttggtagcagcaaggagaatgctcccacccttgtcatggtccatggttatggtgcttcacacgggctcttctttcgaaactacgatgccctcgcaagccgtttccgggtcattgccattgatcaactcggttggggtggatcaagcagacctgacttcatctgtaaaagtaccgaagaaaccgatgcttggttcatagattcttttgaggaatggcgcaaagcaaataacctcagcaattttatattgcttggtcattctttgggaggatatgttgcggcaaagtatgccttacagcatcctgaacatgttcagcacttgattttggttggttctgctggcttttcgtcagaaacagatcatagctctgagtggttaaccaagttccgtgcaacgtggaaaggcatgctagtaaaccatctttgggagtccaatttcactcctccgagaattgtgagaggattgggccttggggcccatattttgttcgaagatataccacaactaggtttggatcttgctacattcattttcaatgatgaattactaacaaaacatgaatctatcttgctgacagattatatttaccacactttagtttccaaagccagtggagagttgtgcttaaattatactttttctttgggggcatttgcaagaaaacctcttctgaagagcgcatccgattggaaagtgccgactactttcatatatggacaggatgattggatg

SEQ ID NO: 17489 - DNA, 795 bp, Triticum aestivum
  unsure (1)..(795): unsure at all n locations
  Clone ID: PAT_TA_17489
gctcggcaagcagacgttcatcaacaactccatgccaccccatatgggaccaaggcccacgtgtcatcggctgcccagccctggcatggccaccccggcaggcttcggggcttcttccacagccaaggtcagcgtcgatgcatccctcgcaggcgccatcatcgggcggggcggagtcaacacaaagcagatatcccgggtcaccggggccaagctggccatccgggaccacgaatcgaacgaggccttgaaaaacattgagctcgagggcacgtttgatcagatcaacaacgccagcgccatgctcagggagttgatcttcaggatcagtggcggtgccaacgctcctccgccgggcgtgatcccggctggaggatctcaccgcggcggcggcggcagtgggcagggaagcaacttcaagaccaagctgtgcgacaacttcacgaaaggatcgtgcacgtttggcgacagatgccactttgcccatggcgagaacgagctgcgcaagtcggctgccgtgtgagattgatcaacctcacccaacatgatttgtagtagcgattagtcggtgtaactctgaaccttgagggctgatgatggattttctgactgtccctgagattatgccatcgattttatggatttcatatttgtcatgactcttatgatggattttctgactgtccctgagattatgccatcgattttatggatttcatatctgtcatgacttttatgcagncctgttgtggttttagtagaaagcttgacatgttcatttcctgaaaaaaaaaa

SEQ ID NO: 17490 - DNA, 769 bp, Triticum aestivum
  Clone ID: PAT_TA_17490
cgagggttccagtattccactggacgcacggcgacttcctatatcttctgaatctgatggttccaactatgctggctctgctattcgtgcttatagcccgaacgtgcttggttcatttggttctaccactttgcagaacccgacaatgagcggcttaagtacaatgatggtaggaagatcctattatgatcctactaccattcttgggggtgaaagtggtggctcatctgcttacccaaagaagtaccacagctcacccgatgtatctgctgtaattgctgcaagcaggaattcattgttgaacaaagcaaatatgggcagcgctgctggaaatcagccatatcttagtaggctggcatgtgaaagatcacataatgtgggcacagcgaacatgtcccagagctctgtgcagtcgagtatgaacaccaaaccagcatcactttggtcccggcaaccattcgaacagctctttggcgtgccgagcgcagagttgaataataggagcccggtgaacaccgagcggagatcaaatggcaccaaggatgatttctcatacaaggaatctgaagcaaagcttctccagtctctcagattttgcatcatgaagctcttaaagctggaagggtcgagatggctttttaggcagaatggtggctgtgatgaaaatctaattgaccaagttgccgcagctgagagagtttcacaagaaactgctgatggcatggacgctaattgcacgcacggacggctcggttgtggtgttgaatgt

SEQ ID NO: 17491 - DNA, 739 bp, Triticum aestivum
  Clone ID: PAT_TA_17491
gcacgagggtgagtcattaattaaggcgaaggaatggcttgtggatcttgttgagataagtttggaagccggcaagatgagtgaagcggaactgactcaatcagcctctaacaaaggtggtccggttactccagtctcacggactaatcttgctaccttcaaagtggttactaatcgtacattattccgcaaggcaaaagaatggatggtatattttacagaggaatgtttgaaagcttggccagacgcgagtcaagatgatcttcctcaacttttctgcaaggatggtgatcctgatggcacagtcccccgtacagtgcctggtagcttgactagtcttgctgaaaattcagcgattgcatcagtcaaaaagccagatgctctattctcgcaaaccatgcttggtaccttgacaaatcctgctgaagactctgggatgtcatcagtgacaaatgcaggtgcatataaacctttgagtgaagaatacttttccagttcaaggaagaatccaaggatggaactggcaactattaggcaagattttgatccaaaaaggcgacggacaactctgacttcgcagattgaaaccggaactgaagatcagcaagcaacatgagtgtctaactgaatggtagcatcgactgtaccagctgctgcttttgcctttgcgaagacggtcaattagctacctactggtgttacttgacgttaagctacttgttaggggcttgcgagtctt

SEQ ID NO: 17492 - DNA, 1337 bp, Triticum aestivum
  Clone ID: PAT_TA_17492
aaattgttctcacgatatcttaatctttcggctatacgtcgcgaagtcatcgcaaacatatcgcgatgggggatcatacaacagttgccgaagtccaagttgatgataacgcgcgctcagactctgaagattcctcctacgacgctgactccataacagacagcgcgtccatcgccagcagtgttctcaaatacaactggaaaaatggtcggcgctatcacagcgacagagctggagagtacagctttcctaatgatgatgaagaacaggatcgtctcgatatggttcatcacgtctttactcggctgatcaatgaccgccttttcacagcacccatcgatccagagggtgcgagggtactcgatatcggcacaggaactggtctctgggcgatacaatttggagataaacatccatccgctgttgtaatcgggaacgatctcagcccaatccaaccagattgggttcccccaaatgtcaggttcatcatcgacgacgttgaggcggactgggtagatccagttccctacgactacatccactgcaaatacatggctggctctatcaaagattggccgcggctaatcaagcaggcctacgcgagtctgaagcccggaggatggatcgagcttcacgaaacagccaacacattatattctgaagatgactcgcttcaaccagataacgccctcgtcgaaatgatggagcatctgacaatagcctgtgaaaagattggtcgaacaatggaccctgcaccatcgtttaaacagtgggtcggggaggctgggttcgaaagtgtgaaagaagacagattcaaactccctatcggtccttggccaaaggatgaacgactgaaagaaattggcacgcttatgggaatcaacatgatcgaaggagtggctgctttcacagcagtgctatttacggaagtgctgggatggtcgcgtgaacgagtcgagctattcaacgcgcgagtcagacaggcatcgcgacagcgatcagtccatccgattttcgactgtttggtagtgactggtcggaagccagggtaacaagcgaccctatggaaataaatcgggtctttctttaagggccgaatctgtggggtatatccataagtcgactagtctccgcggctttacaagcgagatggacactgcaatgatactaaaacatggggtattttgattttggacccacggaagatggatcttctttctaaaatgagggggaattggtcggatatggggggctttatgtatcgggagcgatgaagttgtgccgggaacagtacccgaagggccaaaaactggggggtttggttgctgataactttg

SEQ ID NO: 17493 - DNA, 974 bp, Triticum aestivum
  unsure (1)..(974): unsure at all n locations
  Clone ID: PAT_TA_17493
ccacgaggccggcctcctgtcccccgtccactccgccgccgccgccgcccgccgcgattccgcccgcgtccaccgccgcgcgtcgccccggcggactccaggacctccggatcggagccccgcgcctcgccatggcggtcgccgcgctcaaggtgcagctgaacgcgctcctctccaacatgttcgccacgggtatggtggacgagcagttccagcagctgcagtcgctgggaggaggggggcaccgggccgtcgggcttcgtcgaggaggtcaccaccctcttcatcgacgacgccgaccggatcatcccgacatcgccgaccttctggaccctgccggtggtggattttgacaaggtggacgcccacgtgcaccagctcaaggggagcagctcgagtgttggtgctcagaaagtgaagctcgcctgcatgcacttccgccagttctatgaggcaaaaaggaaagaagggtgcctcatggcgttggctcttgttaggagtgagttctgtgatgtgcgcaacaagttccagaccatgatgcagctggagcagcagatcgaggcctgcagtcccaagtagagtagcagtcactgaagcaaaaggagcttagctccatgtgacccccgtgtatgtatctcttatgcttgtaggcagtgtaacgggtgtcgggggctctggaaggcgtgtgtgcggaaccggaccgaccgattcccacgtcggagctccggactcgtgaccctttgaaacgcaacttgcttgccctgcgtcaatgtacgtcgcaaccctatacttgtttgtgtcgtgtccgcccccaggctgcgtgtaaactcttaccttgttgttgtatgtttgttggggtccctcgtaaaatgttgttgggggtctcttgaacgccccttgggggggggccgggtacccaaattcgcccctaaaaatgaggncctntttacgcnccgctcantgnggngggnggg

SEQ ID NO: 17494 - DNA, 658 bp, Triticum aestivum
  Clone ID: PAT_TA_17494
tctacgtgcgcgccggggagggcgccaagatcacctggatgatcaaccggaaaaccaccagcttcgacggcggcgacggcaagggcaagggcgcgtcgcggagcctcaagagctgggcggcgagcaccggcgtgtcctgcgacggcgccgtgcgcgtcgaagaagggttcatcagggagggagacacggcgagcgtgatcggcgtgctcaagaggcaccacgccttcgacgtcgtcgacgcgccggacggcgtggtggccaccggctgccagccggcgaggtgcatgttccccgtgctcgtcggggggctggtgctcatcggcagcgacgaccccgacgagggcgtctacatggtctaagcttaagcttgcgacgactgaccggccggcctcgagctgctttgacagtttcagtgctgactatattaacagtttcagcgcctaccgtattaggtctgggtttcgcagcagaaggatctgctgcatactgaatgctgttaattagagtggtgtttataggcttgcccgggtttgatgttgtgctagcagtacttttttttctctctcttcctctttttgctcttctccaagtacagctctgtcgctttttggatcacagcgtgcttaaaccattgtaatgtttcacaggcaccttttct

SEQ ID NO: 17495 - DNA, 821 bp, Triticum aestivum
  unsure (1)..(821): unsure at all n locations
  Clone ID: PAT_TA_17495
tctgagcanagtaaagagttggcttcntgtttatgcatcaaaagatccaaggggttgtcaaggaagtatcgagccttatatgtccagagaattttcagctgctgaaatagctaatccttgcttgcagagcgctggtatattattgcagaaggcggacgtttggcttttgaacttggagcagcgtggggggcacatattagctaggcagtactgcaagcacatcgagagggaaactataccaattgctttcctttaacaatgtgctaccaaatttgttggaccatccgggatttgggggtggtgacgatccaagatggaccatcttcatggaagactgtgaggaagaagtctgttcaaaaataagaggatgcttttctgcccctcttaaaaaatgcaaaatgtaatccgtgtttggagtacataaagtatattatcttaccttggtttggaaaatttgaggtgctgcagactgtagagaacagtggtataaagacgttcatgtgcatggaagagcttgctgctgattatgaaagtggcgctttgcatccaattgatgtgaagcaggcgcttgtcaaggcaataaatatgatgttgcagcctgtccgtgaccatttcagtagcaatgatgaagcaaaagaactcaaggaagctatgcagatattcaacagtaatatctagtgagcaaaaggtccacatgcaggcggatattcataggagcgaacgagcacacctgctcacggaatcgctaggcatccgttcgcattgggatcgaggccactgaaggtattatcgagtgtatacgttgtccagaatgaactatc

SEQ ID NO: 17496 - DNA, 1526 bp, Triticum aestivum
  unsure (1)..(1526): unsure at all n locations
  Clone ID: PAT_TA_17496
ccccgcgtccggtcctcctcgagnagcaagcggcagttggagccttggtggggatggaacgcttccggttcagggcacctcccctctcgctcaagctggccttcgccgccgtctccctctccctcggcgtctccttcgccgccgtctcctgctcctcctcctcctctcccctcccctcctcggccgcctcctcctctccgcggccgtctccccggaccgtagccgccgacctcctcgccgtcctcgccggcccgcgcgccgcggcgcgggtgccggctcgggaggcctcgcgcctgagctcctgcctccggttcctctccccggccaaccccgcctccgtgcctagcgcgtatccctggaggggctcccggaaggttctgctggaaggctgcgatgcggccgaggcggatgcgatggtgatgtggccgccggcgccggtcttggagctggcgcgcctcgccgtcgactccggtggcgaccctggggccatccaccgcttgctcgaccccaccatgctgccggtgcctgatgttgagggaacgaagaagagcaaatgccacctcacaagaacaccgtatggaagacactttgctgacgaggaaatcaattcatactttgcatttctgtttgaattgattgctgcacgaggaccatcggttggattaaatgtatcactgactcggtatgatttattccatgggcatctcttcctggcatcagggacaggaaggcttgggattctgtttcatgccaaagaatatccagcatttgataaagaatcgttcccttacaatttgggatattgccagactgaatctgatgtaccgtatgacgactctatgaatctacgtaatatcctttggttagctccattgccatccagtgagacgaaagcttggttggcaccaggagtgttagtcgtcttggatgcacatccagatggaattatttatcaagacatgatacgcgactatgttcagattgtacggacaatatatgaagatgattttggaaagcatgctgttgatgtcaactatctcaatgttgccaacgcagcggctccagcggatagaattttcatttgctgacatctatcaataggactattaatttcctccaccgtgtgatctcctctctgggaagcaaacaccaaacgtaccgatttttcacccgatcgatgtgttcaaagttccaagaaagcagcagtgggtttgctagcaagtacccctatatagctcgggtgttttcccgcgtcatgctttctgattttgattggagtcagtgttcccctgggctcgtggaggcccctcgcctctcgcctgcgtgtcagcctcgatattgggcggcacatcattggtcggttccagcagcctgtcgaacccgtgttgccctctgtcgtccgagggcatgctcggggggccaaaccctgcccattaggccatgtttgtggcaactttacattgtgaacgaaaagtaccaagtgcaaattttttgcggtgaagtatgtgccctatatatcaagaagt

SEQ ID NO: 17497 - DNA, 1754 bp, Triticum aestivum
  Clone ID: PAT_TA_17497
tagtggatccccgggccattgtaggcttcctgatcagttgtgtggaccacatggctcttgaagcagcgaaccactacctgcagctcgccggcgtccatggcacatccacgccggcagtactactcaccgttctcctgctactcatcattcgactagcatgggtgaggaccacaaccgcgtcaacaagattcggcaagcagcaacagctcccgccttcacctccaggcaagctgcccatcatcggccacctccacctcctcggctcccagacacacatatccatccgggacctcgatgccaagcatggccgcaatggcctcttgctcctccgcatcggtgccgtacccaccttgttcgtgtcctcgccgagcgccgccgaggccgtcctgcgcacccacgaccaaatctttgcgtcgcggccgccatccatggccgccaacatcattcgctatgggccaacagacatcgcgtttgcaccctatggcgagtactggcggcaggccaggaagctcttaaccacacatatgctcagcgcgaaggtggtgcactccttccgccatggtcgtcaagaagaggtgcgcctcattatcaacaagatccgtgcggcggccaccagaggcacggcggtggacatgagcgagctcctgtccggctacaccaatgacgtcgtatgccgtgcggtcctaggagaatcccaccgcaaggaaggccggaacaggcttttcagcgagctcacagagatcaatgtctcccttcttggtgggttcagcctcgagaattacatccccccaaatatggtaatggcggatgcgctcttgaggctggtttccgtcaaggctcagcgactcaacaagaggtgggacgacttgttcaacgagatcatcgaggaacacctacaccccagcaaaccatcatctggcgagcagcaagcagcagatttcatagatcttctgctctctctcaaggaagagtacggtctcactacggataacatcaaggccattttggtggacatgtttgaggcaggcatagaaacatcttatctgacgttggaatacggcatggctgagctcatgaacaacagacacattctgacaaaattacaggaggaggtaagatcccaaggcaaaaagttagacatgataacggaggaggaccttagcagcatggcctacctaagggcaaccatcaaggagacgctgcgcatgcacccaccagcacccttcctcctcccacacttctccaccgctgactgcaagatcgacggatacttgatacccgccaacacacgtgtccttgtgaatgcttgggccctagggagggatccatcgtcttgggagaggccagaggatttctggcctgagaggtttctgcaggatcaagatggtgatgtggacacccaaatgaggggtaaggatcttaggttcctgccatttgggttcgggcggaggatttgtccagggatgaattttgggttcgccaccatggaggttatgttagcaaatctcatgtaccattttgattgggatgttccaaatatggtgggtaccggcgcaggggttgatatggctgagtcgttcgggttaacgcttcgccgaaaggagaagcttcaacttgttcctcagattccctaaacctactatgtgtaagtttatttcgaatgagcacaagaataaaggcaaggaataaaatgactaataatgtagtactgtttatcagttattattactatataaaaaaaaaaaaaaaaaaaa

SEQ ID NO: 17498 - DNA, 1280 bp, Triticum aestivum
  unsure (1)..(1280): unsure at all n locations
  Clone ID: PAT_TA_17498
ttcgtttccgtcttgcgtgcttccccttccctcggccctacaccctcacggccgtggcgcccccggctgggtaccgagccaccccttcggggcccgcgcccggccagggccgggtacctctcgtcctcccggtggcgcagcagccgctccgtccagcaagtggcgctatccagcgcatcgcagtgatccctgcccttcccctcgccgtccgcggtcaccgcggcgcctggcgggctctcccgccatgggccggtggccgcggggtcaggcgtcccgcctgcacaaggcctgcatcaagggtccggacgggaatatcgggccctgccggctgccgtccaggaccgtgtgctgccacatcacgttccatgggctcctacctcagtgtgcaaggacatttcggtttccgacgaaggcgaactggtagtttccggtccaccgcgccggactcgctcttcctcgtggggttcttcacctacaagaaaatacaaggaattcgccggggggctcatctgcgcccttcccctccgtggtgggtgcttctgcttcccaaagccgaacaccctgacaaaggttgggccgtggggtgggaatggagggacaccatttgaaatcccacaggcagagctacctcagcgtctagaaagtgtcacaattcagagtgccgaagttattgattccattgccttcacctacatcggcctagacggcgcaaggcggacagtcggtccatttggtggcggcggcgggactaagcagccgatcctgcagcttggtccttcggagagcctgaaggaaatatttggcacaaccggtaactttctaggattgaatattgtcacatcactttccattgtcaccaatgttaagacatatggaccattcggaaaacaatccgcgggtaatacccctttccgtaccactgcgccagaccgtcacagcattgtgggcttcttcgggcgggctggccaatttgttgaccagcttggagcttatgtgcgcccaaccccaaattagtagaagcaagtgtttcttaagaagacctagtgctttacccgtcatctttccgcttctcagtgttccagcaataagaagggcggcatatatatgctgtcctagtctcatgtactacttgctttcatttttatcttctatgccttttggctatcggctcggtgtggccttagaaataaagttcttattaataagagtgttgaatgtaatcttatccctgcgtcatgttcaatagatgtgctaatgagtagtgcttaaaaaaaaanaan

SEQ ID NO: 17499 - DNA, 606 bp, Triticum aestivum
  Clone ID: PAT_TA_17499
cccggccggggcctccgagacgacggccgggcggtgcggtggccgtacgtagccttccatggaggcgggtgcggggcctccgaagccaggggccgcggcgaaggtggcgtcgtcgtcgtcgtcgttctcgtccgtggccgccacggcggcgagcctggtggcggtgggtctgggcggcgcggcgctgctggtgtggtgggcgctggcgttccacccggcgcacgcgcggctgtggatggtgcccgcggggctggtcctcctcggcacccccgtcctcgcctggctctccctcttcgcctccggcccgtgccgctgcggccgccgccgcccggtcgacgcgccggagcctccggcgccgggcgcacacgcagccgcttagcgacctgcttacttgtacgtagcttgcagttgcttcacctgccgaataccattcttccgtgcgcatgcagtagcttctcttctttcgacacgtacgcgcttgtctaattagtttgctctgctgcttcttgctcgctccgggatcagatgagatcagaccagatgtacacagccatactacatatgttcaccttttgtttcgaaaaaaaaaaaaaaaaaaggccccta

SEQ ID NO: 17500 - DNA, 640 bp, Triticum aestivum
  Clone ID: PAT_TA_17500
ggcacgaacctttttctctcgcggtgagacagcccacttcactatccatttctagactagtccactccttttttcttccaccccgaccacacaaatctattccaccccaaccagatcgccggcgaaggtgtgtgcggcggccagcccgtggatctcggcggcatgccggtagttcgagaaagcggaaccgctcgaggatgctgggcacggaagggggaggagcagagccgtctccgacgcggcatgtctaagaggcgggcgcagagggggatagcggcggcgatcgccggcgagggtgttgcggcagcctgcccacggatctcggcgatggcgcctgctcgagaaagtcgcagcactcgaggatgcgtggcgcggagggagagagcagcagcggatctgacgccgccgccgtccgccgccgcggcgcttcagcgtcggcatgtggtggaggtcaaccagaaggtggacgacgccctgccgcttgcagccgagctgctcgtcgacgtggacgccgtcttctttcctgcgatgtgccgaaggggaactgctcgccgggagtcacccatggccagggcccggcgccgcgtccaactcggtgcacgacgggcgcctctcgtggccggacgccatggccgtgcga

SEQ ID NO: 17501 - DNA, 932 bp, Triticum aestivum
  Clone ID: PAT_TA_17501
gtggacctggagtcgagccggaggcacgcggagaagacggaggcggagctccgggacgagaagaagtgcacggaggagctggacgacgccctccagcgggccatctacggccacgccaggatcatcgagcactacgtggagctccaggagctgtacaacgacctcctggagcggcaccgcggggtcatggggggcatcgcggaggtgaaggccccggccgccacggcccgcgagtcgggcggccgcacggccccccccgccgccctcgcccccgcgccgtcccccctgcggatcctcccggtggacgcccgggcgccgccccgcgagcagagccggcggctccgcgtccagctccgggacaccgccgaggcggtgcatgccgccggtgagctgctcgtcaggctcagggaacccgaggaggcgtccacacaggagaaggagaggagcgcggccatgctgcaggagaaccagaagctgaagaagcaggtggagaagatgaggaggaagcacgaggtggagatcgagacgatgaagcactacctggcggagagccggctgccggagtcggcccttggaggggttctaccgcggcgaggatgcgccccagggagtccacccaccggccacgacgacgatcagtcctggcgatcggcgttcaagtcttgaattccaatgattgctcgagcttcagttgctcctttgccacccaccggcgaccaaggatgatcactctaaattgcttgaatgagtcaactgagcctggttgacagttaggaaacaagcgttggttcttcgatctttcttgatttttatacatgtctatgatgattcatgtgcccactgttggggcaaagcttgatttttttatgtatgatgatgacagtttgtactttcccctttgtatgattgatgggtttacatgtctaaaaaaa

SEQ ID NO: 17502 - DNA, 980 bp, Triticum aestivum
  Clone ID: PAT_TA_17502
cagcaccccgtcgtaccactcgccgccccagccacacaccacgccatcgccacccggctcgaccacgccgtcgtacccgacgcctccgtcgagctccagcaccccgtcgtaccactcgccgccccaggcataccaccccccctcaccccacccgcgggctccaacccctccctaccccacgcccccctccggctcaaccccaccacccccccacccccctccccggccgccgcccacgccccggccctacgccgctcccccctccctcccccggctccccgttgcaagccaggcggcccctccgcgcctcccccgaccaccggccggccgagccgtacgcgccgccccccgccgcctacggcgccctgaggccctacggcagcctccggacgccgccaccggccgccgcctaccccggcgtcgcccgggctccccacgcgccggggccaccagccaccgccacgcctccagcagggccccccacgcaccccccctcccccgcatccccggccgcaccaacccccttcgcccccgggcacaacaacccccccgcccccccggcactgcccgccgccgtccccggccggcgcgaacctgccgttcccgccggtgtacggcgtggcatacgggtcgccgccgccgccaatgaagccgtacaactaattcctcccgatccaccgccggagccaccgccaacacccgatcgccgccagtataatacctcacctcgcgctcgctccgccatcacccgtagtatttttttccaccttggatttctttttcatctcttcttcttccttcttctgaatttgttgcgagtattcgatccacgatctacagagagagagattggatggagttaaaagaggccctcctatgtattctttctgcccggatttattaaattaatttggatgtgtaatcttcgagcctgcaataacagaatgagtggcaccttcatctactgcaaaaaaaaaaaa

SEQ ID NO: 17503 - DNA, 1112 bp, Triticum aestivum
  Clone ID: PAT_TA_17503
gatcagcaaacgaacgtccggcaggcactcaacacaaaacacaaatatgcgttcagctcgcgacctccgcctcgcggtctcggccctcctcctcctccttctgctttcagccggcgtcctggcggcaagagcccagcatgaaatcgacgatgagtcagagttcagctacatccgcgggtcggagaacgggccggagaactggggcaagatcaaggaggagtgggcgacgtgtggcaccgggcagatgcagtcgcccatcgacctctccgaccgccatgccgcacaggcacccaacctcaggtacctcaatcactcctacctgcctgtagatgcctccatcatcaaccgcggccacgacatcatggtcaagttcaacggcgacgccgggagcctgtggatcaacggcaccgcgtaccacctcaagcaagtccattggcactcccctagcgagcaccgcgtaaacggccgccggtacagcctcgagcttcacatggttcacctcagtgccgacaacaagactgctgtgatcggcatcctctacaagatcggcaggcgcgatcatttccttcacgagctggagccttacctgaagaggatagcagataccaaggagaaggaggagatggtaggcatggtggatccctgggaggcgaggggagatgccgaagcgtactaccggtacatgggctccctcaccacgccggcgtgcgatgagggggtcatctggaccgtcatcaagagggttgccaccgtgtcgactcaccaactgaagcttctcaccgacgctgtccatgatggctttgagatgaacgcgagaccccttcagaaggtgaacggaagagatatcaactttttctgccctgatgatcaccatgagcgctattacgctgccgctgatcagtaattaggttcaaacttcaggcagcctgagggatagacatcatgcgtgttaatttttcggaaaccacgacgaagaaccattgattcgatggagcattgcaatgatggtgactctgtaccaagcggagatgttcatagtctcggcacgtttgttaattccattgtaaagtcgaagtcacagacatgtgtccaataaataatttcaagcggag

SEQ ID NO: 17504 - DNA, 2007 bp, Triticum aestivum
  Clone ID: PAT_TA_17504
gccggccgggccgggaaccccctagcagtagcatctcgatcagcacacaacacaaggcaatatgcattcagctcgccagctccacctcgcggtctgggccctccttctcctcctgcacttctcatcgttcgtcccggcggccagagcacagcaagaaattgacgatgagtcggagttcagctacgtctgcggggccaagaacgggccggagaactggggggagatcaaggaggagtgggcgacgtgcggcacggggcggatgcagtcgcccatcgacctctccgaccgccgtgcctcgcgggcgccccacctcggctacctcaaccactcctacccccctgccgaggcctccatcgtcaaccgcggccacgacatcacggtgatgttccacggcgacgccgggagcttgtggatcaacggcaccgcgtaccacctcaggcaggtgcactggcactcccccagcgagcaccgcgtaaacggccgccggtacaacctggagctccacatggttcacctcagcgccgagaacaaggctgccgtgatcggcctcctctacaatatcggcaggcccgaccatttcctgcacgagctcgagccttacctgcggagaatggcagacatgaaggagaaggaggagaacgtcggcgtggtagatccctgggtggcgcggggcgatggcgaagcctactaccggtacatgggttccctcaccacgccggcgtgcggctagccacccccaccacccgaaacacaacgatccgctcaccggcgtccggccggcactcgacccaggacccacacatccgtccgcctcgcgacgccggcttcgcggtctccgccgtccgcctgctcctccaccgtgcggccggcttccgcgcggtcagagaccaggaggaggtggacgacaacggggggatgaagtagaacggcggggtcaactacggcacgggcgaactggagtcggccatcggcggctccggccacgtgcactccccggcagacgccctcggctacctcactcacccacccccgcccctcacggcccccaacgctacccgccgtcacgccatcatagccacgtgtaacggcctccctcggagcccacggacacgcccccctgcgcacgtcctcaagcgagtccacgggcccgcccatagccggcaccgcgtaacccctcagccaggcacactggcgctccactagggtgccccaagcaaagagaagaagactcacatgctcggcatactctacaaacttcaccgccgagaccataggctgccttgaccggagtcctacacgagagcggatagcacaccccatggggaagggagataggggaggcatggtaggaggataggagagcccggggagatggcggagagcctactcgtggtgcatcggcgggagccccggggcgatggccgagcatagggtcggcagtagggccatctgacgacgcgcggccttctacggtgacgacctcacgcctgtcacctacaacgtacatactgcgtcaaagctcaaagtgaaaccactcaccaacgccaccggaggaggtatagagatattaacttttgctgatcacaatacgagcatgagcgctactacgcttcagtatgtaagttattaggttagaaattcagacagcgagacagatagcgagcatgcgtgttaatttgtcggaaaccaggacgaagaaccatggattcgatggagcattgcaacgatggtaactcggaaccaagcggagatgtttttagtctcggcacggttgttaattccattgtaaagtcgaagtcacagacatgttgttaataataaatttcaagcggagtcactgtcgtgtcgttgttgttatcttcaatacttggatgacatgtgctcaatctagtacgctgtcttatttgagttttcttctttattaatatttaaataaaaagtgcctcaatcacggctggttgtgccatcttgttgctaagatgtgctagctaatggatttatttcttc

SEQ ID NO: 17505 - DNA, 589 bp, Triticum aestivum
  Clone ID: PAT_TA_17505
ctggcactggctaggcaaggtagcgaccatatacacaacaccccgtagtatcaacgcaccgccatggccaagctgcaccggctcgtctccgtcgtgctcaggctcgtcgcggccgtcaccgcggccgccgcggcgataatcatggtgaccagccgcgagaccaccagcttgttcggcctggaaatcgaggccaagttctctcacattccgtcatttatcttcttcgtggtggcatacgccgtggcatgcgtctacagcctgctcgtcatcctcgtgccgcccgggggcgccgcctcgagattggtcgtcatggccgacgtggcaatggggatggtgctcaccggcgccgtggcggccacgggcgcgatcgcggaggtcgggaggaacggcaacgagcacgccgggtggctgccgatctgcgagcaggtgcacggctactgcaaccaggtcatgggagccctcatcgccgggttcgtcgcgctggtcgtctacttcctcatcatcatgcactccctccacgccgtcactgataccatgtgtccgtgccattagctaccattatagtgctgtaccctcgatgatctatgta

SEQ ID NO: 17506 - DNA, 969 bp, Triticum aestivum
  Clone ID: PAT_TA_17506
gtgcggcgctcaggcggcgtccccccgcgtccgcccacgcgtccggggaggcatcatcgatcggccattgagagggaacgaagggagagcggcggaggaggcgaaggcatcatccatggccgcggtggtccggagcgtgtggcaggggatcagggagaagggcctcaccaacttcctccgccacgcccgcgaagagggatacctaaaatgccttggggacggaaacctattgcaaaccaaaattcacaacattggtgcaacccttgtaggagttgacacttttggaaacaagtactatgagaaactacatgaacactcaagtatggaaggcataggtgggtagagtatgcggacaagggtcgctacaatgcatcccaagtgcctgctgaatggcatggatggctgcaccacattacagacagcactggggacaagctgctggaggagaagactaaaaagttcattagggagcacagacagaactacaccggacagggtgacgacttgatctaccactccaaggggcatgctctgaacccagggcaaagggactggacaaggtaccagccttgggaaccaaagaaagaagaggccacctgatctgatctgaatggtacctgataatcctttctatgtttcgcatttggtttggtgtcgccgatctaaaaccgccagtcagcttggtttcgtggactggacctgaataatgtactctatctgatactgaatacctgccactgaacaattttaatctgtgtgtggatgtggcaatggaaaaactggcgattgggtcgtcggtgtttgcattgaagagtttcttttttctactgatgtgcgtggatgttgagatgctgaaaggagataatattgtttggtaaatccggtggcgttgcaaaacgtcaaaaaaaaaaaaaaaaaaaaaaaaaaaaaaaaaaaaaaaaaaaaaaaaaaaaaaataaaaaaataaaa

SEQ ID NO: 17507 - DNA, 1425 bp, Triticum aestivum
  Clone ID: PAT_TA_17507
gccgcccccttcgcggtgtccccccccatccccgccttcgccgccgtcctccgccgcgccatgtcgttctcctccgtctccgctgcgtcgcagccgagggtgggtgtggtgcagatgacctccgtgggggacctcgacgccaactacgccacctgctcccgcctcaccaaggaagctgctgcggccggagtcaaatttctttgcttccctgaggtcttctccttcataggatccaaggatggcgagtctgttaagctagccgaaccattagatggcccaataatgcagagatattgctcacttgcaaatgagtcaaaataatgggtagatattggtcgctttcaaataaggcgaccatgtggttgtctcttggaggattacaaataagtgaaccgatgaatttgcaaaagtacgacactcataccggaaaattcatttgttgaatagggaggagctcgtaacgagggattcaatggaaagctgttgatgtacctcgggtgatagcgtagaagcagtgcattgtcccgacagaaggtgacaccttactagctgtgaacaggtcatatgtacgatgccgtctcactgtttgctttgaaatgatattgctaaggttttgcgcataccatctgtatacacatagatatctgggctagctcgctgcaaatgcattcacaaaggtaactgaggaagcacactgggaaattctccttcgtgctcgtgcaattgagacacaatgttatgttattgctgcggctcaagctggaaaacacaatgagaaaagagaaagctacggcgattctatagttattgacccatggggaacagttatagctcgacttccagatcgactgtccactggatttgcagtagcagatatcgacttgtcaaaagttgaggctgtgcgaaccaaaatgccaatctctgggcaccgcaagtttgagacgcatctggaagtcctcatcactataataagttgaaggtggctcttgcacgcttcgcccgctcttatttctcacattccggagattcttcttttgtgtataataactgccatttttgttcacaagatggtccagttcgattgggatttccaagtgagacatgtcatagaacttaaataagctacaactgtagtagcatatctagtaaataggggatatccaaacattggctcagaagcaccttagtgacttggtttgagagtggcttctacctcttgcttatgggtccggacaaatccagaaccccgttccaaaccccaaagcttaggaaccagcttaaggttgtgtttggattgggccttaggggcttttgaagccaaaagctcaaccaaatcccccgaatttgatgtttgtgtggatgttttgatgtgtccatgcatgcgggcggccgtcctttctttatgtcactaaaaaaatccagggg

SEQ ID NO: 17508 - DNA, 713 bp, Triticum aestivum
  Clone ID: PAT_TA_17508
gttgaattggatacatcatgggatgtgataaaggcgggagatttgtgggaagatgatgacgacaatggatatgttcttgttaagccagaggatgcagctgaagggatagctttctttgtagccacatacttatcgacacttacaaaaaccaaggaattatctcctgatcgacttcagaaagcccttaagaagacattttcagccgagaagagaaaaggcaaacttcggaaggcatgggatgggacaaaagtcatttataatgtagcttcatggggtgccacagctgttggcatctacaataaccaagcaattcttaaggcagcaggcacagccattcagatgtcctggcgtgtggtgtccaagttcctgtgagtgatgggtggtggtgattgttgttactggcgtgctacatttatttaggtataaaggataccacattggttggaaatgtccgagtagttgatatactcccgattgaagaattgaggtctagagtttaggtctattgggaggcttgaaggattgaggcttagcgtttaggtttgttgattgaaggctcggaagcccctttaaataaattacgctggggctcgaatgtaaataggcccttaatttggctgcgtgaagcaactgaagctcagcatatgtatcctaaaatgtaaatatgattcatttgataacttcccattggggccagaataaactttgtgaat

SEQ ID NO: 17509 - DNA, 711 bp, Triticum aestivum
  unsure (1)..(711): unsure at all n locations
  Clone ID: PAT_TA_17509
cggcacgagccaccgccgccgctaccgccaccatcctgagatgccgaccgagctgaagcgcgccgcggaggatggtgatgattccactcccacccgtcttcgccggaaaatcgtagttccagaaaagccggtctatctggtggtggcgcacaaggcggagccagcgtactccatcctcagtgttggcacaatggcgcctaagatcccgctgcacctcagccaacgcggcatgtcgttcactgccatggagtcgccgcaggggtcctggatcgttggcgtgggcggggacgaagcagattcacaccaccatcttcgatgtcaccgcctccaaggagtggcagggcccgtggctccataccaataagatggagcccatcctgtttccacaccgcggccaagctctacgtgctctccaagccgcccctccgtggagaggggggcgatggggctcgactaccttccctggttcgagcagattangacttcgaggacggccgccctaaccaagnccgaggtttgcctagaactcgagccgccgcccatctttccgtgccgcatcaccccgcctgagtacaggaacccgccggctatacgcgttgcctcttacgccatggttggctcccatattttgctctccgtgcaactggacaatgtgaccagccccgacaaggttgccaggaaatacaggaaatacatgggaacctgcgggta

SEQ ID NO: 17510 - DNA, 1117 bp, Triticum aestivum
  unsure (1)..(1117): unsure at all n locations
  Clone ID: PAT_TA_17510
cggcacgagatggtcatcaagctggacttcagaaaagcttttgactccatttcttggtcctctctaacatcgatcctacaagcgagaggtttccctcctatcttctgtgcatgggtccaaaacattctccacactggcaaaacggctattctcctcaacggcactccgggatcctggatccaatgtagagctggcctttgacaaggtgatcccttttcgccgtatttattcatcatcgtcgcaaatgtccttcaaagactgatcgcacaggctttcaggcaaaacgaactatgccaccccctccgttcgaatgaaccacccgtaaccctacagtacgccgatgacacacttattattgctgctgccagcgtcgcagcaaccactattctcaaaaacactctgcatgatttcgccctagcaactggcctagtcatcaacttccaaaaaacctcgcttctcaccattgccacagatgacctcacccaaaacaacatcgctgcaactattggatgcaatctctccttcccgttaatctacctgggcctccctccctcccctctcaaactaccactctcagctttcgaccctatactagatagctttcgaaaactccttttcggatgggttgcgcgtctactctctcgtggagcaagactaaccttgctcactgctgtcctcgattccttaactatttacttcatgtccgtttttcgcctaccgaagtctatcctagttaagctagatgccatccgngagagcttttttctggtccaacgaagaaacttgcacgggtgcaaagtgtctggtcgcgtggaaaaacgtttgcaggcctaaagaactgggtggtctaagcattaaaaatcttgaaattcagaaccgctggctacttatgaaattttccttcaaaantttgcaacacaaaaanaancccctgggaccaatggtatcatcaacaatacccacttgggattgcaacaaaaccctaggcttcttccttggaagattataacaaaactgctctccaatnaganncttcgngatacaaaangctntcacttcttttggtagnaaagggttttgatcactctaaaaaangggggccngtccaattcnccaa

SEQ ID NO: 17511 - DNA, 751 bp, Triticum aestivum
  unsure (1)..(751): unsure at all n locations
  Clone ID: PAT_TA_17511
gatgactcggcacgtgacttgtctgtcaaatccaagtctgttcagttctaatgagatacaatttggctgttgcacggtagacatcttgaaacagctgagtggtgatgaaatttctcgcaagccacctggaggaaaggccgcagataggatcgggagacttgcaacacatatagtgaagcaacaaagctactaccctctgtatccacctggctgctgggtgtgcccaatggacttcctcacttgccaagggaagcaattgggagattcccgtcaagctcctggatggttcctcctgcttccttcctggatcttgccccatcctggtgaaagggtgctttccgtgaaacgaaagacaccgggggaacattaacggttcatctgtgtgaaccctggganggctagcaaaaggtatcggtggaggcacgtttgtagagcttttactacaaccagggcactgagaagacgaaagccttcattatgcgcatctaagaaagaatttgtaacattttcctattcaccaagtaccggactggaaaaatgagactagtgtgaagtacatccgttctgttctttttgccccactctgctgtgaattggatccagggagtctgtaagcctgtatttctagttaggtaattcagcttagtattggtggaaaatatctcccaaacttatttgtaacctgcacgtacattttatattcagcacaaactcaacagcctatgtttgggaaaaaaaaaaaaaaaaaaaa

SEQ ID NO: 17512 - DNA, 665 bp, Triticum aestivum
  unsure (1)..(665): unsure at all n locations
  Clone ID: PAT_TA_17512
gccgggtcgggacataaaccctgctnccaccctgctgccggccgctcgggacggtccgggaaaaagaccaatcgcacaacaagaacttgcttctaacaactcccgaccagaaaccacattcaaaatgaagcacctcgcagcttaccttcttctcggcctcggaggcaacacctccccctctgccgccgatgtcaaggccgtccttacctcagtcggtattgacgctgacgaggaccgcctgaacaagcttatctctgagctcgagggcaaggacatccagcagctcatcgctgagggttccgagaagctcgcttccgttccttctggtggtgccggtggcgcttccggtggtgctgccgccgctggtggtgccgctgaggaggccaaggaggaggagaaggaagaggagaaggaggagtccgacgaggatatgggcttcggtctcttcgactaagcgatctctgtctagagattcgcaaagtaacgatacctcacgaatttcgaagatgctacgcacgggttgttcaccagttcttacacgtcttatgcgtggatggattggccggtcatggctggattgtgtttctctaaggaagggataacatacggttatggaaattaaaaaaaaaaggcggttcggctcttcgaaaaaaaaaaaaaaaaaa

SEQ ID NO: 17513 - DNA, 784 bp, Triticum aestivum
  Clone ID: PAT_TA_17513
gccggccgggtcagggagtgcccacaagatagcaactgccggccgggcgcgggaactgccggcctttttggcataccgaacaaccttcaccaccgaactcgaagtttcagtctccgcccaacctgcggttaaagtgattgatttctcttgttctcgtcgactccaaacaaaccacattcaaaatgaagcacctcgcagcttaccttcttctcggcctcggaggcaacacctccccctctgccgccgatgtcaaggccgtccttacctcagtcggtattgacgctgacgaggaccgcctgaacaagcttatctctgagctcgagggcaaggacatccagcagctcatcgctgagggttccgagaagctcgcttccgttccttctggtggtgccggtggcgcttccggtggtgctgccgccgctggtggtgccgctgaggaggccaaggaggaggagaaggaagaggagaaggaggagtccgacgaggatatgggcttcggtctcttcgactaagcgatctctgtctagagattcgcaaagtaacgatacctcacgaatttcgaagatgctacgcacgggttgttcaccagttcttacacgtcttatgcgtggatggattggccggtcatggctggattgtgtttctctaaggaagggataacatacggttatggaaattaaaaaaaaaaggcggttcggctcttcgaaaaaaaaaaaaaaaaaaaaaaacctaaaaaaaaaaaaaaaaaaaaaaaaaaaaaaaaaaaaaggcccctaggccccta

SEQ ID NO: 17514 - DNA, 452 bp, Triticum aestivum
  unsure (1)..(452): unsure at all n locations
  Clone ID: PAT_TA_17514
gagggtctatgaacantgngccttgagaatatgtcctaaaggtttttttgagattatgcaaaaacttgcaagaatgtggtccccccccccagtgatcttgttccaagatatttgttcccggatcttggatctgagcaagttgggacaactgtaagtcttgcagtcatttccattttaaagcagaacgctgtcattactgcttttatttgcacgtcctcttgaacttgaagtttatacgcttgtgggctacttggtatctttattttgttttatgtgatatagtatctctagataataatttatttattacttatatcttgtgatgaacaatggtaaactttattactgaagatcatgtaatcttcttttaatggtgtgagttgtaaaaagtcttattgaacactgacaggcggaatgatgtattgttgatcttgttcaaaaaaaaaaaaaaa

SEQ ID NO: 17515 - DNA, 687 bp, Triticum aestivum
  Clone ID: PAT_TA_17515
gaaaccctcaaatcgcatcccctcctcctcccacgccggccggaatcctcctccgcagccgcctacctcagtcgacctccttcttccccacgccgagcgaaatctctctctctctccgtgaactcgttcgaggtcggcgtttgcgggcgcgggggaggcgcgggagtcagagcatccgcggcgaccggagatcaaggaggaggaggaagaggaaggcgcgggcgcgttgaaggcggacccgccgtccttccggcgccgtgaggtgaccttgcgcgcgggcgggagcttgggtctccaacgcagactgggtccttttgaccccgtggcttcaagggcgagtggcgccggctgggcccgcgggcggccgatcgggcggtggcggtgccggggggcagggtgtcaagaaggcggctgcggcgtgcgacgtggagccgctgcgcaagtgcctgcaggagaacaagggtgatcgtgtcaatgccaggctcacatcgatgccttccgatcctcgtgttctgtcagccccaccactacctctgacagccatcctgccgtaaaaaaggggatgtgaaacacaatggttctgttgctggggtagttttacaagaaactgcatggaacacttatgatgaataaggtgacgacgcaataaggtgacgacacaacggtcatgtgaaagattggataatt

SEQ ID NO: 17516 - DNA, 1095 bp, Triticum aestivum
  Clone ID: PAT_TA_17516
gccacgggtactagcaggccctcctcccctccttcgcctccccgctcctcctcctccccgccgccgccgctcccctccccctgcgcccccccccccccccccccggatccccaccgttttttgccggctaccgcgttggccgcctccccccccgctggtccgcgcccccccccgcgccgccccgccgctgcggggcggtccccgcccgttgcttcggccccccccctctcccggcggtcctggcgcggggccggcccgtcggtcgcggctctggcctcggccgggggccccggcatggggccgggccggcgcccccggcgccgcccccgcccagcggcgccggcacggggggcggcgccggcccccggggcgcggccgcacaccgtcaccattaccgagttcggcgccgtaggggatggtacgaccctgaacaccctgcccttccaaaacgccgtctcctacgcccgggccttcgccgacaagggcggcgcgcagctgtacgtccccaaggctccatggctcaccggcagctcaacccccagcagccatctccccctcggcctcgtgtgggacccctgcctcctcggcgcggagggcttaatggacttatccctggccagggcttagtatggtgggattggcttcgctctcatgaactaaatcatagccgccctcatctcgtggagtttctgtattctgaagaaattgtgatatcaaacttgacatttttgaactcaccagcctggagcatacatccagtgtactgcagcaatgtaaaggttcataacgtcacaattaagactttgttggatgctccactcactgatggcatagttccagattcatgtttgaatgtctgcatcgaagacagcaccattagtgtcagtcatgaagccatctcagtgaaaagtgggttggacaagtacggcatttctatcggaaggccaacctcggacattcatatcagcagagtggatcttcaagcgtcatctggtgctgcacttgcatttggcagtgagatgtccggtgggatctcaggtattcatgctgaccacctaaggatacatggttctgataaagggttctctttgaaga

SEQ ID NO: 17517 - DNA, 738 bp, Triticum aestivum
  unsure (1)..(738): unsure at all n locations
  Clone ID: PAT_TA_17517
cgaccgagcacctcaaatcatcctggcgatcttggagtgagagcgtggctctcaacgctgcactgctacgcgccaccaccgacccaccaagcacctcgagtcatgctggtgatcttggagtgagagcacggctctcaacgctgcactgctacgcgtcaccaccgacggaccaagcacctcgagtcatgctggtgatcttggagtgagagcgcggctctcaaggctgcactgctacgcgtcaccaccgaccgacagggcacctcaagtcatgctggtgatcttggagtgagagcgcggctctcaaggctgcactgctacgcgtcaccaccgaccgacagggcacctcaaaccattctggtgatcctggagtgagagcgcggctctcaaggctgcactgctacgcgtcaccaccgaccgacagggcgcctcaaaccattctggtgatcctggagtgagagcgcggctctcaaggctgcactgctacgcgtcaccaccgaccgaccgggcaccgcatcccctgctggtctgccgggggcgtgcgcgcgcccccctgcgctgctctcccgcgcgccccctccgacagaccgagcaccagaagtcattctggtgttcttggagtgagagcgtggctctcaacgctgcactgctatgcgtcaccaccgtagncctcctcgtgtttcgtgtagctactgtggtacgtggtactacattcttggagctannnnngtaagtgtagnn

SEQ ID NO: 17518 - DNA, 912 bp, Triticum aestivum
  unsure (1)..(912): unsure at all n locations
  Clone ID: PAT_TA_17518
ccaggacccgtccgttttataggggaaaccacaacggcggcgatgcggctactctccggcgtccccgcctccgcgtcctcccgcctcacctccccgcgcatctccttcgcccgctcgagccgtagaagcatgggggcgaacggccccactaccggcaccgcctcctcgtcatcctcttcctcggccactgccagcgccggcgctggcgccggcgcggcccagaagccgtggctgttcgtcgggctcgggaaccccggcaggatgtacaaggggacccgccacaacgttgggtttgagatgattgatgctattgcagaagctgaggggatatctgtcagcactaagcaattcaaatcgatggttgggaaaggccttattggtgatgtccctgtaatgcttgccaagccgcagacttttatgaatgcaagtggtgagtctgtcggccagctggtttcatatttcaagataccacttaaccaagtcgttctgatctacgatgatctagacttaccctttgcaaaactacgtctactgccaaaggggggacatggtgggcacaatgggatgagaagtgtcatccaccatctgaaacaaagccgtgatttcccacggctaagagttggcattggacggccaactggaatgatgggagccatcggttttgttctacgtgcattcagcaaggaagaacaagaatgcttgattccacgttcctgaggggcttgcaacggtgcggataatgttctggaagatcacaagagtgcacctttgaacaccanctcacagcacctgaaacttganagataaaatactgacgtaacaanctagatccacgnaatgtaatagttgtaagtaagatnccagtactcagaacagaacaaaagacattccttacaantaccagtcaatatt

SEQ ID NO: 17519 - DNA, 631 bp, Triticum aestivum
  unsure (1)..(631): unsure at all n locations
  Clone ID: PAT_TA_17519
gcacgaggcttcgggctctaccacaccgatctcaccatggcctacgacgccggcctcacctcctcctcgtccggtggaggtggcggcagcgcccccgccacgccgacgccaacgacgccgaccagtccgagcaaggggtcagggggatggtgcgtggcgagcgcgggcgcgacggacgcgcagctgcagacggacctggactacgcgtgctcccaggtgggcgtggactgcggcgccatccagcccgggggcgcctgcttccagcccaacacggtgcgcgcccacgccgcctacgccatgaaccagctctaccaggccgccggcggccacccctggaactgcgacttccggccggccgccaccctcacctccaccgaccccagctacggctcgtgtgtgttcaccggannccaatgaaatgatgcaaccaaccggagcatgctatgcaccacaccacggccggcgtctgccttgcgccaccgcgtgattgtctgtcattgtcctgacaggacgagagctgagttgtttgtgtacacacatcctgtttatttttctggacaagcaannncgccattcattcgaatttaaaacattttacatgagtgatggtacatccctgcctaattaaaaa

SEQ ID NO: 17520 - DNA, 788 bp, Triticum aestivum
  Clone ID: PAT_TA_17520
ggccgctttcgaggccggcgggtgccgggcggaaaaaaacggcttccaaattgagaatttctcgatcgccatccaactaaccgcccaaacaccacagccaagatgacgaagggtacctccagcttcggtaagcgtcacaacaagacgcacaccctgtgccgacgatgcggtcgccgctctctccacatccagaagcatgagtgctcttcttgcggttacccttctgccaagatccgcaagtacaactggtccgagaaggctaagcgaagaaagaccgtcggtaccggccgcactcgctacctcaaggatgtgtcccgacgattcaagaacggtttccagactggcacacccaagggcgctcgtggccttactgccgagaaggcctaaatgggaccgcatcccttctgaccccctccaccacctctccggccctacccctcttctatcacggacgtttgaaacacccattccctcgagcacgcacacatcaacaatgacggctctctcatagcgtgagctgagaccgtaggggaatatggttggaactggagcaaggcggtgactgggacgggcggctgtgtttgttggttcgtggatgaaggacctctaaaggggtggcttggagcatgggcacggtgttttacatgtttgagcaaggaagtaaaaaaaagaacccctttgctcttcagagattccatagggtttcggttacgaggttctgaaatggcatcttgattctgcatgaaaaaaaaaaaaaaaaaaaaaaaaaaaggcccctaaagccccta

SEQ ID NO: 17521 - DNA, 699 bp, Triticum aestivum
  Clone ID: PAT_TA_17521
gccggccgggctgggatcatttccttcccccatccaacacaagccccgatcagcagagctccccctcacctacagctccctgtcatcaacccacaccgcgagttcgcgtaccgggggaccgatcgatcaagcggcaagaatggcggcgacagggagcgctcagagccgacggttcgccgcggcgtgcggcgttctcagccgctgcatcaaggcggcggaggcgcggccggcgtggttctccccctcatgcccggagcggaagtgcccgcgcaagacgagcacgctgcgggtcctgcgccggcgaacgcgcagatgactatcttctacggcgggcaggtgctggtgctcgacgaggtcccggacgacagggcggccgagctgctccgtgtcgccgctgtctcaggcgcaccgcgtgggaactccgaggcggcggatggcgacctgcccatggcgaggaaggcgtcgctgcagcggttcatgcagaagcgcaagggaaggctcgccgcgcgcgccgtcccctacagccggccagacggcgacgccgtcccctaccatctcacgcttacgctctgatttgtattcgtgcgtagtagagtagcctgagtaattgttgacccactcgcctgtccccgtcgctctgaattattatgatcagaaattattgctgttgttcaaaaaaaaaaaaaaaaaaggccccta

SEQ ID NO: 17522 - DNA, 702 bp, Triticum aestivum
  Clone ID: PAT_TA_17522
gccggccccggcccggaaccaacttaacaaccgatcaagcagagcctcccctcccccctgcgaccggccgagctcgttaggcttcgagagcgcacagggagatcggtcgatcgagcgagcgagcgagcggctagaatggcggcgacagggagcgctaagagccgacggttcgctgcagcgtgcagcgttctcagccgctgcatcaaggcggcggaggcgcggccggtggctctccccctcatgcccggagcggaagtgcccgcgctgcaagacgagcacgctgtgggtcctgcgccggagcacgcgcaaatgaccatcttctacggcgggcaggtgctggtgctggacgaggtcccggcagagagggcggccgagctgctccgggtagctgccgcagcaggcaccgcgccaggggacggcgacctgcccatggcgaggaaggcgtcgctgcagcggttcatggagaagcgcaggggaagggtcgccgcgcgcgcagtcccttacagccggcccgacggcgacgctttctcttgtaaccgtctcacgctcacgctctgattcgtgttcatgcgtggtagagtagcctgagtaatttacggtccatgtaaatgtgtggctgttgttggagtccaaatcctgaattatgatgaaaaaaaaaaaaaaaaagggttttgacctaaaaaaaaaaaaaaaaggccccta

SEQ ID NO: 17523 - DNA, 741 bp, Triticum aestivum
  Clone ID: PAT_TA_17523
gccggccgggcttggatcagttttatcattatcattcctgcaactaacaccctatcaactagcagaggcactgcgagctcgccaggcttccagagcgtacaaggcgaccgatcgatcgatcgaccgaccggcaagcaatggcggcgacagggagccctaagggtctacggttcgctgcagcgtgcggcgtcctcagccgctgcatcaaggcggcggaggcgcggccggcggccacggtggtcctccctctcatgcccggggcggaagtgcccgcgcaagacgaccacgaggcgggtcctgcgccggcgaacgcgcagatgaccatcttctacggcgggcaggtgctggtgctggacgaggtcccggctgacagggcggccgagctgctccgtgtcgctgctgtctcaggcacaccgcgagcgagctgcgaggcggcggatggcgacctgcccatggcgaggaaggcgtcgctgcagcggttcatgaagaagcgcaagggaaggctcgccgcgcgcgccgtcccctacagccgccccgacggcgacgcgttctcctctaaccgtctcacgcttacgctctagttcgtgtccatgcgtactctagagtagcttgagacctgagtaatttatacggttgatgtgtgtctttgctctgaattatgatcaaattattgctctgaattatgataagaaattccggctattcttgttttgactaaaaaaaaaaaaaaaaaggccccta

SEQ ID NO: 17524 - DNA, 760 bp, Triticum aestivum
  Clone ID: PAT_TA_17524
cctgtgcggcgctcgaggcggccgggcctcaatccatcagtttcttcctccaaccaacacaacacccgatcaaagcagagcttcccctccccataccaccaagcgacaccgcgagttcgcaaggcctggagagcgtacagggcgattgatcgatcaagcggcaagaatggcggcgacagggagcgctaagagccgacggttcgccgcagcgtgcggcgttctcagccgctgcatcaaggcggcggagacgcggccggtggccctccccctcatgcccggagcggaagtgcccgcgcaagacgactacgcggcgggtcctgcgccggagcacgcgcagatgaccatcttctacggcgggcgggtgctggtgctggacgaggtcccggcggacaaggcggccgagctgctccgtgtcgctgctgtctcaggcacagcgcgagggagctgcgaggcggaagatggcgacctgcccatggcgaggaaggcgtcgctgcagcggttcatggagaagcggagaagcgtaaggggaggctcgccgcgcgcgcactcccctacagccggcccgacggcgacgccttctcctgtaacggtctcacgcttacgctctgattcgtgttcatgcgtagtacagtagcctgagtaatttacagtccatgtaaatgtgtgttttgttgctggagtacaaattctgaatttatccatttaaatgattaaaaattatttgtagtaataaaaaaaaaaaaaaaactaaaggccccta

SEQ ID NO: 17525 - DNA, 382 bp, Triticum aestivum
  Clone ID: PAT_TA_17525
ttgtggactgtgaattgtcacagagggatcaactaccacgggtgaacaagaaagatagctcagaggagcctagcatggccgctgctcggtgctcctcgttccctgctctctgcgtggtggtagtagtagtggtactcatcggcggctgtggcgctgcgtccggcgcggacgaagaagggctcatccaccttcacttctacttccatgaggtcaacgccggcacgcccaacgccaccgtcctcaacgtcgccagcctgcacaagtaattaagcatctactagctctgtatgcatcggccggcgtatatcacaaatatattcacctgaattgatttggcgcaggaactcatccacgttcggggacctgaacgtgttctacaaca

SEQ ID NO: 17526 - DNA, 482 bp, Triticum aestivum
  unsure (1)..(482): unsure at all n locations
  Clone ID: PAT_TA_17526
gggtccacgggacaacaccaagctctactgaactcccaggaggaggatcttgccgcccatgangagaagcttggcgccacactccatggaaaggacgaggaggtggagaaggtcgtcgtgcagtggacctaggagctggagcagaggtacaaggaggcactcaatgcccaggctctggttcatgccggcaaggtgaaagagctagaggtggagcgggacgggctgaaggatcaggccctgaagctggccaaggagaatgacacgctcaacggtgccctggtggaggcgcagggtgcagtcctcggcaaggctgagcagttctccaaggccaacgaccccatcaaagacctgaagctgaagctggagggtcttgaggagatgctctcggaggccaatgcccgggaggagaccctggccaaggatctggaggtcgagaagcaactgcggaagaacgaagccgccaaccacaaagattttgtgga

SEQ ID NO: 17527 - DNA, 1740 bp, Triticum aestivum
  Clone ID: PAT_TA_17527
gcgggaaaccgcacctggcagggaacggcgccctttcccgcacgcctcattagtctctcgtggcgtgcaccccctgcggcatgccgcggtccggaagcttgtcctcacgctgtgccggcgcgggggccgcgctcgcgccgtaccccacgcggtcgcgtcgcgccagattggagggccgccctaatcgttccggtcggggcatcgcctgtctgcgatccggctatggacctctagccgaagtggggcgcggccgcccgtctccgaggtccatcgcatcatccccatactatcgtagcaatgccctcggtcgtgcgacggctaaggcaggacgttcctgttctggatcgggccgatcccggccaccttcgctgtgaacatgcagttgataaggctgccaatcacggacaggaccgcctgacattcgaactaggccataaaccctgtgctggaaagactcttcgcctcgtgcctctccaggttggcacgtgaatgatccacgggccgccgtcatgctccccttcctcgtagtatgtccacaaggaacaatatcatgtcgtctgtgacgccagcgctcacgaggcggatcattttgcaatgtcgacaccagataggccaaaacgatggcgtaagcaaagcagctgacatagacatgatcaacgccttcaacgacattaccgcaaagattaacggacacgtcgccttcggcacaagccaccaggatgtcgaggaggtaatcgtcttgatgcgggagatgcaaaagatcgccactgcctccacgctggatgctccaatactctggtatctgccgactcggcgtgacatgcacgttcgacgtctgaacaaacagctgagaagcaagatcatgggcgatcatgcaggcacggctggccgcagatggagccaaatatggtcgaggagacaccggcggctgcggggacgacctgctcgggctgctgttagaggcatggacaccgcaccggcaagggagcggcggcgatacaatgacaaccgacgaggtgattgatgagtgcaagaccttcttcgccgcagggcaggaaaccacggccaccctcctcatctggaccatgttcctgcttgccgtgcacccccagtggcaggacaaggtcagggaagaggtcctcagggagttcccaggcggggacggcgatgatgtgatacccaacgccgatattctcgccaaacttaagctgctacacatggtattgctcgagacatcgcgtctctaccctccggtcgtgtacatacaacggaaggctgcctccgacaccgtcctcggaggcatcaaggtaccccagggaacaatcatatcaatccccatcggcatgctacaccgagacaaggaagtttggggccccgacgccaacgagttcaaccccatgaggttcgagcagggcgtcacaaaggctgccaaagactccaaggcgctcttgactttctctctaggcccgagagtatgcactggtcagaactttggcatcgtgcaagtgcaggttgtcatggcgatgatcctcaccaacttctccatctccctctccccggagtatgttcacaagccaaagtatcttctgtctttgacacccaggcttgggatgcctctcattttgaggaatctactatagatgggcgagaaagattgcaaaattaagctcattgtaactcatgagagtaatttcattataatttcagtgtcttagttatggtcaaaaaaaaaaaaaaaaa

SEQ ID NO: 17528 - DNA, 1475 bp, Triticum aestivum
  Clone ID: PAT_TA_17528
ctggcggcggtacagatccggcgggacaccgtcgctgtgcgcagtcctttcccccaactactccggctctaaggtctgggatccgcctcccgggcagccccgacgttgctctccatctcatcgtcggggacccagccgccgctgccgccaaggtctactccctgggggcaccacctcggcttcaccgtgccggactacggcgtcttcgcgaccggcccgaagagccatggcacggacgtgttcgagaagacgcagcctgacggccgggcgcgactggttgtcgctacctcatttgcagaaataaattccccaatgcttctcattgatgatgcgagtacaccaaaaaagaaacaagccttctcttaagagggttctttgtataaaccccagtgtgatgaggaattgaagccaaaagtggggatgctatttgatgacattggctcagtaatggaattttacaagacatatgcacaccatgtcggatttggtgtacgtcttggacagcaaaagatcgtagataatgtgcttctgtggaagcgcttcttgtgtgcaaaagaaggatttcggcccgagaaaggtatggttgttgttgatcattccaagaaaaggcaaaaggtatgaacttcgtgcaacatggataccagcttactttatggagattcccctagctggtcttctcaggacaacttcgatttcagagagcgcaaactcattttttaagcgtttcatttgtcgcaagcttacctttgttgagttttggctaagatttgacactgcttgaagtgtcagaggcagaatgagttaattgctgataacacaagtgaatacacaacaagtgagttggtgacaccatgggctgcagcgtgccgcgccagggcggtattcacccacgagatttttgaattatttcaggcccaggtgcttgctgccagagatgattgtgatgttcaggacacgaaaaatcatgaggagattaaaatcatgtttgtgagtgatcaatacaaaaagattagataagtgtcttatgacacagtatccatgactgctaaatgttcttgcaagctttttgagtccaatggaatcgtgtgccgccatattatccgagtgttgaggggtgcgaaaataaatgaattgccaagaatttatgttcttaagcggtgggagagaaattgcaaaagggacattatcttcgatggggaagggaacatgcttgaagagaatttaattgacccggttgacatggctatgaaaaggaagatagctctcattaggaacaagctagaagatctcattcagaagtctaaaggttcaatggaaggaattgaattcctgcacactagtttgtgcaatgctgagatggctttagcccatctcgtaccagctgtagcatgcaacacacgcgaaaatgaggagtcatttatcgggagcatcattccaaagcacgttaccatccacacacctgctgatatcaatgc

SEQ ID NO: 17529 - DNA, 1598 bp, Triticum aestivum
  Clone ID: PAT_TA_17529
gccggcggcagctggccgtcccaaccggcggcacagacccgcaccaggcgcattcgcataccaccgcaacacacagacaaaccccaagaaatcaccagccgcgcctcccgccgccaaaatgctggccgccgccgcctccgtgaagttctccccggcgtccgccggtaccagtagcaccaccaagttggccttcaagcctgtccacctccctttcctccccaacgccgtcccgcgtcccctctccctctcggcgcgtcctctgtaccgccaggagccgttcctggcggcggcccgcaacgaccgtgccgcgtcaacggcgccccctgcagccaccgcggatggcgcgcggccggtggagacggcggccgcgccggaggccgcgaagagcgccaagatcggggtctacttcgccacgtggtgggcgctgaacgtgatcttcaacatatacaacaagaaggtgctgaatgcgttcccgtacccgtggctcacgtcgaccctgtccctggccgccggctccgccatcatgctcgtgtcctgggccaccaggatcgccgaggcgccccagacggacctcgatttctggaaggctctctctccggtggcgattgcgcacacgatcgggcacgtggcggcgacggtgagcatggcgaaggtggccgtgtccttcacgcacatcatcaagagcgcggagccggcgttcagcgtgctcgtctcgagattcttcctcggcgagcacttcccgttgccggtctacttctccctcctcccgatcattggtggatgcgctctcgcggccgtcaccgagctcaatttcaacatgattggattcctgggggcgatgatctcgaacctggcgttcgtgttccggaacatattctccaagaaggggatgaagggcaagtcggtgagcgggatgaactactatgcctgcctctccatgctgtccctggtgatcctcctccctttcgccttcgccatggagggccccaaggtgtgggctgcaggctggcagaatgcagtcgccgagatcggtcccaacttcgtctggtgggtggcggcgctcgtagtgttctaccgcatgagatctcaggtgtgcgattatgtcgctgcaacacatcgaagcgcatctcggtcatcggggcaaccccatgaatcgcatctcggtcagctgcagccccatcatcctcttccgggcggcgatcgccatcctcggaaccttcatctactcccaggcaaagcagtaaggcaacaccttcgaaccgatgtctctttaaaggagagtcggccagcggggtttctcccactataagttgttgagtatatctaatttaatacgtcccttgtaatatcatatactcgaattccgaaccttcttcttcctttttcctttttttccttggtttagctgcggatgttgtctgaatttttcgtttgttgttccgtgaccatggtgctgatgatgtagagaggtgaataaatctatccaaatcaagtcacataaagttgccacggaattttagcccccgaaaaaaaaaaaatagataaagagacgaccatggaaaaacggctagtacgcttaatcatctgttcccttctca

SEQ ID NO: 17530 - DNA, 859 bp, Triticum aestivum
  Clone ID: PAT_TA_17530
tgctgccgcgggacccctacgagcagctggatctggcgcgccgcatcaccgcgctggccgtcgccggccgggtcaccgggctcgagcgcgaggcggcgcggctcagggagggcgccgccgagcgggaccgggagaacgccgagctgcgggaccgcgtcgcgctgctcgaccgcgcgctccaggagaccaacgccaggctccgcgccgcgctcgaggacaatattcagctgagcaaggagcgggactcgctcgcgcagacctccaagaagcaggcgcgcgacctgcacaagctggagtcgttcaagaggcatctgatgcagtcactccgcgatgatagtacatcgccccaagaaactgttgacattacaacatgtgatcagtcagtatcatctaaaacatcgtcctgtggagatggatctatcagccacactgcagcaaatttgttgaatgggtctggggatcttggaagcacaacaagagaagcggcaaggactccagtccaaaagtatgccctctccccacacatcaaccaacgccttacgccagaagccacaccaaatataatgtccacctctgcttctccaagaggaatgtccaccaccgcaacaccaaagttggtatctggagctacctcgccttcaagaactcgaatcgaaggacacatgtcaatgacaccatggtattcaagcaagcagtcgtctgcagctaactcacctccaaggggacgtcccaacccaggtcgcactcctcgtattgatggaaaagaatttttccgtcaggccaggagccgtctatcatgcgaacagtttggagcgttcttagcgaacatcaaagagctgaatgctcataagcagtcacg

SEQ ID NO: 17531 - DNA, 924 bp, Triticum aestivum
  Clone ID: PAT_TA_17531
tgcagttgtatggccagacattccttcattcgttgtgtacaaagctagtgattggtcagttgttgattcaggcacgggaaaactttttgcatgggacagctgtcgtgacagatatgctttggtcgagagtgcattggctccaaggatgccacttattgtgaaaggtggttcctctaaaaaggcaaaagaagcagctgcagcagcagctcaagcagcagctgcagctgctagtgctgcttcttcagccacagtacaagttcgcattttgttagatgacggaacagctcatgttctgcagagatccattgatggccgtagtgaaccggtcgttggcttgcatggtggtgctcttcttggtgttacataccgaacatctcgtagaatcagtcctttgacggccactgctatatcaactgttcaatcaatgccccttccaccctcccgtccgagtggatcatcttttgcttcggatgacccattttcctccagagaagggccgccccaaaatttctcagttatacacgctggtgagacctatcagcccgtaagcggcttacttgcacaacctgaatggactgtgtgggaccaaactgttgaatattgtgcatttgcttatcagcagtacattgtaatttcttccctgcgacctcagcttaggtatcttggggatgtttcaattccttctgctactggcgctgtttggcatcgtagacagttgtttgtggctacaccaacaaccattgagtgcgtctttgttgatgctggagttgctgccattgatattgagacaaaaaagaggaaagaagaaatgaaagcaagagaagctcagggtcgagcagatgcagaccatggagatttggctcttatcacagtcgaaggtccccaggtcactgcaagtgaaaaaatatcattaagacctcctat

SEQ ID NO: 17532 - DNA, 915 bp, Triticum aestivum
  Clone ID: PAT_TA_17532
ccacactgccagagctagccagtgctgcacacgtcgaacaatatggctacaaaaaactctgctgtcttcctcctcgggcttcttctctcttgcgttgccatgagcagcgcggcgagaatcctagaagagaccgttccttccaaggaggagcaccagcccgaggtgccaccgcttcccaaggtagaactgccaccgttcccggaagtgcacctgccacctaagcctgaacttcccaaggtggagctgccgccgctccccaaagtgcacttgccatctaagcctgagttgcccaaggtggagctgccacctaagccggagctgcccaaggtggagctgccaacgtttccggaggttcacctgccacccaacgccggagatgcccactgttcccgggttccacctcccggcagccggcaggccaagccatgagaactgccttatcaatattgttgccttgttgtacctcctctgctccgcgtacatgtgcctatgctcgtgtcgtgtcagatgatcctgattctttagttgtgagtttcaaaccattgtgctaactgagctccccgcaaggttgggtgcctaccaaggccggagcttgcccgcggtcgagcaacccaacgttgccggaggttcacctgccacccaagccgttcctgcccgaggtggacctgccaccgttgcccgagatgcccgctctgcccgtgttccacttcccaaagacggaggccaagccgcgagaattgccttctcgataatgtcgcctcgttctactttgcttgtacatgtaccctagtgttgtgttggtcgacggtctgattgtttagtcgtggtcgacgatcattgtgagtgatatgtttatataaatatatattgctatatactagaaataaaaaaaaaaaaaaaaaaacgcgagactag

SEQ ID NO: 17533 - DNA, 840 bp, Triticum aestivum
  unsure (1)..(840): unsure at all n locations
  Clone ID: PAT_TA_17533
tccaatgacgaagagatgggttctaagcaagacatgcaggatttgctattgagcgtaggcatcgtgtctcctgtgacaaaggaaactgctggtgctttgtaccatcagcagctctcacgacagctggctgactttgtaagagtaccagttgagagagcaggaggtatgatggcactagtagatgtctactgtctcttcaaccgtgctaggggaacagagttgatctcaccagaggatcttttgcaagcttgctccctttgggagaaatttgatgtcccagtaatgctccggaaatttgatagtggagtgaaggtgatccagaccaagacgcatagtgatgatgaggtatttgcaagaatatcatcactcgcgcaaaagccggatgctcttctgaaaggaataagccccagcgacgctgcatttacactggggattgcaccagctttagcaaaggagcatcttctaaatgcagaaaacaaaggtctcctctgcagggatgtcagtccagatggattccgtttctacatcaatttgtttaacgagattgatctccagaatattcatttgccaaaagctcatggactataccacacctgggatctctctggcaacggcagcacattgacacattttggtagaggtggattcagctgattgaatgttgatgtgacattttgcctgaataccccctgtgttgtanctcatctaattcatctgtaaantaatataacagcgtttatagttcactaaagtatgtctaaacctcttatatactttacggaggaatacaattacgaacataacgtttcacantgggtgataaatgactgtgagtgcgtt

SEQ ID NO: 17534 - DNA, 1157 bp, Triticum aestivum
  Clone ID: PAT_TA_17534
tgactctgctcgccggcggccatgggcaactgcttcgggagcaggatcggctccgacagcccctacaagagcgccggcggctccgcctccccttcctcctcctcaggtgggcgtggaggaggaaggggaagggggcgcgagcgtgtcgagcagccgggtgtcgtcctcgccgccaacgacggtgccgccgacgccgcggagcgagggcgagatcctgcagtcggccaacgtcaagagcttcgccttcaacgagctcaagacggccacccggaacttccggccggacagcgtgctgggagagggcggcttcgggtccgtcttcaagggctgggtcgacgagaccaccttcgcgcccgcccgccccggcaccggcatggtcatcgccgtcaagaagctcaaccaggagggcttccagggccaccgggagtggctggctgaagtgaactacctgggccagttgtcgcacccgaatcttgtcaggctcgtcgggtactgcctcgaggacgagcagcgcctcctcgtctacgagttcatgccgcgagggagcctcgagaaccatcttttcagaaggggctcgcatttccagccactgtcatggaacctgaggatgaaggtcgcgctcggggcggctagggggctcgccttcctccacagcgacatggccaaggtcatctaccgcgacttcaagacgtccaacgttctccttgactcgagctacaacgcgaagctttccgatttcgggcttgcgaaggacgggccgacaggcgacaagagccatgtctccacaagggtcatgggcactcatggctacgccgcgcccgagtatctcgcaacagggcatctgacggcgaagagcgacgtgtacagcttcggggtggtgctgctggagatgctgtcgggacggcgggcgctggacaagaaccggccgtcgggggagcacaacctggtggagtgggcgcggccgtacctcaccagcaagcgccgggtgttccacatcctcgacgcgcggctgggcggccagtactcgctctccggcgcgcagaagacggcggcgctcgccatgcggtgcctctccggtgacgcccgggcccgccccggcatggcggaggtggtgaccgcgctcgagcagctgcaggacgccaaggaggcggccgctc

SEQ ID NO: 17535 - DNA, 700 bp, Triticum aestivum
  Clone ID: PAT_TA_17535
cccccgcacctcctccgggccatccctcgccccccctcctccacccgctccccccgctgccccgccccccccccgcgccccgcggcgcccgcgcccctgccccgcgccgccactcccgctgcccccccccgtcggcgctctcccagtgcccctccccccccgggcctggcccgcccgccccgcctgctccccccgactccccgcccgttctcccgctgcgcccgcggcccttccgccgccccggccccgacgccccccccccccgcttccccggcccccccgcgggcaggtgcccgcccccgcccctccccgccaccggccgccgccgaccgcgcccggcgggaggccgccgcgcgcccccgcgtgggcgtgccggcggccttcccgcgtccccggcttccccccgccctccgtacctccatgcgctgcgtcgcgtggccattccggcctcggcgcccctgcgtcccgcctgtcgctggccatcgcccccgcgccctcaagctccagcgcccgcccccccttcccgcgtcgcgccgccgcccgcgttcccctgcttcgaccgcgccctcgcgcccgacactcgcgccggcccctcgccacaccggcgaccaccaagaacaccgccacctcctcgcctccgcttagtgcatgtcggcaggagcgccaccaccatacttcctcctgaccactgcggcaagca

SEQ ID NO: 17536 - DNA, 957 bp, Triticum aestivum
  unsure (1)..(957): unsure at all n locations
  Clone ID: PAT_TA_17536
cggacgcgtgggtaaagacttaaccaatcggtctctctctctctatccatccatccctgcttttccctttcagctggaggagatctcgggaggaaagatatatagtccagtgtcgtctctgtagagagcaaaagggaaaggagctcgcagcaggtcaaagccacaacaagctgcactgaagaagatatataattgaagagagagagagggggggagatttatttcaagaagaatttcagttagtgcacaagtgcacatacggacatagcaaggattttgccatcgaccggtctacataggtgccggcgatcacgatggcagcgtactaccacggcggcgccggcacggacatccatcaggccggcagcgacggcctgcaaacactgtacctcatgaacccaagctacggcaacggcagctacggggacgccgggccctccggggccaacatgatgctcctcaactcagcggtgagctccatgaccccggcgtccttcggcggccaccaggcgtcgccaccgccggggcagcacttcgtcggcatccctctccaggcgcccccctcgggctacaacctgtggaccccggccacaaccggcatcgccgacgtcatgtcgccaccgacgcagcaggctcatggcgtgagtgccgtgctcagcctgtcgtctcgcgagacgccgccggtcacggtggcttccatcgccggcgacgaagggaggtaccaccttgggtcgacgaccgcggcgtcgcaggggcaggtggtgatgaactccaagtacctcagggcggcgcaggagctgctcgacgaggtggtgagcgtgagcaagggcgtggacgacgtggaccccaaggcgaagagcgctgtgtcggtcaagaagaaggaggattncggaggcctttcnncgcgcggcggngaggaaggcgccagcggggccaagggcggcgcgccagcgcccg

SEQ ID NO: 17537 - DNA, 1294 bp, Triticum aestivum
  Clone ID: PAT_TA_17537
ccttccgccacacaagggaccgacaggtgagtatgcgagtcgccacggtcagccaggcggggccgtccgcgccggtgatcctgagcgtgatgtttcacaatgtgaccaacagcatcgttgcgcgggcggcgttcgggaagaaccggaagaacgcggcggagttccaggcggccatcaagtccggtgtgggcctggcgagcggtttcaacatcccccaccttttcccgacgtggaccactgtgctggccaagctcaccggcatgaagcgcatactccaggacatccacaagacggtggacgccatcctgcaggagatcatcgacgagaggaaggccgcccgaatcgagaagatcatggccggcgccgagaacgtggacgagaacctcgtggacgtgcttatcggcctgcaggagaaaggcggcttcgggttccacctacaccacagcaggatgaaggccatcatcctggacatgttcgggggcgggacgggaacatcggcgtcggcgatggagtgggggatgtcggagctgatgcggaacccgcgggtgatgaagaagctgcagggccaaatccgggaggcgttcaagggaaaggcggtggtgactgaggacgacctgcaggagagcaacctgcagtacctgaagatggtgatcaaggaggcgctccggctgcacccgccggcgccgctgctggtgccccgggagagcatcgaccaatgcgagctggaagggtacacggtgccggccaagtcgcgcgtgatcatcaacgcgtgggccatcgggcgcgaccccaagtactgggaagcacccgaggagttccggccggagcggttcgaggacagcacggtggacttcaccggcagcagctacgagttcctcccgttcggcgccggccgcaggatgtgccccggcttcaactacgggctggccagcatggagctcgccctcgttggtctgctctaccatttcgactggtcgctgccggatggcgtggccgaggtcgacatggaggaggccccgggcctcggcgtgcgccgcctcacgccgctgatgctcctcgccacacccttcgtcccggccgcggtggcgtagctatgtttgtttgcatgtgtcggtggatccctccatgcgtatgctatatcatgcacctacgtaccatatccatgtacttccttcctaaacaaattgtattaatttaagtcaaacattatatatgtttgaaaaaaattgtagaaaaatatgtaaagaactacaatactaaataaataaattatgaaaatatatttcattacgca

SEQ ID NO: 17538 - DNA, 697 bp, Triticum aestivum
  unsure (1)..(697): unsure at all n locations
  Clone ID: PAT_TA_17538
gaccacggcaccgacatcgtcgatgacatcgacagccgctgcagcagccagttcgccaggacgctgaagagcgccgtctggtgcctgacctcgccggagaaacacttcgcggagatgatcagggagtcggtggtggggctggggacgtacgaggacatgctgacgagggtggtggtgtcgcgggcggagatcgacatgaagcagatcaaggaggagtacagggccaggttcaagaccaccgtgacctgcgacgtcgtcgacgacacctccttcggctacaaggacatcctgctggccctggttggctgcgaggaagagtgaagtagcaaacctggagcggtgcagtccatggttgtgggatgcgcacgaaacagaatgagagactagtcataccacacctccgacgggactccgttgtctatcaagtgaattcgtattcgaaagaattttcaattatataattttttccttcgtcgcagttgggctcgttggtaaatttacggtcatgagttagacccccgaaaagcgcgggcgcactatatttttgaaatgaagggagtatttttattgtacgtccnatgttaatttttggggcatggatgaatacatgttgttccacatctcattatttcccaacactgtgtacttttcaaagngtttttgacatttaacggacactaatgataaaaaaaaaaaa

SEQ ID NO: 17539 - DNA, 1125 bp, Triticum aestivum
  unsure (1)..(1125): unsure at all n locations
  Clone ID: PAT_TA_17539
ctttgcctgaaaaacttacggggcttcagagccatctccttactctagtacattcagaagtcctattcttatgccaaggaataccagtgcccctccatcgccactcccaaagttattcccagaaaaccaaatttcacgtactgaagtcaatggaagtgctagtttgcatccattaccacttcctcccagtgctataagcccaatgcaaacatctttcagcaaccagcctgctccaaaagttgaaatgccttcggtgtcttgtcagtggcaaaaaggaaaacttctaggtagtggtacatttggctgtgtatatgaagctaccaataggaacactggagctctttgtgcaatgaaagaggtcaacataattcctgatgatgctaaatctgccgagtcgttgaatcaactggagcaggaaataaagttcctaagtcaatttaaacatgaaaacatagttcagtattatggcagtgacactattgaagatcgtttctacatttacctggaatatgtacatccgggttcgattaataagtatgtcaaacaacattatggagcaataacagaatcagttatccgtaacttcacccgacatattcttagaggcctagcttttctgcatggccaaaagattatgcatagggatatcaaaggagcaaatctgctagttgatatcaatggtgtagtgaaattggccgattttggaatggccaagcatttaagtagtgcagccccaaatctttcattgaagggaacaccatactggatggccccagagatggttcaggctacactagctaaagatgtaggatatgatcttgctgttgatatctggagtcttggttgcaccatcattgagatgtttggatggaaaaccccttggagtgatcttgaaanggcctgctgcaatgtttaaagttttgcataaagaccaacaattcctggagaatttacccctagaaggaaaaatttctgcaatgctgtttcaaagangatccaacaaagaggccacccaaatanttntttnggcanccattttcccggatcaagtcactacantaanangtccananatccttntggggataaagtccaganaacgnacgttcaagggaaaaaatccca

SEQ ID NO: 17540 - DNA, 879 bp, Triticum aestivum
  Clone ID: PAT_TA_17540
gtccgccccaagcggcagcccccgcacaagcgtcagcaacacacaagtgacagccacggcacaatcgtcaggtcctccgccatgtctctcacggtctagttcgttcgttctcgccaacgcgatggcgacgccggcccgccggccgtcggcgcagcagcagcagccgctgacggtggacttcgaggcgctgagctacatcagcaggctcgtggaggcgttccaggcgttcgactccgacaacgacggcctggtcacggcccccgagctccggggcctcctggcctccctgggcctggacaagtcggaggcggaggcgcgggacatgctggcgcgcgccgacgccgaccgtgacggccggctctgcgtggaggagttcctggacgtgatgaacgcaggcgagctcgggctgggcgcgctcggcgcgctcctgcaggccgccgtcccggcgctggagtccttcgcggggcccgacggcgcgctgggccccgacgagctcgccagggtgctggggctcatgggcaccgccagcgccgaggactgcgcggagatcatcgcgtgcatggacggggacggcgacggcgccgtcagcgtcgaggagttcaagctcatggctgacctgctctaggctcgagctacgtacgtagtattgagctagctagagggcgtgcatatatgcagttatgtattgtgaatttgtgattgtgatatcgattaataagcgttagcacgtcaggaaaaaagtggactacttctgcgtcgggctggagtagtgtgtcttctccatctccatctccatctccatctccacttctccatctccatctccatctccaactaaatatttaacacccacactttgcctttcttaaaaaaaaaaaa

SEQ ID NO: 17541 - DNA, 733 bp, Triticum aestivum
  Clone ID: PAT_TA_17541
tttttttttttttttttttacagaagagtatcccctgattgtataacactttgtaccatgtcagcagcgccttacaaaacatatcaaaaaagacgagggacggagccagaagtgccctttttgcatcaagtaggttctactagtatgattgcacacaacacttccgacgagtctcgggctttcagctattccattcctgaaagtagaggtctcaggttaagttagttagccggtgggggcacttccaagggcagtttcttcttgaagttcagctgagcttgcttcctgggcttcgtaggatcatggtttggtttgcttgttggtggagataactgaggacttccactgattgtacgcttgtttctccatcttcttgtgccttttgtgggttggtagatctagctcgtcatcattgtcatccccggatgattcatcagaatggtcgctgtcatcctcgtgtttccttttgctaggcaaaacatccagcagctctctattccctttgatagaggttggatccttcttctccttggctatcccaaaaacatcaaaacaaaggtctcccatagatgtcgaaaccgttgtaaattcagagctagatgtaccacacaggtcaattagcttcagtttgtcaactttgagcttatgcctctttgcacataaatagaatgctgctgcagtaaacactggccgaccaaagtccgtgttgagcgtcgagaaggaggcaatgcag

SEQ ID NO: 17542 - DNA, 519 bp, Triticum aestivum
  Clone ID: PAT_TA_17542
ggccctggcggcggcctcgtgtgcggggcagggcaccacgccagggagagcggtctcgccctccacgggatcccgatgcggggtggagtcgcggtggaggtgctgctcgtggggggaacgatggcctgcctcgcgcgatgcggtggtgaggatgtgggatggctgcggcgggcggctatggaagctgccgagtcgcggcaccagaggcggagggagcggctagtgatgggggcgagggctgggtgctctcctcgtctcacgcggtcgccgagggaagccggcggctacttctgtttctgttggcagccgctcccgcttctgatctgagtggatcctgctcctgctcgcccctggtcaacctcctgcatcggtgcgcccctgtcgcctccgtcgactccacccgtgggttgaggagatggccgaatcgaccgccgtggcgtgcaagcgcggcctgctactgcacaaccaccagcgccagtggaggagctgcggcggggaggtgttcatctactctctttt

SEQ ID NO: 17543 - DNA, 724 bp, Triticum aestivum
  Clone ID: PAT_TA_17543
tatgcccttattggaggaacttcgtcgcggtcagggcccgctccggcccgggccgcctccacttgtcacccatgcaatggctttgaagaagctacaaatatggaacgtccaagttctccactctttagagaactttgtttctgtagttgagctcgacttgggaaacatacccgaactggccatgatctccaatcttccaaaattacaaaagcttataatcaagtactgcccaaagctcgagacgctgcaggagatggctgcactccggagactcgagctgagagtttcccgctgggaaaatcaacttccagtctacctgcaaactgtaaagcctagtcatttgctgctgacctgcaacctagaagtactcacttccatggctgagggtgaatctagctccgagtgggacaagttcagtcatatcaagcaagtcgaggcttatgcaaaggatggacgggatgagaagaaatggcacgtgttctacacatctgaaccctgcaacatacagacaaatattcatcagggtcgattggtcgaagaagaggactaggctgaaactcaagcgcaccaaggaagggcatatcatgtcaagggatatatctatatcatccacggatacgtcgaggcgtgagaaccctccgtcccgacatcagacacactcgaatcccgtgttgccgaccccgtccaaatttcttgctaagtgtgacatatacagttaccaatt

SEQ ID NO: 17544 - DNA, 710 bp, Triticum aestivum
  Clone ID: PAT_TA_17544
gcaccagaaatgtcgccttccactccactacagaagcctgtttcttccccttcaactccatggtcgaggaaaagctcaggcagtgccaagggcatacaaactgaggcgatgttggaccagttcttggctaccttggatgaaaatattgataatgtcacggattcagccaataaaactgcaacgcctccagcaaccatcacgagctttggcattgccagccctgtctcagtcaccacatcaaccaccccttctggtgctacacggagcacacctttgaggcctgtgaggatgtctcctggctcccatcagaagtacagcacgcctccgaaaaagggcgagggtgagcttccaccgccaatgtccctggagcaggcagtggatgcctttgaaagtctgggtgtgtatcctgacatcgagcagtggcgaaacaatctcaggcagtggttctcttcagtccttatgagcccgcttgttgaaaagattaaatcaagccatattcaggttaagcaaacaacagctagtattggagcttcagttaatgttagccaagttggaagcgatctgccaagcacggcaccaccagttagcttatctccacttggtgggactaaagattggcagccaactgtcaccgttgatgaggatggtattcttaatcaaatgcgggctgcacttctgcaatctcgtaatgctcctgttgcccaaacctt

SEQ ID NO: 17545 - DNA, 1394 bp, Triticum aestivum
  Clone ID: PAT_TA_17545
cgagtgttagctacagagagagagagagagggagagtgagggcagcggcaagtgcaagcatcaattaaggtcaggcagggcagagagaggaataagcaagaagagctagctagttaagagtccaagggagggagacaggcagctcctatagtagatggcaatgaggtcgagggggctgcagctgcggtcgcggcggcagcacagcgtgctcgtcgccgcggccgtcgtcgtcggcgtgctgctgctggcgacggcggcgccgcgcgtcgcggcggcggggctgagccggaactactacgccaagacgtgccccaacgtggaggcgctggtccgcggcgccgtgacccagaagctccaggagaccttcaacgccgcgcccggcaccctccgcctcttcttccacgactgcttcgtcagggggtgcgacgcttcggtgctgcatctccgggccgggcgacgaacacagcgcggcggcgcggatacgacgctgtcgcccgacgccgtataggccatcaacagcgccaaggccgccgtcgaggcgctccccggctgcgccggcaaggtctcctgcgccgacatcctcgccatggccgcgcgcgacgtcgtctccctgaccggcgggccgagctacggcgtggagctgggccgcctggacggcaggtcgttcatcaagtccatcgtgaagcacgtcctcccgggccccggcttcgacctcaaccagctcaacgcgctcttcgccagcaacggcctcacccagttcgacatgatcgcgctctccggcgcgcacacgatcggggtgacgcactgcgacaagttcgtgcgtcggatctacacgttcaagcagcggctgcggtacaacccgccgatgaacctagactttttgcggtcgctgcgcaggtgtgccccatgaactacccgcccacggcgttcgccatgctggacgtgaccacgcccaagaccttcgacaacgcctacttcgacaacctccggtaccagaagggcctgctcgcctccgaccaggtgctcttcaccgaccgccgctcccgccccaccgtcaacctcttcgccgccaactcctccgccttcttcgacgccttcgtcgccgccatggccaagctcggccggatcggggtcaagaccggcagcgccggcgaggtgcgccgggtctgcaccgccgtcaactagctagcgttccgttctgttctgttacagcgtgtgtgtgtgtgtgagagagagagagagagagggttaggccggttcggtaggttcggggattacatgtgatgcaacgcaagagcagggggtttttgcttgtgagtggggtgatacagttttgggggggggattatgtgagtggaaaatttttttggtgggtgggttgtggggaggggaaa

SEQ ID NO: 17546 - DNA, 1407 bp, Triticum aestivum
  unsure (1)..(1407): unsure at all n locations
  Clone ID: PAT_TA_17546
ggggcgcgagagggaagtatacgacgcagggatccgccgggtctgcaccagggtcaactaaagtggttgcttaggtctaagctggggtggtagtagcaccagaggtacaagcgcgtgagtggggaaacggcaggcgtcctcggggcggtccatttggtcacgggggctccgcgcgcggtggcggcggcccagggccggcccatatgcccgcagacgcgccccagcgttgggcgccttgtccgcgccgccgtcgcccattagctgcaggagacctgcaacgccgcgcccggcaccctccgcctcttccaccacgacccctgtgtcagggggtgcgacgctcgggtgctcaactccgagcctggcgacgagcacagcccgggcgcggacacgacgttgtcgccggacgcgctggacctcatcacccgcgccaaggccgccgtggacgccgtcgccggctgctccaacaaggtctcctgcgccgacatcctcgcgctcgccacccgcgccgtcgtccagcaggcgggagggccgttctacccggtggagctggggcggctggacggcaaggtggggacgcgcgccgtggtgaagcacagcctccccggcgccggcttctccctggaccagctcaacaagctcttcgccgccaacggcctcacccagaccgacatgatcgccctctcaggggggcacacgatcggggtgacgcactgcgacaagttcgtgcggcggctgtacacgttcaagggggcncggccgcagtacagcccgccgatgaacctggcgggcctgcggcacatgcgcgggacgtgcccgctcaactacaaccccaccacggtggccatgctggacgccgtcacgcccaacaagttcgacaacggatactaccagacgctgcagcagcagaagggcctgctgtcgtccgaccaggtgctcttcgccgaccgccgctcccgggccaccgtcaactacttcgccgccaaccagaccgccttcttcgacgccttcgtcgccgccatggccaagctcggccgcatcggggtcaagaccgccggctccgacggcgagatccgacgggtgtgcaccaaggtcaactaatgttgcttggctagctggaggagtagctgccatggtagcatcacacgtacattcagtagagagggtaaatggatggatgggccaatcagttgtcatgtgtctctcctcttctccctgcccatgcacgccccatatgctcacacaagccatattgtcataaccgatttgttccagcccaattcttttcttcatcatgtaataaagcatataatcatataaatgccgtgggataggaggcccagttacatgcatgtaaatgttacagtgggtccaagttaatcaacaagtatatcccataaaaaaaaaaaa

SEQ ID NO: 17547 - DNA, 781 bp, Triticum aestivum
  unsure (1)..(781): unsure at all n locations
  Clone ID: PAT_TA_17547
nggctggtttgcatgacaaaggaaaagcactattctcgagatcgaaactaccaccagtctcaaagattctggcgaagtgttatgtatgaacaggagtactattttcttgcgtggcgctggaggattttccgactcttcccgtccatactcgtatacgacttatcctgccaaccagatttctcgcatttctattccaaattccacaccttctgcggtgtatgaagaccagacgcaacaatcccaggcactcttatacaggttatctggtgattataaccctttgcattcagaccctatggttgcacaggttgcaggggttcgcggcccgggcggtcatcaagtcattctgcaacggggatccagcggcagtgcggaacatctttggccggttcctgctgcacgtctaccccggcgagacgctggtcaccgagatgtgggtcgacggccagagggtgcagtaccagaccaaggcgaaggagcgtgaccgcgccgtgctttccggatacgtgctgctcaaacacatcccctcatcattgtcatcaggtgctgataatggaggaggccggctgtaggagccttcccgccaaggacgaagaagaggaagaagaagaagaaacagtctcggggcaattgacggccggagaggatgcacagccagagacagagtgacggcggtggagcagaccggccggcacgtttctgtatcatagtatatcacactttgtgacccgttcagtctaaataaaatcaattttgcatgtgcacctgctcatgcatcgac

SEQ ID NO: 17548 - DNA, 1380 bp, Triticum aestivum
  Clone ID: PAT_TA_17548
ttcgttcccgcgccccccccccggccgggccagcggagcgcatctcgacggcggccatggcgacgaacgggaggaccgtcgcgtccgtcgaccccgacgtcgcgctcgcctacaagttccccgaggcctccttcgcctacgacgagagggacgtggcgctctacgcgctcggcgtgggggcctgcggcgcggacgccgtcgacgacaaggagctccacctcgtgcaccacagggacggccagcgccacatcaagggcgcttcctacctttgctggtctttatttcctaacaagaacagcaatgggcgtggaattattaatgtgcctggcattcacttcgatgcaagccttctattggcacggtcaacaaatacatagagatctacaagccaattccttcatgtgccagtgttggtaaacaaggttaagggtagctggtttggccacgacaaagggaaaagcaactattctcgagatcgaaactaccaccagtctcaaagattctggcgaagtgttaattgttatgaacaagggagtactattttctttgcgtgggcgctgggggtgatttttcggactcttcccggccatactcgtatacgacttatcctgccaaccagatttctcgcatttctattccaaattccgacaccttctgcagtgtatgaagaccagacacaacaatcccaggcactcttatacaggttatctggggattataatcctttgcattcagaccctatggttgcacaggttgcagggttcacccgtccgatactgcacggcctctgcaccctggggttcgcggcccgggcggtcatcaagtcgttctgccacggggacccagcggcggtgcggaacatcttcggccggtttctgctgcacgtctaccccggcgagacgctggtcaccgagatgtgggtcgacggccggagggtgcagtaccagacacatccgctcgagcgtgtccgcgccgtgctttccggatacgtgctgctcaaacacatcccctcatcattgtcgaggaggagggggaaggagaaggctcggggctattaactcggccggaggagatgcaccgcgagagacaaaagtgacggcggagcaggccgaccggcacgttttgtgtatcacatatcacactttgtgtcaccccggctggcccgtctctgtatcatatatcacacattgtgaccagttcagtctaaataaaatgaaagttgcatgtgcaaagtgctgtgaggaatatacatactttttaatcggtgctttgattagctaactgtggtgctctgaaaagaggatggttttccgttgtaaactatactcctaagtcctaagagatgacaagtgttctgtacggttgtgcagatgataaaaa

SEQ ID NO: 17549 - DNA, 590 bp, Triticum aestivum
  Clone ID: PAT_TA_17549
ccaccacaatttttaagcagcagccgcctagacgcttccttcagcgcatccacaagaacagctcctccccccccgcccaggagaagacagaaaagatgagtagcatgtcgtgttataccctggcagaaggtggaagcatcttcccatctggcgacgaactcgttgggaatcaaaagacagagcaaggaaattactggacacaatggaattcaaggctatctgatgatttgaacacaacaagcctatactcagacgagcatgagaatggcatcgagcaatgtttcgacgacgccgatgaacatgagaggagcagccaacaggagaggtcgtcagcatgtgccagagttgcatcttcagattgcagcacagggccttcagaagaacaatctgaggggccagcgccgttggaactacaacactgcaaggaaacaaacgacatcttcttgagtcaattttcggatgatgaaatgaggatgatggatgcgccgtttcaggcacttgatatgttccctggctccatgcacaggctgttgtcctatgagaacatgctgagtggagtattgactgattctcaaaatcaagaaacaaat

SEQ ID NO: 17550 - DNA, 1451 bp, Triticum aestivum
  Clone ID: PAT_TA_17550
gtgccgggccgggccgggatcctcattcagatcatcaaccaactctccaactttctcaacaacaactattcagtcttcacgacaacctttcgatacccttcaaccaaacaaccaacccacccaacaatcaaaatggccgctccccagattccttcccagcagtgggctcagatcttcgagaagaccgccggtcccatcgagtacaagcagattcccgtccagaagcctggccccgatgaggttctcgtcaacgtcaagttctccggtgtctgccacactgacctccacgcctggcagggtgactggcccctcgacaccaagctgccccttgtcggtggccacgagggtgccggtgttgtcgttgcccgcggcgagcttgtcaaggatgtcaagattggcgagaaggtcggtatcaagtggctcaacggttcttgcttgagctgctcttactgccaaaacgccgatgagtctctctgcgctgaggctcttctctccggttacaccgtcgatggatctttccagcaatacgccatcgccaaggctatccacgttgctcgcatccctgaggagtgtgaccttgaggccatctcccccattctctgcgccggtatcaccgtctacaagggtatcaaggagtccggtgtcaaggccggccagtctcttgctatcgtcggtgctggtggtggtctcggttccatcgctgttcagtacgccaaggctatgggtatccatgccattgccattgatggtggtgaggagaaggagaagatgtgcatgtctctcggtgcccaaaccttcatcgacttcacaaagactaagaacatcgtcgctgatgtcaaggctactaccaacgatggccttggcgctcacgctgctctcctcgtcgctgctgccgagaagcccttccaacaggctacccaatacatccgatccaagggtaccgtcgtctgcatcggtctccccgctggtgctcagttctctgcccccgtcttcgacactgtcgttcgcatgattcagatcaagggatcttatgtcggtaaccgtgccgatactgctgaggccatcgacttcttccgccgtggtctcatcaaggttcccttcaagactgttggtctctctgagctcaacgaggtcttcaagctcatgaaggctggccaagttgctggtcgctatgtcgttgacaccagccgataagcgcgcggctgtcgcttgggtagtgcgggaaagcacaccccaaaagtaaagggccacctatcgccaaaagggtgatcgataacctactaagaggagttcaggcgggagttgatttgggtttcaggcggtgatggtaaccatgaatcttggttacaattttgtgtacagccctagtttatgagtttttatgattttgtatagcatgaataacagaacgaatacttcgatccagaaaaaaaaaaaaaaaaaggccccta

SEQ ID NO: 17551 - DNA, 1075 bp, Triticum aestivum
  unsure (1)..(1075): unsure at all n locations
  Clone ID: PAT_TA_17551
aatggcccagccctggtgctgctcttcactccattgaagatgaagtaaaggaaatccttgcatctgctggtgttcagattcatagctgctatccacgtggtgtgccgccaatgcttcctttaccaatggctgcacttgtcagcttgacaattacgtttaaagctggataggagtctcgactacattcacgggatcaattgggtcaaggcactgggagaactgtgcagggggtagttcctgggccaaagcatgcccatcataggggccttgttgggacacagaaagtgcgaagggggcatgattttattgtcctctcatgtattcggtctccgtttggcagagacaaagatgcggtggcacagctcatccaaagttgcttctcatcctttctgcgctcatccccatccagtgggtctgatattactgcaagccgtggagttggagctttaatgggagagtcaatcacaggccaccaaggtcttcattttcccatggcccctggattcatctacctgagaacttgtcgaacattccacgatacttactttgtgagcgagatgatcctcaggcaagtgattgattgttcccacaaacttgcaaatggatggtcttccaatgggcctccagcatttaaaatcaggtcgaccgccactgtctggtgctgcatccatggcttctcaggttgccatgcttggtgcgggactgctgtgtgttgcagggggccctctcctggtccaggtgctatatgaggagaccttgccgacgctactgctatcagctcaggaacagatgttggaagaccctggaccggtggccagcacacttcaaggttatgccatggccaacatgcttttcttctgtgggagtctactctggggctcagaaaagacttctcccatcatgaaactgtcactcctctcgaggagaccgcgggtggcgggcacccacatggatttcattgctggtgttctggatgggcacatcctgctggggtgcgaccgagtacgtggatgggtacgtatcgtgctttgtatccctggggggaattttcccnacatggtacggacanaaaacg

SEQ ID NO: 17552 - DNA, 576 bp, Triticum aestivum
  unsure (1)..(576): unsure at all n locations
  Clone ID: PAT_TA_17552
gtggcggccgcttcgaggcccggccgnttttccgggaaaaaaaaaaaaaaaaaaaaaagaggaagagatcataggtatccaaaacttcggtgcagcaccagccgtagtccagttctcctagtgctaccattccttgtgagaaacactgggacgtgatcatggagcgctcttccacccatgttgctctcttgctggctctcctcgtatgctgttccatggcatcctcagcggcggcggcccgagcttttgtggatggaaaccgtgagggagaacgtcctcccgcaccttgggcctcgggcaggaggtcagcggagtgtccaggatgcggaagcacttcatcactgccggcgacggccagacttgcgccacaccgaaagaacctgcaggttgctgcaaacgtcgacttttacgcatgaatcacatgtggaagttttcgttgtatgcatacaagtatcatgcacagacatgttgatgctctcgctattgttgtcatctagtatgcacatatttaaattttaatacagaaaataccgttgaataaaaaaaaaaaaaaaaaaaaaaaaaaaaaggccccta

SEQ ID NO: 17553 - DNA, 1013 bp, Triticum aestivum
  Clone ID: PAT_TA_17553
gccggacgcctatgtgccgccccttccccggttcgcctcctctcgtgcggtttgatccggcccaaggttccgcgagtagcacacacctaatccggcgtcgaatccgatggccgacagcgccggcagcaagatctgcaacgccaaactggttcttcttggcgatgtgggtgctgggaaatccagcctggtgcttcggtttgtaaaaggacaagttgttgagttccaggaatcgacaattggagcggctttcttctctcaaaccttggctgttaatgacgagtactgtgaagtttgaaatctgggatactgctgggcaggagaggtatcacagcttggcccccatgtactataggggtgctgccgcagctatagttgtctatgacatctcgaaccaggcatccttcacccgagcaaagaaatgggttcaagaacttcaagctcaaggaaaccagaataccttagtggctcgtgctggaaacaaagctgatttgctcaaggcgagggaaatttcaaatagaggaagccaagacatatgcgcaggagaatggcctcttcttcatggaaacttctgctaaaactgcaaccaatgcgaatgacatattttatgagattgcaaagcgattgctgcaggggcaggcggcgcagaacccacaggcagcggggatggttctctcccagagacccaatgagagagtggtcagcgcggcttcgtgctgctcctcctgaagcatcgtaaatttggtcacattcgtcgtctgcgagaaattttgggagaggaatctcgacaaactatcttgaaagcgcctcttgctcctgtgccttatctgatatagtcttatcgctaccgtgcccacctgtcttttctttttagttcatgtgtttgtcatgtaaatgcccatactggaatgccttttcagatatcgcaagtgagataccaaaattcgatagcgtgcaacaggttcttaagtgagaatactccctcgtgcgcgtgccggccccccacgagaaaaaaa

SEQ ID NO: 17554 - DNA, 735 bp, Triticum aestivum
  Clone ID: PAT_TA_17554
gccggccgggcttcggatcaaaagcagttcagttcaatcacaggcagcctctcgatcgccccctgctaagctgccaatacgcatcaatcaatcccacttccgattgcatacactgatataccacatcatctccttctccaaagatggccggacgcatggcgcttgcggcggtcctgctgagccgcggcggctgcggcggcggcggcgcagtcggcgtcgaacgtgcgcgccacctacaactactacagcccggagaagatcaactgggacctcaacgccgccagcgcctactgcgccacctgggacgccggcatgtcgtacgcctggcgctccaagtacggctggacggccttctgcggccccgccgggccgaccggccaggcgtcctgcggcaagtgcctcctggtgacgaacacggcgaccggcgcgcagatcacggcgaggatcgtcgaccagtgtagcaacggcgggctggacctggacttcgacacggtgttcagcaagatcgacaccgacgggcagggcgtggcccagggccacctcaccgtcagctaccagttcgttgactgcggcgacaactgagtaattaattaactcgtgctcaggcgctatggaaaataagaagctgcaaataaaagctactaatgtgctatttgcattgatgcacttcgtaataaataaagtgggatgaattggacgtgattgttaaaaaaaaaaaaaaaaaaagacccctag

SEQ ID NO: 17555 - DNA, 1152 bp, Triticum aestivum
  unsure (1)..(1152): unsure at all n locations
  Clone ID: PAT_TA_17555
ggcacgagatcaattgncgttcttttaattgacggtagacattgntggacagggaaattcccccctttgtcatgttttcatgtcagggactattaaaaataaattatactaccatgttctgtttttatatctattacactgtactgtccttgtgattataatcacaaatgataatctacataatccaccatttgaaacgattaatagctcttgccagaaaagaggatgaacataaaaatatctttctgcagtttanacctgtttgcaaggccccttatgtatacattaccaatgcagtnctatttattatccatgattttttattactattattattctcttttagtgaggagctcggcacgaggagatctcaagcgcgatctcaagcggcacacactatacgaggcttcaggaggaanggattctatgctgttctattatctccccttctagaacagtttttaacatggtccccttctggtagttgtttctgcagtatggtacccttgcataatggctatagnttcatgggtgataanttccattattatttttatcaagtaccaccgacnatcaattcttatatctnagcttgaagaaaaccggcctaacctcatgctcccgtttggggctcgtgggcaggctctccttctgaaatgttgtaacccggcttgatccgggggcgttgctggtctggggtcacctctcgcaccttgtccttccacattcctgaagtactgacaactggtaacgatgccctttcctgctccttcatattggcgttttggtgtgttctgcccatgcacacgggattatcttatattttgtagcgccttcgcccgggtcgctcgtttattcctctgtgtgtctatttctaacgtcttttgtcactgtcctagcctgcctcgacttgttgggtgttcccctcgcggtgtctctgcgtccccatccagattcgcgcccctgtgcttggtcgcattaccccccctgctcgcgcgctttcagtgccgtactcgctgttctcctgggacgtcagtcggagaccccgagaggctgctgcgagctgctattcccctccttgagctggcggactgatgatggaggacccgccctcttcgctgcaccggcgccgccgctgctacttctgcttct

SEQ ID NO: 17556 - DNA, 837 bp, Triticum aestivum
  Clone ID: PAT_TA_17556
cggcacgagggcgcacgcgtacgccagccgtgcctacgcggccttgcccaccacgttcccaatcgcctcccacagctccatcatggtcggctccgaccggctccagtactacgcgccgccgcagggagcgtcggcgtcctcggcggcggcgggcgagctgtacagcagcggcatgcagcaggtgtcccgcttcgccgccgcgcaccagcagcagctcctggccgtcagcagcagcagcagcgagcgcgcgatgatggccgcggccgagcagcccggcgccgggcgcgacgagctgatcgacatgctctaactggaggcggggctgccacggcccgaccgcctcggcggccgccaccaccccctcgccggccagcaccaccaccacgctcacctccggaggcggcagcaactacaacaacggcgaggaggccgaggagctggacctcaacttgagcctgtagcagccagcagcggtgagctcgccggccggcgctgcctccaatccaagtccaagtccaagaccaagacaaggttaatccatggccacgtagtacctctacccttctaccactcctattcgcccggctattcatgtcccctaccacccttcagcacgacgtacgtacgtaccgcccgcccgcccgcccgcccgcccgccaagattagctgtttttaattagagaagaagaagacgaagatgttaattaattaattagttcctcgatcggccctccttcagccagtcttttgtactatgttaatgctagcggtgagctgtgctccttgtaatcgtgctcttgaatttcaccccctgttcgtctgttgaaaaaaaaaaaa

SEQ ID NO: 17557 - DNA, 1108 bp, Triticum aestivum
  Clone ID: PAT_TA_17557
caggttgcactagggtttttgctagtttccgccgtcgatcgccgccgacccccgccgcccgccgacgcatccctccttctccttgagcgctcccggcacagcgtacgggccatgagagacctccacctcccgctgaatcagacccagagggtccgcctcgaggccgcgctccacgagctccagaccctcgcccccgcggccgcgtccgccgccgccgtcaccgtcgcggacaacatccccgtcaaccacgaggacaacatcctcaaagggcatggtaccacggaccaggatggggaggtggtggcgacgctgtgcggcgtcgtggagcgggtcaacaagctcgtctacgtccggacgctccgggcgaggtataagccagaggttggtgatatcatagttggccgtgtcatcgagattgctccaaagcgctggcggttggagataaactttagccaagatgccgttttgatgctttcttcgatgaatttgcctgatggaattcagagaagaagaactgcggttgatgagcttaatatgcggagtatatttgaagaaaatgatgttgtctgcgctgaagttcgtggtttccaacatgatggatctcttcatctacaagcaaggagtcaaaaatatggaaagcttcagagaggtcaattgctcacggtgcctgcgtatctggtaaaacgccggaagctgcatttccatcatctagagcagtatgacgtggacctgatccttggctgcaacggtttcatctgggtcggtgagcacgtcgtggtgcgtgaaattgctgatttgaaggaagacgaacagaagctgagcgccgaagcggagacttttaccccaatagaaacaaggagacacatttgccgtcttgccaatgctgtgcgcgtgctttcagccctaggattcactctgaccgtcgagctgataattcagaccgcagaagcgagcgtatcatcaaatgtcgagataaacgacatgctcggggccgaattctacgtccagacggcggagagagaggctaagcgtcgaggtgacctcctgggaaagaagagtaaatcattttggccctgcctgcctggtttgctgtaaactgaaaatgctg

SEQ ID NO: 17558 - DNA, 731 bp, Triticum aestivum
  Clone ID: PAT_TA_17558
tcggcacgagcttcatggtaaactctcgaagttgaagtagagaacacgctaggatggccattcggtgtttctatgctactctggtccaaatccttctctgccttatgctctgtcagccatgctatagcacagtaactgacatccaatgtctgaagaggttgaaggcatccgttgatccaaacaacaagttgcattggacatttgatgacaacaaagaaggatccatatgcacttttaacggcgtggagtgttggcatcctaatgaaaaccggattctttctcttcggcttagcagcatggatctgaagggccaattccctgatgggctcgagaattgtagtagcatgacatcgctggatctatcgagcaacagcctttccgggccaatcccggttgacatctcaaaacggcttccatacatcacaaaccttgatctctcgtataatagcttctcaggggagattccagaatcgctagctaactgcacttatctcaatgttgtcagtttacaaaataacaagttgactggtgcaatcccagggcagtttgctggtctttctcgcttaaccgagtttaatgttgctaacaataaattatcaggccagatcccaccatctttgagcaaattctcatcatccaatttcgcaaatcaagacctctgtgggaaacccctcggcgggcacgcccccgcctcctccagcgggcggccggcgcgggcggcgggttctgct

SEQ ID NO: 17559 - DNA, 731 bp, Triticum aestivum
  unsure (1)..(731): unsure at all n locations
  Clone ID: PAT_TA_17559
ggcacgagcaaagctagtatatgctccagaacctcatgacgtagggcggtacctgcaagctgaggttaaccttggtggtcaaacctctgtcgcaaagactgctggcccactagaccctgcgccaggtttggtcgattatgtagagacccttgtaaggaatcccgaaaccgactacaatgttgttgtccttcaactgaacggaatcgaccaacctgctgactccatccacgtcctatgcgtcgggaaactgcggatgcgacttgcccaaaggaaacgacggtcgtagccangggaatcctactccgccccgacgctgctagccggcgccgggcgtggcggaggcgcggcgccacaacccctgcccccgccgccgcgggtaggcctcggcttgcccctgggcttcgaccccgcccgggggcccatcgccccgcccaggctcccccggggattcgccatcgcccgcagttttatccttccccccccgggggacccccctccgtggtgacacgtcctaccacaccagctaacttagttctgacccttgacggaatcagtgcacatctatctctgtgcagtggacggcggcgtctgtttagtagtactagctcagtgcctgcttggcatcggttcattgttttcttgcctaggtttgttcatcttctttcacgtcatcactgtatcctgctagtatcttgctaggtagagcatgtttttattttttattttcctga

SEQ ID NO: 17560 - DNA, 650 bp, Triticum aestivum
  Clone ID: PAT_TA_17560
ccggcccccgctgtggtgctgccggcagacccccgccagggcgtcttaccatcggggcagccccctgcggccgctgcggaccaggtgcagccctctggacccgccgaagtgccctcaccgacgggcgacgccctgccgttgctgagcaccacagccattacagggccccggccccgcagccgtccccgtcgggtgtctctgcgccgctgggtgggtgctctgcaaccagtggaccccggggccgcggtctcgcctctgcggcagccctgcggggcaccgcggctgacctgtgccccggggctaccgctgccctgggtgctgcccctccgcacccctgcggcggtcctccaccagcccaggcagctgccccaccgcacccctgcggcggtcctccaccagcccaggcagctgccccaccgcacccctgcgggggacctcaaccctccggtgcacacggcgggaggcctgcggaggccacggcagttctactcgagaacccagggccatcccccgcgtgatccgggcggcgcccccagagctgtgtgggcggggccgagcaaacggcaggggctgcgccgctcgcccggcggggggcccgcacaaagcagtgcagcagcagctgtgacaatgacacaaagcaatgtgaccgt

SEQ ID NO: 17561 - DNA, 652 bp, Triticum aestivum
  unsure (1)..(652): unsure at all n locations
  Clone ID: PAT_TA_17561
tcacgggtcgatcgcactcggcgggaatgccggcgccggcgcaggctccgtctgccgccgccgccggcggcgcggcgtggcgccacctgctcctcctcctgaccgccctcccgctcgcgctcgccctcctcgcgttcgcgctccagtggcgcggcggcggcgtggacgacgccggctcccgctggcccgctcgcctggccgtgccggccccgtcgaggctgcagtccctccactcctccgccgcatcctgcgtcgaggtgctcgccgcctccgccgcccccgccttcccctacctccgcggctggtccttccacttcgacgcgccggacacccaccaccccaaggtgtgcgtgcagacgagcacctccgccggcctggaccagatcctgccgtggctcttctaccacaaggtcgtcggcgtcgcgcactttttgctcttcgtcgagggaaaggccgccaagcccagcgtcgccggcgtcctcgagtccatccccggggtgaaggtggtgtacagaaccaaggaacttgaggagcagcaggcccggagccgcatctgggacgaaacctggctatcannattcttctacaaaccctgcaactacgaactgtttgtgaaacaatcgctcaacatggaaatggctatcgtantggc

SEQ ID NO: 17562 - DNA, 1953 bp, Triticum aestivum
  Clone ID: PAT_TA_17562
ccacgcgtccgccagcccacccattgtaggcaggcacttgctcagttgtccggacgacatggctttcgaaggagcataccatttcctgcagctcgccgtcggccatgccacatcctcgccggcggcactgctcctcgtcgtagtacccttactgctgttactgctagcatcggtaaggaggtccaccatgaccggacgcaagctgcggctcccgccttcgcctccgggcagcctccccatcatcggccacctccaccacatcggcgcccagacccatatctccctccagcacctggtcgacaagtacggccacaacggcctcctcttcctccgtgctggggcggtgcccaccgtcatcgtctcctcgcccagcgccgccgaggccgtcatgcgcacccacgaccacatcctcgcgtcgcgcccgtggtccatggcctcccacatcctgcgctacaacaccaccgacgtcgccttctcgcccctgggcgagtactggcagcacaccaggaagctcgtcaacacccatctcctcagcgccaagaaggtgcactccttcgcaaatggccgtcaagaagaggtgtgcctcgtcgtcaacaagattcgtgaggcggccaccactgctccatccacggcggtggacatgagcgagtttctggccgcctacaccaacgatgttgtaagccgctcggtgctgggagcgacccaccggaagaaaggccgcaacacgctcttcagagagatgaccgagaccaacgtcgaccttctcgtgggattcaaccttgagaacttcatccctaggtggccactgacggaggtgctcttcaggctggtctgctggaaggttcagcgacacctcaacaagtgggacgccttgctggaagaggtcatcaaggagcacatcaacttgaagcaagacaattctgccgacttcatccatgttttcctctctctacagcaagagtacggtctcaccgacgataatgtcaagtccctcttgatgaacatatttgaggcagccatagaaacatcatatctggtgctggaatacgccatggccgagcttatcaacaacagacatgttatgaagaaactacaaaccgaggtaaggacgtttgcatcgtccaagggaaaaaagttggacatgattacggaggaggacctcagcagcctgccgtacctaaaggcaaccatgaaagaggcgctgcgcttgcacccaccagggcctttactcctcccacactactccactgctgattgcagcatcgacggatatgacataccggccaaaacacgtatccttgtgaatggttgggccattgggagagacccaaaggcttgggagagaccggaggagttcatgcccgagaggttcctacaagatggtcaggagaaatctagcaacctgggtcaagattttaagtatcttccatttggatccggacgcaggatttgccccggggcaaatttcgcactcgcgaccatggagattatgctcgtaaacctcatgtaccattttgactgggaggttcccaatgagaaagatggtgctggtggaaaggttagtatggctgagacgttcgggctgatgcttcgccgaaatgagaaactctaccttgttccaaggattgcctaataactagtagtgcccccgatcccaagtgtaagcctatttagacttgtgcgcaataattaaggtgagggctaaaataagcatgttgtccatctattgttgctggcgatcgataagatggacgagaagtttaatgcactggttatagtgcagttatgttgtagtagtcatgaaaaataatgtatttgagttgtgatcagtggcgtagctagggggtggccagggtggtccatggaccaccctggaatttccccatagcttgtatatagtgtagtaaaaaaatatttctttgaaaataaataaacttatgtaaatatttcaaa

SEQ ID NO: 17563 - DNA, 2114 bp, Triticum aestivum
  Clone ID: PAT_TA_17563
gcgcagtttatacacggaaaagcaatggaagaggaaataactcctttggtttttttatatggcttaggaatgagcataccgtttcttgcacctcgacgcggcctgtcccacatcctcgacgacggcactgctcctcatcatagtacactcactgttgttactgctatcatcgccaaggaggtccacttttaaacggaaagcaagctgcggctcaccccttcgccttcgagccattgcaggcctcgctagcttcctggtcagttgtggacgccatagatggctcttgaagcagcccaccactacctgcagctcgccgtcggcccatggcatgtcctcgccggcggcactgctccttgtcgttgttcccttactgctgttactgctagcatcagtaagaacctcagcgtccacaagaaagctgcggctcccgccttcgcctccgggcagccttcccatcatcggtcacctccaccacatcggcgtccagacccacatctccctccagcacctggtcgacaagtacggccacaacggcctcctcttcctccgcgccggcgccgtgcccaccgtcatcgtctcctcgcccagcgccgccgaggctgtcatgcgcacgcacgaccacatcctcgcgtcccgcccgtggtccatggcctcgcacatcctgcgctacaacaccaccgacgtcgctttctcacccttgggcgagtattggcagcacaccaggaagctcgtcaacacccatctcctcagcgccaagaaggtgcactccttccgccatggccgtcaagaagaggtgtgcctcgtcgtcaacaagattcacgaggcggccaccaacgctccatccacggcggtggacatgagcgagttcctggccgcctacaccaacgatgtcgtaagccgctcggtgctgggagcaacccaccggaagaaaggccgcaacacgctcttcagagagatgaccgagaccaacgttgaccttctcgtgggattcaaccttgagaacttcatccctaggtggccattgacggaggtgctcttcaggctggtctgctggaaggttcagcgacacctcaacaagtgggacgccttgctggaagaggtcatcaaggaacacataaacttgaagcaagataattctgccgacttcatccatgttttcctctctctacagcaagagtacggtctcaccgacgataacgtcaagtccctcttgatgaacatatttgaggcagccatagaaacatcgtatttggtgctggaatacgccatggctgagcttatcaacaacagacatgttatgaagaaacttcaaaccgaggtaaggacgtttgcatcatccaagggcaaaaggttggacatgattacggaggaggacctcagcagcctgccctacctaaaggcaaccatgaaagaggccctgcgcttgcacccaccagggcctttactcctcccacactactccaccgctgactgcaacatcgacggatacgacatacccgccaaaacacgtatccttgtgaacggttgggccatcggaagagacccaaaagcttgggagagaccagaggatttcatgccggagaggttcctacaagatggtcaggagaaatctagcaacctgggtcaagattttaagtatctgccatttggatccggacgcaggatttgccccggggcaaatttcgcacttgcaacaatggagatcatgctagtaaatctcatgtaccattttgattgggaggttcccaatgagaaaaagggtactggtggaaaggttagtatggccgagacgttcgggctgatgcttcgccgaaatgagaaactctaccttgttccaaagattgtctaataactagtagtgcccctgattccaagtgtaagcctatttagatttgcgcgcaataattaaggtggggcctaaaataagcatgttgtccatgtattgttgttgtcgatcgagaaggtggacgagaagttcaatgcactggttatagtgcagttatgttgtagtagtcatggaaaataatccatttgagttgtgatggacttatattatgtgcttttgaggtaaggccatatggacttgtctttttgtaaaaaaaaaaaaaaaaaaa

SEQ ID NO: 17564 - DNA, 925 bp, Triticum aestivum
  Clone ID: PAT_TA_17564
gctccaccacacccgccgcctacctccccccttcccgccgccgtggaaggagaccggcggctggctcccaccgcttccgcgagggttcggaggcagtaggctccgctgctgccatgctctccaggatctctcaactcggggcgcggctcgtgcgcgagaccagagctgcaggaaacttgtcaagccatagcagcaattactaccgaggtctcagccggcattcagccccagcgaagagcatcctcttctccaccgcaacaacaagtagtcatcatgatgaaggcggtgacgacaaggagaaaatctctgtaacatttgtgaacaaggatggcactgagaaaacgataagtgttcctgtcggaatgtccatgttagaagctgctcatgaaaatgacatagaacttgaaggagcatgtgaagggtcgctcgcatgttccacttgtcatgtcatagttatggatgtaaaggactataacaagctagaggatccaacagatgaggaaaatgatatgcttgaccttgcatttgggctgacagaaacgtcccgtcttggctgccaagtaatagcgaagcccgaacttgacggcgtccgactggcgttacctgccgctacacgaaacttcgcggtagatgggttcgtgccaaagccacactgaagacagccatcagttttgtaccttagcatcatcatgtaacttcgctacggtatcgtctctgagagcccccgtgccctcggacttggatctgtcctcattttatgagctccttggtcagtgcaagatcatcagtgtgtagtacactggcagtgggtgaatactgaataatcaagatgtgttcgtgacactccattgccctttctcaccctgagagttggtgcaaacttcgctggtgcatcctgaccccatgatatgattcgctcaatcag

SEQ ID NO: 17565 - DNA, 1478 bp, Triticum aestivum
  Clone ID: PAT_TA_17565
gcctgcccgcccccccagggcgtcccgagggacgcactggccgagcgggggattcggcatctgccatccgatcatggcggtcggcgagctggactggatgaccgggatggctcgcacctgctaacttaccaccgtggaaggcgtggagattgttcattcaggaccgtccgaacatggttcacagcatgcgccgcgcgctgcaaggaatgtacccgaccagtggtagcccatctgtaggaaaggtttacaatgttaaaccagatgtcatagggcagggtggggaatgcgaggggagaacacgctctccatcatggatggcaatgaacgtgatttgaggtccgaaattcctaagctctttgtaccggaaaaagaagtaaagttcaagattccaatattcagaaatcactgagaagtgcttagattgtgatggtcgtggaaaggtgccatgtcctacttgcaatgctggtcagcagcatgggttttacaaggcaaatcaaatgactcggtgcagtgtatgtgatggcaggggtttgcttgctcagcaagatggatctgatacagtatgtgggatgtgcaatggtcaaggaatgttgccctgcatagcatgtgcatcccggggcctagtgacatgccagacatgtaatggctgcggttcccttcttgcacaaagcactgctcatgttcgatggaagacgcttacagcgagaaaagttagtgcaacaacaggagctgcttcggtccctgacgaagttttccacagagcgcaaggggtgcaactatgcaacatacaggcataccaatgcactccagctttctttgccgattcatacccactcaaccagttctcgtcggagattgtcgctagccggctgccagttccaccatccgcaagagtaatttcggagagacacatcatctcggtcgtgcccgtgacccgtgtcacaatgtctcaccgtaagcggtcttttagcttctatgtcgtcggcgatggcagggatgttttcatacgggactattcttcgaagttctgctggggccttggccgttgcttcgaatggttggggaactagttcatgtgtgtgccaccttttggtgtccaatgtccatactatcaaaacttgtaactgcggagaggcagtgtgatttctggtgtgtaacagtaaagatgtgcaacgttatctgtagactgtagtgttacagtacagaagcttctgtgtgtacattttgggcttgtggatcatatacagcggtactgtaccgattgtttgatgtgtagctggtgtgtaacagtaaagatgtgctccgttgtctgtagtgttacagcacaaaagcttctgtatgtacattttgggcttgtggatcatgtacagcgcggctgtgccgattgtttggtgtgtagaaaataattcatatttggttataaaaataataatgagaaaacagtggatcaaaaaaaaaaaaaaaaaaaaaaaaaaaaa

SEQ ID NO: 17566 - DNA, 1309 bp, Triticum aestivum
  Clone ID: PAT_TA_17566
cacgcggcattccgcggagctaccgagagccggaagccggaagcaagtgagctgagcgcaggcgggtggaggcggacggacgcgacgatgagggcggtggcgatcgcgagccccggcgggccggaggcgctgcaggtgcgcgaggtggacgacctcccggcgccgggggagggcgaggtgctcgtcgcggtggccgccgccggcgtcaaccgcgccgacacggtccagcggcagggccggtacccgccgccgcccggcgcctccccctacccggggctcgagtgctccggcaccatcctcgcgctcggggccaacgtgcccccgcgctgggccgtcggcgaccaggtgtgcgcgctgcttaccggtggcgggtatgcggagagggtggtggtgccggcggggcagctgctcccggtgccggagggggtgtccctgaccgacgccgccggcttgcccgaggtggcctgcaccgtctggtccaccgtcttcatgaccagccacctctcccccggcgaatccttccttatccatggcggatcgagtggaatcggtacattcgctatacagattgcgaagcaccttggtgttaaggtttttgttactgcaggaagcgaagaaaaactagctgcctgcaaaggtttgggagcggatgtatgcataaactacaaaactgaagattttgtagctcgcgtaaaaaaaaaaacgaagggaaagggtgttgatgtcattctggacaatatcggcgcatcttatctccagcgcaatctgaacagcttagctgttgatggtagactcttcatcatcggtttcatgggaggcactacaactgaagtgaacctgcaggcgatgcttgcccgaagattgaccatacaagctgctggattgcggaacagaagcctcgctaacaaagcccagatcgtcagcgaggtggagaagaacgtgtggcctgccgtcgtgtcgggcaaggtgaagccggtgatttacaagacattccctctgtctgaagcagctgaatctcacaagttgatggagacgagctcccacattggcaagatactgctgattccatgattggatatggtgtatcatgtattcatgtgtacactagccgctgtgggcactgtttactgtggtgaactatgcatggacatgcccttttatattgtaataagctggatctctaagtgctggtgaaattggatatgtatctcgaggataaatagtcacaataaaatgttggaacttggaagtctttcacattaatctgttgggacgtggattgatgttgagatttttccactcaaaaaaa

SEQ ID NO: 17567 - DNA, 748 bp, Triticum aestivum
  unsure (1)..(748): unsure at all n locations
  Clone ID: PAT_TA_17567
gccggccggtccngggacgccaaatcctcaatcaaaatgtctaccgcccaggagctctccacatttcctcggacttgatctgggagatcgtccgtgacaacaactgcttctccgccaagagcaagaagaacggcggtgttcagttctcccgggaccccctcaacctgaccaacaagagctcccgaaagcacgccggcttcgtcaacgacaaggccgtcggtatcgctgccggtgagaagggtgccgttgttgtcaccaccaagaaggctcagcccaacaagcccgctcagaacatcaccaccacttcttacagcggctccaagagcaaccgcaagacctaccaggctgttgccaaccaggtcgccaagaactcttaccgcgctgacctccgctccgccgctgtcgagcgtgcttctgccatcaagaagtcccacaagcccgtcaagtccgagcctgagcagaagctccgtggcaacaaggccaagaaggccgctgccgccgctgaggagaactaagcttttacgatgcaaacatagaaatggatggttgtgaataaggctacaggatgaagctagggaggtaggctgcatagctcacacctgatgagaaaagggatcatcagaatgggcaaagcacatgaaccgaggtctctgggtcattcacggctggagtttttgagctcaaaatgaatgaatattccgtcggcgatatcgttggcaactaaaaaaaaaaaaaaaaaaggccccta

SEQ ID NO: 17568 - DNA, 887 bp, Triticum aestivum
  unsure (1)..(887): unsure at all n locations
  Clone ID: PAT_TA_17568
gcgggctggctgcagccactcctctcgctacaacagatctagctccaggtagttaaataactttgcatccacccaggagagggaaagttcgagaatgttccggcgcagcggcggtggcggtgtcaggggcaagacggcggctgcgagcaccagcacgggcactgagctgcccgtcgatggagctgtgcgggtgacgaaagtggacaagatccaggcttacaatctcgtctcgaggccgtcggtgcaccacgccatcgtgccggcgacgtcggggccggcggagagcctcgccgtcagtgttgtccgggtggtggacgtcgtggacgaagctgtgcgggtgaccaaagtggacaggatccaggcttacaatctcgtctccaggccgtcggtgcaccacgccatctcgccggcgacgtcagggccggcggagagcctggccgtgagggtagtccggttcggggacgtcgtggacgaagaatccgacggcctcatctcggtgaccatcacatagaactaactactctttactacgtaactaataactaggcctgtcgtgccttaagcgtgtttaacgtttcgcgagagaaacatatgtacgcgcaccagtgggtaactgtaatggcaatagcacgtggaaggatattaataatcttgggaaaagaaaaataatgagggctcctagcccgtcagggttgtccggttcggggacgtcgtggacgaagaatccgacggcctcatctcggtgaccatcacatagaactaactactctctactagtaataactaggcctgtcgtgccttaagcgtgtttaacgtttcgtcagagaaacatatgtacgcgcaccagtgggtttaagtgtaaggcaatagcacgngaaggctattaa

SEQ ID NO: 17569 - DNA, 1154 bp, Triticum aestivum
  unsure (1)..(1154): unsure at all n locations
  Clone ID: PAT_TA_17569
aacactggatacgatctgaagcacttatttgttggaagtgaaggctccctcgggattgccgctcgagggtcaatacttacacctgcaaagctaccttcaactaatgttgcatttctttcctgcaatgactacatgagctgccagaaattgctactggtaccttcaactaatgttgcatttctttcctgcaacgactacatgagctgccagctaggaggagcttgggctatgacgcatttggaaggagttcataatcctttacctgtctcgccgtacaaattttatgttctaattgagaccacaggaagtgatgaatcatatgacaaagcaaaacttgaagcttttttgttgcgttcaatggaagatggccttgtagctgatggagttatagcacaggatattagccaagcatctaatttttggagaatccgcgagggtatatcagaggcatctgtaaaagttggtgcagtctacaagtatgacttgtccatacctgtagagaaactatatgatattgttgaagaaatgcgcagccgtgttggtgatacggcagaggtattgggttatggtcaccttggtgacgggaatctccatctaaacatcttatcaagcaagtacagtgacaatattctggcacaaattgaaccatttgtctatgagtggaccgctggccacagaggaagcattagtgcagagcacgggctggggctaatgaaagctgagaagattcactacagcaagtcaccagaagcagtgcagctgatggcttccatcaagaagttaatggaccctaactcgattctaaacccatacaaggttctacctcggtctgcattgtcaccggagcagggtaactgattgagcttgtcgcctgccaaatcaacttcagagaacaagtgttaacttggatagaagagatctgtctgtacccaataaaagtagtcaataaaattcctgttgttgtcagcgtctggagtgttgtaaacaattattcagatggacatcaaactaggaaaaaacatcaattaaggccatgtacaacccaggcgcttgcacaggcacctcagagaaaaaaaaaccttttttgtgagattcctgggccctggtcctgcccggagggctaccccnccctctcnctctttccccggggtgtg

SEQ ID NO: 17570 - DNA, 672 bp, Triticum aestivum
  unsure (1)..(672): unsure at all n locations
  Clone ID: PAT_TA_17570
ccaaagcgtccgatcaatcacagaaaatcgtccctccatatctccccagctcttcttcctcctcccaccccccgcctagcccccgggtcttctggtgcttcttcctcagatagcgaagaaggagagtagatccggtggagagggggcggcggtgtcggcggtgatggcggtgatggatctggaggtggaggagccgcggctctcgcccgggccgggcttccggtcccatgcgaccgacgaggaggtggtcacccactacccccaacccaaggcagtcaacaacgccttctcctgcctggtgatcgccgacgtcgacctcaacaagaccgagccgtgggatctccccgggaaggcgaagatgggggagaaggagtggtacttcttcgtgcacaaggatcgcaagtacccgacgggcacgcgcaccaaccgcgccacggagaaggggtactggaaggcgacggggaaggacaaggaggtcttccgcggcaagggccgcgacgccgtcctcgtcggcatgaagaagacgctcgtcttctacaccggccgagcgccccgcgcggacaagacgccgtacgtgatgcacgagtacctactcgatggccagctagctcacccaccnnncccgcccgtccggaacgattgggctgtttgccgggtgttcgacaaggactt

SEQ ID NO: 17571 - DNA, 637 bp, Triticum aestivum
  unsure (1)..(637): unsure at all n locations
  Clone ID: PAT_TA_17571
nncatccgttttgttannnnnnnngaggcggctgttggtcgctgatgtgccttcgtcctgggacgtctcttggccccgtcttctctttgagacggcgccttgcctcgagagttttcacatccacattgcctcttgcatggaggagcccagtcccagtgaagaaatatcctggtgtccgacaaagtttcggcagcatcgcttgaaggagtttgtgatggctggttttgaggcaacagaaaggcagatttaccttgtcaagtttgtcatggccgtatgcacggcgttgcgtcatgtcagcatgttcaagaatgggcatgttcaggacaaggggcactgggaatgggagatggtgacacagcaacactcatggactgaggaggacaaggacgacacgctcaagcagattatgggcacggcatcttcaacagcagctccggttcaactggttttaggctgatcatcgtgtgtttgtgcctgtcttatgatcctctcataatgtattccacatctctgttttactcgatgtgatttataatatattactcaaataatgtttttgtttgttattccttttctgtgctaagcagtgcgtgtgcattttttaatgggaacccgatccaattttgtttggtgtaat

SEQ ID NO: 17572 - DNA, 440 bp, Triticum aestivum
  Clone ID: PAT_TA_17572
tgctccggggcgcgccatgctccgtcgccatcctcgtcgaccgcgggctcggcggccactcccaggtcgccgccaagaacgtggagttctctgtggccatgctcttcttcggcggggcggacgactgtgaggcgctggcgtacgcgacgcgcatgtcggagcaccctggcgtcgctgtgactgtgacacgcttccggcccagccgcccatcgtccggcgacgcagccgacgaggcggccatcgaggcgttcaagggcaaggtcgaggccgtgaaggacgggtcggcgatgtacgaggacgtagaggcgtcggccaaggaggaggtgctccaggcgatcaactcgctgtccaagtccaacatgttcgtggtggggaggatgccgccgacggagccgctggtggagaggccccaggagctgggcccccgggggagctacctg

SEQ ID NO: 17573 - DNA, 1834 bp, Triticum aestivum
  unsure (1)..(1834): unsure at all n locations
  Clone ID: PAT_TA_17573
ggagcgagctctgcaggaggccattgcgagcggggaggtggcagttcagtggttgagggacagccttggaatcatttcctcagcagcagaaattgaagggttggctgaaagtgtgcaggattcaggtggcatatactttgtgccagcattcaatggattgttcgcgccatggtggagggatgacgcgagggggatctgcataggaatcacaaggttcacaaacaaggggcacattgcccgagcagtgctcccgcgtatgtgaaacgcggcgtttgactttctgtaccccatgcattgctatgctggggcggcgggtgatgggaagagtgcagaagggggatgctcgctccgtgccgatggtggtgctactgttaacaaccttttgcaggcatatccagtccgatttggtggggatccgtgatgtcaggccgaacaggagttagttgggcagcatgtcacagactgctcgaacgcagcacgtacaatgcttatgaatctaaaggcacttgactgggacaagcctacacttgaggcattaggcattcctgccggcatcttgttagatgacgcacacaggaagaagagaggagagtcggtggccagtggcggttttatgatcatttgacctgtctgacctttctctctagtttgttacaccttgttgcgcggcaaaattggatcagtgtgtgccagcccatgtttgtcgacgaataaatggtatgttgtacattatttcggtgggatttttctttggctttatataggaagaattggagcataaatgtccttgtatatctataagtacaggagcatctggattcttcagagagaagtgccatgggtagtaaaaaaattcagtggttgagggacaagccttggaatcatttcctcagcatcagaaattgaagggttggctgaaagtgtgcaggattcaggtggcatatactttgtgccagcattcaatggactgttcgcgccatggtggagggatgatgcaagggggatctgtatcggaatcacaaggttcacaaacaaggggcacattgctcgagcagtgctcgagagtatgtgctttcaggtcaatgatgtcctcaactccatgcataaggatgccggggagtcaggagaagtgaagagtgcagaaggggagttcttgctgcgtgtcgatggtggtgctaccattaacaaccttctcatgcagattcaggctgatttgttgggtagccctgttgtcagaccagccgacatcgagacaacagccctcggggccgcatacgcagcagggttagctgccggagtctggacgaaggaggaaatatttgcaggcctgcacaaggagaacacgacggtgttccgccccaagttagatgacgcacacaggaagaagagaggagactcctggtacaaggcggtttcaaggtcatttgatcttgccgatctttctctgtagattgtcccaccttgttgcacggtaaattggatctgtgtgtgccagtgtggtgtatcagttaacccttgtttgtcttgccattgaataaatggaatgttgtgcattattagttctgtgggatttttcttcggttttataggaagaataggagatacttgtccttatatgtctataagtacaggaacatctggattcttcagaaagaaatatttgtggagtattctggtatattttcatggttagcctcaagcacatgtaacatgtttgtgtccaggtgctccaagctagggataaataaatttgagttccatgatacaaaaaaaaaaaaaaaaaactcgagactagacctgcccgggcggccgntngaaatcacttagtgaattc

SEQ ID NO: 17574 - DNA, 620 bp, Triticum aestivum
  Clone ID: PAT_TA_17574
gtacaagagcaaatattatattcctcaatcttatatcagcttcttgtacacgcttctccaagagaagagagatagcttgaacaagaagcaaatattatattcctcaatcttatatcagctccccaaggggtgcatgtagtcagcaagagattcccaagggtcaagattgtgacatcagagatcgagcttggtctgaatgatgatttccgtgtcatccctgggatgggtgagtttggggacagatactttggaacagatgattatcagccatcaacgcccttcttcgcagatgacaaaaaccgtgttgggcttttgtgagaattgcccacacatgccacctcctgcctatggcattattaaaattctttttgagaaattttatttctatattcccaaactctcggatgtcagtactgttatgttcactagcggaaactgtatatcatgagaacgttccaaacggacattcacttgacataaatggcacaatatcatatttttcatgcacccataccaatctcttctccaggctctgttcacagactattctgtttgatatactagcttgtaatgtttttcacctcttccccatgattttgttatgaaatacggtgactctt

SEQ ID NO: 17575 - DNA, 1328 bp, Triticum aestivum
  Clone ID: PAT_TA_17575
gccggccggcctgggagtcatcttgtcctcacatctctcaaccaaacttttcacgatacaaacgacttaatactattcatcatgtcttctgctctcgaccagctcaaggccaccggcactactgttgtgtctgactctggtgactttgcctccattggcaagtacaagcctcaggatgctaccaccaacccttctctcatcctcgctgcctccaagaaggaggagtacgccaagctgatcgatgtcgccatcgactacgctaagcagaagggtggctctgtcgaccagcaggttgacgatgccctcgaccgcctcctcgttgagttcggcaaggagattctcaagatcatccccggcaaggtctccaccgaggtcgacgctcgttactctttcgacaccgaagcttccgtcaacaaggctctccaccttatcgagctctacggcgagcaaggtatctccaaggaccgcatcctgatcaagattgctgctacctgggagggtatcaaggctgccgagatcctccagcgtgaccacggcatcaacaccaaccttactcttatgttctctctcgtccaggccattggtgctgctgaggctggtgcttacctcatttctcccttcgtcggccgtatccttgactggttcaaggcctctaccaagaaggagtacaccaaagaggaggaccctggtgtcctgtctgttaagcagatcttcaactactacaagaagttcggatacaacaccattgtcatgggcgcctcgttccgcaacactggcgagatcaccgagctcgctggctgtgactacttgactatctctcctaacctgctcgaggacctcctcaactcctctgactctgttcccaagaagctcgatgcttcccaggcctcttctctagacatcgagaagaagtcttacatcaaggacgaggctctcttccgcttcgacttcaacgaggaccagatggctgttgagaagctccgagagggtattagcaagttcgctgccgatgctgtcaccctcaagggcatcctcaaggagaagctctcctaagttacatgcgcttgataagccaagaaaatgatttaaaagttataaaactcttgtcggggaagaagccgtatcgagttgattgcgagcaatgagcttgaatctacacgcgatctttattggaggttaccgattataccacatacctactctagtctaaaaccacatagcttcgcctaagtcgtggcgatgtggcgaaccacgatctgataggggcattagttgtccatggaaacagatagtggctacataacgaatcgagacgacatgttacgccc

SEQ ID NO: 17576 - DNA, 1248 bp, Triticum aestivum
  Clone ID: PAT_TA_17576
gcctcagaatgcagacttacaagtgaacggtatacaagtgcgagtagttcccaggcctagcactcagttactagggattaatggacgggatgatgggccggtgataacaaccttttgccgagaaggacagaataaaatagttttatcaagtgatgatgcccgaccattttgttttgggatcagaattgcaaagaggaggacagttgaccaggttctaaacttggtgcccaaggaagctgatggcgagtcttttgaggattctcttgctcgtgtttgtcgctgtctcagaggtggaaatactgcagatgatgctgacagcgatagtgatttggaagtggttgccgacttctttcctgtcagcctgcgttgtcctgtgagcggttcccggcttaggtccgcgggcccgctcgtgccgtgtgcgcccttgggctcttgtgttctgcgaacgtttgccgtgctggatcagcggcctcgtcagtggccatggccctcgtggccgctggattctgcccttgtgcgcgccacccttgcccgctagttcagccggaccgcctccctggttcggtatggctgtctgggtggcccccagccgggtgggtagcctgctggctctggccgcctgtagggtggtgttgcagctctacgttcgtccctggcgctcctgccgggcggccccctgtgggagctgcaacgggtcaccattcctgttgctggtgatgtaaaatctgaaacttaaaaattggcagcaggggaaatgtaggccttaatggattgtgggaagctagtaaagctgttgacataaatccctcaaagcctatgagcagtagccacactggaatttacagggatggggactaccaaagtgtgagcgagtgcagcacgcaaattggtgagatgtacagagttgatgacagaccacagcaacagcttgaagatgcagacgtcatcgttctcagtgactccgatgatgacaatgttgtgacagtgtctccaccagctgcctatagtgatgttggtggtttgggatttgctcccatttctgcgccgggagttgctgaaagttaccaggagggtggtgtagttgggggccttggccttgatttgttcaacgacaacagcgatatttttgacataacttcctggtctgcgcaaccccaaccaagagcaagggttcaattttttcggaactgatgttctacttggttctcacaattcatctgatgcagcgccaagtgcttatacccttgg

SEQ ID NO: 17577 - DNA, 1156 bp, Triticum aestivum
  Clone ID: PAT_TA_17577
gcccgcgcgccgcatggagcagaatggtggctccttcctcgccgtgcgccggctctccggccaccaccacccatcgccggcggacgtcgtgtcggggtcgacggcgtggatcgggaggggattctcctgcgtctgcgtgcagaggagggacagcgacacgcgcatttccttcgatctgacccccattcaggaagagtgcctacaaagattacagaaccggattgaggtgccttatgatagtcaaaatggagaacatcaggaagcactcaaagccctttggcatgcttcttttcctgggactgaacttctaggactagtatcagatcaatggaaggagatgggatggcaagggaaagatccatccacagatttcaggggtggtggctttatctctttggagaatttactttacttcgctaagaactatccaaaatccttcgaggagctcctttgtaagcaaaatggtgacagagcattatgggaatatccatttgctgtagctggagtaaatattacatttatgctcattcagatgcttgatcttcaagcagctaagccaaggtctttgattggagcagtgttcctaaatttacttatagaaaacgatcgagcttttgatattctttactgcataacctttaagctgatggatcggaaatggcttgaaatgcacgccacatatatggatttcaatactgttattaaatccacacgccgccagcttgagagagagctattacttgaagatattcagcaaattgaggacatgccgtcatacagttttctcgcccgttagcaactgaagtcttgcctaacatcgccacgtgtagtaaagttcttgacacatgcttctaaagagtggaatgtaggaatcagggactcgtgcttgtgtggtttttgctaccgtgcttaggtactctgatatcctgagcgcatgtttgggtcttcttggatctgacctctagagtaactggctacctgaacagcagttgggccatgctagtgccggtaggatgtactttcggaaacaatttgtcctggcgcggagtcttcgtgctaggaaatacgtagtaagttctgaaactcctcagtactcaagacagctttgtagccaagtgcataaatgatattggtgcgctctcgttttgcactaaaa

SEQ ID NO: 17578 - DNA, 1162 bp, Triticum aestivum
  unsure (1)..(1162): unsure at all n locations
  Clone ID: PAT_TA_17578
gccggcagggccagggagcgtgcgtgccacctgcgaccccgtaccgtgtttgcgagcgcggcgacggttgtgatgaaaagttgcatctgttaacggacacgagttgttctgctaccaagttcgacatcgggtcaggaaacctggcggtggtggtggtggtgaggcccagctgtttaggcctcggacatgttctgctacaaaatctggcaggggttcgttacccgcccaattggtctagattgtgagcaccagcccttttgattgcgagtgacatcttgatgagaactggtgcagggcgtttacctgccaaacctatctggactgccccaaccagtcagtccagctgaggagaacgtccttataaaagggccgcccaccagtcaaatgctccccggcctagtagctgtcgacctgtctttgatagtcatcaggatcgttggagctgcctgcaaacgtccacccatccttgccagctgggtgccctagtgagaggttacccgggtggttgtttcaccagacgaggctcgtcacgtatcttaaccacaagaatagatgctgtgaggaggatgtgtgcaccgaggctcgtctgtatgatgagctgcagaagcacagacatgaaaaggattgctgctcatgcactgctgacttcaatgagcttcagaagcacacacagcaaaagcatccagatttccgcccttcagaaatcgatcctgccaggcaagttgattgggacaacttccagcaatcttctgatatcgtggatgtcttgagcacgatacatgcgcaagttcccaatggtatcgtccttggagactatgtcattgaatatggggatgatgatactggagatgactatgaagtgctccgcagggttaggaggaatggtggtcttttatttgttgcaaggcttttgtagatatccaagaaccgaagaagagggagaggaagggacagtagaggaatggaaggaggaacagcatcaggtcatctgggagaactcanctcgangtcccgacacaantgttgacctgagggaacagattgatgaantgatgagatacatgtcacangggggactantatggaacacaagaagaaggcattccatacaggatacagatnggccgtgatcgggtcactatagacagcgataaagaaagat

SEQ ID NO: 17579 - DNA, 1050 bp, Triticum aestivum
  Clone ID: PAT_TA_17579
gccggccgttccggaaaaaaaaaactacacacaccttgtcgccttaaacgcacaaccagcgacaagatgcgaacctacgaggacaccttctccggcgcgagaatctaccctggcaagggtaagctctacgtccgtggcgacagcaagatcttccgattccagaacggcaagtcggagtctctcttccttcaaaggaagaacccccgccgtatcgcatggaccgtcctctaccgccgacagcaccgcaagggtatctctgaggtatgcaacaattgaaagccagcggcacttcgcacgaagctcgtcactgctgctggccctcatgacaacatttgccacaagacagaactgacacattctacaggaggttgccaagaagcgaacccgccgcactgtcaaggctcagcgtggtatcgttggtgcttctcttgacgtgatcaaggagaagcgcaacatccgacccgaggcccgctccgctgcccgcgcccaggccatcaaggagagcaaggagaagaagcaggccgaggctgctaccaagaagtccgagaaggctaagctcgctgcccaggcctccaagggccaggctgtccgacaggtcagcaagcagggtgccaagggctctgctcccaaggtccaggccaagacccgttaaattaggaatggaacttgagtgaggatgaaaatgggagagtggagtccgtggttctttgtgcggcgctcggccgggccttctacggtctcgggtgcatggaatgccaatagggtgcattgatagttgagcaatgcaaaatggtcaaacaaacaaacagacaacgcatctgattcttgtcgtgacgaacaagggatgtgcagttgtgcggtggctcggtaaatacctcacggcgttattggaaactagcaacttagcttgttagataacgacacaatgccttacgatgcaagaccagacgtcacgggaatcgcttcaattagattgtgttcaatggtattcatgtagtttgtctctattctatcgttgtctcataaaaaaaaaaaaaaaaaaggccccta

SEQ ID NO: 17580 - DNA, 901 bp, Triticum aestivum
  Clone ID: PAT_TA_17580
gccggccggttgtgcggcgctcgggcgcccggccgggcttgccgccgccaatccacggtcaactacacaacaccttgtcgccttaaacgcacaaccagcgacaagatgcgaacctacgaggacaccttctccggcgcgagaatctaccctggcaagggtaagctctacgtccgtggcgacagcaagatcttccgattccagaacggcaagtcggagtctctcttccttcaaaggaagaacccccgccgtatcgcatggaccgtcctctaccgccgacagcaccgcaagggtatctctgaggaggttgccaagaagcgaacccgccgcactgtcaaggctcagcgtggtatcgttggtgcttctcttgacgtgatcaaggagaagcgcaacatccgacccgaggcccgctccgctgcccgcgcccaggccatcaaggagagcaaggagaagaagcaggccgaggctgctaccaagaagtccgagaaggctaagctcgctgcccaggcctccaagggccaggctgtccgacaggtcagcaagcagggtgccaagggctctgctcccaaggtccaggccaagacccgttaaattaggaatggaacttgagtgaggatgaaaatgggagagtggagtccgtggttcttgtgtctttgtccggccggttcttctacaatctcgggtgcatggaatgccaatagggtgcattgatagttgagcaatgcaaaatggtcaaacaaacaaacagacaacgcatctgattcttgtcgtgacaaacaagggatgtgcagttgtgcggtggctcggtaaatacctcacggcgttattggaactagcaacttagcttggtagatacgacacatgccttacgatgcaagacagaaaaaaaaaaaaaaagggccct

SEQ ID NO: 17581 - DNA, 1562 bp, Triticum aestivum
  Clone ID: PAT_TA_17581
gattcagatcgcaaaacagaaagaaagaaaaaaaaagagacagagagaaagcagcaatggagtcgctgactctgcgcgcctcgccgtcgtcgaccgcctcgccgctgctccgcctgcccggccggcggcgcgcggcgtccgtccgcgtctccgcctccggcgccggcgccggcgccgccgagccggacctgtccgtgaccgtgaacgggctgaagatgcccaacccgttcgtgatcggctccggcccccccggcaccaactacaccgtcatgaagcgcgccttcgacgagggctggggcggcgtcatcgccaagaccgtgtccttggatgctggaaaagttatcaatgtaactcctcgctatgctcggctcagggcagatcctaatggatctaccaagagtcctatcattgggatgggaagaacattgaacttatcagtgatcgacctctcgagacaatgcttaacgagttcaagcaaactggaagcaacggaataccctgataggataagtcattggctcaataatggaggaatacaacagaagctgcatgggcgatgagcttattgaacgtcttggaggaatcatggagtcgacgcgcttgagatgaatttcgcatgcccacaatgcagccctggccgaaaatctggcggcgctcttggtctggaccgtgtcatgctaatcagtctgtcccgatcccatcacgacgccctccattttccctatacgtccttacactactcctaacactaggattaagaaacaaaacaaaaagaactgttgctacctttgctgcatcaagtaaaagccgccatgaacacaataaggagtgtgatgggaattgatctcaaaactttgcgcccagaaaccttgtgtggaggggtactccacacctgggggatattctgcgagagctgtgcaccctattgcacttgcgaaagtcatgcagatagcaagactgatcaaagaggaatttcctgaaggtcggtccctctccgccattggtggtgttgaaaccggcaatgatgctgctgagtttattctacttggcgcagatactgtacaggtatgcacaggtgtaatgatgcatggttatggccttgtgaagaagctgtgtacagagttgcaggattttatgagaatgcatgacttttcgtcaattgaagatttccgaggggcgtctctcccctacttcacgacgcacacggacctagtgcagcggcagaaggaggcgatcaagcagcggaaggccatcaggatggggctgcagtcggacaaggactggaccggcgacgggttcgtcaaggagaccgagagcatggtctccaactgatgccgcaactccgttggatcggatctctcggtctccaactgatgccgcacctccgtccgatcccctcacgacgcccttcctttccaccatacttccttccacttgtgattaaacccggacctataaacgaaacgaaaagaaagaacagtgggaacttttgctgcacctcattcaataaagcatagtggtggtacgaaaaaaaaaaaaaaaaaaaaataacccaacaaaaa

SEQ ID NO: 17582 - DNA, 479 bp, Triticum aestivum
  Clone ID: PAT_TA_17582
ctgtgcggcgctcaggcggcgggccggatcctactcttcccaagccacaggagaggagagcagagcagagcacaacccttggacacctcttcttcttcttccatagtaacccaacccaccctttgcgaagatgtataacgctccgtcggggcaggagatgtcctacacggagcacgtgcagaagcgccacgaggagaagggctgcatctacgcatgcgtgttcacagcgctgtgctgcttctgctgctacgagacatgcgagtgctgcctcgactgcctctgctgctgctgcaactaaaccggacatggccgccatggacggaggccgcaaggcgcagaggagatccaccggcctccgccgcctttcataataagcatatgtgtctagtgtcttagctcgatgagaactgtatcacaactttgctataatactatctgtccttgtaatcatcaaaaaaaaaaaaaaaaaaaggccccta

SEQ ID NO: 17583 - DNA, 505 bp, Triticum aestivum
  Clone ID: PAT_TA_17583
aaaaaaaaaaaaaaaaaaaaaaaaaaaaaaccttgcttgcatacacacaagaactagacaaggtagaagagatctaaaactagccggagagaggagaggagcccggcctgccggcggcgagatgtataacaaccctccgccgccgcaaggcatgtcctactacgagcacgcgcagaagcggcacgaggagaagggctgcctctacgcatgcgtgttcacggcgctgtgctgcttctgctgctacgagacgtgcgagtgctgcctcgactgcctctgctgctgctgcaactagaccaggctgccgtgcccgacatggacggaggccgcaaggcgcagcggagacccaccggcctccaccgtcgcctttcataataagcatatgtgtctagtgccttagctcgatgagaactgtatcagatgttgctgtaatactatatgcccaggacaaggctatcactgtaaacatcgattatggtttgtgctgcatcttaatttaattagcacc

SEQ ID NO: 17584 - DNA, 500 bp, Triticum aestivum
  Clone ID: PAT_TA_17584
ggtggagggatcctaatcttcccaagccggccacgggagagcagagcagaatccttggagagtatcttcttcttccatagtaacccactccaccctttgccaagatgtacaacgctccgtcggggcaggagatgtcctacacggagcacgtgcagaagcgccacgaggagaagggctgcatctacgcatgcgtgttcacggcgctgtgttgtttctgctgctatgagacctgcgagtgctgcctcgactgcctctgctgctgctgcaactaaaccaggccgccatggacggaggccgcaaggcgcagcggaggtcgaccggcctccgccgccgcctttcataataagcatatgtgtctagtgtcttagctccatgagaagtgtatcagaagttgctataatactatctgtccatgtggtcatccatcatggtttgtattgttgctgctgctactgctctaccattttaatttgattagcatcagattatggttctcaact

SEQ ID NO: 17585 - DNA, 789 bp, Triticum aestivum
  unsure (1)..(789): unsure at all n locations
  Clone ID: PAT_TA_17585
gccggccgatttctacatcttcacgagccacaggagagcagagcacaacccttggagaccacgtcgcgcggagccaccggagagcaggcagagcacaacccatgagaggagagcagagcagagcacaacccttggacacctcttcttcttcttccatagtaaccccaacccaccctttgcgaagatgctataacgctccgtcggggcaggagatgtcctacacggagcacgtgcagaggcgccacgaggagaagggctgcatctacgcatgcgtgttcacagcgctgtgctgcttctgctgctacgagacgtgcgagtgctgcctcgactgcctctgctgctgctgcaactaaaccggcacatggccgccatggacggggacggtccgcaatgggcgcaagaaggagatccaccggccctccgccagcctttcagtaataaggcatatgtgtacttatgtgtcgctaagctccaatgagaactgtatcaacaactttgctataatactatctgtccttgtaatcatccatcatggtttgtgttgttgctgctgctctaccattttaatttaattagcatcagattatggttctcaccaaaggaaaggaagactgggccgaccagacgaccgcgcagaacctgcgaacctgtctaaagactgcagaaacgacgggcccactgcgcttttcctttgacactttgctttgtctccctgtaattatctgaagactgaaatgaacatttcattattattttctctaaaaaaaaaaaaaaaaaaggccccctann

SEQ ID NO: 17586 - DNA, 597 bp, Triticum aestivum
  Clone ID: PAT_TA_17586
taaaaatgcttcattatctatcggcactcgttgctgcgcttgcagctagcactgttcaggcttctgctgatattgtctctggtgccacatggactgcgaccaacactggcgagcatgttcaagcacacggccatggcttgatcgaagttgatggaacctactatatgatcggcgaagacaagaccgacggcactttcttccaaaacgtcaactgctactcatccactgatctcgtcgagtggacataccgaggtgcactcttatcccgcaccagcgaggcgggcgatcttggacccaaccgtatcgtcgaaagacctaaggtcatttacaacgatgatacgaagaagtatgtcttgtatctgcatatcgacagctcagactacaaggacgctcgagttggtgtagctacaggtgatagcgtttgtggaaagtatacctatcatcgcagcttccgaccacttggtaagcagagtcgtgatatgggtcttttcaaggatgatgatggatctgcttatctcatgactgaggatcgcgagtatggaacaagaatcatggccttgtccgacgattatctcaatgttaccgaaatcacatatg

SEQ ID NO: 17587 - DNA, 2208 bp, Triticum aestivum
  Clone ID: PAT_TA_17587
cctcgcgtccgggtcctcacacccaccccctctctcctctctctctcgtcgagaagaaagaaaggaagcgaaagctctagtctcgccacctgcacacagaccgctcgtgaggcgagagagaggccgaggccaccaaaccaaaaaggaaaagaatttttttcttggagaagaacaccgtacgcataagcatcgaggagggaggcgggggcatacaggagagggtggaagggaaacctagtcaaacagagacggatctgccctccgccgccgacgccgacgccggccacgatcgcctggtccctggctccccgcaaactcacgactcgtcctctctgcctacgacctatcgtcgtacccgccggtaagcgcttccgccacgtacgtatcgcagttccgttcctgtaaacaaaacatggggtcgcatggaagcacgtgactcgaccgcgccctgctcccccctccatctctctccaagttaggcggccgggggatccctacctccctcctgcctcgagcaatccccctctccctccttgtggtctccgggttcccgtctcagattcccaggttcgatcttgatccccagctatccccacctgcctctgccgtcctcgaatccttcgtcgcagaggcgccgcttttacctcttcttgccgcgatttgagaagaagactttattgatccgagcaagtcttcttgggcgggaagaaaggagccatgatacctgctgtgaagctctctccggccgccttctctgtcaccaatcaacggtctaaatcagcttttgttccgtcggtgtccattctcaacatgaaaaaatttgcgtcctgctcccttagaccactctacctcacacggctagatgacccacacacttccgagctgaagcctcggaggcagctgcttgacttccggtgtgcagcttcagcggctgatgacaaggagtcaaaggctgaggtgttgccagccagctcagaagcagcacaaaagttgaagatttcaatctattttgcgacttggtgggcgcttaatgtaatctttaacatctataacaagaaggttctcaatgctttcccgtatccctggctcacctccacactatccctcgcctgcggctcagcgatgatgctcttctcatgggtcacctgcctagttgaggcccccaagactgacttggatttctggaaagcacttttcccggttgctgtggctcatacaattggacatgttgctgccacagtgagcatgtcaaaggtggcagtgtcattcacacacattatcaagagtgctgagcctgcattcagtgttttggtgtcaaggttcattctcggagagtcatttccgatgcctgtatatctttctcttctcccgatcattggtggttgtggtctagctgctgcgacagagctgaactttaatatgattggatttatgggtgccatgatatcgaaccttgcatttgttttccgcaacatcttttcgaagcggggcatgaaagggaagtctgtcagtggcatgaattactacgcttgcctttcaattatgtccctggtcatactcacaccatttgctattgctatggaaggcccccaaatgtgggccgctggatggcaaaaggctcttgcagatgttggccccaacgttctctggtggattggtgcacagagcgttttctaccacctgtataaccaggtgtcctacatgtctttggaccagatttctccattgacgtttagcattggcaatacaatgaagcgcatatcagttattgtttcgtcaatcattatcttccgtacacctgtccgccctgtaaatgcactaggagctgccattgccatctttggcacattcctgtactctcaggcaaagcagtgaggtttaaactattgttgaaggtcaggttcatggacgaagaatgtctgcagaaatagtaccaagcactggggcaaattttgcttgtgcaagtgtcttgtagatacaggtttaggttttcatgcgagaggcgataataataatggaccatgttgctgtttccttgttatttgttaaatcacaaactgaactccagtggccatgaactgtcgttgtatcctgaaataagaactgcatggaaattcgtctgacagttccgttgctggaaagtaacgatagccctatgcttaacggttaattattgatatttaagaactttgtgtattttgaaaggca

SEQ ID NO: 17588 - DNA, 1312 bp, Triticum aestivum
  Clone ID: PAT_TA_17588
cggacgcgtgggcggacgcgtgggcggacgcgtgggcggacgcgtgggcgcagacgcagcagcaaccgcacctaatccagagccagctagaacccgccgccatgggcgcgccgctcttcggcgccgtcctcctctgcctggtactcgccgcggcagcggtgccggagcagcagcccacattgccctcctcttcagcggcgaacagctccacgggggtgaactccaactcggtgctggtggcgcttctggactcgcactacacggagctggcggagctggtggagaaggcgctgctgctgcagtccctggaggacgccgtggggcggggcaacgtcaccatcttcgcgccccggaacgaggccctcgagcgggacctcgacccggagttccgcgccttcctccttgagccccgcaacctgcgctccctccagcgcctgctcctcttccacgtcctcccctcccgcctgcactcgcactccgcctggcccgcctccaccgcgcggatgacgctctccggcgagcacctccagctgtcagccgacggccagaagatgctagtcggcaccgcggaggtcacgcggccggacgcggtggtgaggcccgacggggtcatccacggtatcgagcggctgctggtgccgcgctcagttcaggaggatttcaaccgccgccgcagcctggctgccatctcggccgtgctccccacgggcgcccccgaggtggaccccaggacgcacaggctgaagaagcccgcgccgcccgtgcccctcggcgcgccgcccgtgctgccggtctgggacgccatggcccccggcccttccattgctccggcgccggcccccggccccggatccgggaagcaccacttcgacgggcacagccaggtcaaggacttcatccagacgctggtcctgtacggcgggtacaacgagctcgcggatatcctggtgaacctgacgtcgctggcgacggagatggggcggctggtctcggaggggtatgtgctcacagtgctggcccccaatgacgaggccatggcacggctgaccacggaccagctgagcgagcccgggtcgccggagaacatcctctactaccacatggtccccgagtaccagacggaggagagcatgtacaacgccgtgcggaggttcgggacggtgaggtacgacacgctgcggctgccgcagaaggtgacggcgagggaggcggacgggtcggttaagttcgggcacggcgaggggtccgcctacctcttcgatccggatatctacaccgacgggaggatctctgtgcagggcatcgacgcggt

SEQ ID NO: 17589 - DNA, 2180 bp, Triticum aestivum
  unsure (1)..(2180): unsure at all n locations
  Clone ID: PAT_TA_17589
ccgcaacgaggcgctggagcgggacctcgacccggagttcaagcgcttcctgctcgagccccgcaacctcaagtcgctccagacgctgctcctcttccacgtcctcccggcgcgccacccggcgggctcctggcccgcggcctcccaccccacgctctccggcgaggacgtcgagctcgccgccggcgccaacggatccatgcgcgtcgcccacgccgccgcacccgcacctcacccagagccagctacaacccgccgccgtgcgcgggccgctcttcggcggcgtcctccacggcctcgtaccccccccggcagcggtgcgccagcccacattgccctcctcgtcagcggccaaccgctccatgcgggagaactccaactcgggggccggtggcgacgccggccgccggttcggcaaggtgcggtacgacacgctgcggctgcgccgcagcggcgttccccggaaggcggccgtgtcccgcagcttcgggcagggcgagggccccggctacctctccgaccggcacaactacgcgcccggcaggatcgccgtccacggcgtcccccccgtgctgctccccctggagcgccagcagccggccccgccggtgcccgcccccccggacaggaaggcgccccccggtcaccggctccaggaagagcaagctccggcgaggcaagttgttggaggcaacgtgcagaatggctggcgtcttcggtcagcgatcgcgattagcgagctgccagtagaaggatggaggaaggattcggaagaagattgatctcatgattggttgacaccgaaacacggcccgaaacgaggtgacggcggggagctgggctgggctttgcttgcttgcttggagcctgccagccgtccacgatattgtttgctgttcttttttttgtttattactattatactactatggaataattggtggggaatgtaaaaccggtggttgttggtgtgtccggtccaaggaagaagaagaaaaaagaattgtttaaagcacaacttcgacggacacagccaggtcaaggacttcatccagacgctggtcctctacggcgggtacaacgagctggccgacatcctcgtcaacctcacctcgctggccaccgagatgggccggctggtgtcggaggggtacgtgctcaccgtgctggcccccaacgacgaggccatggcgcggctgaccacggaccagctgagcgagcccgggtcgccggagaacatcctctactaccacatgatccccgagtaccagacggaggagagcatgtacaacgccgtgcgcaggttcgggacggtgaggtacgacacgctgcggctgccgcagaaggtgacggcgagggaggcggacgggtcggtcaagttcgggcacggcgagggctccgcctacctcttcgatccggatatctacaccgacgggaggatctctgtgcagggcatcgacgcagtgctcttcccgccggtggaggacacggccaagagcgccggcgcctcgcccgtgaggaaggcccccgccgtcaccggcacggccaagcccaagctccgacgagggaagttgttggaaggggcgtgccatgtcgcggctgtcttcggtgggcgatcacacttcacgagctgccagtagatcatggccgatgatggcgaccacggatgtctccctagctgctttgcttgcctcctgaggctcaaagatgaacatgaacccaagtactagtatcatgctgagttttggttaataaaggctagcgaggaagggagacctggtggttttgcttgttgggccgtcaggaaattaggagaaaaaaaggtggatggaaatttgtttatacgggagatcagatcgacatcagtgtatagcaatttttttcttcttctttatttgtttgatttgtggtttaagatgctacatactttttggcgaaacaaagggaattcccaaaacatgggtatgttcgtgaccaaaaaaagttcncgcatttgatctccngcctcacacgtcaatcagcactattttaaggcgaacatatatacaaatgattatttttgatgaagattcccctggttatcttcatganaaggttcaccttcatcggaagagaattgatctcatgattggttgacaccgaaacacggcccgaaacgaggtgacggcggngagctgggc

SEQ ID NO: 17590 - DNA, 813 bp, Triticum aestivum
  Clone ID: PAT_TA_17590
cctcgctgcaccgccgccgccgctgcgatgtccgccgccgccgccgccggcgaggtctcaaatccgtctcccgcgccgccttctcctggaagccgacgggccgggcgcagcagacgctcgcggcggcggtgagcaggtcgggcgtgggactccactcgggcgcgcgcgccaccgccaggttgctccctgcgcgcgccggcgaggggaggtacttcgtcgtggaggaggcgagggtggcggcggaggcggggaatgccgagccacagtctccgctctgcaccacgctgcggagcgggagcggcggcgcgcgggtgcgcacggtggagcacctgctctcggccatggaggcgttcggtgtcgacaactgccgcgtcgaggtcagcggcggcgatgagatccctttgcttgatggatcagcgcaagagtgggtggaggccattcggggtgcaggtctgtgtgcggccgaggatatcggtggacagaagttggagaaactggcacccaagatcgacgagcctgtttacctgtgtaaggacgattgctttgtagctgcattcccttcctcgcaaatccacatcacctatggaattgattttccaaaggcgccagcgattggttgtcaatggttcaatactttcctggatgctgatatatactcaagcaagatagctcctgcaagaactttctgtatttttgaagaggttgaaaaaatgcgtgatgcccggctataaaaggaggatcactggaaaatgctatggtttgcagtatgtctggtggttggcttaacccaccacttcgttttgatgatgaacc

SEQ ID NO: 17591 - DNA, 621 bp, Triticum aestivum
  unsure (1)..(621): unsure at all n locations
  Clone ID: PAT_TA_17591
ctgcaggnaattcggcacgaggggaagaggagggggtcgtggaggcgccagcgccgccacaggccgcagctggggtctgcgcggtgtgcttcaggccgaccacgtttaggtgcaaacagtgcaaggctgtgaagtactgctcattcaaatgccagatatcccactggagaaaagtcacaaagatgaatgccatccaccaggtgctaatgctaagccagatgatggagctgcaatttctgttgcaaaggaaggaaatgttgaacaccgaagagcttctgaagagaatgtagtggctggggtacaaccagtggctgaaattagtgtaccggttgcgtctgagtctgaaacttctggcacaaaccatgttgtgaagagctcaaatgataaaaggaaagatacgcctttcgaaggggtatctgctaccacagagatccctgaaaagggcaattctgacaatgtggtcaaacttggtcaaattacccctcaagtagcatcctttgacagtaaaagggcagaatcaaataccaaatctaccaattttgttggaaatagttacgtgaaggacttagatgatatattggttcataaatctcaagtttctgcaccaaagatgagtggcct

SEQ ID NO: 17592 - DNA, 606 bp, Triticum aestivum
  unsure (1)..(606): unsure at all n locations
  Clone ID: PAT_TA_17592
ntccngtgtcatactttaatagtgaatgtatagcgcctnatcanttacgaaatagcactcgcaccttggccccccaacctggggttgccttgagccccatcctgcttgggcttccccgtttcgccggcgagctatccttacaggcggcaggggacgctttgccgcgttccaatggtgccagctcccctcccggccttggtccgttcatgccaccagcggtgcatccgttgccgaactttcaccgggtgcgcgattccccaaggtgaagtttgttagagttgtgtcgaatattgtgtacaaagtaggttacagttggatttgtagttgtattgtgtttacataagatgtggagtcgtgtcctagtaggacacttgtatcctaggcctctcatatatagcgggggtagacacacgatgtaacctatgccaacataatagcacaggaacgcaggggaagccggcggcatgtgccggcgtccagagcgacctggtgcggtattgtgacggtgtcatggggaggagcgcccgtagtcaggccccggagatgtagccatatcgatgaacctcgttaacaaaaaaaaaaaaaaaaaaaaaaaaaactcgagac

SEQ ID NO: 17593 - DNA, 458 bp, Triticum aestivum
  Clone ID: PAT_TA_17593
cggccgctcgagaacaggaacgacacacgaatcacctgcttttccaggcagctatgggattctgcagtggccgttcagatgtccaggtgctcccaaagaacacctcctccgcatcgtcgccgtcttcctcgtcggctgctaaagattccggccacagtgagaagaacaagaagcagcagggtgtaaagaatgaggagaggaaggagaagaaaaggagcaaccttgaccgggctgcgctcacgacgccccacttcccctttcattctcgccccggtcttctgtaatagattaactgagaaaatgctgcacacatgggatcctgtagattttcctattagcctatgatttattcattgattggttggttgtatttgatgatctgaattacaattgtttctttttaacatacaaagagattatgttcattgttattgggataattattaatttttaacttc

SEQ ID NO: 17594 - DNA, 571 bp, Triticum aestivum
  Clone ID: PAT_TA_17594
ccgcccggccggcgcgccggaagaaaccacacacgaatcactagcagagaagagcagaggaaagaaaggaataagcgaagagaatatcaaaaggtagtgcggtagtagctaggtagcagcgcagccatgggattctgcagtggctcttcagatgtacaggtgctcccaaacaacacatcatcgtcgtcgccgtcttcttggtcagcggctgctaaagattccggccacagtggcaagaacaagaagcagcacgttgtaaagaaggaggagaggaaggagaagaaaaggagcaaccttgaccgggctgcgctcacgacgccccacttcccctttcattctcgccccggtcttctgtaatagatcaacggagaacaatagtgcacacgtacgatcctgtaggttttcctattagcctatgatttattcattgatggttggttgtatttgattattatcggaattacaattgtttctttttaacatacagagagattatgttcattgttattgggataattaatttttgttgttggattcttatgaaaaaaaaaaaaaaaaaaggtccctagga

SEQ ID NO: 17595 - DNA, 582 bp, Triticum aestivum
  unsure (1)..(582): unsure at all n locations
  Clone ID: PAT_TA_17595
tgttgttcgctactgactcttgcaaacttgtgcacatacagcttcgaaggagaagagggaccgaagtgagcagctgctgccgaactacccttgaaactcggaaccgagcttgcagacaatgtgcatctgtttccctttgccatttttggcgcagggtccggctcgtcaaagttgggatgaagcatagcaaggttttagatagatcaagggggaaaattttccggtccggtcgtgttatttcttggatagcgtttgttcattctgggtcgactctgttttttccgtcgtcgcaattttcctggacagagcagagtgtgcaactgtaagaaaatgatgatgtcgtcactgctgtgaaagaaattccgttggttggtaataaaaaaaaaaaaaaaaaaaaaaaaaaaaaaaaaaaaaaaaaaaaaaaaaaaaaaaanngggctggacgatcaaaaggaaccaagattacatccgggcttcctgcagacgtaaaatctctttaatagagccaaataaaatgaaactactggccgttgttcaacaactgtgatgacaaaaaaaaccctggaaactacccaacttaaa

SEQ ID NO: 17596 - DNA, 448 bp, Triticum aestivum
  Clone ID: PAT_TA_17596
gtcgtggtgttcgccgacgagaacggcatcctccggacggagctgttcgacctcgactacgagtacgacgcgccgcgctggttcgacctcgcgcaggacgaggcgcccgccgaggccgccgccgccgagctctggttcgccaccgcccccagctacccgccctcccgactgtgtatcctcggacaactcaagcccctcgtctcctgtacatgaatgtgagatgctgcgcatgcaagatctgagccaaatggcataatgtaatctttttattgctggtttttatgtatgatgtcatgaagatgtacgtttgaaatgttgctttgatagcaaaattgtatttttgtgtacatgctgctttgacagcaaaattatgaaaatttatgggcaaaaatgtattcctgtgtactgcacttgaaaaggctacagccaactgatgatgttgctgtgg

SEQ ID NO: 17597 - DNA, 1303 bp, Triticum aestivum
  Clone ID: PAT_TA_17597
atccgctgacttgtactactcctgatatccagccgtcacctgtctccatcgaacaaaccaagatcccagaagcatcccacacaagccaagccaagacgacggctcccagcagcaggcagcagctgatggagatcgccagggtcgacctccgcgggctggagcccggcgggccgggctgggcggaagcccgggacgcggtgacggcgtccgtcgtggcgcacggcttcgtcgtcgtggcgcacgacgcgctcggcctggagctccggcaggcgctgttcggccgcgtcatgccggagatcttcgcgctcccgccggaggccaagcagcggaacgtctccgaggtgggccccttccgcggctacatctccaacgtccccggcaccaactgggagagcgtgcgcctctccgagcccaccgacgccggccgcgtccgcgacttcgccgacctcctctggccgcaggggaaccccgccttctgcgacacgatcgcgtccgcggtcaagaacgtgtgggagctacagcgcacggtggagacgatgatcctggagggcctcggcgtcggggaggagcacatcggcgcgcatctggacacgctcgcccacagcgtccggctgtcgcgctacgggcccccgccggacgcggagacgaacatgtccctgcaggcgcaccgcgacgacagcatcatgacggcgatcgtgcagcacggcgtggagggcctcgaggtgcaggttcaggacgggatctggctcgcggtgccgcctgagccggacttgttcaccttcgtcgccggcgagctgttcacggtcgtgactaacgggagggtgccgggttgcttccaccgcgtgaggacgccgagcaaccgcgagcgcctgtcggcgctgttcggctgcccggggaaggacggcgtcctactgagcgccatggacgagctcgtcgacgatgagcaccctctgctgtaccgtccctgcaccaacgacggctacacgacgttccggcactcagatgaagggcgcaaggccggtgatccattgaaggccttctgtggggtggagaaggacgatcaccgttcgtaagtcaagctcacttcacctcaccattctgaagtcgtcaagctctgttatccacaccattctgaagccgcaaatgctagattacccatgtaataatcgcgacaccattctgaagtcctactgctactgaactttactcaaatcgctgtcagttatctcttcgattaagcactttgtggatgataattactagtacgacattaccggctgatcttaaaaagtttactgttgtg

SEQ ID NO: 17598 - DNA, 832 bp, Triticum aestivum
  Clone ID: PAT_TA_17598
ctctcggacagaagaacctacacaggaggctaaaatgatgcaggaagataacacccactgtgagaataagttgatcgagcttgagagtatcagtgaagataacaacatcattcctgagagaaccagtatctcggaaggcagagaagagctgctggactgtatctccagcatgtcgaaaagtgccgaggggcttcggctcgggttggattcgttgtcgaaacgagtcggggacttcttccagatcgtgcttacaggacgtgatgcgttgctctgcaatctagaggatgtcagatgcagcaagcaagggtcaccgaggttaggtcttggatgctttacgtttctggcctgtgtatgttctctgttggtgtaacattgccctgcagtcggcgcagctccgccgccgcgtgcaccgcccctctgtcaggtcccccctccccaccctccccgggtctatgctcgcgctccgcgtcgcggcgccggtgtatagacggctgggcagcgcattcttgtacaccgctcttctgacatgtggcccctgctcagcctcagcggaactaagttagggcaccatatttcagcggcgatgtgcataatcttgggctgccaggttgtgttgtgtggggtcgtaggtttaggacagcttgtgttcttcgttttttgacgagtagaagtaatgtagacaaatacatattagcgtgcagtatcagtggaatgtacaatgccgagaggacagtaactgtttcatatgtatgccgaagtgtgttgccagcaatgttagatatgaaaggtgcatcgtgaagggcaaagcaaaatctttgaggtaaaaaaaaaa

SEQ ID NO: 17599 - DNA, 494 bp, Triticum aestivum
  Clone ID: PAT_TA_17599
gggtcgacccagcgtttcaataaggtgcagcgcctcatagtgtacccccaccaccaccaacgctacactcacaagctaacctcaccatttcaggaagcatatgagcagcgaaagcttgggcaagaactccaagatcatgggtggccgtgaaagaaaagaagcagaggaagatcttgttttcagaatgcacaggcttgtcgggaacaggtgggaacttatagctggaagaatccccggaagaacagcagaagaagtagagatgttctgggcaaaaaggcaccaggaccaatgaaaatgaaaacaggatgcatgcagtaaaactagattgacatataggatgcacatgtccatcaaaaacctgtgttgatcttactcgtcctatcttctcagccatgctaaaagcaacttgttctgtaccaagcatggatgtacataagaaaacctcaagaaaaaggaggaacatgtgctaaataaacaaaaatatgaattcgctt

SEQ ID NO: 17600 - DNA, 1222 bp, Triticum aestivum
  unsure (1)..(1222): unsure at all n locations
  Clone ID: PAT_TA_17600
gtgccgccccgcgccggatgggcccggtgcgacgtcggctcgagtaacaaaccaggtgcagcgcctcatactgtactcccaccaccaccaacgctacactcagaacctggcagcaataaggtgcagcgcctcatagtgtacccccaccaccaccaacgaccgccgcctacactcacaagctaacctcaccatttcaggaagcatatgagcagcgaaagcttgggcaagaactccaagatcatgggtggccgtgaaagaaaagaagttaatagcaccgcaaagcattttgttgatttcacagaagcagaggaagatcttgttttcagaatgcacaggcttgtcgggaacaggtgggaacttatagctggaagaatccccggaagaacagcagaagaagtagagatgttctgggcaaaaaggcaccaggaccaatgaaaatgaaaacaggatgcatgcagtaaaatagattgacatataggatcacatgtccatcaaaaacctgtgttgatcttactcgtcctatcttctcagccatgctaaaagcaacttgttctgtaccaagcatggatgtacataagaaaacctcaagaaaaaggaggaacatgtgctaaataaacaaaaatatgaattcgctttgttccaaaaaaaaaaaaaaaacctacctctgtgactcacccaacgcgctccctgcatccttgacacaatcccagtgcaacccacgcggaacgcctcccccgagaagccccttccgccgggtaaacaatgccgtcgctgcctccanaccgctnnagganngctttaaanttcnggaaagttcgttnnnaaatnangtaaaanctccggtccgccaccatcctgtttcgcttcgcttgcttgttcctttcgatctttcttcactctctcttctccaaaatatactctccctctgtttcactagatcagtacacataggaggcacaaaatcaaagttctctttgatggagttggaccatcttagccactgttagatagacacactactgctctatctaatgtgagcaagttagcctgattccatcgaacattactgaactttcgtgcctcaccagatggatataggaacaggaggcagtaccttttaattactgtcattttgataaaaaagaggagaactaacaaaggatgaagaaacagtctatgttttcttaatatgatttttagtgaactttaacatacatattcg

SEQ ID NO: 17601 - DNA, 844 bp, Triticum aestivum
  Clone ID: PAT_TA_17601
gtccggcccgagggccccccgaaccgacatcccttctccggtgccacggggccccccgagctgacaccccgtgcctcttgctgccgccctcctcgaggtttccacggggacctgcgtggtggcccctgcggcaaggtgtcctcgcctgctcctggtgatggcaggcggcccatatggggtcgccgggaccggggagtcgcccgcgtcccagagggtcgggcggtcccccgggagccgccgggggacgggcggatcgaccctgctcacccggccggcgggccacaacaccggccgccaccggtgggtgcgactgcggaaggcaaggcccgcgagcctggtggacatgcccgcagacgagatggccagcgacgctcggaagctggagaaccggcagatcaaggagaaggccctgtttgactgcgagcgcgcgtcggcgcccaaggcgtcgacggaccagttcaagtgcgggcgttgcgggcagcgcaagacgacctactaccagctgcagacccggagtgcggacgagccgatgacgacgttcgtgacgtgcgtcaactgcaacaaccactggaagttctgctgagcgccggcgactctgctgcaactgctagcgtgtttttcctgttagcgatgccgtttcagtcttgacaggtaggctggtccgttttttcatatgcttaggaggagactgttttcttgtgttgtttttaatgtggttattaagaaccctgatttattcagattgtgtactagttgaccgcataaatgttgttcgctggatgaactgatgttgcctgatgtaagttttatgaaagagattgttctgtgttagttatgtaaaaaa

SEQ ID NO: 17602 - DNA, 858 bp, Triticum aestivum
  unsure (1)..(858): unsure at all n locations
  Clone ID: PAT_TA_17602
gccggccggccggtggaaaatagtatcttagcttcaccgtccttctttgtgatacccaattgaaaatggaaactccttttaccgtcaaggctcagccgggaactgatgtctggaagcagcctccttctacagacgtcttcacagcccccttccgtcctcactctatcgctcccctgaagcactttatctcagcaacaatcactttccgcacaacctacgtccaccagtacgatcaagcctgtcttctcctcaccttcaccaagccaggcgccccccgaaagtggatcaagacgggcattgagctgtacaatgagcacccgcgctactcaactgtaacatgcgactcttgggccgattggagcgttgaggcggtaggacccaacgatgaagctggtgtcatgagtggtgagaagagcgtcactatcaaggcgatgaaggtcgaggatgccctgggtgtttgtctctgggtctacagggtcgatgagaacggcgaaaagacgccgttgagacagactaactgggtgtacggcgacgaaggtggtgagggctgggagctcgaggtctcagctgctgtcgccaggccagatcctcataagaacatcaaggatgatcttgaggctacgtttgacaagttggacgtcgaatgggagaagcctacagcttaaacaaattcacaagttaagcaagtattgacaatatacacaaagacatcacatgcaaggatcataaaggcacctggccgaatttctcattacctcgaccctgacggtgcaagcgccaggggagaccgttcaacgatccccagttggtaataatcatncagatcgtaacttcaaaaaaaaaaaaaaaaaggcccct

SEQ ID NO: 17603 - DNA, 566 bp, Triticum aestivum
  Clone ID: PAT_TA_17603
agtacggggcgaaccggcagatccgactgggcaacgccaaggacacgcgggggacggcgtacgtggtgtacgaggacatctacgacgccaagaacgccgtcgaccacctctcgggcttcaacgtcgccaaccgctacctcatcgtgctctactcgcagctcaacaggatgtccaagaagacggacatcaagaagaaggaggacgagatcaccaggctccaggagaagtacggcgtcggatccaagaccccctccgccaacgacgcctgatccttggtgccccgtgttttttttttagttagaaatcgtcgagagaaactgttgaatcggagatcggtcctgtaatctgtgcttgccgcggtatgtttgtgtttgcggtggttccatattgatgatgaacatagctcggatggaacttgaatttgatactttaattagtaggtatatctgtgctgtgggtgtcaatggtctgataaacaggggcgttcgcttgagatttttgatatgtgcatgattgttcagatacattaagcagctggaatatattgagaggattcgtgctgcttg

SEQ ID NO: 17604 - DNA, 982 bp, Triticum aestivum
  unsure (1)..(982): unsure at all n locations
  Clone ID: PAT_TA_17604
gccggccgggcgaggagcaaccacccaaatcgatttggtccagacaccaccgagcccccaaccccagaccgaaaccaaaccctaggcggcggcggcggaggcggaggagatggcggcggcgagcctgaggaaggggaacgcgaggctgccgccggaggtgaacagggcgctgttcgtgcggaacctgccgttcaacatctcgagcgaggagatgtacgacatcttcggcaagtacggggcgatccggcagatccggctgggcaacgccaaggacacgcgggggacggcgtacgtggtgtacgaggacatctacgacgccaagaacgccgtcgaccacctctcgggcttcaacgtcgccaaccgctacctcatcgtgctctactcgcagctcaacaggatgtccaagaagacggacatcaagaagaaggaggacgagatcaccaggctccaggagaagtacggcgtcggatccaagaccccctccgccaacgacgcctgatcctgcgcgtgtttgtttatttagttagaaatcgtcgagggaaactgttgagtcggatatcggtcctgtaatctgtgcttgccgcggtatgtttgtgtttgcggtggttccatatcgatatgatgaacatgactcgttgattcatagcatctgcttgggttgtcctgtgctttgatgtaacttgaatttgatactttgattagtaggtatatttatgctgtggatgtcaatgatctgttaaacggggttgttcgcttgaaatttgtgatatgtgcattattgttcagatgcatggagcggccgcttgtgtaacttcaacaagagacgttcgttgctgggtgttgctgtgtgctgattagataatgctgntggcctaaaaaaaaaaaaaaaggcccctttgaaagtataacagtncaatttgttaaaggggccgnacaattcccaaatggtctttacncccangctctttnaanccganggaaa

SEQ ID NO: 17605 - DNA, 491 bp, Triticum aestivum
  Clone ID: PAT_TA_17605
gccggccgggctcccgatcaagcacacgacagcttaagtttctaagccttccagtgccggaacagagcagcatataagaatggcatccctgaaggccgtgaagccaaccggacttgacgggaaggccaaggagcctaccaaggttagtgccaccaagggacctgcaaagctcagtgccacggcgaccaagccagcagccgccaagggtggcatcaagaaggctgagtcaaagccacgggagcctaagaagaggcaggtgaagagcaccaagccagcagcagcaaaaaactgacaacggcagcaggagaaatggagcttgcgtagctatctccatggtgctatgacttatatatgaatcccacctttcccttcctctgtctcccatgatgtcgatcacgcctagacagggtgtactcacaatccatgtgagaatattacaaataagacgtgtagttctgccatgctaaaaaaaaaaaaaaaaaaggccccta

SEQ ID NO: 17606 - DNA, 1718 bp, Triticum aestivum
  Clone ID: PAT_TA_17606
cggttaccggcaccggctcggcctacagttctaagccttccagcgcaggatccgaggaccgcataggatcggaacccatcaagatcgtaaaaacagcagcactgaaggccgaggacgccaacccggacaaggagagcaggccaagggggctaccaaggttagtgcccccggaggcgcaccccgaagctgactgccatgggcgaccaaagcccagcagccgacccaaaggggacgggcatcaagaaggcggagtcaaagccacgggaagcccaagcaagaggcaggtgaagagctgcaaagccagaagcagcaaaaaactggacaacggcatgcagaagaaataggagcttgcatgccaccttcattctgctacgaattatatatgcatcccgcctctcccttcgtctgcctaccaggatgtcgatcatagctcgactggcgccgacactatgtgtgcaatccatgggaacaaatagttacataataaagacgtagtaattctgccaacaacaacaaataatttaaaaaaacataataattcatggggagagattctaatgccgcgctcgaggcccaggggatgaacatgatgagcggcatgccatcctacgccaacgaccaccaccatcagaggaaggaaggcatcaaccaccagcagcaagaacatgggaaccccatggccctcctttctgcagcacataagtactcgcactagtgccgccatgcacgctagcctggactattctgccttgggagctcgtgacaagattcgcctggtcggccgacctctgcagccggccggcccgctgaccttggggtggctgccgcatctgggccctcccggcggctgctacgcggccgtggagccgtcgtccgggcccccgtccccgtgaccccccgtccggccggacagcggcacactgctgcttctccccccgcccgcctgggcaagaggcagcagcagtgtgcaccgccggcggcgactgatcgtaagaagcgaacatccgaggaaaggcgggaaagcactgtcaagaagtccaagcaggaggcatccacagcatcacctcctaagcaaccagttcctgccgggtccctgggggcgcaggccgcagcacggccgcctgccgtctcgccctttgggaagacagacacagcatcggtgctgtttgaaacgatcaagtatatcaagtttctgcacgagcaagtacagctgctgagcgagccgtacacgaacgcgagcaggagcaagggtaactgcaacaaccttcttccatggggagatcgtgcggaggcgagcaagggggagggggagcatgacctgagggagagagggctttgcttggtccctgtctcgtggacccccgaggtgtaccgggacggcaacgccatggactactggacgccggcgtacaggggctgcctctaccggtgatggagcctgcgctagctgcaaaagccgtgcctgcccgatcgacggagatttgatcgttccaaattatgtaggatgtgctactacgccggctgatgatcggtctgctttgtggtgcctgtattgcctaggttataattcgttcgctttgcgcttctaattatgtttgttgatctgtaacgagtaacaaccgctctcttacagacatggtatgagttgctcacatttgtagctactaatacagtaatgttgcgcatgatataaaattatcagtagatatttctcaaaa

SEQ ID NO: 17607 - DNA, 785 bp, Triticum aestivum
  Clone ID: PAT_TA_17607
cacgctgcccgctcccggcaacctaccacagcacacaacacagcacagcacagcacagtgcctgagaagagcagcgctcgcaccgacacagcatgccgctctagctagcttacagcagtctgggcgtacccccaccgtacccgcgcaaagagaatggcgactgtggtggcggccgttgaggccggggtggtggcggtggcgagcgggcggagcagcaagctggtccggggcctgtactggcgcctgcgcgcggggatccggcggctgcagtcggagcggcgcaggtggcgcggcggcggcggcaggcgggagcgcttcaacttccactacgacgcgctcagctacgccctcaacttcgacgacggccgccgcgccgccgacctcgtcctagcctgaagcagatgccgcgctcgctaggtgctcgattgtgttgtgggccttgaggctgggctgcgtatggaagctggtggcttttaggggtcggggttcttctgtctgtgtgcttctttaattagtgctttagttagtttaggagctgcaatgtttcggggtgaaccggaagagcaatctctctagtctacgagctctgcgctacgctctgttgcgactgaacgccatgatttgcaggggtgagattctttcttcgcattcggtgattgctcatctgcagcggaattcgaatggcatgaaaagtacgcgcaactttgtatgtaggtgtcactagatagttgaaggctcctcctgattaatgacatgagctcatggagcagttatgttggcgtgct

SEQ ID NO: 17608 - DNA, 872 bp, Triticum aestivum
  Clone ID: PAT_TA_17608
cccacgcgtccgctctctcttgcgctcctactactctctgctgttcttcaggtgtgcaagaaagatatacgcacgtgagctctgattggcatggccgtggaggcggttcttgaagcggcggcgatggtaccgtcgccgccgagcaaggagatggaggcgtctagcagtaccagcgaggaggcgtcggcgttgctggggcaggcggaggggtggtcgaagcggaagcgctcgaggcggccgcgcgcgctcgcccccagcgaggaggagtacctcgcgctctgcctcctcatgctggcgcacggccaccgcgacagcgcccctgccgccgcgtcggagcagcagcacgggtgctccgtctgcggcaaggtgttcgcgtcctaccaggcgctcggcggccacaaggccagccaccggaagcctaccgcggcgccggctggcgcagaggacctgaaaccgcaggcggcggtggcggcggcggcagcttcctcgtcggggtccggcgaggccgcggtcggcgctggaggcggcaagctgcacgagtgcaacgtgtgccggaagacgttcccgactgggcaggcgctgggcggccacaaaaggtgccactacgacggcaccatcggcagcgccgccgcggggcccgcgcacaagctggctgccaaggcgaccgcggcaagcgcgacggcggcgagccggggcttcgacctgaacctgccagcgctgccggacatccccggagcggtgcgcggtcacggaaaatggggaggaggttctcagccccgtttccttgaagaagccgaggctcatgctgacggcgtaaatccacagttacctgctgcatatacttggtcaaagtttagggtagaatctgctga

SEQ ID NO: 17609 - DNA, 711 bp, Triticum aestivum
  Clone ID: PAT_TA_17609
atctcaatctcgaccacccaatcatcagtctagctagggtttttgctctaaaccaagaccctctctcagctctcgcgtccgctcgaccagcgcggatggggaaggacgggaaggggaagggcaagcaggcggccggctcatccgacgacgccggaggcgccaagggaggcaagggcaaggggaagggcggcaagggaggcgacgacctcggcacctgcaccttcgtcaaagctaggcacgtgttgtgcgagaagcaggggaagatcaatgaggcgtacaagaagctgcaggaaggctggttggacaacggggacaaggtccctcctgctgagtttgccaaggtagcccaagaattctctgaatgcccgtcaggaaagaaaggtggggatcttggatggttcccacgtggtaaaatggctggtcctttccaggaggttgcgtttaacacacctgtgggagctactagtgcaccattcaagtctacgcatgggtaccacttcatcctctgtgaaggcaggaagaactgatatgaaagtatgcttcaggtttggaatgcaagcatcttgtgataatatgggatgcaaatgccccccatgtcttgtctattgactgaataagcgttgtgcctggacatgtgtactcaagctactattatactgtcccaaaccagagtgtcttggaaattgtgcttgctacaagtaacccggtatg

SEQ ID NO: 17610 - DNA, 943 bp, Triticum aestivum
  unsure (1)..(943): unsure at all n locations
  Clone ID: PAT_TA_17610
cctcggctggctgggctgtgaatctcgaccactcaacagtctagctagctagggtttttgcccctaaaccaagaccccctctctcagctctcgcgcccgctcgaccagcgcggatggggaaggacgggaaggggaaggaggccaaggggaagggcaagcaggcggccggctcctccgacgacgccggaggcgccaagggaggcaagggcaagggcaagggcggcaagggaggcgacgacctcggcacctgcaccttcgtcaaagctaggcacgtgttgtgcgagaagcaggggaagatcaatgaggcgtacaagaagctgcaggaaggctggttggacaacggggacaaggtccctcctgctgagtttgccaaggtagcccaagaattctctgaatgcccatcaggaaagaaaggtggggatcttggatggttcccgcgtggcaaaatggctggtcctttccaggaggttgcgtttaacacacctgtgggagctactagtgcaccattcaagtctacgcacgggtaccacttcatcctctgtgaaggcaggaagaactgatatgaaagtatgcttcaggtttggaatgcaagcaccttgtgataatatgggatgcaaatgccccccatgtcttgtctgttgactcaataagcgttgtgcctggacatgtgtactcaagctactattatgctgtcccaaaccagagtgactcggaaattgtgcttgctacaagtaacctgatatgatatacagtatgtgtttgagataagctgagatttagcttgtgtccctcctttttacggtaaagaaaagagaaaangatgcttccttttggggtgggcaccattcaancgggagctcacccctatttacattgtngatgggccctttncctttgtgggaggnaagggatactttataaacgagctcattctgaaaaaaaa

SEQ ID NO: 17611 - DNA, 896 bp, Triticum aestivum
  Clone ID: PAT_TA_17611
ttggccaaccctactgtggcagcttacactggcctccatcaaaatgggaagaccagagctggcccgtagggccattgcagtggccgaggagaagctctcagctgacaagtggccagaatactatgacacccggtctggaagattcattgggaagcagtcacggtcatatcagacatggactattgctggttttctgacctccaagatgttgctggaaaatccagagctagcttctatcctgacctgtgatgaggaccttgagctccttgaaggctgtgcttgctgcctctcgaagaggagtagatgctcacgacgtgcggccaaatcagatatcactgggtaaaacagcagaaacccgtctactcttgctactccgcacacaagtatacgatcgactgagaattaactgaagtggatacactctagccatacaaatcagatatcattgggtaaaacagcagaaaccgttcttctcttgctactccgcacacaagtatacgatcgactgagaattaattgaagtggatacactctagccatgtacattataggtttacgttagatatccatccattcattcattccctcaatgtgcgctcattcttttttgccgagccgccattgatgggaactgcccttggtgataccagtggtctagaagagcatcgccattttatgttggagctctcatgtacacacaaaagagtaatttattcttgtatctgttacctgcctctcctgacttgggagtgatgccaagtcctcacgagtatatctctatcagcattttgagctgtgtgttgcattatttgcaaaactgagactctgtaccatgttcttgtcatgaataatgatacgttttcctttggaaaaaaaaaaaaaaaaaaaaaaaaaaa

SEQ ID NO: 17612 - DNA, 532 bp, Triticum aestivum
  Clone ID: PAT_TA_17612
aggtgtccttcaaggtgatcctcacctccgaccccaagctccccttcaaagtgttcagcgtgccggaggcggcgcccttcaccgcggtgctcaagttcgccgccgaggagttcaaggtcccgccccagaccagcgccatcatcaccaacgatggagtcgccatcaacccacagcaaagtgcaggcaacgtgttcttgaagcatggctctgagctgcgcctcatcccccgcgacagagttggagcgccggtggcgtctttctagtcattgttagagtcaacaatgaagaatcctatataacaggaataaaagcatgtccatgcttggttgtataatggatgtaacatggttgagtataatcctatgattgacaggatgaatatatagcttgccagacagtgccatgtgttgctgtctttgtttgcaggccctgatttcctggtaatgctcttaaaaaccagggagcgaaaaatatacctggcacaccagtgctggatatctcatttgtttccgaggaaaaaagacattgacct

SEQ ID NO: 17613 - DNA, 666 bp, Triticum aestivum
  Clone ID: PAT_TA_17613
accagcggcggcggcgtctcggctcgcaccccacagcacacccatggcggcggagggcggcggcggcggaggaggagggaaggtgtcgttcaaggtgatcctcacctccgaccccaagctccccttcaaagtgttcagcgtgccggaggcggcgcccttcaccgcggtgctcaagttcgccgccgaggagttcaaggtcccgccccagaccagcgccatcatcaccaacgatggagtaggcatcaacccacagcaaagtgcaggcaacgtgttcttgaagcatggctcggagctgcgactcatcccccgcgacagagttggagcgactgcggcgtctttctagtcagtcattgttagagccaacaatgaagaaacctatataacaggaataaaagcatgtccatgctcggttgtataatggatgtaacatggtcgagtataatttaccatcaacagccagccagccctatgattgacaggatgaatatagcttggcaggcagtgccatgtgttgctgtctttgtttgcagcccctgatttcctgctactgctcttgaaagccatggagcgtctgcttgcagtgttgactttttgagagaggaaaaaaaatacacctggcatacgtgctggacacctcattgtttctgaggaaaaaaaggcattgac

SEQ ID NO: 17614 - DNA, 629 bp, Triticum aestivum
  Clone ID: PAT_TA_17614
gccggccgcccacgcgcccgccaacgcgtcggccgaaccaaaatttctatcacgcgaccccggcaaggcgaaccaaggcggcggcggcggcggcggcacccatggcggcggagggcggcgggggcggcggaggagggaaggtgtccttcaaggtgatcctcacctccgaccccaagctccccttcaaagtgttcagcgtgccggaggcggcgcccttcaccgcggtgctcaagttcgccgccgaggagttcaaggtcccgccccagaccagcgccatcatcaccaacgatggagtcggcatcaacccacagcaaagtgcaggcaacgtgttcttgaagcatggctctgagctgcgcctcatcccccgcgacagagttggagcgccggtggcgtctttctagtcattgttagagtcaacaatgaagaatcctatataacaggaataaaagcatgtccatgcttggttgtataatggatgtaacatggttgagtataatcctatgattgacaggatgaatatatagcttgccagacaaaaaaaaaaaaaaaaagggccgcttggcgatctagaactcgtcgactagttctaaaaaacgagggagcgaaaaatatacctggcacaccagtgc

SEQ ID NO: 17615 - DNA, 771 bp, Triticum aestivum
  Clone ID: PAT_TA_17615
cttgtattatgatgcttgtatgacttattttatttttagagttgtgttgtaataaaaaaaaaaaaaaaaggaggcgcatcgctcggcggccgcccaaccaaaattctatcacgcgaccccggcaaggcgaaccaccaggcggcggcggcgtatcggcaacccacagcacacccatggcggcggcggagggcggcggcggcggaggcggggggaaggtgtcgttcaaggtgatcctcacctccgaccccaagctccccttcaaagtgttcagcgtgccggaggcggcgcccttcaccgcggtgctcaagttcgccgcagaggagttcaaggtcccgccccagaccagcgccatcatcaccaacgatggagtaggcatcaacccacagcaaagtgcaggcaacgtgttcttgaagcatggctcggagctgcgcctcattccccgcgacagagttggagcgacggtgccgtctttctagtcgtcattgttagagtcaacaatgaatgaaggaacctatataacaggaataaaggcatgtcgatgctcggttgtataatggatgtaactttgttgagagtaatttaccatcaacagccagccagccctatgattgacaggatgaatatagcttgccagacagtgccatgtgttgctgtctttgtttgaaaaaaaaaaaaaaaaagaaacgtgcaaaataagtgatggacgcctctgttgtgaccgaggaaaaaacacagccacaccaccgctttctagaaaattcctcaaaaaaa

SEQ ID NO: 17616 - DNA, 1866 bp, Triticum aestivum
  Clone ID: PAT_TA_17616
cggggcgccgacgacgatagctagctctcttttagcattctgccatggctcacgtacatgtagacgagatgctccacgaagcagcagcagccgctccacgatctctcttgattgcgactgcggtgctcttctcccttgtggttctgccgctcctactccgcattattgccaagcagggagcggcaagcgatgccaagctgctgagcctgctcccatctcccccgacgaggctccccatcatcgggcacctgcacctaatgggcgatcttccctacgtctccctcgctggcctggccgccaagtacggcccggaactcatgctggtacacctcggtgccgtgcccaccgccgtcgtgtcctcgccgcgcactgctgaggccgtcctgcgcacccacgaccacatcttcgcatcgcggccgcggtcgatggtcttcgacatcatcatgtacgggcagacggactcgtgcttctcgccctacggcgagcacttccggaaggccaggaagctcgtgacggtgcacatgctcaacgccaggaagatacggtcccagcgcccggcccgggaagaggaggtccggcaagtgattggaaagatcgccaaggccgcggccgcgcgcgaggccgtggacatgagcgagctcctgcactcgtacgtcaacgacctcgtttgccgtgctgtgtcgggcaagttctcccaggaggaggggcggaacaagctgttccgtgagctcaccgacatcaacgcggcgctcctgggagggttcaacatcctcgactacttcccgagcctggggaggttcgagttggtctgcaaggtggcgtgcgccaaggcccgacgggtgaggaagcggtgggacctgctcctcgacaagctaattgacgaccatgcagcaaggatggtaagccgtgagggtgaggcccagccggagcaagaagaagacaaagacttcatcgacgtatccctatctcttcagcaggagtatggtctcaccagggaccatatcaaggccatcttgatagacatgtttgaggccggcacggacacctcgtatatgacgctggagtttgccatggcggagctcatacggaagccacaccttatgaagaagctgcaggaagaggtaaggaggaatgtacccaacgggcaagagatggccgccgaagacgatctccccaacatgacctacctcaaggctgtcatcaaggagacactccggctgcatccgccggtacctctcatgattccacacttctccctagacgcctgcaccgttgatggctacacgatcccagcaaacactcgtgtcgttatcaacgcctgggcactcggcaggcacagtggctactgggaaaatgaaaatgaattccaacctgagagatttatgaatggagccggcgttgatttgaagccaaatgagttccattacttgccatttgggtttggacgaagaatgtgccctggggttcactcggcatcagcaacggtcgagacaatgctggcaaacctcatgtaccgattcgattggaagcttccacccggattgaaggaagaaaacatagatatgactgaggtgtttggaataacagtttcaagaaaggaaaagctcatcttagtccccgtgaccgcatgagtgcacgtagcgtgcagctcaaaaagttgagccatcatggtatttggtgcgcccatatatgaatgtattcagaacttttttttatttcaaaaataaggttgaaatcctggacctctacatcattgtaatgcgcacaactagacaaataaatgtgaattgtttttaaaaaaaaaaaaaaaaaaaaaaaaaacttcgagggggggcccggtacccaattcgccctatagtgagtgta

SEQ ID NO: 17617 - DNA, 1052 bp, Triticum aestivum
  Clone ID: PAT_TA_17617
gccggccgggcttcatggggcgtggccaagtggtaaggcattgggttttaccactgcacacaagtccttggactgaagtggtcacctcctcctcggctccaccatgcttcccaggatccagaaaagcatcttccatctcggggaggagggtggtgatggccaccgcggtgctgatgatcaccatggagataacatcgttgacatccagcggcgcctcggggggcacacccacggccgccggctgcggcgaggagggcgagacgtcgtcgtcgggctgcagatcctcgtccagcaccacccgcaaccgtgtcatgtcgtcctcaagcagatggtcagctcgccgccggcccgccgccgcctttctggcagcttctcgggggcctgctccctgtgccggagggagctcagtcccgacaaagacgtgtacatgtacaggggtgaccaggggttctgcagcgaggagtgccggcggcagcagatcttgtcggacgaggcgagagagcacgaggccatggtcagcaaggagcgtcgaggtctggctcaccgccgtcaccaccccgggccatggccggcgccgccggtggcgatccggggcgcgccgaggagattactggcggtagcctagcctgattatgcataataacgcatgcacgaactatgacatccatgagcagatcgatcaagaacctatgatgctgaaaagttaattacaagtaatcgaggggcaaatcaatacgcgtatttgcatatatggcgaggtgagggtgagaatcttgagatggtatgaatatgttagagagacgttgaagcagggtgcatgttttttcttcaggctggttggttcagatctgtagtcatgatgcaaacaaatgtaatctgctcctggccgcctgttaatatgtgcacatccggttaattctagagggaagaaagtaaaaaataagaataattggtacacgaaaataaaaagaaatgctgctgcaagatactgtatttgtgatcaagtgttaaactcgtggtgtaatcctgaacacaagttaggcgtaaaaaaa

SEQ ID NO: 17618 - DNA, 1093 bp, Triticum aestivum
  unsure (1)..(1093): unsure at all n locations
  Clone ID: PAT_TA_17618
agggtttcgctgtatctgggactgccgggnaagatgtggttgcctgtctgaatgccgccatggagaggcaggggcttgacatgagtgtgtctgctctggtaaatgataccgttggagccttagctggagcgcactattgggacgaggatgtgatggttgcggtgattttgggcaccggcacaaatgcttgctacattgagcgaactaagtccatcccaaagctccaacacctcgggcttggaacaggaaacacgattatcaacaccgagtggggagctttttcagatggtcttccactaactgaatttgacagggacatggatgccgagagcataaatccaggtgaacagatattcgagaagacgatttccgggatgtaccttggagaaattgttcggagggtggtggccaagatggctcaagagtctgatctgttcggtcactcattggctgataaactagctgagccatttgttctaagaactccacatttgtgtgctatgcaacaagataactccgacaatcttggacaagttgaatcaattttgcgcgacaccatcggtgtcagccaatcttctgtagcagcacgaaggttcatcgtagaagtttccgattgtgtcgtcaagagaggcgggagattggcgggcgctggcattgctggcattcttcagaagatggagaatgattccaagggactgatcttagggagaaggacagtggtagcgatggacggcggactttacgagaattaccctcagtacaggtcatatatggttgaggctatggcggagctgctcggtccacgggacatggagcacatcatcgtcgagcacaccaaagacgntcgggcatcngtgcggacttttggaancgcaaaccaaaatatcagcaactcactctccgngtgatgtcaattaggaacttcaaagcaaaaattgctgcnaccttctggaactgggtgggttcaaaatgatcccggccaggaatatcaatcacagaccagggattaantatctctcgngantnaaatancccatccaatgngaatacgttaatgcggnaancgttgaaagattaaatnntaattnagcan

SEQ ID NO: 17619 - DNA, 1569 bp, Triticum aestivum
  Clone ID: PAT_TA_17619
tccgtcctcgaccgttcagatattcgacgagccgaggcggcggacgtatgtaggacggtggctggctacggacaagatagagagacggtgagggagccgttgccgacatacgtccaagagcagacagcatcaagatctgccccatccggccccacttgcagtgtccgttgggcagatacgaccccctttcctgcttgcttgggctgcgccgtctatataagtcaaccggccgtcctcacctggtcaccctctcccggcccattacattacacgaaagcaaagcatacctgagcagagctgcggcagcttcgagctgaggccttgtggagtagtcaaacattgagagaagaaaatggcacggagcccagctcaaatcgctatccggttgatcgctctgctccttctgcttccagtggcgtggtcggcgacgttcacgatgaccaacaactgcggctacacggtgtggccggggctgctgtcgggcgcaggcacggcgccgctgtcgacgacggggttcgcgctggcgcagggcgcgtcggcgactgtgaccgcgccggcgagctggtccgggcgcatgtgggcgcgcacgctctgcgccagcttcgagcgcaggcagttcacctgcgccacgggcgactgcggctcgggcgcgctccagagcaaagctcatgtcgctgcgcggctggcctcgctgctccttttcgctcccagcggcttggtcgggatacgttccttatgagcaagcatcgtccggggtacccagctcccgatgctggtcgtgccgcagggcgctgccgctgccaccgccgccgccagctccacgggcgggcccaagtgcatggccaccggctgcctggtcgacctgaacgccgcgtgcccggccgcgctgaacgtcacgtcggcgggggccgccagtagtgcggtcggcgggagcgccatggcgtgccgcagcgcgtgcgaggcgttcgggtccccggagtactgctgcagcggcgcgtacgggagccccagcacgtgccggccgtcggcgtactcgcagttcttcaagagcgcgtgcccgcgcgcctacagctacgcgtacgacgactccacctccaccttcacctgcgccgccggcaccaactacgccatcaccttctgcccgagcaccaccagtgggaagtacaccgacgagaacccgcaggctgccggcgtgccgcccgcgaacggcacgatggtgtaccgcggcggcgagcagttctcgacgagcggcggcgcctccactgccgcccatgcgtcgcagctcctcctcgcggcggccgtcgccgtcgcgctgctcctgtaagggccggccggccatacgtgcaatgtcggcaacgacatacgtacgtgctccccgcctcaccgtgtctgtccttatccggcggcccgttcatggagtgacggaggcaggacatgagatgagactcgagcggagcacaagagaagggcgggcaggcaagatcaaaggctgacagtgccgctactgatggcagatcaaacaaggatatcttcacatactgaacgcaaccttctagatagcttacagta

SEQ ID NO: 17620 - DNA, 730 bp, Triticum aestivum
  unsure (1)..(730): unsure at all n locations
  Clone ID: PAT_TA_17620
gatccggnagcgatgggcaggggcgtgctgngagtgcatctcgtcgagccaaggcctcttcggcagcgatttcctagggaagatcgacccgtatgtaatcgtgcaataccggagccaggagcgcaagagcagcacctccagagatgaggggaggaacccgagctggaacgaggtgttccggttccagatcaactcctctgcggccaacgggcagcacaagctcttcctccggatcatggaccacgacaacttctccagcgacgacttcctcggccaagcgacgatcaacgtgaccgatctgatcagcaccggcatggagagcggcgcgtcgcagctgaacgcggcaaagtacagcgttgtgtccgctgataactcataccacggcgagatcagagtaggcctcacgttcaccgccaccaaggttgaagaagacggagggcaggtcggaggctggacgcacagctctcgcgagtagagcatgtaacgtccttgcccttcgctcgtagctttagtgttggatgctatgatgtccgtgactgaatgatgtgattccaagtgtatgtacgttgcacctgtagtagctttttagaagatgtatatgtactagtagccagaagtcagaactcgtagcaggctagaggcgtcaattccgttaattaattgtcgatttgtggttcttattttagggggaattgtgattctggatgcgaacaacagaaactttaccgtc

SEQ ID NO: 17621 - DNA, 910 bp, Triticum aestivum
  Clone ID: PAT_TA_17621
gccggccgcgcccgccgcccgattgcaaacgcctgagaccgaggccgaaagagagaaaggccttcattcagaagggcagagcaaccggccggccgtgggagaggatcgacttcgagtgttggttagctttccggcgagaacgagagagcaaatacaatggcgcgcggccttctggaggtgcatctggtccacgccaagggcctctccggcaccgatttcctcgggaagatcgacccgtatgtggtggtgcagtaccggtgccaggagcgcaagagcagcaccgcccgagatgcggggagaaacccgagctggaacgaggtgttgaggttccagatcaactcctccgcggccaacgtgcaggataagctcttcctgcggatcatggaccacgacaacttctccagcgacgacttcctcggccaagcaacgatcaatgtgaccgacctgatcagcatgggcatggagagcggcacgtcgcggctgaacccggccaagtacagggtggtcaccgccgacaactcgtaccacggcgagatcaagatcgggatcaccttcaccgccgcaaaggttgattcccattgccaggttgaagaagacggagcacaggttgggggctgggtacacagctttcgtgagcagaaggtctgaggttccttccgtcgtgcataattattcgtgctggaatgtgggcgtggctgctatgtcaaccgcatcatatgcctttgattgactgatgtgattccaagtgtatgtacgctccattttgtagcactttagatgtatagtcacaacagcttaacttatccaatttcatttaaggcttacattctcatgataggatcgccaaattcatttatgattaagattcttttgaaacacataaaaaaaaaaaaaaacggctcgagactag

SEQ ID NO: 17622 - DNA, 549 bp, Triticum aestivum
  Clone ID: PAT_TA_17622
ccgctccttcttccccaacccactttccccattcccctttctcgagtccctcattattgccgtgttaaggagcgccgccaatgttcaccaacgagcgccgccacgcccatggaacagagcatctccgtcggctttccgtcgcccgccgcctctccaacgctgcctcatccgacatcctcttccatgcatctcaaagcgcacgctatcgaccaattcacattgatggcgccactgtcccacggatgcaggtaccctaggctctgttggtttacaaggtcaagttggtttcttcagtgaggaggggagagaaaagattactacatctggaaatggaggtcagcaccatctacaggacatgaggagtactttggcggttttagcttgttccgggaagttagcttgatagtttagcttgtttatggagtacaagttcctgaatattattacatgatctagcaacatgagcttcctttttcaacatgacctttcgggtgtattttttggatgaaaaagtgatgtgataccacgagtacactgccttcctttttc

SEQ ID NO: 17623 - DNA, 588 bp, Triticum aestivum
  Clone ID: PAT_TA_17623
tccgcaggcggcgaggtgctgcgcggatctactacgacgaaggcgattgggcgctccagcgaggtccgaggccatggagttcttgatgcagccgataaacagaacgctactggtggaggtgaacgataatgacatcacgatgggtgctgtgcgtgtcccgctggatgcgccagcatatgttgagcttgcagcgccggctgcttcgagtgcggatggccagatctggcgtgaggagggcggtgcagaggctggaagtgcagataaggctcagtgttcggagcactccatagaacaattggacccaaaaacaccaggttggacacaaagagtgcatgtaggtgctgctgctctgggcagggctccttgcgcgggacagggtgacagtcctggagaagacaatccgggaatttgcagttcaacctggaaacattgtcattgtgccaatataggaacaagtttcaacacacttggtgaggcctataacttttacaacttgcaagagtgggtatgtggatttggggtttgacagggaaagccaattgtgaatgacaactggacatgtcgatggcaatggatattatgtggatc

SEQ ID NO: 17624 - DNA, 578 bp, Triticum aestivum
  unsure (1)..(578): unsure at all n locations
  Clone ID: PAT_TA_17624
gnaaaattccggggagcacaaaagaggccggggagggagacagggacacgcaagcttcaggcacaagccctacgccgcctcgcctcgcctcgcctcacctcgttgcttgtcttcgaagatccgtagttagttgcactgcaccaagaagaatcaaccaaagcttcgccccgacttaatcgatcgatcttggcgcggcgctgattaatggcgcactgcggcggcggtccgggtccggcggcgccgcgggaggcgtcatccgtggagagccatttccagggcctgctcgacgacgacgacaagtaccgcgcattgtgcggcgcgttcgggtacctgcagcagcaggagtggccggacctcagcggcgcgtgctacgcggccttcggcgcgccaccgccgccgggcaccagcaacggcgccggcaactccttctcctgcagcggtagcgccagcagcggcggcggctccactaagagaaaacctgacgcgtatgtagacgcaaaggacgactgcaagaggccgagagggaagcagcagctgtgcgatcctgacgaggctggagcggcggcgaaagggaggcc

SEQ ID NO: 17625 - DNA, 577 bp, Triticum aestivum
  Clone ID: PAT_TA_17625
cgtccgtccgtccgtccgtccgtcgagatccaggatgatcccggccggtgctgcagctgctgctggtggagcggcagggatgatgcgcatccgcgaggtcgcacgggcgcacatcgtcctcgggtgggccaccgccctcctcgccgtcctcgccctcaacctcccgccacagcttcaggggacgtgcaggaccaccgaggatgaggtggcgcacatgcgcgtcgacgcgctgctgctgctgctgtccagcgccgcccaggccgcggcggccacggtggccgccttcgcgttggaggactggcgcacgggagtgccctggagcttcgctgtcttcgcccatgggatgggtgtcgccaccttctaccgcctcgacaacgtcgtcttcttggtggcgcgcgtcaccgtcgggagctgccccagcagccatgtgctcgtccacgggaaccccctggtagcccacttcattctgctcgcggtgcccctcggtctcttcttactgttctccgtttccaagttgatctccgcactcagtaaaccagagttgataatttcttatgcgatgaccagtgccatatta

SEQ ID NO: 17626 - DNA, 1633 bp, Triticum aestivum
  unsure (1)..(1633): unsure at all n locations
  Clone ID: PAT_TA_17626
ccgtggtgggcgccgagtccttcctccttgcgcacccagcttgcttgcggcttccgatcgctcccagaggcccacgggccgggcggccctgcgacgccccgccccgcgcccacgccccggcctggccctccgctccctacctccctcccaccaccacgccggccttccccgcctactccgtccgccccactctccggaaccgccggggcgtccgcccgtccgcccgtacctccgtcgagagccatccctcttccgcctcctgctccacccgctggggcagcagagccagggatgatgcgcatccgcgaggtggcacgggcgcacatcgtcctcgggtgggccaccgccctcctcgccgtcctcgccctcaacctcccgccacacctgcagggccgttgggccacccccgctgcggcgcaggcgcacatgccaccccacgccctcctcccgccgccgtcccgcccctcccattccccggcgccctccctgcccgccgtcgcgtcgcaggcccggcgcgtggcagtgcccacgcgtccgcccacgcgtcccgagatgtgaattgctcggtgaccttccatgcttggtgtgcccaccagaggggtctgttgcaaagtgatccagaaggcgagcataatgaatatattggtttttatgggagatgcctgaatcatgctactaaccgtgttaatcctgagaaatgcttgagaagcaatgaatggacatgtgcacgcacagagggttttaaaggacgaaagggtgaaggctgttctggttctaattacaagaaacctcaagtgaagagtagtgagtgcagtgtttcccaagaacagataaatgcttggctacggataaacggatcaaagccttgcataagaagacagtccaaaggatggaagcatttggtagtgtataaatctggcatacatggacttggcctctacacatcagagtttataccgcgtggctccatggttatagagtatgttggtgaaattgttgggcagcgcgttgccgacaaaagagagatcgagtaccactctgggaaacggcaacagtacaagagcgtctgttatttcttcaagattgacaaggagcatattatcgacgccacccgcaagggtgggattgcaagattcatcaaccactcatgcatgccaaactgcgtcgcgaaaataatctctgtcaagaacgagaagaaggtagtgttcttctcggagcgccacatagatccaggggaggaaatcacgtacgattatcacttcaaccaagaggatgaaggcgaaagaatcccttgcttctgtagatcatttagctgcaggcagtatctcaactagttagttggctgatgtgccgtctatttagtttagtgtatgtatataaaggactcgggcttgtaatttgaacatgcgattcatcatttagggagcttttattccacgagaacatgtaattctgtgcctgtctatttcagtgtatgtaaaagacttgggacttgtattccgaacatgtgattcatgatttagggaacttctgttccaccagaattgtactaaacatattactccctctgtttgtaaatataaaaagttttggcagttcaacttcaactgccaaaaccgnnntcggacgctng

SEQ ID NO: 17627 - DNA, 686 bp, Triticum aestivum
  Clone ID: PAT_TA_17627
ctctgcatgccacatgacttgcaaaaaagagcttttggccaattattagaccttgcaaggaagtctatcaaaccccaaagggtactatatcgagtactcacagtggagatatcaaaactgaaaatcttaatttgtcaaaagttctgtactcccccaaggccacgagaaatcttatatcagtaccattgcttgaaaaagagggttatcgtctcacatgttaccggggaaagtgtggtatagtgttcaaaggtgctctaagacagtgcggctctggagccgaagaccctagagataacttgtattacttggttgaattcagactagcaagaaaaatattcttaacacaaagaggagaagggaagtcgaagatgattaggagacgtacatccatctctggtgatacttgtgcagagatgggactgtagcggtgtgcatacctggacaagtctccttcacttactggtggcttcgaactgcaagcagcttgagtaatgtataatgaagcttcaaaggcaaagcacgttgtcgcatctagacagttgtcctattcgaatagtttcctgaaaaaggaaagctcacttgggttgatccctcggtagttttacccccctaaacatgtaaaatcgacactgctgaaacctcagattgccacaacgcgatcataagaagggtggtattttaccaaa

SEQ ID NO: 17628 - DNA, 512 bp, Triticum aestivum
  unsure (1)..(512): unsure at all n locations
  Clone ID: PAT_TA_17628
catacgcatacgcattagggatgcaaggcggcgcccgatccgccccgctttgtattgtagtcaaagtaaatcaacttagttataatctttctggttcagctttagttcagtttgaactaaatttctgttttggcgggcttatgcgggatgcccgcttgcatccctaatacgcatacacacagcgtgagatcgagagcgagatggccacgccaacccccgccgttcggttctccgacgtgccggagaatctgcctagatgctttgctctctcaacaaacaccaaccggccgatgaaagccacagtggacgatcttttcgcggagattcacaaggacgacggtggcatcttgacgaacccgcacgccaggttctacttcgagccatccaggaagcacggtggccgtctcctgcacatcagatgcggctacaacaacaagtactggatggccaaacaacaacagcgacaaccagatgacggcgccgccgccgccgncattgncatcaccggcacc

SEQ ID NO: 17629 - DNA, 592 bp, Triticum aestivum
  unsure (1)..(592): unsure at all n locations
  Clone ID: PAT_TA_17629
gtgcggcgctcgaggcgccggccggcccgggaacatccaccaactcatctcaaccagtcccaaagtacaagcacatctctctcttcccactactcacataaacatcactcacaatgggtcaactcgacaacgacaactggctctacccaggagacggtctcacaagtgaaaacggcagtgccgagttcaagattgagggcgacggcaggatgtctatctactgggacggcgaagttatctggcaaaacacagatgagggacgtgaagacatcaagggtattcatctgcaagaagatggtaacctggtcctctacacccacgacgatgaagccgtctgggcctcaaacactgaggatcatggcgacgaggtgtacctgcgtgtacaggatgatggaaacattgtcttgtacaagggagaggatgatgacgctgaggctgtttgggctagcaacactgtccacgaagattaagaatagggagcactcatgcagctgaccagcttggctggaacacttcaataaaaaaatacaagttaaaaaaaaaaaaaaaaaaggcccctannnnnnnnnnnnnnnnnnnnnnnnnnnnnnnn

SEQ ID NO: 17630 - DNA, 1334 bp, Triticum aestivum
  Clone ID: PAT_TA_17630
gccggccgggtcccccagtcccctccccaatccaacccatcccctccctccgtcggcttaaaccctagaccgccgccaccctccgccgccgccggttgacatggagttctggggccttgaggttaagcctaaccagtccctcaaggtttcacctgatgatgaccacttcctccatctctcccagggtgcccttggtgaagtcaagaaggatgacaaggctaccatgttcgtcaagattggcgaccagaagctagccatcgggaccctctctactgacaagttccctcagatccagttcgacctcgtctttgagaaggagtttgagctctcacacaattccaagacgtccagcgtcttcttctctggctacaaggttttccagcctgccgacggagatgagatggattttgattccgaggacgagtctgaggaggagcaagacaccatcattccagcactcaccaaggagaatggcaaacctgaagccaaggagcagaagaagcaggttaagattgacactgctgccccttcaaagtccaagcctgctgctaaggatgggggaaaatctaacaaggatgatgacagcgatgatgatgatgacagtgatgaggatgacagccaagatgactctggtgatgatggagcattgattcccatggaggatgattctgatgatagtgaggacggcgatgattcctctgatgatagcgaggatagctctgatgaggaggaagaagaaacacccaagaagcaagagactgggaagaagagggtggctggaagcgtgttgaagacccctgttactgacaagaaggccaagattgcaacaccgtcaggacagaagacaggtgacaagaagggagctgtccatgtggcgactccgcacccggccaagaaggcaggcaagaccccagcaaccagtgagaagtcgcccaagtctggagggtcggtcgcgtgcaagtcgtgcagcaagacattcaacagtgagggcgctctagcttcgcactccaaggccaagcatgaggccaagtagattaaaagaggaggatgctggctggctgcctcctatgagattatcgttatgctcctgtcctgtgttaggctatctactatatccttatgttgtcgtgcgtgttccctaccctacctttccttacctagcctcatccttatccttttggaagggaagggaaggcaaggcaaggcaagttaagggagaacccgttgagctgttagtgatgatgagttgttgccgtgattcggaattggaattggttggtggaatgctatggtttttcgttcaaaacgaatgattcctctgtggtttggtatgc

SEQ ID NO: 17631 - DNA, 1429 bp, Triticum aestivum
  Clone ID: PAT_TA_17631
gccgggcctcccgcccattccccaaatccatccgtccgtccgtccgtccgccggcttaaaccctagtacgactagaacctagtggctcctccgccgaccgccgccgcttcccatgggcagttctggggtcttgaggttaagcctaaccagatccgtcaacgtttcacctcgctgatgaacacttcctccatctctctctcgcagggtgtcctttgggaggtcagaaggatgacaaggcaaccatgttcgtcaagattttcggcgacaagaagctagccatcgggaccctctctaccgacaagttccctcagaaccatgtcttacctcgtctttgagaaggagttttgagctatcacacaattcccagacatccatgcgtctttctttctggccaaaaggttttccagccctgccgacggggatgagagagatgttttttgattcggagggagtctgagggggggaggaagaacatgaatatcatgcccagaccacacagaatggaaaaaacctgcagacaaggaggagaaggaagaagcagattaagattaacactgctccacattcaaagtaaaatgctgctgcgaaggatgggagataaaataaaggaagtatgatgacagcggatgacgataatgacagtgatgagagtgacagcgaagatgactactggtgatgatggagcatcattgacccatataggatgattattatgatagtggggatggtgatgattcctcttatgataatgacgatagctctgatgaggaggaggaagaaacaaccaagaagcaggaggcgaggggagaagagggcggctggaaggcgtgttgaagacccctgttactgacaaagaaggccaagattgcaacaccggtcaggccagaagacaggtgacaagaagggagctgtccatgtggcgactcctcacccggccaagaaaggcaggcaagcccccgctacccgcgagaagtcgcccaagtctggaggggtcggtcgcgtgcaaagtcgtgcagcaagaaaattcaacagcgagggcgctctagcttcgcactccaaggccaaagcacgaggccaagtgaaggaggagaggaagttgttggctggctggctggctccaatttacttattattttgatctgtctgtcctatgagtttattatcgttatgctgctgtgttaggctatctatccttgtgttgtcgtgttccctacctccttagctagtctgatcgggagggaagggaagggagaaaccgttgagctgttagtgatgatgcgttggttgttgaatcaaacaaaaaagccgctgtgattcggaattggaattggaattggatggtggaatgctatggtcatcatggttttgaatgaatgggataaaaaaaaaaaaaaaaaaaaaaaaaaaaaaacgcgagactagtcttctc

SEQ ID NO: 17632 - DNA, 1025 bp, Triticum aestivum
  Clone ID: PAT_TA_17632
ccttctcccaccgcgccgcaaaccctagccacccccgtgctccgccgctgccgctgccggagctcccccacctcctcctcatcctcctccggcctgggcgcgccgccattccccgaggcggccggcgcgggctgtgcgaccgacgccgggtggcggccgagctgcgccggggaatgcttgggctcccaggttctgcagtgttgctgttctgacataggtgaagatgaaggggctcggccttgcctgtttgcttcttgcacttgtgccacaagtggtacttgggacgcatgatgtgtacattgttaccatggaaggcgacccggttgtgagctacgcaggtggagtggaaggatttccagctaccgcggcggatttggatcaagagatggatgttaccagtgaggctgtcacatcatactctcttcacctccgaaggcaccatgagaagcttctggactcgctttttgtagcgggaacttacgagaagctttatagctaccatcatcttattaatgggtttgcagttcacatgtcatctctgcaggctgatttcttaaggaaagccccaggtgttaagtacgtggagagagatacaaagatacagaagttgacaacacacactccacagtttcttggattgacgacagcggtatggccaacaggaggtggatttgatagagcaggtgaagatgtggtgattggttttgtggattcaggaatttatcctgaacatccaagcttctctacccacagaactgatccttatggacctgttcctcgttacaaggggaaatgtgagatagatccagtaacacaaagaagcttctgcaatgggaagatagttggggcccaacattttgcaaaagctgcaattgctgctggagcgtttaatcccgatgttgagtttgcatctccattagacggcgagggtcatggaagtcatatagctgcaattgctgctggaaacaatgggattccggtgcgaatgcatggctacgaatttggcaaagcaagtggcatggctc

SEQ ID NO: 17633 - DNA, 660 bp, Triticum aestivum
  Clone ID: PAT_TA_17633
agttgcgcggcttacagccttggaactctggctggtctccatgcagctgcaattatggatctgatggagctcgggttagtcaaactgcagcagtctctcggaaagatagctggttcatacctacaaaattggctacaaatctctcatcgagcttgtcagattcagctgccagcaaagagggtattgtggttgtggagacaaactttaggttgtatgcgtactctgcttccaagctgcactgtgaaattctacgtcttttttcaagggtagagtatcaactcccgaaccttattgtgggagctattacaaaagaaagtctgtatggtgcatttgataacgggatcactgctgaacagataatttcattccttcagcaaaatgcccaccctcgtgtcatcgacaaaatacctatagtcccagagaatgttacagatcagattaggctgtgggagaatgaccgtaacagggtcgagatggtcctgtcacacgtatacgaacattttccgagcaagtacatgtttgagcaatgctgtgaccacggatctattaacgggtacttgctgtttaggtattagcaaatctgccgttgatgggtcgagtggcattttctatgctagttcagttatttggatgatcctggtcgacgcggccgcgaattcg

SEQ ID NO: 17634 - DNA, 797 bp, Triticum aestivum
  Clone ID: PAT_TA_17634
ccgcgtccgcgtgggagcatccctccctcccggggagtttccgggaagccgccgtcgcgcccaccctcccggggagtttccgggaagccgccgccgccccgcaaaccgcgaccacaaaagcgaatatataggaggcgcctaccttacctgcccctccagccggatctgaagctagctaggttgctgctgcttgatgcgatcgatccgtatcaccaaggagcaaaacaactgtattgatctccttcgatcttcctccaggactgcagctggtaggctaattactactaggtggctgccatggcgctgtggactgggctgggtcaggcggcgacggtggcgcagctggtcggcgcagatgttggcgggctcatctccatgatcgtgcagtctgcgttgacggcccggcagaacaggtccgagtgcgagcagcttgcgcgtcgggccctcatgatcgcgcagcttctgccgcacgtgcaggagccagaggcggcgcagccgctggccgggctgggcgacacgctccgggatgcccacgagctcgtcctgtcgtgccaagggaggggcgcggcataccagttcgtcatggccagcaggacagccgaaaagttagggaggttcaggccaagattgattcctaccttatcctcttccccgtgattagctacattggcataacacgccgcattgaacgaatctacaacgtccttgttccagatgactccacgagagttgaaccgtccacacttttgcagctgcaggagtctacagaggatggtcaaggagtaccactgcatgga

SEQ ID NO: 17635 - DNA, 816 bp, Triticum aestivum
  Clone ID: PAT_TA_17635
cgcaacccccccgcaacacgcgaggaagaaaggagaggacgatggtgaggaagagggaggggatgatgtcgtcggcgccgtggcggacgctgtcgtcggaggcggggggcgagggggagggaatgggcgacgaggaggagtccagggtgagccgcgaccggaaggagacccccaccagcaacacgccacacagccacaccacggacctggcacgcggcaagcgccccttccaggagcacgccgtcgacgccgaggagcgctactccttcgacccgcaactgcaggtctctttgcagagttttaacgggtgtctgcactgggcattcacgttgcacacatttttcaatgcctctgcctcccgtgatggcatacagtgtctcccgtaatgtgaactttttcttgaagttcttcacacaattctgggatgaagaagcgattggaaaccctcggagatgccttgggctgggaagtgagcatagctgctggcggtttcggttgattgccgaactgctatggaaaaaagttgctgggccaggctcttgggggagatgtatatgattcttcaagacggttgcgggcttgtgctagtggccaagacttgttaagtgctttgtttatgcctttattatcatgtggtgatggtcagtctaaatttttgaagtttcagtacattttcttccattaaatgctgatttttttttatcaaaagttttgttctaatagtctaagtttgttaaaagtttaaaagtaagtgtttgtgcccaaattcccatatttttgaaagagattatggtccttcattggataaaaaaaacc

SEQ ID NO: 17636 - DNA, 788 bp, Triticum aestivum
  unsure (1)..(788): unsure at all n locations
  Clone ID: PAT_TA_17636
ccacgcgcccctgcgccaacgccccgggccccaccccccccacgctccccccatcgccgccaagctccactgctccgctcctcccctccgtctccctcccaagcctctcgtctccgacagatcaaggaggccaggagcagcaacaagatcagcagctcgattgggcaggcaagcggcggatggagttcgtgctcatcatatccctgccgctcctcatcctgatcctcatcatcgccgtcgtcctctgcatcgtctgccgctagccacatgccgactcgtctctgctcggtccgctgtgactgtggtcgcaccatatgttgtgttaatcaatccaatattacatcatgactcggcatagaaaagtaaagaaaaaagctcctctccaccaccatttctatttttctgttctgtcactgtggtgtgattagctggctatagctttattggctttcctgatggcaacaaaagcatcgatcccatgtgtcgatgcgcaatgcatatgatatactatgtggctgtaaaaaaaaagaacaaattccgttcctgctctgattgattcgggggaggttgaatacaacaaaaatacaccaaaaccaaagggtcccaagtcagccgtgaacccagagcacccattaccgcgtcagtgacccctttcaggggcttgaccggagccctcctttgcctacgacccccctacccaccgtcccacctgggaaaaccctgccgccggtgcccccanatnccactaaggnatggacccctgacgggataaccgnggttgggtacca

SEQ ID NO: 17637 - DNA, 1586 bp, Triticum aestivum
  Clone ID: PAT_TA_17637
ccggctaagcacgtgaaattataagggatgacgggaccggccagctcttgtcctccttcaatcccgattttcggccgacgggttctaccgtgatgttcgtttcggcgctatcgtccagggcacggccaattcatgttgaccggaaacaacgatatgaagccgccgattcctaaacgaccccggcggatggctatgtcgccggaatcagcacctttagcctccggcagtagcagcttcatcccagatgatataatcttctttcagatactcgtacttcttcctgtgaagtcccttgtgcgcttccaaaccgtctgcaagtcatggcgcaccacattaaccagcatcagtttcgtgcgctggcacctggagctttccaagcgaacaaggtcgaccatggtcctcgtgccacgcaagtatcaggaggaccgacggaaggcgtgttctagattactcagtatcttcagcttccagccaggggaaagcaagtgtgcggagcttatcttccgaaaggaatttcatccctatgggatccctgtgttcagcattcctctccattgtgatggcctgatattgatcccttgcataatggggaaaattttcatctgcaacccggccactagagagtttgttgagttgccacctggaagcccaagtgttctctttgagcacagggtcgcctttggctttgatccttggagtggtacctacaaggtggcgaggcacttcatccgctcgtacagagatactctgcaaatagatggggaaggaggcaccactagagaatacagcagtggacatgagatcttaacattcggtggtgacagcaaagaagaagcttgggtatggaaggccactgtggatccaccataccctatcaaggccaggactccaatttgtctcccaggggtcttcttttggagtgctctcaagtccatggcacatggcaaggttatctcgaatgtcatccttcgatttagtttacttgatgaaacatttacggtgcaccctaaccctccatgtagtgatcatctaggcaagaatgatgcactatctgcactaggtggaaagttatgctatatccactctcccactccgtgggagattgccatttggttagcggaagatgggccaaatctgacttggtcactatgccgccgtgtcagtctgccgataccaagaaatcttcttgcctttgcatgtgcgtcaactgacccggacaagatattcctctccattgatgcgcgctaccttctcaggtgtgacctccatgatgaatctcttgaagaaataatcaacatgcgcgacatgttgtatgatctccggaacggcagaaaattcaccattggttcactccttgttgcccactatatggtgccatttgtggaatcactgttgcgcatcagatcttcatagcaacaagccatcatatcgtatgtgatgtgatctaataaatgttgtccaatttcttgtgtgcaagtgttgcaatcaaaattctgcattaatacatatttgtttttgtattgttccgaaaaaaaaaaaaaaaaaaggcccctaataagttaatattgtccagcacaaattttgca

SEQ ID NO: 17638 - DNA, 553 bp, Triticum aestivum
  Clone ID: PAT_TA_17638
gcaaccaaaattccactccggaattagtcacagagaacagctcaagcaaagagcattggcagcgttggggaatcaatagaggagatggagggatcatggccaatgcggccagaggaagcgcaccggtggtggtctggtaatgcggcggagagctcggggcgcacctcctatacgccgtctcttcaaattgtgccaccatctgtgccgcatggaggagagatgggggatggcgccggcaaaggagatggaggctagcggtggggctccggcgaggtggcggcgcgtgatgcaaggatgcgtggtcctgtgagctgggcctggtagcgcttgtgaccggatcagcgcgactgacgcctgttccctcggtgcgtgtgcaaccgagtgttgagtttgaacttcacttgctcttgtaaacttgggttctttttgcaaagcttgattaggccatgaagaattaccatgtttcttctttgtgggcagtatgttttgcctagaaatgctggacatgtgggtcatataacatgcactacataattgggttcatgcccattgg

SEQ ID NO: 17639 - DNA, 830 bp, Triticum aestivum
  Clone ID: PAT_TA_17639
aagccgagctacgtagcccccggagctagcctcttccggtgcaaccaccatcacggaggaatccgcggtcttcttcctcgctgccgtcgaagaaagatgcggcctctacggggagatcccggagccggagcggaccttgctgtcctctgctgctgcttcttgctcctctccttcctgtcccgtggcgcggacatgcccctaggctcctccctctcgccggcggccaattcgacatcgtggtcgtcgcccaactccacctactccctccgcttcgtgccgtcgccgacctccccgtcgctcttcgtcgccgcggtcacctacgctggcggcgtccccgtctggtccgccggtgccggcgcggccgtggattcgaggggctcgctccgcctctcgtcgtccggcgacctgcacctggtcaacggctctggagccgtgctctggtcgtccggcaccgccggccgaggcgtcgccgccgcatccctccatgagagcggcaacctcgtgctcaacaattccagggggcgcgtcgtgtggcagtcattccaccacccgacggacaccgtggtcatgtcgcagagcttcacctccggcatgaacctaacctccggcccctacgtcttcgccgtcgacagggccaccggcaacctcacgctcaactgggccagcgccggcgccgctcccgtgacctacctcagcaagggctacaactacaccttcaccgccaacacgacgctcagctccccgaagctcacgatgcagaccaacggcatcgtctccatcaccgacgggtcgctcgactcccccatcatcgtcgcctacagcagcaacta

SEQ ID NO: 17640 - DNA, 589 bp, Triticum aestivum
  unsure (1)..(589): unsure at all n locations
  Clone ID: PAT_TA_17640
gctccagcccccccccgcccgccccccccaccccctcgaatcctcatcagcagcacccatggcgcccaaggccgcagagaagaagccggtggagaagaccccggcgggcaagaagcccaaggcggagaagaaggtgccggcgtccaaggagggcggaggcgagaagaaggggaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgagtccgccaagctcgcgcggtacaacaagaagcccaccatcacgtcgagggagatccagacctccgttcgcctcgtcctccccggcgagcttgccaagcacgccgtctctgagggcaccaaggccgtcaccaagttcacctcctcctaggcctcttccgatggcagcgttttgtgtgtagttagcagtgcgatggtacaatnctnctgtaggaattgtgctgcttgttggtnctgaagaaatagttatgtcgccgtctgaattattaaa

SEQ ID NO: 17641 - DNA, 495 bp, Triticum aestivum
  Clone ID: PAT_TA_17641
gccggccgggccgggttaggtgacatatagaagaccggccgggccgggatctcattacaggaaaaagtttattacattttaaaatcaattcgaaacaaagatgtcctcttgtaccactaaggctaagattgatatctccctcgatgaggactttggcgagcacagcgtctcccaaatcattggccgtcgaggtgaaaagatagccaaagcgaagcatcaaccttggaaagctgcttataaagtggacccgactgatgttccatctaccatgtctctacacgacaaaccctggtacaagagtgagcatctcgacgcggcgtacgaggaccattccggtgcttaagtggagaggggcatatttcttgcctgcatgggacttgcaaatgatgcttatgtgttgcctgtatagctgatatcatgtttatattttggggttactcgaggaagacatgagtaggcattcgttactaaaaaaaaaaaaaaaaaaggccccta

SEQ ID NO: 17642 - DNA, 556 bp, Triticum aestivum
  Clone ID: PAT_TA_17642
gccggccgggtccgatctcattcaaagtttattacattttaaaatcaattcgaaacaaagatgtcctcttgcaccactaaggctaagattgatatctccctcgatgaggactttggcgagcacagcgtctcccaaatcattggccgtcgaggtgaaaagatagccaaagcgaagcatcaaccttggaaagctgcttataaagtggacccgactgatgttccatctaccatgtctctacacgacaaaccctggtacaagagtgagcatctcgacgcggcgtacgaggaccattccggtgcttaagtggagaggggcatatttcttgcctgcatgggacttgcaaatgatgcttatgtgttgcctgtatagctgatatcatgtttatattttggggttactcgaggaagacatgagtaggcattcgttactatcttgtttaaatgcctccttgaacagttgaaattggaattgataaccctcgttgaaactttacatcagtaaagcctttaaaaacaaaccacgaccttaacaaaaaaaaaaaaaaaaaaggccccta

SEQ ID NO: 17643 - DNA, 571 bp, Triticum aestivum
  Clone ID: PAT_TA_17643
tgtgcgccgctcgagccccggccgggccggaactcatctcattacacaacaaagtttattacattttaaaatcaattcgaaacaaagatgtcctcttgcaccactaaggctaagattgatatctccctcgatgaggactttggcgagcacagcgtctcccaaatcattggccgtcgaggtgaaaagatagccaaagcgaagcatcaaccttggaaagctgcttataaagtggacccgactgatgttccatctaccatgtctctacacgacaaaccctggtacaagagtgagcatctcgacgcggcgtacgaggaccattccggtgcttaagtggagaggggcatatttcttgcctgcatgggacttgcaaatgatgcttatgtgttgcctgtatagctgatatcatgtttatattttggggttactcgaggaagacatgagtaggcattcgttactatcttgtttaaatgcctccttgaacagttgaaattggaattgataaccctcgttgaaactttaaaaaaaaaaaaaaaaaagcccctaaaaaaaaaaaaaaaaaaaaaggccccta

SEQ ID NO: 17644 - DNA, 689 bp, Triticum aestivum
  unsure (1)..(689): unsure at all n locations
  Clone ID: PAT_TA_17644
aggctgccgtgatcggcctcctctacgatatcggcagccgnnacgatttcntgcacaagctcgagccttacntgcggagaatggcagacatgaaggagaagnagnagaaggtcggcgtggtagatccctgggtggcgcggggagatggcgaagcctactaccggtacatgggttccctcaccacgcctgcgtgcgacgagcgcgttatctggaccgtcatcaagagggttgctaccgtctcgagtgaccaactaaagcttcttaccgacgctgtgcatgacggctttgagatgaacgcgagaccccttcagaaggtgaatggcagagatatcggcttgttctgccctgatgatgaccatgaacgctattacgctgctgctgatcattaattagctctacacttgagccaacctgacggattgactgcatgtgtgttgttggcaattaatggcgaagaagagcgatgacatggaacactgcaaacgatcgtgactctgcgacaagcagggatgtttgttggccttggcacggttcttataattccttaataaagtcaaagtcacagacgtgtcgttgttgatatcttcaatacttggataataagagtccaatctagtatgctatcttgtttgtgtcttctttccttctattgcaataaaaagcgcgttgatcacggcattgccattttc

SEQ ID NO: 17645 - DNA, 593 bp, Triticum aestivum
  Clone ID: PAT_TA_17645
cgaacagcatactgcacttgccaacaggggctcagcgattcaactgaagaagaagaagaatacaggatgtgctacaaggtggagtgcgacaaatgcggcaagatcacctggaaggggtgcggcaagcatgtcgcgtccgtctacgaagacatcgagaaaggaaagcactgcacctgcaaggcgtggccgggtgttgacacggaagggtcgtcctcgaacaccaaagaaggtggaggaaaagcttgagttcttgcacaaggatcactagttttgcaactactggactgaaggagactgcagttttgaataaaagcttgcctctgctatctgctctgtatttgtttctggcttcttcgctgaagtcacttttgatggtataataaaacattctgcagttgatcgattgtcttatctagctaaagatgcaaatcagggctgggttccagagagagctggaaaaactcagcaaactctttgatcaatgattcataagctatatccattagctctgcatcattaagttctgtaccattggaagccttctgtaatatctgcttaatgctaccaacaccaaaaaaaaaaaaaaagggcgg

SEQ ID NO: 17646 - DNA, 1126 bp, Triticum aestivum
  Clone ID: PAT_TA_17646
cccacgcgtccgcccacgcgtccgctgctcagctacgtgtccaactatgccttggctggcctgccggtgcacctcagttggcgcgtcatgtacgccatcggcgtgctcccgccggtgctcctcgccgccggggtgctcgccatgccggagtccccgcggtggctcgccatgcgcgggcgcgaggccgacgcgcgcgcagtgctcgtgggcacctccgataccgccgccgaggccgagctccgcttcgaggagatcaagcgggtcgtcgaggcgccgcgagaagccgatagtggcgtgtggcgggagctgatctttcggccgtcggcgatggtccggcggatcctcgtcttcgtggtcgggctcaacttcctccagcaagcgttgggcgtcgacgccatcttgctgtacagcccgctcatgttcaagaaggcgggcatgtcgtcgaacagcgccatcttgggcgccaccgtggccatcggcgtcgtcaagacgtgcttcatactcgtggtctcgctcttctccgaccgcttcggccggcgcccgctactgctggccagcgccggcggcgtggccgcctcgctcaccggcctggctctcacactctgcatcggcgagacgtcgccagcgagcacggctgcctgcgtggcgttcacgctggccacggtcgcggctttttcggtcgggtgggggtcgctcccgtccacgtacacggcagagatcacgccgctgcggctgcgtgcgcagggctcgagcctcggcatggcggtgaaccggctgacttgcgggctggtaagcatgtcgttcatatcgctagcgggctggatcaccatgcccgggtgcttctttctgtatgccgctatggcggccacggcgtgcgtgttcgtattcctgcgcctgccagagacgaagggccggaccctagaggagatggacgtcctcttttccaagtgattgtgtcatctgtaggttttcggccacagttcaatgcacgctgctgcggcccgcggcacgtttggtagaaacctttggaaaaaaaatgtgtgaacccttttgtgattgcatcatccatagggatcaataaagggcttctactcctcgaacatctgtcgcgcccaaaaaaaaaaaa

SEQ ID NO: 17647 - DNA, 669 bp, Triticum aestivum
  Clone ID: PAT_TA_17647
gccggccgggttgggaaaggctcccgatatccttgttatcacaccactcaaccatgataaacattacaaagccacaaaactggacccgcggtgattacctggtctcaacagaccctgctcttctccaggttgatgccatcaatgctgcgctgagctcggacatggtctggtgggccggagaccttccggccgatgcactctgggatgcccttcggagttcaatatgttttggtctttatcgtaaaagatcttcagaaatgaatggcaccgggccgacagttgaatacaagattgaggagtgggagcaggttggattggtcagaatgatcacagacggggtcacatttggatacctaaccgatgtgtacattctgccagagcatcaaggaggtggacgtggtcgctggatgcttcagattttaaacgaggctttgcagggttggcctcatcttagacgagtgatgcttctgacaactgataagatgcatctttttgggaagaatttggggatgaaggactacagggagtttgacggcatgaagggtgtttctattgctatggttgagggtcctggagcacagcattgatgtttgtatgtagaagcgatttggatgaagctatcaagatatctgttatttatcccaaaaaaaaaaaaaaaaaaggccccta

SEQ ID NO: 17648 - DNA, 998 bp, Triticum aestivum
  unsure (1)..(998): unsure at all n locations
  Clone ID: PAT_TA_17648
ggcctcacttgtgcagggtttaaagatctctcctgccggcttaagctccaanatgaagttcttgtttcagatactgaaagattgagcatgacccactccaatgttaagaagctgcaaagacatttccaagctgacacatatccctggatccaacggttgaagcatcaagagcttgttattgagaggcgcctcctaaggatcatgagaatagtggaggctttggaaaaccggggtttccgtgttccgttaatgaaagaggaagccgatttatatgaaagattggttgctataataaagcagataaaaggaaccggcggtgatctatcgaagagagcttataatcttctttcaacctcacgtgttcttgcaagcgccggctgcgctagtggtcccatctatattccgagttcaaccaaagtcgataagcagaatgttaccgagcttcttgaggcattgcaacagcagaccgaagcagttgcgaagttaggcaacgtattaaaaagggataccagggacgtggaaattgtactttcggaagacacggatatggaagaagacagttccgggagaagggcatttaagatgtaaaactgaagcatggtctccattttaggtacctataagcagaggaagatccgtcttatcatcaagggccggagcctccagccgatgggattgtgttgtctggagtctagatgaactttgatcttaactgttgctgtcgtcaagccaaaatgtgaaatcaatttgagcatctgtcttaaccatgctcctcggatagttgagagaattcctcacttggcgctttcttgaatttgctttcctattctgctgcccaaaataagaatttcttccctatttgacactaagtgcaaattttcttcctatgtgacacttttcgtccattttgacaagtgaaggtctcaggtgacatgaaaagaccatttttcccatatattgttatataacgctaaaagaatagaccgctggtttgactg

SEQ ID NO: 17649 - DNA, 571 bp, Triticum aestivum
  Clone ID: PAT_TA_17649
ccactctcaaatattcttgccatggcgacttctctctcgccaaccgtcatggtgatggctctgttgctggccatgctggtcgcactctccttagcgcacaaggagcaccaacacgcgccgactcaagcgccgagccccgctcaccatcatggccatcttgccccggcaccaagccatcatcgccatcacgggccggcgtcggcgcctgctcccgcccacgggggacaccaccatcatcaccatgctccggcccactcgccggtccaccaccatcatcaccatgctccggcccactcaccgggccaccaccatcatcaccaagctccggctccatcaccgatccaccaccatcatcaccacagtcccgcaccatcgccggtccatcaccatcatcaccatgctccggcaccatcgccggtccaccaccatcgtcaccatgctccagcgccatccccggtccacctcgacgccaaggagttgtacacttagagttataccatctcctatttgtatcttcatcttattttccccggggaagtgtttaataaaatcattttacggaaaaaaaaga

SEQ ID NO: 17650 - DNA, 559 bp, Triticum aestivum
  Clone ID: PAT_TA_17650
gccggcctggtcgggacaagtccataagggtacgagttcaaatggtggtgcggtgtgaacgcgccacagggtgacagggccaaggaaggaggtgttgtctttgactaccttgctttcattgcttacactatcgacgactgcatggaagcttgtggtaacatgaaccagaaagacgacgataaccacaacggcgtgagatgcaggaacattgttttctcaaaaagcatggcggcgcagctggacggcggagaaaatggcaactgttggttgaaaaacgcgacaaaatccgagggtggtgattggggctttaaagatacgaacattgcctacgcggagcttgacgactagaagcatgatgacgaagttttctaccagcgcaggagtaatcgggggctatgtcacttgggacgaagtgttctactaatcaaatcagtcttgtaatactccaggccaaggttacctgcggctttgatgcatcggtgttcaatagcatgctttgctgtttctcttcaatacacaatttatgcaacgccagcctttgtcacaattacagtacctt

SEQ ID NO: 17651 - DNA, 731 bp, Triticum aestivum
  unsure (1)..(731): unsure at all n locations
  Clone ID: PAT_TA_17651
cccgggccggcgtccgcccacgcgtaccagcagccaagcaatccccacacacatctctccactacccgattcctttctccagctcgccatggacgcctcagccaccgtagccaccgggaaggggaagaagggcgccgccggtcgcaaggccggaggccccaggaagaagtccgtgtcgcggtccgtcaaggccgggctccagttccccgtcagccgcatcgggcgcttcctcaagaagggccgctacgcgcagcgcgtcggctccggcgcccccgtctacctcgcggccgtcctcgagtacctcgccgccgagctgctggagctcgccggcaacgccgccaaggacaacaagaagagccgcatcatcccccgccacctgctgctcgccatcaggaacgacgaggagctcggcaagctgctcgccggcatcaccatcgcgcacggcggcgtgatccccaacatcaacccggtgctgctccccaagaagacggccgagaagtcccccaaggagcccaagtcgcccaagaagaccgccaagtcccccaagaaggcgtagattccttgcttagttaggctgtagctgggatgtatggatgggtgtgcttcaggatacttcagttcgaagtagactgttcttgctttgtcgttgtattttctgaccgcgatttcaatgaaacaataagttgctttcatacaatttaaaaaagggcggnnnnnnnnnnnnnnnnngg

SEQ ID NO: 17652 - DNA, 1822 bp, Triticum aestivum
  Clone ID: PAT_TA_17652
agtcgcggacggtgcaagcagcagtcaaggcaatccccccacacacatctctccactccccgatactttcttcagctctccccatggacgcctccgccaccgtagccaccgggaaggggaagaagggcgcgggcgggcgcaaggccgggggccccaggaagaagtcggtgtcccggtccggcaaggccggggtccagttccccgtccgccgcatccggcgcttcctcaagaaggggcgctacccgcaacgcgtcgggccccggcgcccccgctaccttccagcccgcctcgagtaccttgccccccgccggcgggctgctggtggccaccccgccaagggccaaaagaaaaggcgcatcatcccccgccacccccggctccccatgcaggacggcggggacgtcgggaagcttggcgaccggctcaccagcagcccccgcgggctcgtcgccctcatccaccccgttcaccccccccagctccccgcccaggacggcccccaagtcccccaaggagccaaggacacccaccaagtcccccaagacggcctagattccttgcttagttagcttgtagtggctgtgacgggtaggatgggtttgatcaagaatactttagtcttcagttcactgttcattgtctttgtcttttttttgtattttcttaatgcgaatacaattagaagttgctgcagaaaaaacattctcattctcctctttgacttctgacagaagtgactcatagtaatttctttgtttgtcaagctgagacgtgaggagatcattgtactcttcaacacctccgctatatcagcttcaactttactgtttagtagagcttgcatccattcctgcatcaccactgcatattgaacagataccatctgcttcatgaccaccatagcaattgtactcaaccagtttaccatctgttttggactgaatcaaacgatggacatagttgtcaccagcataatcccaaaccttctgtgtttctaattcaagtgaatagcagctctcagtttctttccagtgttcaatagcatgaccgcctttgtaccttccacagccaacattaccacagattacacaaatccaaagattttccgaagttccacaaacagaacacattgatttctcaggttgctgctgacaatacctacaaactgggcacgaagagcctgtccattttgatatgcatgaacagtggaaagaatggttgcatattgtagtaagaatgcctccaggatcttggtcaagtcgctctagacacactgggcaggtagcctgctcagctgagctcgtaatcgagctatgggcatgctcgatcaattgagtgtagtgcacgtcttccacaaaacgtacacgagaaacatccaccctccagtgatgagaactgctttccattgaagtgcttgtagaagctatcggtggagctcagagtgtcaaactttatgagaacgcttatactggtcctccgctccatcaatcctgacgatgcgcatctcgagcatgtgggggacgaaggagccgcagaagcggcagaagtccgcgtccggcccgggcgtgggctccgaaggcacgaacacctgcggcttcctctctgccggaagatgagatgacgaggcggcggcggcagcggcgggtgggtcggggtggaggaggacgacgccgcgggtctcctcgatgcgggggttcccggaggagaaggggaccgactcgagcgcgcgcgtggacgaggagggagacgcggaaggggggagggaggcgggatcgccggcgttcgccatggccggagaggatcagaagcctagggcaacgac

SEQ ID NO: 17653 - DNA, 1208 bp, Triticum aestivum
  Clone ID: PAT_TA_17653
ccgacgcgcgaccggcctggggcgccgccgactccgcctcccgcccactccgcggccccgctacctcctcgggctcgagccctgccgggtcccccgcagtggactaggcctgccacttctttcgccatggcccgcccttaggccctggacgacgaacgaagaccgacgcgcgaccgacctagggtttcgcgcattcccccgcgccccgctccccccgtcggcatcgaggtctgctgaatctcgagcaatggagcggtcttttcagttgaatccgcatgccactcctttcgtgcctacctccaagtctccgtttgcggaaagcttgaaaggaaagaaggaccctgagaagcaagtagatgagactgaaaagaatgagactgctgacaagtctgctgggtatctactcccagagtccctttcttttgatgactatgctgaaagcctaggaaagatcaacatctctactgagtcatcatcaaaaggagaagctgctgaagcaagtcacgcgggtaatcatctcgccgtggtggaatctctctcgctgatgttcccagatgtgtctgctgacttcattcttgaagcactgaaggccaatgaatttgacgcggtactcaccattgatatgctttccgatctgtgcgaagctgatgataacggtcactccgccgaagtatcagaaaagccggagcaccatggcccttcgtccacataggcgggatgagaactctccagctacatctggtccaagccaaaccttccccaccgtcatcaagactcgatgtagcggagcacaatttctcgattctgcaaagaattcaccccgaagtgttcgattcgtagtgccaaaagcaacaagtactatgtgtttggggttttaaattccgggtgggatagctggtctgtttgttggagtctgccccatcgtgatgcctggttgcaagttgtacagatcttttggtgtagccgtttagactccggaattcaacaaccctgtgccgcgggctgcgcttgttcaaaaaaaaaaaaaaatgaacctatgcattgccgtgttctcccgcgttccaagcggggaggagacagatcattcgccttatttggttgtgtggtgcgggtttgcatgggtgcaaagatatccgatttcagttggttgtgctttgcagaaatggaggtgcctttgcgtgaaaaaaaaaaaaaaacggacgcgtggg

SEQ ID NO: 17654 - DNA, 1099 bp, Triticum aestivum
  Clone ID: PAT_TA_17654
gccggccggtcacgggaagcccccgatacccccatcacgaactatcccacaatggcgtcacgcttggcacgaagcgccgtcggcgctcccctcctccgacccgtcctcgcccgccgagctgcccctgccttctccgttgccgctgcgcgatacaacagcaatgttcccgccgaggaccccaagaagaaggctcagagcatcatcgacgctctccccggcaacagcctcctcagcaagagcgccattcttagctccgccgccgctctgtccgtctacgccatctctagcgagtactacgtcatgaacgaggagaccatcatcgccatctcccttctttccgtctggggtgctctgatcaagtacggtggccctgcctacaaggagtgggctgaggcgcagaacaacaagatcaagaacatcctcaacagcgcccgtgccgaccacaccgaggctgtcaagggccgtattgaggacgttaagcagatgggcagcgttgttgagatcaccaagaacctgttccaggtttccaaggagactgccaagcttgagtctgaggctttcgagctcgagcaaaagactgctctggctgctgaggccaaggccgtccttgagtcctgggtcagatacgagggccaggttaagcagcgccagcagaaggagctcgctcagtccattatcgccaaggtccagaaggagctcgagaaccccaaggtcctccagcagatcctccagcagagcgtcgctgacgtcgagaagatcgttgcctccaaggcccaatagataattacacgccgctagagtctcgatcaccggattccacggtttttctttgtaccccccttgtgccataacaacacctgtgcattagccgaataaatcaagaccctagttacttcactaaaaaaaaaaaaaaaggcctctagtctgtgagattttcgagatttcgagatttgggcccattgtgttcaaatgggtttatcggagctgtaaattgctcgtcgggaaaggtcgggatctccgacatcgcccattctcggcggatcgcaaaataacaaaaaacacatcttcaacgcaaaaaaaaaaaaaaaaaaggccccta

SEQ ID NO: 17655 - DNA, 569 bp, Triticum aestivum
  unsure (1)..(569): unsure at all n locations
  Clone ID: PAT_TA_17655
gcaaacagaancanttcctttgaactccccctgcgttaccttcccactggattcctcgttatgagaccgttaataccaatttggtggaggtggtactactgggcaaaccccgtgtcctggaccatatatggcgtcatcgggtcgcagtttggcgataacaccagcccagtgtcggtcaccggtgggagcctcgcggtggtgaagcaattcttggaggacggtatgggcattaagcacgatttccttgggtatgtcgtgctcgcgcatttcgcgtacgtcatcggcttcttctcggtgtttgcttactccatcaaggtgttgaacttccagaaacgttaggaatgcaggcgtcccaatccatagtttgtgtgtatatctgtatagtaggatacatacgtaggcattgttgcataaactctgctatttagagtttgtagtgatatgccggccctattttttaacgttcatttttggtctgtcggttgttgtcaaagtgtaatttggttcattttttgtctaataaatatactgtgacccttgtgcaaaaaaaaaaaaaaaaaaggccccta

SEQ ID NO: 17656 - DNA, 1372 bp, Triticum aestivum
  Clone ID: PAT_TA_17656
ctgatctttggtactgattagcgtggtcgtggccgaggtattgggcaagtcgaacgaactgttttctaccgtgaaaaggcggcagggatgtactctccattatcctatgcattagctcagacatgcgtggagatgatctacaacgtcgtgcaggggtttcagtacacgggcatcatctatgcgatgattggattttagtgtaaagctgccaattgcttcaatctccttttctttacaatgacatcatccatccactttccatggtttggcgttatgctcgtcgcgttgaccgcatcttccattctcgcaaacatatccatggcctttatactccctcttcgtaatctttttgctgggttcctcgttgcgacacagttcattccgatttcgtggtggtggtactgctgggcgaaacctgtgtcttggaccatctatggcgtctatcgggatcgcagttttggcggataacgaccgagtccttctggtctgtcccccgtacgtgggagaccgcccgggtaggtgaaagcaattcttggaggacaatctgggcatcaagcacgatttccttgggtatgtcgtgctcgcgcatttcgcgtacgtcatcgccttcttcttggtgttcggctactccatcaaggtgttgaacttccagaaacgttaggcagacggccgtttattttatgctgctgcaagagagaggcggcaataatctatagtttgtgtgtatttgtgtatagtagaagtagtaggatacatacatagacatcgttgtacaagctctgctatttagaggaatggattttttttcgacttcatcaaaaataaaaatgacatccttttccgtttagttaaaccgttgataccgatctcgtggacgtggtactactgggccaaccctgtgtcgtggaccatctacggcgtggtggcgtcgcagtttggcgacaacaagagtcctctcaaggtccccggcgggagcgacacgtttgtgaaggagttcttggaggacaatctgggcatcaagcacgatttccttgggtatgtggtgctggcgcactttgtgttcatcatcgccttcttctttgtgtttggctactccatcaaggtgttgaacttccagaaacgttaggccttcttctttgttttaatttatatatatagtgtttgtgtgtatatgaatgaatgtaatgtatagtagaaagagtagagttgacaagggaaattgttgcatagataggccagacctggttccgtatagggcagccgcatgagacgagaggtggtggtgacatgatgcctatttcttgttttggtgtacccattgacattgatatattaaatacgaaaaggtcatttttggtgcaaaaaaaaaaaa

SEQ ID NO: 17657 - DNA, 819 bp, Triticum aestivum
  Clone ID: PAT_TA_17657
gccggcctttcggtcacttcagatctcaattgtctagattttctatctcaaccattttaaccatgcatttctcaaccttcgctactatcctcgctgccgtgcccgcggcactcgcctgtaagggttacaccggtggtctccctaagcatactggtaccaagaccctcagcactcctcagtacatcgccagaggtcagacctttgacgctggctgggtcaagtatgaccgtggtgtgaaatgtaccggccagtctgaaggcggtgagaaggacactgttttcgtcctcgaagaaggtgccaagctacgcaatgtcatcattggcgccaatcaaaaagaaggcgtatactgcaagggttcatgcactcttgaattcgtgtggtttgaagacgtctgcgaggacgccatctccatcaagggcggtggcacagccaacatcatcggaggtggcgcttacaaggccgccgacaagatcatccagcacaacggttgtggtcacgtcaacattatcaacttctacgccaatgactacggcaaggtgtaccgatcctgtggtaactgcagtggaaactgcagacgctccgtgcacatggagggtacaactgctgtcaatggtggtgagctcatgggcattaacctcaactacggtgacaaggctacttactcaaacaactgtttccccaaggttcagtgccagggctacaatggctgtgacaagaagaacggtgcttgtgaaccccagaaggttggaacttgctaagcaaccaatacctgaatggccaagcccagtcgagttgtgtcttgaaaactgtagtcgggcg

SEQ ID NO: 17658 - DNA, 1060 bp, Triticum aestivum
  unsure (1)..(1060): unsure at all n locations
  Clone ID: PAT_TA_17658
cccgggtcgnacccactgcgtccgcggnacgcgnntgggcggacnngcgcggggcgtccggcgcatagaaccagagaagaacagagagacggaagacaacaatggcagccgaaggagacctgaagttgctaggcttgtcggtgagcccattcgtagttcgtgttcgcatggcgctccacatgaagggcttgagctacgagtatatcgaacaggacctcttcaacaagagtgagctcctcctcaagtccaacccggtggagacgaaggtgcccgtactcatccacgatggcaagaccatactcgattcgtcagccattgtgcagtacatcgacgaagtctgggccgccatgggcccgtcgatcctccccgtcgaccccaatgagcgcgccaccgcccgcttctgggcggcctacgtcgatgacaagctattctccgcttatgtcggcattaataaagcgacgacagaggtggagagggaggagaaggttagcgagatgcttgcagtgctcgagcaacttgaggaggcatttgccaagaactcaaacggaaaggccttctttgccggggactccatcgggtacctcgacctcgcggtcggatgccacttgctctggctcaaagcgcaacacaagatgtttggcgtggtgtttctagacgccggcaagactccgctcttagaggcttgggcgaaacggttcgctgagaccgacgcggcgaaggaggtggtacccgacacaggcatggtgatggagtatgccaagaagcgccaggcttatcgtgctgctgttgctgctgcggcggcgactgccaagtgaaacgcttcagaccagtgccactgagtatcgactaccgaagcatagcgaaagcaaatgatcacctatgtatttgggagtttagtttccaagtctctcccagaactaaacacttgctcgaaacaacaatgctttgtgaggggtataagaatgtgttatatatattggctcttactncacctttcacacatctttacctctcccctccttctctttcttttttccctccttttcttttctttttttct

SEQ ID NO: 17659 - DNA, 886 bp, Triticum aestivum
  Clone ID: PAT_TA_17659
tggggcggcgctcctgtccctcgccggagcccccaacgcatctccgctcccggcgccggccttcatctcatctcccggcggcggctccccatctctcctccgcatggccaaggtggtgatgcacaggaggtgtgcgcgaagaccacgaccgaggagggaaagtgatggcggaggtgcctctatgcgggaggaagaactcaggccgcatccgcacgtcgtccctggtgccgttgttggttctcccgccgtcgtgcaggcccgtgagccggtgctcttgacctcaagcccgtccagcccgccgcgcctctagatcgcccccgcacaggctgccggcgcccgcctgtcccgtgtctcccaggcgcacctcatggtcgacacctgaaggcatctggcgccgcccatgtgttgatattgcattattgcacgcgtccaggccaccgaagccctcagtcccccgtcatcgtcgtgggaaactgctgcttcggctagcctagcaccgatgtcggcacgcgcctgagctccctatcgcgccacctctgtgtaagctgtagggcggtaagcggaggacatgacggccgcttcctgcttgctctcttggccaggtgcgtcgcgctcgcgcgcggggcttgcgtgctatgactgaagaagtgaagatacgtgtgatgcgtgggcgccttggctgtcacccgctattgtgctgcataaccggtccgctggcacgtgcaaggctatgccgggaccaaaaggatcgacgcggcgacgagctttgtggccgagctgcggcgttctggcgtggtttggacatcctgggcggggctcgcgtgctcaggacacgcgtttctcgcgtagttcgtggacaaacaggacgtcggtaacacgattgcac

SEQ ID NO: 17660 - DNA, 646 bp, Triticum aestivum
  Clone ID: PAT_TA_17660
ggcgaatccccccaacccgaaagcatcgatggcccccaaggcggagaagaagccggcggcgaagaagcccgcggaggaggagccgacgacggagaaggccgagaaggccccggcggcgaagaagcccaaggccgagaagcggctgccggcgggcaagaccgcctccaaggagggcggcgagaagaggggccgcaagaagggcaagaagagcgtggagacgtacaagatctacatcttcaaggtgctcaagcaggtccaccccgacatcggcatctcctccaaggccatgtccatcatgaactccttcatcaacgacatcttcgagaagctcgccggcgaggccgccaagctcgcccgctacaacaagaagcccaccatcacctcccgggagatccagacctccgtccgcctcgtcctccccggcgagctcgccaagcacgccgtctccgagggaaccaaggccgtcaccaagttcacctcctcttagattccgctgcctgtatctgcaactagaagtagtgttagtgctggctggaaatagttgaaagcttgccaatgctttgttggctcgttgattgtaaggggtgaatttgtgctgcttttggcaaactaagaattcgaaagtaaaacgattcatttctgctgc

SEQ ID NO: 17661 - DNA, 586 bp, Triticum aestivum
  Clone ID: PAT_TA_17661
cccggtccacgcctggcgtcactccacgcactgatcaccgcacgcaactccccatcctcttcctctcccccacgatcctctcctccgaccatcccaatcaccgtcggtccaacctccaatccagggcctccccctctcaccccaaatcgatggcatcccgtccatataaacagccggcgaggtggcgtccatcgcactggagccatggcaggcggagcagagggcggaggagcgaaatccggcgatggcaagctagtcaaggccatcgcgacggccggcggcgcagcacgcgaccgcagcggatctggttctgggggccccgtccgtgcgcgtccaggcaggttccgaccgtggtcgccctcgccctcgtacgtcagtcggcggcgtcggttcggtgtcggagccaagattgtcgacccggatgaggatgcagtgggtgatggtgaagccggtgttgtggctaaccaggacggcgcggcggcaggtgctgggcaagatggcacggcagcaggagtgcgtcccggtgctgaccaggataccgcggctgcaggtgctgggcatgtcgccgaaaagaccagcaagtagt

SEQ ID NO: 17662 - DNA, 556 bp, Triticum aestivum
  unsure (1)..(556): unsure at all n locations
  Clone ID: PAT_TA_17662
agcgtttgatgttgccatggcccggattttgacgagttcgtccgtgccgatgacaggtttgaagtggtcgtaccgaggaactttgctcttgtttgctttcggatcaaggcaagtggagccatgacggagaaggatgctgacgaggccaaccgcgtgctaatggaaaatctgaacaaaactggcaaggcttatcttgcacacacggtggtcggtgacaagttcgtattacggttcgccgttgggtcgtcgctgcaggaggagaggcatgtgagaagtgcttgggacctcatcaagaagactacgggtagtatcatggattaagtggacagacctatcggtgccgaaagctttaggggcaacacaaatcccaatatttatgatacatttattcttttaatttatctttcttttcttttgcttcgattcagattattatttatttggacatgtggttcttatttccactgagggtatatgtatatagtaggcaacgaaatggattgtagactgtaaaaggtaaaatggcttatattgaatgaacacnagatactttttt

SEQ ID NO: 17663 - DNA, 783 bp, Triticum aestivum
  Clone ID: PAT_TA_17663
ctctggacgagacgaatcgaagccgatccgactttccaaatgccgcaggcgcaggctagggcggtcctgccggtggtgctcctcggctgcggcggcgtcggtcgccacctcctccgccacatcgtctcctgcaggtctctccacgccaaccagggcgtcgccatccgggtggtgggcgttgccgacagctcctcgctgctcgtcgcagacgacgtccgcgccagcggcctcgatgacgcgctcctcaacgacctctgctccgccaagtccgccggctcgcccctgtcctcgctgctcgctcgcgggcactgtcaggtgttcaacaagccggaggcaatggggaaagtaatcgatgctgctaccatgcttggaagaacaaccggtctggtgatagttgattgttctgcaacttatgacactgttggtgtgctgaaggatgccgtggatcatggatgctgcgttgttttggcaaacaaaaaacctcttacatgtgcttatgaggattttaaaaagttgacgtcccacttccgtcagataagatttgaatctactgttggagcaggtttgcctgtaatagcttctgtaacccgcattattgcatctggagatccagtttcccgaatcgttggcagtctgagtggtacacttggctatgtgatgagtgagctggaggatggaaaattttttagtgaagttgtgaaaactgccaaggctcttggttatacagaaccagatccacgtgatgatctcagtgggatggatgtggctagaaaggcgttgatc

SEQ ID NO: 17664 - DNA, 2017 bp, Triticum aestivum
  Clone ID: PAT_TA_17664
atcgtcatccacatcgacatcgtcaattcacaacctcacccagacaagaagaaaagaacgaccgaaggccctcgctcgccatcacccgattcttttccattctcttcgacttttgtttcgtaggaacaagagccagagaacttcttgtcatcctttcgaatttcggaaggttgtatgagaagcttctctcgcgccagcaaaagtcgcaaatctggactttgaggcacgcgtccccgttcccttcagtatcttcccctcgacatatcgggaatccgaatcccacacacagaccgttaccgaaacaaaaacacacgaagaggttgagatcaaaccccaacagcccgaagccggacgggaaggtgaaatatcttctgtctccgtcaccgccgaaaaggtccctcctcctcgctcagagtcagagtatatcgaagaagaggtccatattacgcgtgaagaagaacattaccaccgtcccggtgtccataagtacgagcacgacgaagagcactttactgtccgtgaagactcccgacgacctcaacctccctctcaataccaaccttcccagtaccaccaaccttcccaccaccaaccacctcccaaattccaatcttctcacactcacgtagagatcgacacccaccgtcatccctactactccacccccattgatctcgctgaacgtgaataccgccagcgttaccgccctgcccaagctttttccacagaagacccttcttcccactctcatcctcactacaaacctcaagacaacttcaaagccaacaactacactgttgaaggccgacccgctccccagttctattcatctgagaagactgacatcaacaacttcactgttgacgaccgctcctctcgccctcagtacaaccacaccgagaagaccgaaatcaacaacttcactgttgacagccgatcttcccgtcctcaatacaacacctgtgagaagactgagatcaacaatttcactgttgacacccgctcttcccagcctcggtaccgcgacagcaagacaactcaagtcaacacttactccgttgacaagcccgtttctcgtccatcttacaagaaggacgtgagatttaccgaaaaaaccgtcgaatcttcaaagtccgacaacaagtccaagatgggttactacgacgacgagggttctttccgcaacggcggcatccacaagcttggtgacaagtctcgcgagatcgagattgacatccgcgagacttctggccctgccagctctcccaacaccgtcagcatcccctgccaccacatccgcctgggtgacttccttatgcttcagggccgcccctgccaggtcatccgcatctctacctcctctgccactggccagtaccgctaccttggtgtcgacctcttcaccaagcagcttcacgaggagtcctctttcatctccaaccctgcccccagcgttgtcgttcagtccatgctcggccctgtcttcaagcagtaccgtgtcctcgacatgcaggagggtcagatcgttgccatgaccgagactggcgacgtcaagcagggtctccctgtcattgaccagtccaacctctactctcgtctccacaacgctttcgagtctggccgtggctctgttcgcgtcctcgtcctcaacgacggtggccgtgagctcgccgttgacatgaaggtcatccacggctctcgcctgtaagcgtgttcaactgttttctgaagacgggcagccgtttacaatgcgactccttcccaatgtttaattgagtgaagggacagcgctaccagtctcacctcagctgtggggagcgggtctgggctgtcccccatctcacctgtacaatgtcaagtttcataggggatctgttgtgtcaagatggttcgagttttgtttgtgtcgagattggtaaatgatattggctagctggaaatactggagtcttttgtgtagatgggagagttcggtacatgaactatagtaattgacaattgattccgcatctactta

SEQ ID NO: 17665 - DNA, 946 bp, Triticum aestivum
  Clone ID: PAT_TA_17665
accatgaaccaccgcagaggggaaacatctttgtcttcagttcctcggagtgatcctttaacaactgattatgggacaattgatgacctgtgtgatctatgtcttggatatggtgctatgtctgtattggaggatacaatattagcaataactcaatccacgacatatcatgacacaactgtgattcagtacatgaacactgttctcacccgcatttgtaactactgtgaaatgcatcggcactataattatctttacaattttctggttctaaaaggtgaccatgtggcttctggcctttgctgtattcagttattcatgaattcaatgtcccaagaggaatctctgaagcatttgggacatgccaagacacattttgaggaagccttatctgtacgagatagaacaattgaggctacaaaattggtatcacggactgctcgcaataagagtgcatcggaaaaactaactcgagagatgataatgaaattttctaccagagtttcctatcagatggatgttgtgaaggccctcaacagtgtagatgggcctcagtggaagacctccctgtttggaaatccaactgatcctgaaactctgaggcgaaggtgcatggttgttgaaactctggctgaaaagcattttgatttagcttttagaatgcttcatgagtttgatcttccagttgtggatgtttatgccggtgtagcagcatccctcgcagagaggaaaaaaggtggccagttaacggagttcttgaaaaacataaggggaaccatagaagatgatgaatgggatcaggttctgggtgctgctataaatgtttatgctaacaagcataaagaaaggccagatcgacttattgacatgctaatcagcaatcacaggaaagtacttgcttgcgttgtttgcggccgtctgaaaagtgcattccagatagcctcac

SEQ ID NO: 17666 - DNA, 632 bp, Triticum aestivum
  Clone ID: PAT_TA_17666
gcattcgataggttaaatcacccccaaaacgcacccaccaccacaactccggcggcggcgaccagacgaacacgagcaccaaggcgatggcgactgctctcaaccgcggcctccgctccgggatccgcctcctcgccaccggcgccgaggcctccaagccagcttcacgtggattccatgctaccggtgtgaagaggatgtcagggcatggccatgatgagccatactacctccacgccaagcacatgtacaacttgcacaggatgaagcatcagaagctgactgcatggacttcggtgctgggagctgtaagcattggtgtcggtgtcccggtcttcgcggtcgtcttccagcaaaagaagacctcctcgggctgagcttacatgccccctccctgggcctacttgttggatctattttgaatttagcattttgtgaagccaaagctgtcacttcaccttactcttgttgtttcgtgttactccatttgctgttagcagatgatctgaatcttaagctcgtttctttacggcactgctttctgttaataatacaagtggcttgaactttccaggctgtggagaaaccctgcagtgtgatccaaaaaaaaaaaaaaaaaaggcccctatgta

SEQ ID NO: 17667 - DNA, 1980 bp, Triticum aestivum
  Clone ID: PAT_TA_17667
ccgcgccccaccctccgcgacgcgcaagccgagtcgcagcggagcgggttcaatcaccccccaaaacgcaccccaccaccacaactcccgccagcggcaaccacgaacaaacacgaagcacgaaggacgagggcgaacgcgcgaaaccgaggccatcgctcctgcacccacctcctggcctccgccgcggggtccgcctcgccagcttctggcggcgcggcttccacgggagtttcgagggtatccggggcaaggggaatgatgaggcagtactaccatggacgctaatcacccagaacaccccgaacacaaggcacatgtacaagatgcataagcagcatgcaacttcaaggtttcggcatcggtgattcgtttgctgtcggtcgtcatgcattggtcatcggtgtccttctctgcgaaagaaagccttccgcaaagaggacgacctcccccgaaggcttacatataccctcccattgtgcctatttattttttgttattttcaaatttagcaactttatgaaactccaatggtttccatgtcatcttgtttgttttttgctcagtgattctgtactttggtcaatctgcatttgctctaaatcggtaacttcttttcttttcagtaatagcaatttttgtttgaactttcagaggcttgaactttaccaagaaaaggagaaaaaatatagaataatccaattgatatttccttaaatcgtggaatttgatgatgtctatggtgcagttttaacttatttctatgaagacagctcttgaaagttttttgacttgaaaaactacaccctactgtattccatatctgacaagaatgttcatgaaataaagatcagtcctggtttaatgcttttggatttatacaagaacaaccagctccatttgtgtgaagattcttaatattgaggatggcacagttttgaaattcttcaaccacctcctccatcgaaataagaaggtggatttcattgaacagtttaatgaaaagctcttggtcaagcaggatggagagaatcttcaaatacttgatgtacggaacttccagttgactgaagtgagcagtactgagttcatgactccatctgcctttatctttctgtatgaactccagttgtttttgacattccggaatcgatctgtagcagtttggaatttccgaggtgaactagtaacatcatttgaggatcacctgctgtggcaccctgactgcaataccaataacatatacataaccagtgatcaagatcttattatttcttactgcaaggctgattccactgattcatcttcagaagaaaatgctggctctataaacatcagcaacatactgacagggaaatgcttggctaaaataaaggctggcaatttcaacgagcaaaagaagacatggaagttccagaatacaatcacagaggctcttgaggacatcacagctctgtactacgacgaagagcgtgatgagatctacaccggcaaccgtcatggccttgttcatgtgtgggcgaactgagagctgagaaagcaaatttcagggacaaacaaggtgttgttcgtttgcaggcggatcaatttaacaaccaagcctcaggtggtgctggccgcgaagaggtcttgggtctccagccgttagcaatttgttgatgtggagtattgtggtgtcgagctgctctttaccgacagaagatttgttgtagagttagtgcttgtcatgtgctttaccatagcctgtagtagccttggagatgtctcgaggcgagctctcaaactgtacctcacctggtggcccctcctggtagttaactctgctacctgaaaaagtaaaccccattctgtctgtcatgtgtctggttgttgttgagtttggatcttgtaaacataaacaattgtagtgtgtggcaccctaaacctacatagtggtacaaaaaaaaagttgacggcaaaaacatttttttttttttaggg

SEQ ID NO: 17668 - DNA, 930 bp, Triticum aestivum
  Clone ID: PAT_TA_17668
gccccgtttgctcttgcgcctcgtacaggaaaagtttggcttggtttaccccaagcggagagggttttcctttccaggcgcgtaggtggatgggatgcagggcgccggcgcggaggggaggagcaggggctcgccgtcggccatggacaaggccgacgagagcgccaagaaggcgcggctggagctgccccacggccacctcgtgaagcaagagctcgtcgcgcacgacgcggcggccggaggaggcgccatcgttgcggtggcggagcacagcccgagggcggagctcgccgtgaagatcgacatgtgcgtgctccactgcccgctctgcgccctccccttcaagccccccgtcttccagtgcaagggcggccacctggcctgcggcgggtgcgcggcccagcagccctccggccggtgcggggcgtgcgcggacggctgcggcttcttcgacccctgccccgcgctggacgccgtcgtgtcctccacccgggtcgagtgccccaacgccggctgccacagctacgtcacctaccacgaggccgacgagcaccggagcgcctgcgcgcacgcgccctgccgctgcgcggagcccggctgcgccttcgtcggcgcggcgccggacctcgtccgcccacctcagcgccgcccacgccgtgcccgtgcgcgccatccactacggcaaggtgagccggctccaggtccccgtgtcgacgccgcggctgctgctggtcaacgaggacgacggccgcgtgttcgtgctcaccgtgggcgcgctcggcgccgcggcgaccgccgtgtccgtggtgtgcgccagggggagcgcggccaacaagccgcggttcacgtgcaagatgtgggtgaacctggcggcggcgaacggcggcaaggcggacatcgtgctggtggagatgcaggtgaggagcaaca

SEQ ID NO: 17669 - DNA, 826 bp, Triticum aestivum
  Clone ID: PAT_TA_17669
ctgagtttcggactcatattggtgaactgctgtgtcggctgcgaagcagttggttactacgtgctggaacagtggagtttattgtggatactctttcaggagaattctatttcatggagatgaatactcgactccaggttgaacacccagtaacagagatgatcgtcggtcaagatcttgtggagtggcaaatacgtgttgcaaatggagagcgcctgccattatctcaggagcaggttccattaaacggacatgcatttgaggcccgaatatacgccgaaaatgttccaagagggtttcttcctgcaacagggaccttacatcactatcgaccagtcctgtcttccccaacagtaagagttgaaactggagtcgaagaaggagatgctgtcagcatgcattatgatcccatgatagccaaacttgtcgtttggggtgaaagtcgcaatgctgcactagtcaagctaaagaactgtttgtcgaactttcaggtttcacttctgcttacaattgttgctttccttccgcagctctcaagccctaatgccttcgaatatccgatactctcctctgtctgcggttcaatgaggttcttcgaagttcacctcccatggcctctcgcgaagcactgcctgcttaaggattctggtgtggtacttctgatcatccgtccctatcatggtgtagttaatgaatagacagattgcaggtttgcctacaaatgttgctttccttcaagaactcgcaggccataatgccttcgaaagaggcctagttgatacacatttcattgagcggtacaaagatgattttcaaagtacttctg

SEQ ID NO: 17670 - DNA, 850 bp, Triticum aestivum
  Clone ID: PAT_TA_17670
gccggccggttcctgccggccttgacttcatccattccatctctctcgaccacacacccctagtgctcctccacgatggtcaagtcgactcttcttctcggcgctcttgccgctttcagttcctatgctcaagctaaggagatgaaggtcaatgaggacaaggcccagagactctatgacactggagtgattcacaacaaactcatggccagcaagcaggccgtgtgggagaagcaagaggccgctggtgccttcgccagcgagcagtaccccaagcttggttataccaagtgtgtccgaggttttgccgaagccatcaagggcgatgccaagaacacttttgcctgccacaacgccgacttgtactctttcttgagtcacgccgacctcggcagcaccggaggtcgaggctcctcttcctggggatggacttcctcagacggtcgtgagtttgtcgccatcggccaatacgacggcactgctttcgccgagatcaccaagaagggtcagctagtctacctcggtcgcctccctcagtactctgtgccctcccagtggcgcgagattcgtgcctacaagaactacgtcatcattggctctgaggccgtcggtcatggtatccagatcttcgattttaccaagctgttgaagatcgaccccaagaagcctgtcacctttgacgccaagaaggacctgaccagtcacttcagcgcccttcttcctgttggtcgcgctcacaacgttgtcgtcaacgaggagctcaagtatgccgtagctgatggcgctcagccgcgagacgacaagaactgtgcttctggtctgaacttctttgatctgactgatccttcta

SEQ ID NO: 17671 - DNA, 1299 bp, Triticum aestivum
  Clone ID: PAT_TA_17671
ccgcgccatggggtggcgtgcaggagtactatgccaagccaagctcatacgggaggccgcagggccggccgtgggaacaaggcatgccgaatttggcaggttacaggccagggccgccggtgctggtgagggagaagctgggtgggcatcacgggccactgagtgcgtcgagggatcatgaacatgccatggacaaaagagctcttgatgaacttggggcagagaggaaggatggtgtgctgccaaagtatgcacaatcggaggcggacaccaagcgtgctaaacagcaatatgctcagaggtctcgtgttcgaaaactccagtatattgccgagcttgagggtaaagtccaatcattacagtcagaagggatagaagtgtctgctgaaatggagtttcttactcaacaaaatataatgctagacttggaaaacaaagccttgaagcaaaggctggagagtatagcacaggagcaagtaattaaacgtgttcaacaggagatgtttgagcgggaaatcggtcgtctcaggtcattgtatcagcagcagcaacagccaccacagcctcctactcttgctcgtagtaacagcagagaccttgactcacagtttgcaagcatgtctttgaaacacaaagaccccaactctgggcgtgacgctgtctctgggcctcttcgtacttagttctttcagccttttgttctcgtgagttccaaaccactcctagaccactcttttgtggctgtgaattcgcgtcaagaatccttaaaggaatgcatcaggaaaggagcagcacatttggaattgtgcccctatcacttggtgaataactctggaaaggctaataactgtggatctgatcttcattctttgggaatatgcacctggtggtcatcctcagctcactgccattgttgatgctcgaccagtcggaggtgtttagtgttttatttgtagctctggatgctgttcgtgcatccctgtaccatttcggatcctagggttctaatttgttcctgtggtcttgtttctctatgttgtcttcttcatgcatcttagccatagtctgcattgctttgtcagtggaatgtggagcactagttagcatctgatacagatgcttttaaatgtgccacatccttgagaactcatttgttttatcgttggtgattcaataaggtagtgcaaataaagtattagcattatccagagttgtgacttggtgttgacatgctgcaacttcactgtgaaattctgtaagttatgccatctcgtttcatttgatacacttcttgtgagt

SEQ ID NO: 17672 - DNA, 879 bp, Triticum aestivum
  unsure (1)..(879): unsure at all n locations
  Clone ID: PAT_TA_17672
acaaatcttgcaagnttgcaaccacagnatagcaacatcacaccaagggagttcatggcgttgtctatggaacacttggtctttgtgatagttgtacaagattcagaccctaccatgacacacgcgccctataaatacatgatcacggcacaaaccatcgccacacacaagctgaccttttttctctgatcatttcttctcagagacacattccatcttcaaaatcaaaacaagtggccatgatgagctccaagaaactagctcaactttccaagaagtggcaaggaatcagtgccatcgggcgaagaagggtcacaacaacggacaaggatgtgcacccgtcctgcagctcagttgcaggcaagggccacttcgttgtctactcctccgacgggaggcgcttcgagatccccatagcgtgcctccgcacgatgatcttcgaggagctcctgaggatgtcgcaggaagagtttgggttcacaagtgaggggaggatcacactgccttgtgatacgacaatgatggagtatgtaatgtgtttgctcaggagagaggcttctgaagatgttgagagggcgcttctcagctccataataacgacttgccaccacccaagcagaatgatgcaagcagccactggacttcaccagcaattttctgtgcgcagctcctcaagagtgaacatctccagatttttctttctgttttcatgttccatctttttccccggttgtacttttggagcacaccttttgtgcaacgtttttccaagggtgccgtactgtggatgtacagatggatgcatgtaaaaataatcacattgtgtttacaagaagaaagaatcaagtttagccccttggaaaaaaaaaaaaaaaaaaa

SEQ ID NO: 17673 - DNA, 1128 bp, Triticum aestivum
  Clone ID: PAT_TA_17673
tgtgcggcgctcgaggcggccggctttgtcatctgctctcggcgccctccccccccccccagcccttcgccgattcctcctcgtcgccctcccccctcccctggcgacctaccaccgccgcccggcccccgccgtgccctagccccgcctcgccgccggcggcctcgctccccagacccctccctccctccgcctcccacgcgtctccgtcgcctcctccgcctccgacgcgcgtccgcgtcccgcatcgccgcgaccccgcccgatcccgagcttgtttgagcatccattcgtacagtatgtcggagaagccatctgatgatacgactggccaggtgaggcctgaaggagatgtttctgatgtgaaagtggaaactggcaaccaggcataaaggaaatgagatgccatcagcacagcaagaggaagcagtaatcaacgaaaaaagtatggaggagtactgcccaaaacgtcaccactcatatccaagagaccatgagcgagcttacttgggaaactgactggatcgggctctgggaaagtaaggccggcatcctaacaagcctaaccgaaagctcgacgtacttcgccccaaaccacatcacacccatccccaagcgcattcacgtggactccgtcatgcatccactcacaccgacgagggcgacgaccccgcaacgggggttacgacgacgacgccaaggcacccggagacaaccaagccaccggagagcaccgatgtcccctagtgaaccgaactctgccatttgatcggaacactcccattcgttgctctaatgataagaagtgtgggcgccctgtaatcgcttggctgtattttaaaccgaagtgtctgcaggacaggccgttcaccgaccgcgctttatccttcgagggactgcattccgcctgttaacagttctgtatcagttcggtgtgggaattagaacatcgcgctgagtttggtcccggggtcgtacaggtagaaaagcatgaacctgagacctagacaattacagagataaataaaaaaacggctgccggctggtttctggctgtctgaactcccccgctgtaaggtttaccgtttgaattccgtggaatttcatgaagggatcgtgtaaaaaaaa

SEQ ID NO: 17674 - DNA, 503 bp, Triticum aestivum
  Clone ID: PAT_TA_17674
accttcaaacagaatatcttccttcgttctaccagcagcaacaagtaatccttgatgccagactgcctgatcaaagcattcggcagtagaggatccatggctatggagaggttcttcacggcgctcgtcttctgcgaggccccgctggacggctacggcacatcggtgcttaccgccggcacggtcaaaaggctggtctcaggtggcggccacgcgacgaagccagcagtggctaacaagccggactctgagaaggcgcagggttacttcactggcaagccgacggcgcagcggcgccccgggttcgagctcgcgttcgacgggctcaattgctttgacaccatcgtcatgcactaagcaagtcagtgtcatgccggctttcttgattttgatcagtaattctgtatagaattggatcggttagatgcttgacacgtacttggggctgtgattttttttgttcattcgattgtactcttcgactggtgcataagcttcaatac

SEQ ID NO: 17675 - DNA, 541 bp, Triticum aestivum
  Clone ID: PAT_TA_17675
acacaacaagaatctctccgttcgttccacaaagcagcagcaaggaatcgttggtgccggactgcccgatcgaatcatccgtcagaggatccatggccatggagaggttcttcacggcgctcgtcttctgcgaggcgccgctggacggctacggcacatcggtgctcaccgccggcgcgatggacaggccggtctctgccggcggcagcgcgacgaagccggcggtggctaacaagacggactctcagaaggagcagggactcttcaacggcaagccgacggcgcagcggcgccctgcgttcgagctcgcgttcgacggtgtcaactgcttcgacaccgtcgtcatgcactgagcatgtcgctttctcgattcttatatgtatagaacttgggtcagctagactgttttgacacgtaagtggacttgtgatgatttgttcattccattgtagacagtagtgcataagcttcatcaataaagatgatatgaatttaaagttaatataaatataatcagattacggataatgcggatcaaagt

SEQ ID NO: 17676 - DNA, 624 bp, Triticum aestivum
  unsure (1)..(624): unsure at all n locations
  Clone ID: PAT_TA_17676
agttncaatttgaaggaacggccgccgggggcggggactacgaagaatctcctccttcgctcgaggagcagcagcagcaaggaatccttctttccagactgcctgattcaagcatccgtcagtagaggatccatggctatggagaggttcttcagtagaggagcggcgctcgtcttctgcgaggcaccgctggacggctacggcacatcggtgcttaccgccggcacggtcaaaaggctggtctcaggtggcggccacgcgacgaagccagcagtggctaacaagccggactctgagaaggcgcagggttacttcactggcaagccgacggcgcagcggcgccccgggttcgagctcgcgttcgacgggctcaattgctttgacaccatcgtcatgcactaagcaagtcagtgtcatgccggctttcttgattttgatcagtaattctgtatagaattggatcggttagatgcttgacacgtacttggggctgtgattttttttgttcattcgattgtactgttcgactggtgcataagcttcaatacaaacgaaaggaatttaaaggggacatctcctagtatcattttatgtcttcaaaaaaaaaaaaaaaaaaggccccta

SEQ ID NO: 17677 - DNA, 968 bp, Triticum aestivum
  Clone ID: PAT_TA_17677
cctcgtgccgaactcggcccgaggccgccgtacaactaaacagattccaacacaactacagtagtaccgtgctagtagaaatggccggaggaggcgatgagctgaagctactcggcacgttcgcgagcccgttcgtcatgcgagcgaagctggcgctcagcttcaagggcctgagcttcgaggacgtcgaggaagacctggccaacaagagccagctcctcctcgagtccaacccggcggagaagaaggtgcccgtgctcatccacaacggcaagcccgtctgcgactcgcgtgtcatcgtgcagtacatcgacgaggccttcagcggcaacggcgcgcctctcctccccgccgacccctacgagcgcgccgtcgctcgcttttgggccgcctacgtcgacgacaagctcttggcgtcttggctgcaggccgcgaggggcaagacggaggaggagaaggcggaggggctgaagcagacgctcgtggcggtggagaccatggaggcggccttcaagacgtgctccaaggggaagcctttcttcggcggcgacagggttgggtacctggacgtgacgctcggcggtctggtcgtctgggtgcacgccggcgcggcgctgtatggcatgcggcttttcgacgacgccaagagccctttcctggcggcctgggtggagcgcttcggcgcgctggacgccgccaaggctgtcctgccggccgtcgaaagagtggtcgagttcgccaagatgagacaggcgcaggctgcggcaccggccacggcaggaggcaactaagctgcccataaccacgtgtttagacatcatcagctcggagtctgcaatgctacgttgccaacaccagagtgtgttactgattgttgtactggttccgttgctcttgcgaataaaaaatttctcagccatcgccaatatcggctggctggagcgtgatcaaaaaaaaaaaaaaaaaaa

SEQ ID NO: 17678 - DNA, 621 bp, Triticum aestivum
  unsure (1)..(621): unsure at all n locations
  Clone ID: PAT_TA_17678
aaatatcaaaatgactgatatcaagaattactctctaggcaactttacgctccaaaacagcagtgtattgcccagagcgtggatctcttacaaaacatttggtgatccttctctacccgctgttctctacccttcatggttctcgggcgccatctcagataacgagtggctcatcggaaatgacaaaacactttctccggagaagtactttattatcataacggctcttttcggaaatggacagtctactagtccttccaactcggatatcactccctttccggatgtatccttctacgacaatgtcaaagcccagcatcaactcatgacccatttgggaatcaagcatctccgtgctgtactcggatggtctatgggcgccgcgcagagtttccaatgggctacgcagtatcctgactttatggacatttgtgttccattctgtggttcagcacgaacatcgcttcacaaccaggtttttctcgagggcgttaaatctgcacttttagcagcaaaaggagcgacttcagcgggaagtatcaaaggacgtgttgagtccccgtcatacagcgagagaaactggaccgatnaagaaaagacgtcgggntgaaagcttttgga

SEQ ID NO: 17679 - DNA, 397 bp, Triticum aestivum
  Clone ID: PAT_TA_17679
gccggccgttccgggaacttcgtgatccgtctccgtcgacacagggaatcaatcagcagcaatggcgaagtcaaagaacagctcccagcacaaccagtcgcgcaaggcgcaccggaacggaatcaagaagcccaagacttcccgttacccttctcttaagggtaccgaccccaagttccgacgaaaccatcgacatgctcttcacggcaacatgaaggccctgaaggaggctaaggagggcaagcgcgaggtcgtctaagcacccggcaaaggaatattgaggcgtcaatttggagcattcgcattgctcggttacggcatacacacgatagaacctgcgcaaatgaacgatggaaaataccgaacgaaaaaaaaaaaaaaaaaaactaggccccta

SEQ ID NO: 17680 - DNA, 399 bp, Triticum aestivum
  Clone ID: PAT_TA_17680
gccggccggttcggggagatccgtctccgtcgacagagggaatcaatcagcagcaatggcgaagtcaaagaacagctcccagcacaaccagtcgcgcaaggcgcaccggaacggaatcaagaagcccaagacttcccgttaccctcctcttaagggtaccgaccccaagttccgacgaaaccatcgacatgctcttcacggcaacatgaaggccctgaaggaggctaaggagggcaagcgcgaggtcgtctaagcacccggcaaaggaatattgaggcgtcaatttggagcattcgcattgctcggttacggcatacgcacgatagaacctgcgcaaatgaacgatggaaaataccatacgattagcccgaccaaaaaaaaaaaaaaaaaaggccccta

SEQ ID NO: 17681 - DNA, 554 bp, Triticum aestivum
  Clone ID: PAT_TA_17681
ctcaggccacccgttaccttcgggctcgcaacttcgtgatccgtctccgtcgacacagggaatcaatcagcagcaatggcgaagtcaaagaacagctcccagcacaaccagtcgcgcaaggcgcaccggaacggaatcaagaagcccaagacttcccgttacccttctcttaagggtaccgaccccaagttccgacgaaaccatcgacatgctcttcacggcaacatgaaggccctgaaggaggctaaggagggcaagcgcgaggtcgtctaagcacccggcaaaggaatattgaggcgtcaatttggagcattcgcattgctcggttacggcatacacacgatagaacctgcgcaaatgaacgatggaaaataccatacgattagcccgaccaaaaaaggtggtggatgccgatacgtacgtctcggcgaatgatgctgtgacagtcccgagtaaagcatgttgcttggtttccaggaacatgaggtagaatactgaacactactgcctgaactccaaaaaaaaaaaaaaaaaaggcccctagtcccagttct

SEQ ID NO: 17682 - DNA, 1267 bp, Triticum aestivum
  unsure (1)..(1267): unsure at all n locations
  Clone ID: PAT_TA_17682
cgctcatccacaagncgcctgcccaagncgctctcgcacatccgcgggctcaaggacatgatccccatccacctgcaccccaagcccaacgcggcggaccaggaggtccgtttccagtgcccggtcaccgggttcgagttcaacggcaagtcccagttcctcgtgctccgtggatgcgggcacgtgctgagcgtgaaggctctcaaggaggtgaagtcgtcctcgtgtttggtctgccataaggagtttgatgagatggacaagatgcccatcaatgggaccgaggaggaggtggaagtgttgaggcagaggatggaggaggagagagggaagctgaaggagaagaaggataagaagctggcgaatgggctcagtgggagtaagcatgctgctgctgcggttgcagacactgagaagttggagaatgggaagaaaggggaggctgccccagcaaagcggtttaaggctgcagatcatgcaccggctcatgcaaacaagaaagtgtatgcgtcaattttcacttcttccaataagtctgatttcagggagacatactcatgccggtcactccccctgggaaggaattaaatcgacgttggggagattccaatggcgtggaggtgaacctcttgtactgattcagcgattagcttcataccatggctcgtccataagttctggtattattgttttagctgttggtgttatctatgcttgactgctgtgtggagctttctagttttcactcgcagagaagcaatatgtttttataaatgatttgtgaaatatgtaatggctgtaacacatatcattgagtccagtcttctctagcaattgtccgaagtaatgctgtggtttccatccagggagaagatttgttttataatgattcgtaatacaactcattgatcgtcgttgcacgccgtccttaccgcgaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttggtaaatcagctcattttttaaccaataggccgaaatcggcaaaatcccttataaatcaaaagaatagacccgagatagggttgagtggttgttccagtttggaacaagagtcnctattaaagaacgtggacttcaacgtcaaanggcgaaaaaccgtct

SEQ ID NO: 17683 - DNA, 922 bp, Triticum aestivum
  Clone ID: PAT_TA_17683
gccggccgggtcggaattctctcttctctcaatccctttattctctcctccacctcatccatcatgtctgctcccgcccacaaattcaaggtcgctgacctttctcttgccgcctttggccgcaaggagatcgagctcgctggggccggccgggccgggatctacaaaacccccctccccctccatgaattttctacgacgcttcactccgcttcgatcattctctcgaacattcacaacaacacgcgccatcatgtctaagctttacgttggaaacctgtcctggaacaccaccgatgagactctccgccagaccttcagcgagttcggcgaggtcaccgactctatcatcatgcgcgaccgtgataccggccgtgcccgtggtttcggtttcgttaccttcagcaccgaggagcaggctaccgctgctgtcgatgccctgaacgagcaggagcttgacggtcgtcgcatccgtgtcaacgtcgccaacgcccgtcctgccggcggtaacggcggcggcttcggtggtggccgaggtggcggctacggtggtggccgaggtggttacggcggcggtgaccgcagctacggtggtggtgaccgcagctacggcggtggtgaccgtggtggttactaagagacttgacttggcttttgacttcttcacttgacttccggatcaccagacgcgggttgacatgtatcgtcgaccccaaacgaaaaaataatgaatggatgatgggtttggccgctaaaaacccagtcgcttgagattgacggtggagagggacttttcaaagataccataagacaacagacagaactctgaactttttctcatcaaaaaaaaaaaaaaaaaaggcccctaatgcacttcatgggccgccctacctgaaacttccccctaatcacagttttttgg

SEQ ID NO: 17684 - DNA, 1736 bp, Triticum aestivum
  Clone ID: PAT_TA_17684
ggtccccggcccaccccaccccccccccccgcccggaccgcatctcctcccctcacctcccacctcccggtccccgcgccccctgacccctccccgcccgccgccgccgggaactttcttccgagctcgatccatccagtggccggcgacagcgaccgcccgccgcgcggatcgatccagcgaccaacgtggagcacggctgctagccgtgccctctcagtcaacccaagtcgcaccacgtgccaccaccttgaccagctccgccgctgctatttttctccctccattcctccccccgccccggcctcccctcgcaccgacggcgccccggccgctcctccccgtccgccgcgccgcgcccccgccgctcctccccgtccgagatgcctcagctccggcgtggaggtcacgatgcggggcaagtagccgctgggaggagtcccgctctagggggcggcggacgataagcgcgtcgatacgctccgtacctgcaccggtacattccccggatgtaaaactccggcttagtcagataggttcgaggatgatgaactgcggcataatcaaagagaattgcagcttaaatacgaggagaatggagatgaacatcaatcaacaaaaatgaaggtggaagatgtgcagttatcaatggatgacctcgaaatgattcaggtcattggtaagggaagtggtggcgtcgtccaactagtgcggcacaagtgggtgggcacataatatgcattgaagggaattcaaatgaacattcaggagtcagtacgcaaacaaatagtacaggagctcaaaataaatcaagcaacacagagcccccatatcgtcctttgccatcaatctttttaccacaaatagtgtaataatatacttgttctggaatatatggcacgtctagcacttgctggcatgctggattaggatagattgatactggatcctcacgtaacagttctttttcacagagacataaagcgttctaacttgttagtcaatccataaaggtgaagtacagattgcagataatggggtgagtgcagtgctagcaaaaccgatagaggtagcgtgatacatttgttgttttctagagactgcatggcgaccgagctcattcggtggccgcgactctgtcgttgagaacctacaactatattgcgcctcttgggaatagtggcagctcctattactacaagagtgatatatggagtttgggcttggtaatacttgaatgcgccattggccgcttcccctatactcctccggaaggagaaggctggctaagcttctatgaactattagaagcaattgttgaccagccaccaccttctgcaccagcagatcagttctctccagaattctgctcatttatctcttcctgcatacagaaggaccccgccgaacggatgtctgcttcagaactcttgaaccatgccttcatcaagaagttcgaggacaaggacctagacctggggatcctcgtcgagagcctcgagcagcccatgaatgtgcccgagtgaggccgtcgctcggggaggtgaggccttgcggcgagtttcttccagggctgccctcctgacggcaattgtgtattgctgtgaacctgatgaatgagtgaccgaccccccacccctgtatgtgatgatgtttatgttggaaaaattcctagaggattggaatggattattaatgtatggtaatgacttgaggcccttttgttgcgcgtctaa

SEQ ID NO: 17685 - DNA, 1129 bp, Triticum aestivum
  Clone ID: PAT_TA_17685
gccggcggtcgcagcatctttcattcgtgtctgaagcagcagccattgcccattgccgagagtggagtggtagagcagttcgagtttgcttttctctcttgcttgattgatcggtgcctcgatccatcgttcgtcggcggtgcatatagttagcgaggaattctcgggccggccaccggcgacgacgaccgcgagtgatccgtgaggatggtgaacacgacggcggctatggtgagcggcggcgtgctgccgctggcgtccctgaaccacatcagcatagtgtgcaggtcggtggaggagtcgctcgacttctacatgaacgtcctcgggttcacccccatccgccgccccggctccttcgacttcgacggcgcatggctgttcaactacgggatcggcatccacctgctgcagtcggagcatccagagagcttaccggcgaagaaggagatcaaccccaaggataaccacatctccttccagtgcgagagcatggtggcggtggagcggcggctcaaggagctgggcatcccgtacatccagcggtgcgtggaggagggcggcatctacgtggaccagatcttcttccatgaccccgacggcttcatgatcgagatctgcaactgcgacaagctcccggtcgtcccgctcgccggccagaacttcgccatggccgcctgcaagagggtcgcctccgtcaagcaacagcagctgcccatgccagtcgcacaagtagcgcaagcaacccctgctccggcggcggccgcggcttcgcagtgcgttccggcgccgaacccggccttgcagcgcgtcggcggcgaggaggcggcgcatatctcgtgcgcgtgaggggtggggggccggggtagccaggccgcccaactggtgggtggcgcgctccgtggagttgtggtttttgtacattgtgatacgacagtgtgcgtatgaataaagcgaggggagcagagtgtagtttcagcttcaaatctgcgtctcggagcggatgagccctctgtttgctctgtttttcctccccgtccttcgaactactgtagtaggccagtatttaaccaaaaactaccacatttcactaaaaaaaaaaaaaaaaaaggcccctgggctcgagcgg

SEQ ID NO: 17686 - DNA, 970 bp, Triticum aestivum
  unsure (1)..(970): unsure at all n locations
  Clone ID: PAT_TA_17686
cgggaatctagcttttatggtctgtgatccgatgaagcttgcaccttctacacctacagggtatgcttctgcatcatcaactgcactccttgcatcaaagatggatgtgccaacacaatttgggatccccatccctgcagtatgtgaatggttaaaacagcactggagtggtagcttggaagatgttagcaagccaatgatgccccctgcacgattaatatcttctgctggacaacgangtgaaccttcttctctgagtcatcttcattatattaanaccactgnagcgagagggtggggcattgtcatcatcgcagatgccagcaanaccgacacggcagcatgggtcatgcagttcagcatctgccaagatttcatatggtgaaaangattctgttaattcacactcctttcaaggccaacgagatcagcctcacagatgcccagacctaaggagcaacctggttcggtcatggatagctttcctcctgggcatccaagatctattttcttaccgcttcctctaaagcaaatgatgcctgtcgataataagatcaaaccgaactgctcagtttcagatgaatcacgggtagctaatgcgcgaatcaactgcgatgctatgcacaatgttgcttaccaggaaaactgctggaatgaggcacagtcaagttcttcaccaccggcaatatcagaacaaggagataagagggacggcttcagcagcggggaggagacaatgtactccgcggaaactatggaaagcagaaacattcccagtccaaaggacaagaggccccagatagttggccggtcacagagttttgcgaaccatagcaaatgggattcacctaaaagtgttgaatcttcgaaagggccgccctcaaggtcgcacacattcattcctttgagaaaaccacacttgcaagcggcatcaatttcacagaaaagccaggtttattttagccccact

SEQ ID NO: 17687 - DNA, 654 bp, Triticum aestivum
  Clone ID: PAT_TA_17687
gccgtcgccgtcaagacggagaccgcggaggcgtcggcgtcccgggaggacgcggcgggggttgagagggcggtgtcggagagcccggtcgtggtggtggggaggcgggcctgctgcctcacccacgtggtgaagcggctgctgcaggggctcggggtcaaccccgccgtgcacgaggtcgccgacgaggccgcgctcgccggggtcgtgccggacggcggggaggcagcggcgctcccggcggtgttcgtcggggggaagctcctcggcggcctcgatcgcctcatggccgtccacatctccggcgagctcgtgcccatcctcaagaaggccggcgccctctggctctgatcggacccttccttcctttccttagtttcctttcgtcagaagacggtgccgcggtgtaatcctggccgttggatcgaatttactctaggattttgggtttctttaatggtgtgctaaattttttctcaacaaatatatttatgagaaaaaaagaaacagacagctagcgttactgattttggtaatttatttcgtctggtcatgagcatgtgaatacggaagaagagcatgggcggcattgcagcgtctgtacagtttgtcgtttccatttccgagttaatgtgaatcagatgcttcttacgg

SEQ ID NO: 17688 - DNA, 771 bp, Triticum aestivum
  Clone ID: PAT_TA_17688
ctgtgcggcgctcggccgctcgaggcggcgggcgcagacgcccagccatcgtgcacacgaaccacacaccggcgcaagacagggaaaagagggaaggtcgggagcatccacgtagtggtgcgcaatgtaccaagcaatcccctacagcagcacccggccctgggcccgcccgtcgccggcggcggagccggccgtggccgtcaaggcggagaccgcggaggcggcggcgtcccgggaggacgcggcgggggttgagagggcggtgtcggagagcccggtcgtggtggtggggaggcgggcctgctgcctcacccacgtggtgaagcggctgctgcaggggctcggggtcaaccccgccgtgcacgaggtcgccgacgaggccgcgctcgccggggtcgtgccggacggtggggaggcagcggcgctcccggcggtcttcgtcggcgggaagctcctcggcggcctcgatcgcctcatggccgtccacatctccggcgagctcgtgcccatcctcaagaaggccggcgccctctggctctgatcggacccttccttcctttccttagtttcctttcgtcagaagacggtgccgcggtttaatcctggccgtcggatcgaagtttacaccagcggccgatttactctagagattttgggtttctttacatggtgtgctaatttttttctcaaaaaatatatttatatgagaaaaaaggaagcaaaaacagaaaaaaagcctgtgcggcattgcagcgtctgtacagtttgtcg

SEQ ID NO: 17689 - DNA, 853 bp, Triticum aestivum
  unsure (1)..(853): unsure at all n locations
  Clone ID: PAT_TA_17689
ctcgtgccgaattcggcaccaccaaccgcgcgccactgatccatcaactccactccactagctacgtaccttccgaccgagcagccagagagatggagaggatggtgatgaggctggtgaggaacaagcagtccctccgccagctgcaaggggccgccgccggcggcctagcgtcgtcgtcctccgcctcctcgaccgccggcgccgccgcgtcctccttctccaccctgcagcagcagcaggaggaccaccccggagtgctcaacatcagggacaccgccgcccacctcatcggccggacgccgctggtgtacctgaacaaggtgacggaggggtgcggcgcccgcgtcgccgccaagctcgagttcctccagccttccttcagcgtcaaggacaggccagcaatctccatgatcgaagacgcggagaagaaggggctgataaccccaggcaagacgacgctgatcgagcccacatccgggaacatgggcatcgggctggcgttcatggcagcactcaaagggtacgagctcgtgctgacgatgccatcatacaccagcctcggagaggagggtggtcatgaaggccttcggtgcgcagctcgggctcgctgacccgggccaaaggcaccggcgggaccgcaacgcagatctaacccaaccctaccagaaccttcctgcgcgaccttcatgcgccacgcagttcgagaatcccgccaacgtccaggtgcactacgagactaccggtcccgggggatttgggggggacacgctcgggcaaggtccgacatcttcctcatggggaatcggcaaccggggggggcccgttaccgggcggtccggaaaantacctt

SEQ ID NO: 17690 - DNA, 976 bp, Triticum aestivum
  unsure (1)..(976): unsure at all n locations
  Clone ID: PAT_TA_17690
tatgcactancacactggcttggggtgtcaatcctcccgcccgccggcgcgtgggcaagggtactgaatactatgacgggaaaacaaaaagatatgttgattatgttatcacagatattctgcaaatgatgggtcgtgctggccggccacaatatgaccaacatggcaaagctgttattcttgttcatgaaccaaaaaagagcttttataagaagttcttgtatgaaccgttccctgttgaaagtaatctgagggagcacttgcacgatcacataaatgcagagattgtttcgagcacaattggtaataaagaggaggcaattatctatcttacttggacttacctatatcgcagactggttgttaatccatcttactacggattggaagatactgaaacatataccttgaatgcttatctctcgaggttagtggaaactacacttgaagatcttgaagacagtggatgcataaaagtggatgaccattctgtgcagtctttaattttggggaaaatagcttcacaatattaccttagttaccttaccgtctcaatgtttgggtcaaatattggtcccaatacacaatgggggccttgtgctgcacgtcccggcgcctgctccaggctccgtccgcttccgggttccccatcatcctcgcaccgtccttccgttcccctgcgaaaaggcccttatccagtttacaacacacctttgataccaattcnaggtattaccctcccaagaacttctccaaagcaattccatttnngacatacacgatntaacacctgatnanacatctnttaacagntatgatgattttgcacatggtggntcaatgcattgcattagcacnctaaatgttataaggtcctggttaanaatcacanctgagtacatcatgatgaaacctcanttactaggagggnttcaattngctnaantttccgaatnnaatgcncactttntnggag

SEQ ID NO: 17691 - DNA, 929 bp, Triticum aestivum
  Clone ID: PAT_TA_17691
gagcggccgcttctttcctcctcatccattcgctcttacactgcatcttacactcgttgtatctcgccttatcaaccaacaagaacaaaaaaacaaacaaacacacattcaaaatgaagtactccgtcgctttcgtcgctctcgccgctgttgccgctcaggctcagtctcttgccgacgtccccaagtgcgccattccttgcctcgacaaggccatcgccagcgagaccagctgtgacaagaccgacctcgcctgtgtctgcaagggcttcagcgctgtccgatccaaggctacctcttgtgtcattgacgagtgtggtaccgacgttgccatcaacgaggtccttcccgctaccgagaacctctgcaagaacccccccaaggagtctgaggccaagtccaccgccgaggaggagaagcccaccaccaccgccgctgccacctccaccttggtcgttgtcaccaccagcgccgaggttgttgagaccaccgccgctgccaccaccactgtcgctcccatcattcccaccaccgctgctgaggagcccgccaccagcacccccgccgctgccacccctaccaagggtcccgagcaggccaacggtgctgctggcctcaagggtctcggtgccctcgccatggctgctttcgctgcccttgctctgtaaaggagtttaaggaaccagcttgtcagttatgaaaagaccaattcctcaagtagtcgaactggacagccaatgtgcatctggtgagacgaacggggtaagaggcattgttttttttaaagttgaaaggacgatattgattatgtgtatgagaattggaaacgctatcgggaatcgattcacgggttaatagtaatggtctttgaccacaatgaatataagcgaatataccagtgacaatcaaaaaaaaaaaaaaagccccta

SEQ ID NO: 17692 - DNA, 1231 bp, Triticum aestivum
  Clone ID: PAT_TA_17692
ctcgtgccgaattccgcacgagcccgaccgcccccccaaccccccccaaaccacccaccgcagcaacaagggcaagcgtgcgtcagcatcaaacgacggcccgtcccggattgtgattcgcggaggcgttcctcggcgcccagatgagctcccggatggccggatcggtcctcctccgccgcgccggcgccggcgccggccgcctcttcgccaccaccgcgtccccggcggccaggaccgccctcggtggaggtgagggcgcgtgggtgcggatgatgtccacctccgcggcctcgcaggtcaaggatgaggcggccaagggggtcaaggcggaggcggccaaggccgtgcgacggggagaagaaggaggtggccatcagcagctactgggggatcgagcagtcgaagaagctggtgcgcgaggacggcaccgagtggaagtggtcttgcttcaggccatgggagacgtacaccgctgacacgtcgatcgatctgaccaagcaccacgtgcccaacacgatgctcgacaagatcgcctactacaccgtcaagtccctgcgcttccccaccgacatcttcttccagaggaggtacggctgccgcgcaatgatgctggagactgttgccgccgtgccggggatggtgggcggcatgctcctgcacctgcgctccctccggcgcttcgagcagagcggcggctggatccgcgcgctgctggaggaggccgagaacgagcgcatgcacctcatgaccttcatggaggtggcgcagccgaggtggtacgagcgcgccctcgtcatcgccgtccagggcgtcttcttcaacgcctatttcttcggctacctcatctcgcccaagttcgcacaccgcgtcgtcgggtacctcgaggaggaggccgtccactcctacaccgagttcctcaaggacctcgacgacggcaagatcgacaacgtccccgcccctgccatcgccatcgactactggcgcctccctgccaacgccaccctcaaggacgtggtcaccgtggtccgcgccgacgaggctcaccaccgcgacgtcaaccacttcgcatcggacgtgtactaccagggtatgcagctgaaggccaccccggcgccgatcggataccactgaggctggccgtgttctgctgaattttgcaacgctactactgctactaccaccaagcaaatgagtgtttcgttttggaaggcagaggaaatgagagcta

SEQ ID NO: 17693 - DNA, 1540 bp, Triticum aestivum
  Clone ID: PAT_TA_17693
gcacgaggaaggtaacaaaccctacccccatccctgcccccgcgtcgctcctctcggggcgactcgggaggcggcgaaccctaaccgccgcgttcccctcccctgctcctcccccctcgccgctgccagaggaggtctccggcgaagcccgcgcgcctaccaatgatggtggcggcgaggatctggccgctccggctctgctaggagggcttcggctcacgaggcggcggcctcggatggtgcggcggtgttggtttggcggcaaccaatgctcgattggtggtgctctccctcctcctcggccgtgtggacggcgtggcggcgggcgttgggcgcaggttgcactctcctcttcttctcatcctctccccccatcagacctggcccctggcggccgctggtcgccggatccactgtcgacggggctgctggaggggtggtagcggaccgggagaaatccctggctggattcccggccacgacgacggcgacacctcctggtgtcgtcttcctccttggaggcgccgtcgaggtgcgtttacccccttccctcccactctcatgcccgggtgaaaactctagtctcttcaggctgggcggcagcggcgtttcatgcgtcgtcatcttcttgaaggtgccgccttgggtgagttgggggtgtgcaggggcgatgggtgtggtgtcaagtgtgtggcggctttgcaggaggagttggcgccatggtcttcttgttggggcaatgctctgctatttggttgttcgttgcctgtcttgtggctgtttgttcgctggctctcagtgccatggcatggacagggtgaagatagggttctttccccgttggcagcaacagggcatggaaggcttgaacttggtgctgattccagcgggtgctgtcctgctatctgcattggctgccttggctcccctgcttgcaagttcttcttcaacctcgctcaacagcagcttctcttccttgggtgtggattactgtgtcttgaagagactcttcgtttggtgttcttagcgcagcaggtgggtcgtgctgagaatctcccatggtgacctggaagcttgtaccaatccttgctcaggggagcattgccacttgccaacggtacggcgcccttcgatccagggcgaggggcaggggtccccttcggaagtggagagggtcaatacgagaacggcgttcacctatcgaagtagatgagggcatgtccatctttgctgggctgtaactccccctgaagtttgctctctgtcagggttatggtgctccactcgcgcattgaagggcttcggcaatatcaagctagtctgtactgtttatttcctgtttgcttgttcgtgttggggctagtaggttgtttcgggcatcaccttgtatctgccgtcttttttttgttttcctttttttgcttgtttgctatgcttcgttgtaattgcgggtgtttgtatctcctggccggttgttggctttgttaattcaaagccgggctcttcttgagccttcgttctaataaaaaaaaaagtaccc

SEQ ID NO: 17694 - DNA, 337 bp, Triticum aestivum
  Clone ID: PAT_TA_17694
gcggcgtacctctcgaattccacgcccctcatcccctccaggatctgagcaaaacccacgcacgaaggcaagggggtcgcgagaagaagaagaagaagaacaaacatcgtacggtgccctgctccgggagcagagcatgcaggcgtagtacactactggttctggttatactctctgtatgtaaagttaattttcacacacccatctgtgctaaaggagtataatttcgtcaactgaagctttaattaaaggaaattgaacccggattaatattaaaaaaaaaaaaaaagggcggcccgctcgcgatctagaactagtccggacgcggggtcgaccc

SEQ ID NO: 17695 - DNA, 768 bp, Triticum aestivum
  Clone ID: PAT_TA_17695
gtccaagctccgcactgactcgcagcacaccatcaaggccatctgcatcgtccacaacgagaccgccaccggcgtcaccaacgacctccacgccgtccgcaagctcctcgatgcgtaccggcacccggcgctgctgctggtggacggggtgtcgtccatctgcgcgctggacttccgcatggacgagtggggcgtggacgtggcgctgacggggtcgcagaaggcgctgtcgctgccgacggggctgggcatcgtgtgcgccagccccaaggcgctggaggcggccaagacggccaagtcggtgcgcgtcttcttcgactggaaggactacctcaagttctacaagatgggcacctactggccctacacgccctccatccagctcctctacggcctccgcgccggcctcgacctcctcttcgaggagggcctcgacaatgtcatcaagaggcacacacgcctcggcaccgcaacaaggctggcggtggcggcgtgggggctcaagaactgcactgcgaaggaggagaacttcagcgacacggtcaccgccgtcgtcgtgccgccgtacatcgacagctccgagatcgtgaagcacgcgtggaagcggtacaacctcagcctcgggctcgggctgaacaaggtcgccggcaaggtcttcaggatcggccacctcggccacctcaacgagctgcaacttctgggctgcctcggcggggtggagatggtgctcaaggacatcgggtacccggtgaagctcggcagcggcgt

SEQ ID NO: 17696 - DNA, 1586 bp, Triticum aestivum
  Clone ID: PAT_TA_17696
gcagtgggccgcgccgcgcggctcctcccccggtcaccggcgagaaaaagcacgatggactacatgtgatgggccaggccggaaccacctggttcgtccctgggccggtgaacattccggaccaggtgatccgcgccatgagccggcagaacgaggactaccgctcgccggcgatccctgccctcaccaagaccctcctggaggacgtgaagaagatcttcaagaccaccaccggcacccccttcctcttccccaccaccggcaccggcgcctgggagagcgcgctcaccaacacgctctccccgggggaccggatcgtgtccttctcgctggggcagttcagcctgctgtggatcgaccagcagcgcagcgcctcggcttcagcgtggacgtggtggagtccgactggggctacggcgccgaccctcggcgctcctcgaagtccaagctccgcactgactcgcagcacaccatcaaggcccatctggcatcgtccacaaacgagaccgccaccgggcgtcaccaacgacctccacgccgtccgcaaagctcctcgatgcgtaccggcatcccggcgctgctgctggtggacgcgggttgtccacctgctccccggactaccgcctggacgaggcgtgcggcgcgcggggggcctcgacggcgtcatcaagaggcacacacgcctcggcaccgcaacaaggctggcggtggcggcgtggggactcaagaactgcaccgcgaaggaggagaacttcagcgacacggtcaccgccgtcgtggtgccgccgtacatcgacagctccgagatcgtcaagcacgcgtggaagcggtacaacctcagcctcgggctcgggctgaacaaggtcgccggcaaggtcttcaggattggacacctgggccacctcaacgagctgcaacttctgggttgcctcagcggggtggagatggtgctcaaggacatcgggtacccggtgaagctcggcagcggcgtggcggccgccgccggcgtacctctcgaattccacgcccctcatcccctccaggatctgagcaaatccaacgcacgaaagcaagggggccgcgagaagaacaaacatcatgcagtgccctgcttcgggaagcagagcaggcgtagtacactactgggttgcgtgggttatacttctgtgtaggtataagttgattttcacacacccgatctgtgctaaaggagtataatttcggtgcatctgaatctttaaccacagacccttgaaccctcattgaaattgaagcaaatcccaggcacggaaaagcaagggggggtcgctgaagaaagaagaacaaacatcatgcagtgccctgcttcgggaagcagagcaggcgtagtacactactggttctggttatactctctgtatgtaaagttaattttcacacacccatctgtgctaaaggagtataatttcgtcaactgaagctttaattacagaaaattgaacccggattaatattacaaaacgtgcctcttttagatggctaggcttggtattgctgattgatctactctgtttcctgctactgtacataagctgtttacagtatta

SEQ ID NO: 17697 - DNA, 2168 bp, Triticum aestivum
  Clone ID: PAT_TA_17697
gggcgcggcgccccgacgccgccggcgccgcgccggcggtgggctccggcgcctccttccgccgcgtcctgggccaggtgctgagccaccacctccggcccacggcggagcccaacccgctccggcgctggtaccgccgcgccagctacttcctggaggacaactggcggcgctgctgggtgatcctgctgtggctctccatctgcgggggcctcttcacctggaagttcatgcagtaccgcgagcgcgccgtgtgcaaggtgatgggctactgcgtgtgcgtggccaagggcggcgccgagacgctcaagttcaacatggcgctcatcctgctccccgtgtgccgcaacaccatcacgtggctccgcaaccgcaccgccgcgggccggttcgtgccgttcgacgacaacatcaacttccacaaggtgatcgccgcggggatctccgtcggcgccgggctgcacatcatctcccatttggcgtgcgacttcccgcgcctgctgcacgccaccgaggaggagtacgagcccatgaagcccttcttcggcgacgtcaagccgcccaactactggtggttcgtcaagggcacggaggggtggacggggctggtgatgctggcgctcatggccgtcgccttcacgctcgccacgccctggttccgccgcggcagggtccgcctcccggggccgctcagccggctcaccgggttcaacgccttctggtacacccaccacctcttcatcatcgtctacgcgctgctcatcgtccacggccacttcctctacctcaccaagaagtggcaaaagaagtcgacgtggatgtacctggcggtgccgatggtgatgtacgcgtgcgagcggctgacgcgggcgctgcggtcgagcgtgcggccggtgaagatactcaaggtggcggtgtaccccggcaacgtgctgtcgctgcacttgtccaagccgcaggggttccggtacaagagcgggcagtacatcttcgtcaactgcgccgccgtctcgcccttccaatggcacccgttctccatcacgtcggcgccgcaggacgactacgtgagcgtgcacatcaggacgctgggcgactggacccgggagctcaagaacgtcttctccaaggtctgccggccgcccacggagggcaagagcggcctgctccgggccgagtacgaccgcgacgtcggcgccatgtccaacccgagcttcccaaaggtgctgatcgacgggccgtacggcgcgccggcgcaggactacaagcaatacgacatcgtgctgctcgtggggctgggcatcggggccacgcccatgatctccatcatcaaggacatcatcaacaacatgaagcggttcgaaggagacgtcgagtccggcaaccccggggacgcgagcacgtcggctcgtccttccggacccggcgcgcctacttctactgggtgacgcgggagcaaggctccttcgagtggttccgcggcgtcatggacgagatagctgagtcggacaagaagagtgtcatcgagctccataactactgcactagtgtctacgaggacggggacgcccggtccgcgctcatcgccatgctccagtccctcaaccatgccaagaacggcgtcgacatcgtctccggcacccgtgtcaagacccactttgcgcgaccaaactggcgcaatgtctacaagcgtatcgccctcaaccaccgtgaacagcgtgtcggagtattctactgcggtgcaccggtgctaacaaaggagctgcgtgaccttgcgcaagatttctcgagaaagacaaacacaaaattcgagttccacaaggagaatttttaacttctgtagacaacccagccacaagaagttgctctttttgcggaaagtgtgttaattcagtacatagcaagttattatacttatgagtagagcgactagatcaaaggagatattgaatgtgttgatttagtacatagcaagtcttgtacttatgaaaagtagagggactagatcaaagtaggtattggttgattatgacaagtttgatcagatttcgtcagcttttgcctagaagaataacaatacacttaagcagtgtggaagttgcatgcacaaaatttgcaactttcttaatcaacatccatgatcagtatacagtctgaccaatgttttaatc

SEQ ID NO: 17698 - DNA, 1034 bp, Triticum aestivum
  unsure (1)..(1034): unsure at all n locations
  Clone ID: PAT_TA_17698
gagatncgggacagctcgtgacaaggnagtgccgtattgatggcttcaaccgcacaaagatccacggatctgtaatacagatgtccccaacattatctgaagagccagtcggacatgagaatgagaagatagttacaacagatgatatggttacctcttatcaactaccccctgatggttataatcaatacaagcagtcaggtttggatactctccagagaacaccatgcagatcaaggtacatgggtgtgcaagtgagtcagacggaagaaccttctgatgccaaattggataaaacaaccacaagcagcgtggcgaagagagggtcacatttaagaagatccattcagagcagcatagggaagttgattcatggctctgaaagaaggaatactccacattcagcccaagcaactcctgccaaaatcacaactaacgcaaataatgacggcgcatctccaattactaccaacgcgaggttaagaagaagacagtcactaacaggtctcccacctccatcgacgaccatgtcacgcagatcgtctctaggaggaaagtcggattcgagttcaagtgacagaaaagccaaaacgccacctctgatgaattcagctgcgaaggcaaagagatggctgtgaatcctcagtgaaaatcgtcagagatttccatctcaagctgagcatgaatccgcgatagctgccgagttagagtcatcagcttctgtcaaaccatgatactgctgaaaaaggaacaccaggcgagggttcgcgatgttgagagagacccccacaggttcaggctaggttacattccttgtaacaactgaaacttcttgagaggttacataacatgtggatggagtgtggaaatggaagcaagtaaagaatgcttgttttgtgtttgttgtattctgaatctctgaatgagtcgagaaagcaatgcaaaaatgattcagattaacctagcagccaagtgtcagatttggcatatgtaatttcatggctacttctggaacatttttgtaactgctcgtt

SEQ ID NO: 17699 - DNA, 1717 bp, Triticum aestivum
  Clone ID: PAT_TA_17699
ctaggttcggttagttcatgtcctttggtggctcaatatatgcatttacttgccttatctggtgtgaacctaacatatgacattggcaattccgcagggattgactatatatcagttgctgcgtttgatcacttgatctctgcccatgtggccttcttcaaaaatgcggtaagatgctgccctttaatggtctcaaagaatgtatttgaagccacccttgtcgttctgtgctaatctctgatcttatgctgcttagttcccaagcctacttcagaacattccttcacgagcattactgactaacgaaccaactctggaaacatgttctgcctatatatcagttgactggagtcttggttccacaaattccttgctaatcaacctcttttggggctacaatgcttcttcacactattttgatgcttctctagagaacattaaattcacatatcagtgatgaacttatcggcttagcgattgcattattgattgaaaggccggccgggagaggatcaatttcctcttaccatcactccccagagtccacggagtccagcgtgagcgctcggcgcggcaagtcggccaccatggccgcggcggctctcaccctcctcctgctggtcctcctcccggcgggccgtgctctcgccacggcggccggcgacgcgcacccgggctacgcgggcgcggaggccgacacctgcgagccggcgcccggcggcgctcccccctacggaggaggcgcggcaggccggcgccacggcccggcgctggaggagtacgggggcgggcacatcgtggacatcacgcacgcgtaccgccccagcatgccggcgttcgcgcccggcgcgaccgtcggccccctcgtgcggctcaaggcgtccatggaggacgggtcggagtacaacctgtcggagctccggatggagtgccacatgggcacccacgtcgacgcgccgggccacatgaaccaggcccacttcgccgccggcctcgacgtcgacacgctcgacctggatgtcctcaacggtcctgccttactggtcgatgttccaagacacacaaatataacagctgaatccatgaaatccctaaatataccgaaaggtgttcgtcgcgttctcttcaggacattgaacacagacagggggctcatgtggaaggcagctggtgatatgagttatgttggatttacagaggatggtgcacagtggttagttgacaacacggacatcaagctagttgggattgactatatatcagttgctgcgtttgatcacttgatctctgcccatgtggccttcttcaaaaatgcggatatcatcctagtcgaagccctgaaactagacaacgtgaagactggactatacatgctgcactgcttacctctgagactggttggctctgagggctcaccaattaggtgcattcttatcaagtgatcaccatggtgcattcttatccgagtggctgctcttgccaatggctgcaacgtatcgtgcccgcagatgctacaatatctttgtccacggtcccatcttagtggaaaaagaaaatgcctcttgtcatgcatacaagtttgtattgtaaaatgaacaaaggaaatatagcagtactacgaataagtgagtagtgaagacagacttgtagcgacttttgtcagtctgtaaccagtgatgaaccacacgagtttgtataatttccaatcgagttcagc

SEQ ID NO: 17700 - DNA, 874 bp, Triticum aestivum
  unsure (1)..(874): unsure at all n locations
  Clone ID: PAT_TA_17700
gtgcgctgttcgacgcggccgcggcggtccggaaccgcctctcttagatccgaacaacacgacctttgtcccatcgccagtttcccttccgcttttttctacaaccaaacgtaatctttcgtcgctcatcaaaatggatcgcatcaaggagaaaatgaaccagcttcgcctggaggccgacgaggccgctggcaaggtcgaggagcttcagaccaaggtcaaggtcctcgagcaggagaacctgtccaaggagcaagagatcacctccctgcagcacaagaacaacctccttgagggtgaggtcgagaagctcgagaacaccgtcaaggacttcaagaaggccgccgacgagggacagcagcacggaacccagaacgagacccttcagcgaaggctgcagctcctcgaggaggaggccgaggatgccgacaagactcttcgtgaggccaacgagaagctccgacagaccgatgtcaaggctggacacttcgagcgcaaggtacaagctcttgagagcgagcgtgaccagtgggagaccaagtacgaggagatgtcgcagaagtacacttctcttcagaaggagttggaggagctccaggccgagattggcaacatctaatcgaactccgacctttatacacttgcgccggatgcagtatgtttattagcatgtccctcagccatcagtatactcgttcagttgcatgatgctttggttgaagggatctttgagtgttggccagatgagcgaatgaagcagtttccgtatatcatgttacttttctactagctgattgaagctggcctttctcatttctaagggtatcttttgtaaatggtgcgcctgtttgcatccctctctgntgtccaaatc

SEQ ID NO: 17701 - DNA, 369 bp, Triticum aestivum
  Clone ID: PAT_TA_17701
cgggtacggctgcggtggaggaggagcggcgccgaggctgatgcccaccattgaagaagaagctccgttttttggctggtcgcgtattatatatatagtttatatattcgcaagactgttatatctgtcgtctcttgtccggagactggaagttgaactgggtttgctgctgctggcagtcgttttgggtcggaaccttgtagttaagttaatcccgtaccgtaccccctggatcttggatgttatcaggtaatagttatgatgattgtgcttggaactaaaaaaaaaaaaaaaaagaataaaaaaaaaaaagaaaaacagacgctcaataagatcaaaacttaagataatcgtgcaagctaaatcata

SEQ ID NO: 17702 - DNA, 620 bp, Triticum aestivum
  Clone ID: PAT_TA_17702
ccctcctacacctacacgcctggcccatgaccctctggccttggttcaagagactctccgaaaatcaccacttaaaaaggtttatgatcctggtctggtgctctgcctcaaagctggaatggaataatgccattcagatctgtcgacgatgtgaagaatgaattcaagtcactgtcgctaaaaattacccatgcccacggcaccagcaacctcgacatccctcctgaaaactacctcatcgtgacgaaagacgggaatgcgtgcttggccatccttgatggctcgtcggatcgtgttctgaggcatctcatcttaattggagatgctatgatgcaggatctgtttgtgatatatgacaacgaggtcaaccgtatcggatgggtccgtgcacagtgcgacaggatgcaggaccttgagtctggcatcattgattcacgtctctgaataaagttcgaatcgacatagacaaaaaccttagcaacaacaaaagagtgctctcgtacggtattcaaaagattgtatggcgctcccgtttataatgaaacatgttgacatgttgaggaataaataaagtgtaaagagagaatcaagtggacatgatttggcaggcaaaaaaaaaa

SEQ ID NO: 17703 - DNA, 1481 bp, Triticum aestivum
  unsure (1)..(1481): unsure at all n locations
  Clone ID: PAT_TA_17703
gcaagcggcgggcaggatctcgggctgagagccgccgcgccttctgccattgtgtctatcccttctacgattatgtgagccagcgctcgcgcagcatagtttctgggttcctaggacgccgtcgcttgggcgcgtaacgcgatggccgcagccacaccccactcgccgccgccgcaacagctttcatcgcccttcctggagtatattacggcccccggcggcctcgacaaggttgtgctccgtggcaggcgcagctgcgccgtggaaatacgacttcttgaaggtcaagtaacgtcatggaaagattggccatcacgaggagttgcttggttgtgagaagcaaggcaatcacgcatcctgaatggtgacgtggcggcttacctatttgcttacctctgtttggaactcagaggaatggtaagcaagacgtattttcaagaaattgccttcggggatacgatgataatccgctcgctttactagagattcttgcaattagaggctttaatgataatgttcttaggcctagtgaagttgatctatagatgtggccacacagtttttcgtttcgctcgagtattgttctatgttctggtggttatttgagtctcacgcctcaaatcaggaagaccatcattgatggaaaactttttgcttatacatttgcatatcacacatacttctctgtttctgacataagtgaagtacgtgtcgaagggctggaaacaatggactaccttgacaacatgaagggaaaggagcgtttcacagagcaaggagatgctattgtatttgaatcagaagttgataaggtatatcttgctgcaccctcgaaagttgcaattattgatcatgacatgagaagaacattcgtcgtgacaaaagaaggacttcccgatgctgttgtttggaacccttgggataagaaggcaaaagctatgcaagattttggggattcagaatacaagcacatgctttgtgtggagcctgcagccgttgagaagccaattaccctcaagcctggtgaagagtggaaaggaaggcttgggctctccgctgttccttccagctactgtagtgggcagttagatccattaaaggtccttcatggttgagttctcacttcttcctcatgtacaggttatgttttactctagctaagctgtgttccggtttcaatgtatcacttatcgtgtcctttcttccttttcatcatcctctacctcttgccctttttgtatctacaagtgggtagtagggcagttctaaaataacagaccacgtcagttgtttttagcccagagcaggtcaactcgtccgtaatcaaatccatcagtctaaagtaacgtttcgtgtggttcagtggccatactaaggaatgttaccatgtggtgcagttgtagcattttatgttaaagtagcattttcttcccgcaaaaaataaattatgagcaaggaattgtntttccaaaaaaaaaaaa

SEQ ID NO: 17704 - DNA, 484 bp, Triticum aestivum
  Clone ID: PAT_TA_17704
cgcgaaggaagaagacggcagaagaggtggaagaagcccttctagccatccatgttgcatcaaatggctcacatgagtggattgacccaaattgctccttcagattgcaggatccacgtggcattcaaggtctcgaaggtagattccgcgtccgcacccggtttgcgggctcgacgcgcgcgcgaccggcttccgccgtgacagccaccatgcgcgcctcctccgcgcgggcggagacgacaatgacacgctagttcctcctcgccggcgtgctggagcacgcgctcgtcctcctcttcatacgctgcgtgcatagacgcggctccaccagctgctcgcgtgcttggcagcgcggcggcatggcgaggagggactgaagacgacgtgagcgggcgagccttcggcttcatggcacatggatggcggcgacacgctggtgatgggcgagaaattgttggccggagcaggcgggcgccgccatgcg

SEQ ID NO: 17705 - DNA, 556 bp, Triticum aestivum
  Clone ID: PAT_TA_17705
gccggccggtcagaaacactcgacttcttcttcggccggggaaaaaagcaacacatactacaacatcaagatgaagactaccggactcttgaccatccttttcacctccatggctgcaactgccattgccagtcctaacgccctgcctatgggtgtcgaggttgttgaacgcgacggcaagaccattgttcgcgaagtgccacatgcactcttgagtcgcggtcttgaaccccgatgccgagaatgtgtcggccaaggtggttcgtgcaccattggtgatggcagctgctatgctgaggaccccccactgtactgcacatggtgcggtgacaagtgcggatctcgctgtgttcgccagggacagacttgccagcagacgtgtgtttaagacttgacaatgacaacccgataccttagaagcatgaggtagcagatcaagttcaatcgctatggatacgctatttttaccattcagacaatcgttatatatacaactcaattaaatatgaacataaatgaatatttttaaaaaaaaaaaaaaaaaaaaaggccccta

SEQ ID NO: 17706 - DNA, 1624 bp, Triticum aestivum
  Clone ID: PAT_TA_17706
tcgacccacgcgtccgaatgaagcatcatctctccttgagttgtgtacatccaagttgaagattgttcaagtgaccgcgagcatgtcagataaggatattaaacttgcattgtctgggccccctaatattcttgtgacaaccccagcttgtgttgcagcatgcatatcaaagggcattgtccagggatcatctattaaagagtcactttcaatgatgattcttgatgaggctgaccttctcctatcctatcgctgcgaagatgacttgaaggcacttgtcccacatatcccaagaagttgccaatccatcctgatgtctgcaacttcaagccctgatatcgacaaactaacaaagctacttctgcacaacccttttgttttaactcttaccgaggttggtcatgcaaaggatgacgtggtccctagaaatgtgcaacaattttggatttcatgcagtgctaaggataagatgctttatatcctttcccttctgaagttagagcttattcaaaagaaagttctaatatttgtgaactcaattgacaatgcattcagattaagattgttcctggaaaagtttgcgataagatctgcagtgttgaatgctgagttgccacaaaattctcgcctacatattattgaggctttcaatgctaggctattcgattacctgatagcaacagatgacaataaaacaaaggaggcgaagcaaaccaacaaggaaagcaaaaaagattcaaaggggtcacgcaaacatttgcaacaaactttagatgctgaattcggagtcgtcagaggaattgacttcaaaaacgttttcacagtagttaattttgacatgcccccgtatcctgctgggtatattcacagaataggacgaacagggagggcaaataaaaccggtgcatctatatcacttgtttcaccagaggaggataatgttttcgaagagattgaacacatgttgcaagatgttgaaaaaaaggataccaactgcattttacctttcccgttactcacaaaaaatgctgtcgagtccctacgatatagggctcacgatgttgctaggagtgtgacaagccgtgatatacaggaagcgcgtcgtcaagacgtaaagaatgaaatcctcaattctgagaagttgaaagctcattttgaagagaatccaacagacctcgatttgctcaaacatgataagttgcttaccaacaaatcaattcctgctcaccttcgggatgtccctgaatacctaattgaccccacaacgaaagaagccagcaatgcagtcaaactttcgagggctgctatgggtcttgataatccccgaaggaagaaaagaatgggattcaggagtgggtcaggcaaaagtagcgatcccctcagaacgttctctgccgagggcaaatcacgaaaacgaaggggaaaggaaagagaaggagatgatagaagaaagaggaggaagaaggcagaaatctaatgctgcaaacagttcactatcaattttgctcggttttatagactcattgccttgtaactttgtagcatctctagaacgaagacaaagcttaatgtgcaacattgtacgtcaaatattttttgggagtttatgttaaaaaaaaaaaaa

SEQ ID NO: 17707 - DNA, 564 bp, Triticum aestivum
  Clone ID: PAT_TA_17707
gccggccgggtcgggaagaaattcctcagctcttactactaactcgcaggttgtttgagaggacggaagtcataccacagtcaagatgccttcagaagccggtcaccgactatacgtcaagggacgtcacctgagctaccagcgctctcgtcacaccacccgccctgctaccagcctgatcaagatcgagggtgttgacgacaccaacgccgccaacttctacctcggcaagaaggtcgctttcgtctaccgtgcccagaaggagatccgtggcaccaagatccgcgtcatctggggcaaggtcacccgtcctcacggaaactctggcgtcgtccgcgccaagttcacctctcctctccccaccaagtctttcggtgcttccgttcgcgtcatgttgtacccttcgtcgatataaaaaaagggcttcgggctggagttggtagtgaggggcggttctcatttggctgcattggtcgaggcaaggataaaacaaactgccttgctttgaggcattcaattcaaaaagacgtcaaatcccaaaaaaaaaaaaaaaaaaggccccta

SEQ ID NO: 17708 - DNA, 895 bp, Triticum aestivum
  Clone ID: PAT_TA_17708
cggccgctcggccggccgggccgggacaaacgacgcgcacccacggaacggtctttttgttaagacaattcctcagctcttactactaactcgcaggttgtttgagaggacggaagtcataccacagtcaagatgccttcagaagccggtcaccgactatacgtcaagggacgtcacctgagctaccagcgctctcgtcacaccacccgccctgctaccagcctgatcaagatcgagggtgttgacgacaccaacgccgccaacttctacctcggcaagaaggtcgctttcgtctaccgtgcccagaaggagatccgtggcaccaagatccgcgtcatctggggcaaggtcacccgtcctcacggaaactctggcgtcgtccgcgccaagttcacctctcctctccccaccaagtctttcggtgcttccgttcgcgtcatgttgtacccttcgtcgatataaaaaaagggcttcgggctggagttggtagtgaggggcggttctcatttggctgcattggtcgaggcaaggataaaacaaactgccttgctttgaggcattcaattcaaaaagacgtcaaatcccaaccccgaaaagggctcttcgcacctgagctactcgtttttgatgatataacttgatctccctttcatgcaacggttatcggaaatcgatcctgtccactgggaggggagcttcagcgatgaaacactttctggtggttgggattcgggaccggtgtttggaactacggtcgtgaatagggtacaagcgaatcatcgatgaaatgccaggtccagggcctctattacggcaggaaaaaaaaaaaaaaaaaatggcccctaagttgactcgtatggagaaatttgagccatggttggcgtctatgatgaat

SEQ ID NO: 17709 - DNA, 1528 bp, Triticum aestivum
  Clone ID: PAT_TA_17709
taactaaccaaaccatttcgcaatctcgcaagcgacgcagccgcctccaccaccaggaaccagaccgcgcactcctccttagctcgagcccagaccggagccctgttccgccgtggatcgctggaggagagggccaccggccggatcccgacgggccagatggtgggcgacccccgcggcgggggcgagtagcacggctgcgatcggcggcggacggatcggcggcgccgcaaggcggcgggggccaccatgtctgccgtagtgtgcggcaagaggtcctccatcttcgccgacgagctcatcccttcctctccgccttcccctccccaccaccacccttccaagcgggcccgctgctccccgacccgcgccttcgacgacgccgccgcggcccaccggcgggaggcgctgctccaccaccttcgctccctcttccctcacatggatccccagttgcttgaaagagctcttgaagcatctggagatgatttggattttgcaataaggagtttgaatgacctgcgcctggagtcagctgaggctatcttttcagctgctgttagtgaacctgagaatggcctgtcaacagcccttaagttatcggctgaaggtaatggccaattggatgctattagtggaaatccacctgcgacagataattgtcagacaaatcaccatagctctgaatgggttgagctatttgttagagagatgatgagcgcctctgacataaatgatgcacgggctcgtgcatcaagagctttggaggttattgaaaagtccatcatggagcggacaggagccgaggcagtgcaaaacttgcacaaggaaaatacgatgctaaaggagcaattagcaatagctcttcgagagaatgctgttctgaagcggggggttgcaatccaacatgagcgccaaaaagagtttgatgataagacacaggaggttcacaacctaaagcaattgattttgcagtatcaggaacaactaaagactctcgagatcaataattatgcacttaggatgcatctacagcaggctcagcagaacagttcaatgcccgggcgtttccaccctgatgtttgctgataagctttccatcctgatgtctgctaatacgcaccagaattctgtccatgtatcttattgtcagagggattcaactattggccctggtatttgtacacttactgaagtcccgagctcatatggtatccgtacacttttcgaagcctcaagctcgtatgtttacgtatacatcacattatcataaagacctgccatctgagaaacgtaaacagcgaagcgtcgatattgaaataaaggatcctgtgctccaggaaagttcagaagaaataatatgttgaggtggatggtgctgcggtgcctattggttaatgtacactctgtaacagtattttgtgtgtgacctcaagggtgagcatagtgtattgctaccagacttaaaatgcaagtatcgatgaaaaatggcgtgttgatgtttatttaaaaaaaaaaaaaaaaaaaa

SEQ ID NO: 17710 - DNA, 223 bp, Triticum aestivum
  Clone ID: PAT_TA_17710
aaggaatgaactcaattcttgtgatctctgcccttctttctcttccatttgagatatatttggagagagaagggcagagatcacaaggaatgaactcaattcttataagcacattttgatttgtagctttgattgcgcacatttgttgtggagatatccgggagatcattaatgtagcccattgaaatgataggaaagaggtttacatttacaggaatgtttg

SEQ ID NO: 17711 - DNA, 1264 bp, Triticum aestivum
  unsure (1)..(1264): unsure at all n locations
  Clone ID: PAT_TA_17711
ggtcgtcctacatcacccaggcatcctccagnagacgctatcgacgaagcgattcgggccggaggagcggcggttcgaccacctcgcgttcctcaacttcgcgcagaacgtcgtctgcttcgtctggtccttcataatgatcaagctgtggtcgggcggtagcagtcctgccgggcgggcgccgcttctcaagtactggggcgtcagcatcaccaacaccatcggcccgaccatggggatcgaggcgctcaagtacatcagctacccggctcaggtcttggcgaaatcttctaagatgattccagttatgttgatgggaactctactctatggtgttaagtatacaattccagagtacttttgcaccttccttgttgctgggggcgtgtcatcctttgcattgttgaagacaagttcgaagactatcaagaagcttgctaaccctaatgctccgcttggctacgggttgtgcttcctcaacttagcttttgatggctacactaacgcgccccaggattggacacaattctgataaccacattttgatctgtagctttgattgcacgcggtcgtggtggagatgtccggcagatcattagctgtatcgcggtcgaggtcgccattactgttcagtaactggccatacgcaaacggttttgaggctgtaagtttttgccgggagaacccagaggtggcctgggacattctcatgttctgcctatgcggcgccgtgggtcagaatttcatcttcctgaccatcagccgattcggctctcttactaacactacaatcaccaccacccgcaagttcatgagcatcgtcatctcatcagttatcagtggtaacccactgtccatggagcaatggggaagtgttgtgatggtcttttctggcctctctctccaaatatatctcaaatggaagagaaagaagggcagagatcacaaggaatgaactcaattcttataagcacattttgatttgtagctttgattgcgcacatttgttgtggagatatccgggagatcattaatgtagcccattgaaatgataggaaagaggtttacatttacagaaaagatagaaaagtacggtaatcgctaatagtgttagctatttaaaaaacgcgccgtacgctatccgtctcggggctgttgcttcttgccgggaaaaaaaaaaaaaaaaaaaaaaaatttaattaagtccaggttccccaagactaacccttgggatataatgcttggcatgaacctctggggaacc

SEQ ID NO: 17712 - DNA, 1969 bp, Triticum aestivum
  unsure (1)..(1969): unsure at all n locations
  Clone ID: PAT_TA_17712
gccacagtcgttctaccgcgctcgctctaacactacaatcggcacaccaacattttttccgccagtggctgtgaggactccggaggcgcaccctgttaacatcaggcatgaaacagcgctaatcaactcgagacaagccgagacacctcgtggcgaatctaatattgctgacgaacttgatctgttttaggaggatcgcgaaggggttgctccaaattcacggcgtgctaaagaagtggaggaggatctgaaagagaggaggaagttgggtaaaaaacagctagctgcggttggagcgcgggtatccttagaagctggcctctcgagcaggaagggagccgaacttagagggcgggaggctgcaataacggctgcaattgaatataatgatggtagaaatggagaagtatcaacaataaagcatcaacttgactccgccaaagagggggttggagctgttatggaccagcaaaaggagtcagagtccgaaacaaaggctctccgatccatcactcagcgaatgatcttaacccaattccaaatagaagaggttgtcctaaaaaggtgctggcttgcacgttattggggcttagcggttcaatatggagtttaccccgagatcgcggtgtcaaagcatgaacattggtcatctttagcccctcttcctctcgaggttgttctctctgctggtcaaaaggctattaaggaggagcctcgtaagcaaggagtcattcaagcaggtgaggatgatgctcagaggagaaataggcttgtgcgagatatgagtgatgtaatgggagaaggcaacatcgagagcatgctctcagttgaaatgggacttagggagctttcatctttgaaggtggaagatgctgttgtggttgcacttggtcagcaccggagacctagcatagttcggcaattcacatcagattataaatcacctggcgaacctaaattcttggaggcatttgaccttagcaacgaggaggcggaggatgttagcttcaagcatgcatggcttatatacttctggagaagagccaaaactcatggtatcgaggaagatattgctgacgaacggcttcagttttggattgctcgcaacgcggttgctccaaattctcatgatgctatagatgtggagcgaggtctgacagagctcaggaaattgggcatagagcagcagttgtgggagggcacacgtgcagacatcgacgaagcctgcctcagcagcgatggaggacgaatagggagggcgcgcgtcatgagttcatgatcggttgtggtctatgctagtgtatcaccccagttttggacaaacttaccatggaatcatcggtctccaagcagcagcgatgcttcagtcctccagcgttgagcaatggacttgtccagattccgacgagtttgtgtagccgattttatctctttgttgcattagttccgtggaatgtgtaattggctttgtcctggcaaagacgatgatacctcacctcacctggtaattgtgaatttctgtgattactccgtctcccatgcttactcagctatctggcctcacgaactgaactgataaaaaagtgcaagctatcttgtgtacgtgcttcaccgagagagaaaaaaaagagatgggccacctgttaaactagcgttggttatccacttgtcctgcggagcttntgctgtgatctgtgtgggtatgaagttagatggggaacgcgactatctgcagtccatgctacggaaaaccggtttggaaccggggcggccgtcgtcaaaagggaagaaaagaaaaggcttaaccgtttcccggttcttggcttgttcttcacccggttcccggtccccttcttcggcttgttcacattaacctggcgatttccaatacaacccctggaatggacagagcccaactcaactcgtcctgcacggacgccaacattgcgggaaaaaacccccnaagtta

SEQ ID NO: 17713 - DNA, 613 bp, Triticum aestivum
  unsure (1)..(613): unsure at all n locations
  Clone ID: PAT_TA_17713
cggncgcgtgggtcgcccacgcgtccgggttgtcgaaaactggagctttgcaggctgcccatccataagggttgccgtggaatcctcgggttccctccagtgctgccgcagaaaatgatcttatgctagattgattgttcaagtatttgattactgataggaacagtcagcttattttattttgtaaaaagacaggaacaatatccagtacgattgacttcttctgtaacagcttcattgaggagctcaaaggtcgtgactgtgactgttcttaggccaatactttcatttgttgttataacatttgcatcattcttcacaagttgcgaaatcaagcatgctaacggtggcgagcgatttgagcgccaatgactcaacaactgattatcaatcagtggatgcagggttagtttactatgccgatccgagcgagcgtcaggcgcgcaaagctcaccgtccacatgcctcctcttcgtctgcatccgcagtgccaaatcactccccatccgagcagatataactaaacttcttgataataaaacactgggtattttaaaactggttgttcaagcagacacaatgtgcactgacaaaagatggcaggaacaatggt

SEQ ID NO: 17714 - DNA, 635 bp, Triticum aestivum
  Clone ID: PAT_TA_17714
ggaacccccattccccccccctttctcccgccccgcacgcctcccgccgcggcagcgccggaagggcgcgctccgccttcccccccccaaactaccgacccccctcccgcccgtcctcgcgtccccctcgctgccgcgggggctggtcccgagcgctgtcgctgggcccgatcgggaggtcgagacggcggcagtggacgtcctcgcccaccagcgggcgccccgggattactaccagggcaagacctccaggcccaccggggtccacacccgcaaagccggccatgttatggtgggatacaaagtgaccaaggttcgtggatccctgacttgactgattttaagttcaagccttatgtatcacaatgtgccagggccatgtctcggagcctcctcaaccgaacacaagaactgatatctttctagaatgctcttaaagaagctgatatgtttccatgatgccctagttacttgttttcgcaagaatgtcaatgctacgctttccaaattaaggtcttcttacggtgcccatgttcagagcatctaacctcggtcaagattgctacgtgtggactagttgtaataacaaactttgtgcctcagcataaattcgatttttttttaaaaaaaaaaaa

SEQ ID NO: 17715 - DNA, 595 bp, Triticum aestivum
  Clone ID: PAT_TA_17715
cgctgacgaccgaccttgcatgcgtgcgatggatccagttccactcgccagccttccgcgtccacgaggacggccgcgtggagcgcttcttcggcacggacaccaccgagcccggcttcgacgcggccaccggcgtcacctccaaggacgtcgtcctcgacggcgccaccggcgtcttctcccgcctctacctgcccgcgctccccgacggccccgaccgcgggaggaggctgcccatcctcgtctacttccacggcggcggtctggtcctcggctcggccgcctcccagatgtaccacggctacctcaactccgtcgtctcccgggccggcgtcctggccgtgtccgtcgactaccgcctcgcgccggagcacccgatcccggcggcctacgaggactcctggatggcgctcagctgggccgcgtcgagggccgacccgtggctgtcggagcacggcgacgccggccgcatcttcctggccggcgacagcggcggcgccaacatcgtccacaacatggcgatcatggccggaagtgctgatgatgacaacggtttacccgtgggggcggtggtggagggggtgatcctgctgca

SEQ ID NO: 17716 - DNA, 616 bp, Triticum aestivum
  Clone ID: PAT_TA_17716
gccggccggttcgagacaagctgagccaacgcagagatcgagcgagaaactaaaaaagcgagggaaatatcaaatatggtgctgggcatgaactgcttcggcgctcctgaagccgcaagcaaggtgtcgccggcgggcaggcggctgggaggagagggagcagaggccgtggagcagagagcggcggtaacagaggcggcgccaagtggccacgtagtcggcgaggccaagcagatgggaggtgttgatcaggtgaaggcggcggggaaggaggggaagaagaagaggagcggggctcccatagtgatgcaccacttccccttccattctcgtcctgggctgctctgagatttcgacctccggctggtgtggtcactgggattttgatgaagcttttgtcagcattctgccagagagttcgcctgttttgtgagggctagattatttgatgagcattgagggctagattatttgatgagaattgtatcttgtactccctctgtccgaaatttcctaattcaagacggagggagtatgtgttaatataatgtcataaaagttcatttcggaacactgtttgccacagtattaaaaaaaaaaaaaaaaaaggccccta

SEQ ID NO: 17717 - DNA, 582 bp, Triticum aestivum
  Clone ID: PAT_TA_17717
tgtgcggcgctcgaagcggccggtcgggagcatccgcgctgagcctacgcaaagatcgagcgagaaactaaaaaaaagcgagggaaatatggtgctgggcatgaactgcttcggcgcccctgaagccgcaagcaaggtgtcgccggcgggcaggcggctcggcggagagggagcagaggccaaggagcagaaagcggcggcgaaagaggaggccgcagtgaaccgtgccgtcggcgaggcgaatgagatgggagccgatcaggtgaaggctgcggggaaggaggtgcacaagaagaagaggagcggggctccaatagtgatgcaccactttcccttccattctcgtcccgggctgctctgatctcaaactcctactactagcatggccactgcaattttggtgaagcttctgtcggcattctgccggagagttcgcatgttttgtgagggctaaattatttgacgagcattgtagtagttctatcttagaattgtactctcttcgttcggaatcactcgtcgaaaaaatgaatgtatttaaatgtattttagttataaaaaaaaaaaaaaaaaaggccccta

SEQ ID NO: 17718 - DNA, 877 bp, Triticum aestivum
  Clone ID: PAT_TA_17718
cggcccgagggagatggaacgaagctgagccaacgcaaagatcgagcgagaaactgaaaaaagcgacggaaatatggtgctgggcatgaactgcttcggcgctcctgaagccgcaagcaaggtgtcgccggcgggcaggcggctcggaggagagggagcagaggccgtggagcagaaggcggcggtgaaagaggcggcgccgagtggccacgttgtcggcgaggccaagcagatgggaggtgttgatcatcaggtgaaggcggcggggaaagaggagaagaagaagaggagcggggctccgatagtgatgcatcactttcccttccattctcgtcccgggttgctctgatttcaacctcctactagtgtggtcactgcaattttgatgaagctgttgtcggcattctgccagagagttcgcctgctttgtgagggctagattatttgatgagcattgtagttttttcttagaattcgtatctttgtactccctccgtcccaaatttctgcgacgagtaattcgagtcgacacggagggagtatgtgttaatataatgccataaatgttcatttcggaaaaaaaataaaaaagacagacgtttaagcgaacaagatgggagccgatcaggtgaaggctgcggggaaggaggtgcacaagaagaagaggagcggggctccaatagtgatgcaccactttcccttccattctcgtcccgggctgctctgatctcaaactcctactactaagcatggccactgcaatttttggtgaagcttcctgtccggcattctgcccgggagagttcccatggtctgtgagggctagattatttgacgagcattgtagtagttctatcttagaattgtactctcttcg

SEQ ID NO: 17719 - DNA, 746 bp, Triticum aestivum
  unsure (1)..(746): unsure at all n locations
  Clone ID: PAT_TA_17719
gcagggnaggatccaatggatatggagtcgtcgtcggtggcggtggtggcggtgccgttcccgatgcagggccacctcaaccagctgctgcacctgtcgctgcagctcgcgtccgagcctcacggggttaatctcgacctgcactacgcggcgcccgcggcgcacgtccgccaggcccgcgcgcgcgtgcacggctgggacgacgcggcgctccgctccgtccacttccacgagctcgacatccccgcgttcgccgcagctggagatcctggcgcacccggccacggcggcgttcatgagccactgcggctggaactcgaccgtggagagcatgagccacggcaagccgatcctcgcgtggcccatgcactccgaccagccgtgggacgcgcagttcgtccagaaatacctcggggctggcctcctggttaggccgtgggagaagcacggcgaggtgacgccggccgcgatcatacagcaggcgattgaaacggtgatggtcggcgaggaagggctcgcgatgaggcggcgcgccatggcgctcggggaggccgttcgcgcctgcgcggctgcaggcggctcatcgcgcaaggatttgcaggatttcgttgctcacctcactaggtgatactgtatcgtgtgtctttttctctttcttttttctttttctttctttttgataaaacttgctcacctaacttaggtgatacgagtgtaataaagaaaacaaatactccctgagtctc

SEQ ID NO: 17720 - DNA, 920 bp, Triticum aestivum
  unsure (1)..(920): unsure at all n locations
  Clone ID: PAT_TA_17720
cgctcgcggcgctcctccgggacctctccgcgtcccgccgccgcgtcgtcgtcctgcacgacgtcctcaacgccttcgccggcgtcgaggcggagcggctgcccaacggcgacggggagtccttcaggcgctactgcggctgcatgtcgaccatggagagcatgggggacggcgggccggctcttgcggggcccatgcactgcgaccagccgtgggacgcggagcttgtctgcaactacctcaaggccggcaccctggtgcaggcatgtgacgcgggagttcacggagtagcccaaagaggcagtcatcgaggaccagtctccgacaaagaatggcctccggcaacgggcgagagcgctccgggatgccgcccgtgcctccgtggctgacggcgtcgtcgcgcacgggcctagatgattccaccgttacatcacaaggcgtcggcaaagggccgtgtgcgtcgtcctgcatggcgcggtcggtctcgcgcggcggcggcatggtcgccaacacgtgccgcgcgctcgagggcgagttcgtcgacgccttcgccgagaccctcgctgccgttggacagaggatcttcgccgtcgggccgttgaatcctctgctggagccgggccagatcgacgcgaagcaggggcggcacgagtgcctggactggctcgacaagcagccggcggcgtcggtgctctacgtgtcgttcggctcgacgtcctcgttccgagggtcgcaggtcgcggagctcgccgcggcgctgaagggcagcaagcagcgcttcatctgggtgctgcgcgacgccgaccgcggcagcgtgtccacggacgacgccgacagccgtcggcacgcgagactggcatccgagttcgctgagcagaccaggggcacggngctggtgatcaccgggtgggcgccgcagc

SEQ ID NO: 17721 - DNA, 669 bp, Triticum aestivum
  Clone ID: PAT_TA_17721
gctccctccgcttccctccgctcccccctcctggcgctcctcctgctgctcgtggccgccgccgcgtccaccacctcgacgttcgaccgggcggttgctccgcgcggcggctccgccggccggcctcgcgggagcggcgccggggagttggtcagcagctgtgctgggagattgtgatggacagtcaggtcgtgcacgggggagatcatcctcttcttcctccacggcgaggcggtcctggggccccggtgctgccgcgccgtccgccccctggagcgccgctgctaggccgccgacgacctgctgtccctcatcgggttcagcgcgggaggagggggacatgcttaagggctactgcgcacccccgcgacagcggcgaggcgcagcaccatggggctcttcatggcgttgcaagtgacgggcgccgtggccgccgctgcgggaaggaaagggcttggtgccgcgatgaagctaagactatggagggtgtggtcacgttaccacgtaggcgcttgtgagcgctgagatgcttcatgagtttatgtaatcaggtcatgagtttttgtggcgaagggtgtctgtgggttttgttggtgtgtttcgtgaacccaattcgcgttcgctaaccccatccacggctcgaataatagcttctgccatattacgaat

SEQ ID NO: 17722 - DNA, 429 bp, Triticum aestivum
  Clone ID: PAT_TA_17722
gcgagccgtcgtctctcagggagaagggcctggtggtgctcccgggggaggacgcgccgcagcagccgccgccggacgtcgcggggaagatgttcgagccgccgctccgctcgtgggccgcgccgaggcctgctccagcggaggactccgattcgggcagcgggaagaaggatccgcccctgctgctagggccgtgaccgtctccggctctagttcttggtggaacccagcggatattgtgggaggctgaagagcatgcgttaatggtagaaaagtctagtgattctgcctttagtaacctttattatttgccacaatggttgtactacgctgatcagctgagaggttgattcgagtgttttctttttgcgagtttgacagatgcttgtgttattatcctttgcctcttaagcaatgatcttaatgcac

SEQ ID NO: 17723 - DNA, 1703 bp, Triticum aestivum
  Clone ID: PAT_TA_17723
cagcaagcggaccccctgtcccggcccccccccgcccccccccaccaccgcgcggagccaccgtccaaaccaagcagcggactaccaaagggaggaggagagagccagaaagagcaccacaataggcaggggacgagcgagcagccataccaacactccaactgcgcagctcccccggggcagcgcactcctcggggccgttggctctcgcagcgccgggagcagcgcctctccggcgagagccgtgagggcagggccacgcacggggcagcaacgggaccagactggaccggccgctccgtgtggaggcccggccacggcatcgacgggcgcagcacgcccatcccgccgagtgaggaggacgggtaaatggttttgcgagggtgttgaagcacacagagtctatgttgtcggcagaatgaagcagatcgcccaggtgatgaaaaccccttgatgatgtgttgcaatctcatggtgtcattccagtgaacattgaacttcattctaccatatgcttgatcagttacaagagcatgtggaaaccattgatatggcaaatgatcttcattctattggtggactagatcctctgcttggttacttgaaaaattcacatgctggcatccgagcaaaggcagcagaagttgtcagtacggttgtccagaataacccgaaaagccagcaacttgtcatggaatctaatggactggagccactattgacaaacttcaggtctgatcctagcacgactgcacgcacaaaagctcttggagctatctcttctctgattcgcaataaccagtccggtcttgctgcatttcgtctaggaaatggacatgctgcactgaaagatgcacttggttctgatgatgctagacttcagaggaaagctctgcatctcacacagtacctgctgaacaataaggcggataggaacgtcgctgcagagattggtcttccgaatcaactgatacacctcgcatccagtgacgattctggagtccgggaggctgccctgggcggccttcttgagctggcacgcgacaagacaccagctgccagcaacgctctacctgatcaggacaagctgaaagacgtcctgaagagccgaatcgaaggcatcagcgccatggacgcagacgacctgcaagcagcccgtgaggagcggcagctggtggactccctctggaaagagtgctatggcgagccgtcttctctaagggagaagggcctcgtggtgctccccggggaggacgcgccgcagcagccgccgccagatgtcgtggggaagatgtttgagccgccactccgtgtgtgggctgtgccgaggcctgctccagcagaggaccccgactctgggagcgggaagaaggacccaccccttctgctaggaccgtgaccgtcttccagctccagttggtagaaccatctcggaagcctggagagcaagcatggtggaaatctagtgattctgcgcgtacaactctgtaacttttatttggttgagtttggcagatgcttgtgttattatcctttgcctcttaagcgacgatctttccacatacttcctccggtccttttttactctgcatattagaatactctgaagtcaaacttcacaaagtttgaccgtatttatatgaaaaatataaacatttgccatgctaaagttatacaatataaactttaagtcagacacattt

SEQ ID NO: 17724 - DNA, 1059 bp, Triticum aestivum
  unsure (1)..(1059): unsure at all n locations
  Clone ID: PAT_TA_17724
gctggatgcggcgtgccgccagactgtcaccattaccaagaggcaagtgtcgtcctcttacagccgcgccgcgaagctttctttaatcccgtgaagaagcagaggaggcggcacgcaattagccagcccagtcccctcgccctcacgctgctcaattgacccgatcgaggaggagtcgccaattaggccgagcgaaggggcagccaagccatggccaccgccaacctgtccagcgtggtggtggcggtcgacggcagcgaggagagcatgaaggcgctgcgctgggcgctcgacagcctgcgcctctgccccgacggcgcgctcgtcgtgctccacgtccagccgccgcccggcatcgccgccggcctcaaccccggccccatccccttcggcggccccagtgtggcggaggtgccggcgttcacgcaggccatcgagtcgcacccagcggcggatcacggatgccatcctggagcacgcgctcaagatttgctccgataagaatgtggaggtgaagacgcaggtggtgggnggggggatcccaggnagaagatctggcgaggtggcggccgaactcaaggccgatctgctcgtcatgggttgccgtgcttttggccctgtcaaaaggatgttcttgggtagtgtgaacaactactgcatcaacagcgtcggctgccccgtcgtcgtgatcaagggcacctaacccatcctccacccaacaaacattcgttattgcgttccacgccatgttttttgaggttgctactgtgttgtgtgtactcctgtgcaaagccactgcatgcttccaagactatgcatggcttatgttatcattcatgttgtttgttagtgcttggttggatgaggccgaagaactgctctgtacattctgtgcatggaaattggctgtgggtctctggaaataagtctgcacattgctttgtacattaaataattattgtactatcagctgaaacacggtgccatggggcacatggttttgtacaaaaacattgtacgcagggcttgcaagttgcaagatccatggtttttttgtcc

SEQ ID NO: 17725 - DNA, 1055 bp, Triticum aestivum
  Clone ID: PAT_TA_17725
cgcaattagccagcgctcgcacgccacgcgcccacgcgtccgcccacgcgtcctgaatccccaagcaggccgagcggaggcggcacgcaattagccagcgcacccctctcgcactcacgcttctcaattgacccgatcgaggaggagtcgccaagcaggccgagcgaaggggcagccaggccatggccaccgccaacctgtccagcgtggtggtggcggtcgacggcagcgaggagagcatgaaggcgctgcgctgggcgctcgacagcctgcgcctccgccccgacggcgcgctcgtcgtgctccacgtccagccgccgcccggcatcgccgccggcctcaaccccggccccatccccttcggcggccccagtgtggcggaggtgccggcgttcacgcaggccatcgaggcgcaccagcggcgggtcacggatgccatcctggcagcacgcgctcaagatttgctccgataaggaatgtggaggtgaagacgcaggtggtggtgggggatcccaaggagaagatctgcgagggtggcggccgaactcaaggccgatctgctcgtcatggggtgccgtgcttttggccctgtcaagtaggatgttcctgggtagtgtgagcaactactgcatcaacagcgtcggctgccccgtcgtggtgatcaagggcacctgacccatcctccgacccagcagacatttcttattgtgttccacaccatgattcttgaggttgctactgtgttgtacgtactcctgtgcaaattcactgcacacttccaagaccgccgtatggcttgtgttatcattcatgttgtttgttagtgcttggttggatgaggccgaagaactgctctgtacattccgtgcatggagattgccaaattggttctggggtccgtggaaataagaatgcacagcgtgcacgctgttttgtaaattgatcattgttgtaagtatatcagctaaaacatggtgccatggggcacatggttttgtacaaaaaaaaaaaaaaaaaaccccaaaaaaaaaaaaaaaaaatcagtccataattaa

SEQ ID NO: 17726 - DNA, 809 bp, Triticum aestivum
  Clone ID: PAT_TA_17726
ttgcacacgaatatggtgggagggggaagaggaagcggacgagcacgacgagggaccgggtatggggcaaggaggaagaggaggtgcaagatgaaggtcagcgcatcggtgaagcggttctgcggcttctgcaacgtggtgaagcgccgggggctcgtcctttaccccctgcacctccaaccagaagcacaagcagcgccagcgcctctccatcctcgccgcctgcctcccgcccccgccaccgccgagctccgcctccgccgccgcgttcgccgaggcttccaaggtggcccgacaggagatgtcaacgaagttcaactggccgctgggtctagctgccctgctcaagaatggtgacaaataatcaggcgatgaatactagctagtcggtgttttgatattaagtggagtttccagttgaggaattcttgtaacgaaaatagcatgccatcatgtatctgatatcattggttaaactgttcgtttcatggaataatattggcatatactcttaaaaaaaaaactaaaaacacacgagaatagttgatcccttcctcttcgacctagtggcaacattgcgtgcaaggctaactgtgttaaccgaggttatgacaaggataagagcagttgccttgaaggcagtagtggcacatgctgttgcggaaagaactgagaagtaccatgaaatgagtttatatatgtactagaaatatttgcatgaaggtgaatgcttatattgtttgtgtgaaacctgattcagttcatacaaagcaattaataataagctattgataattattgttttagta

SEQ ID NO: 17727 - DNA, 912 bp, Triticum aestivum
  unsure (1)..(912): unsure at all n locations
  Clone ID: PAT_TA_17727
actgctcgacccacgctccaattcagcgagnatcaggaaacgagccctgcacggatggacggctcgtcggcggaggtggcgaaggtgaagcgggcgaagaccgtcttgacggtggcggcgatctccggctccctccgccgggcctcggccaacgccggcctcatccgcgccgccgccaagatgtgcgaggagtccatcccggggctgcagatcgaccacgtcgacatctccgacctgccgctccttaacaccgatctcgagaacgtcgacggcaacgccttcccggccgccgtcgaggagttccgggacagggtccgcggcgccgactgcttcctcttcgcctcccccgagtacaactactccatctcaggccctctgaagaacgcgctggactgggggtcgcggccaccgaacgtgtgggcggacagggccggcgccatagtgagcgcgtcagggaagtccggcggcaagaggtcggcgtaccacatccggcaggtcggggtcttcctcgacatccacttcatcaacaagccggaggggttcgtctcggcgcaccatccgcagagcaagttcaacggcgacggcaacctcatcgacccggagactggggagctgctgaggaagatccttctttccctccgggcgttcgcgctcacgctcatccacggcaacgactctgctgcaaactccggacaaggtagttagtatatttagtggtgtgtgccatctgctgtgatggccggatgaaggagctagttgagatgtcgggatgttagtgccttgaataatcttgtatgccaaacattcttcttcgctagcttccatgggataataacggatgggctgcgcgggcggccattctaccccccgaagaaacatgttaacatttggccaaaagggggccgtaccaat

SEQ ID NO: 17728 - DNA, 1329 bp, Triticum aestivum
  Clone ID: PAT_TA_17728
cttcggcgccgggagggacgccccgctctgccggcccctcgcccgcctcgccctcgccgccgccgggcgcgccagggcccccggcggcagcgcctgccccggcctcgtcccccctgcccccctccgcgcccccgccgcccgggccgtcgcccccgcgctcccgcccgcgcaagcaccgcacctctgagcggctgagctccagggccagggccagggccatggagcggcggagaaggggcagctgcttctgcttgctcgccgtgacggcggcggtggtggtggcggcggcgtccggcggcgaggcgaagctgtcgccggaccactaccgcaggacgtgcccgcgcgtggagtcgatcgtgcggtcggccgtggccaggaaggtgagggcgaccttcgtcaccgtccccgccacgctcaggctcttcttccacgactgcttcgtccagggctgtgacgcgtcggtgatgatcgcgtcaagcagcaacgacgccgagaaggacgcgccggacaaccagtccctcgccggcgacggcttcgacaccgtcgtgcgcgccaaggccgccgtcgagaaggcatgccccggcgtcgtctcctgtgccgacatcctcgccctcgccgcccgggacgtcgtctccatgtcgtcgggcccgagctggaaggtggagctcggccggctggacgggctcgtctccaaggccggcgacgtcacgggcaggctaccgggcccggacatgcagccggacgccatcaccgcgctgttcgacggcaacggcctcgccgtgcgcgacatggtcgcgctctcgggcgcgcacaccgtcggcttctcccactgcgagcgcttcgccggccggctctaccggcgcggcgcggtggacccgtcgttgagcccgtcgtacgcgcggcagctgatggcggcgtgcccgccggacgtcgacccgaccatcgccgtcgacatggaccccgtcacgcccaccgtcttcgacaacaaatactacgccaacctggccgcgggcctggggctgttcgcctccgaccaggcgctgcacgacggggccgcgtcgcggccggccgtggaggggttcgccgggaaccagacgctcttcttcgaggcgttcaaggaggccatggtgaagctcgggagggtcggggtgaagagcggcggggacggggagatcagacgagactgcaccgcgttcaactagtaggagaggaaaccggccgccaggcacgttgacactagctggtactgtaactgagaagaaaagttataaggtctcgatgcattgataaaacaattcctttttataaatgcaccctcgtgccgaattc

SEQ ID NO: 17729 - DNA, 625 bp, Triticum aestivum
  Clone ID: PAT_TA_17729
ccaccccctcggcgcactccagcaccatacgtacgtgacccagcgccgtttcacaggccatggactcaccgctgccgttcctggtcgcgatctcgtcgctgctcctgctcctagccggcctgtacatgacgcgcctcggcctgctcggcaagaggcgccggagctacccacccgtcgccggcaccatgctccagcagctgctcaactggggccgcctgccggagtacatgacggagctctcccgcaggtaccgcaccttcagcatgctcaccctgacccgcagctccgtccacaccgtcgacccggccaacgtcgagtacattctccggaccaacttcgccaactacggcaaggggacgatgacccatgacacgatggaggacctcctcggcgacgggatcttcaacgtcgacggcgccaagtggcgtcaccagcggaaggtcgccagcttcgagttcagcacccgaatgctccgggactacagcagtggcgtgttccgcgacctggccgcccagctcgcgggcatcgtggccgccgccgcggctgccggggagaggtgagcatatctgcggtcgacgctggactcgattttcacggttgggttcggggtcaacctgggctcgct

SEQ ID NO: 17730 - DNA, 1477 bp, Triticum aestivum
  unsure (1)..(1477): unsure at all n locations
  Clone ID: PAT_TA_17730
ccgcaggaaaaataataccaagccgacacgtcacggctaagaaccggcacgaaaaataataccaagccgaccaatcatggctcgcccccgcctccggctgctcctcctcgtcgccgccgtcctcctcctcctccacccggccctctcctcggcggcagaggggctggaggaccccctcatcgagcaggtggtcgggggcgacgcggagaacgagctggagctcaacgcggaggcgcacttcgcgaccttcgtgcggcggttcggcaagtcctacagggatgccgacgagcacgcgcaccggctctccctgttcagtggacagcctccgccagtcgcgccaccaccaccccctcggactccgtccgcgcttgcacggcatccccaagttctgccgaagcttcctcaaggggatctccgggtcggcgcacgacgcgccggccctccccaccgacggcctccccacagagttcgactggcgcgagcacggcgcggtcggcccagtcaaggaccagggttcgtgcgggtcgtgctggtccttcagtacgtcgggggcgctggagggtgccaactacctcgccaccggaaagctggaggtgctcagcgagcagcagctggtcgactgcgaccacgagtgtgacccgtcagaaccacgcgcatgtgatgcgggatgcaatggtggcttgatgactacagctttcagctatctcgcaaaagccggtggcttagaaaccgagaaggattacccatacactgggaggaacagtgcctgcaagtttgacaaatccaaaattgctgctcaagttaagaattttagtactgttgctattgacgaagatcagattgccgctaaccttgtgaaacatggcccacttgcaattggtatcaatgcagtattcatgcaaacgtacattggtggtgtctcatgcccatacatctgcggaaggcatcttgatcatggtgttctcctggttggctatggatcagctggttacgcaccgctccgcttcaaggagaaaccatactggatcataaagaactcatggggcgaaaactggggcgagagcgggtactacaagatctgcaggggtccgcatgtcaaaaacaagtgcggtgtcgattccatggtctccacggttaccgccatccatacctctaagaaggaataagatcttgtagtactcagtctggattgcctatagacatgcttgtgtgccaggactaggtattccatgatggttattccagtattgccttgcaattcgtaaccagtaaatatgtgaaacttctcttgattgctgtaatgtatctctgggttgctatgtattgctacgcagttcttggaacatggtagcagatatttgttgccatcattaatgtatataatctggtgttctgggttgatcaaaaaaaaaaaaaaaaaaaaaaaaannnnnnnnnnnnnnnnnnnnnnnnnnnnnnnnnnnnnnnnnnnnnnnnn

SEQ ID NO: 17731 - DNA, 577 bp, Triticum aestivum
  Clone ID: PAT_TA_17731
gccggccgggtccgggtcgtcttggcactcccgtcgacagcaacatcagacaaaatggcccccgccgcaaagaagcagaagaagaagtggtccaagggcaaggtcaaggacaaggcccagcacgccgtcgtcctcgacaagaccacctctgagaagctctacaaggatgttcagtcttaccgtctggtcaccatcgccaccctcgtcgaccgaatgaagatcaacggttctttggcccgacagtgccttgccgacctcgaggagaagggcatcatcaagcctgtggttacacacagcaagatgaagatctacacccgtgccgttggtggtaccgactaaatgcaattcaacgaaaaatttgagtctcacgattgtgcgtctgggtggcctggacgatagacaggccacaaggtcggagggtgttgcaaggcgaaaaagaagcctggtttaggacgctattcatgctcggttaagcattgggacggaatcgctttagcaatggcaacggaatgaaaaatcttcgaaacgaccaatttatggttctctctagcaaaaaaaaaaaaaaaaaaggccccta

SEQ ID NO: 17732 - DNA, 708 bp, Triticum aestivum
  Clone ID: PAT_TA_17732
gtgcggccggcggccgggccaataacacactttctcttactgtcctgtcgtcttcacactcccgtcgacagcaacatcagacaaaatggcccccgccgcaaagaagcagaagaagaagtggtccaagggcaaggtcaaggacaaggcccagcacgccgtcgtcctcgacaagaccacctctgagaagctctacaaggatgttcagtcttaccgtctggtcaccatcgccaccctcgtcgaccgaatgaagatcaacggttctttggcccgacagtgccttgccgacctcgaggagaagggcatcatcaagcctgtggttacacacagcaagatgaagatctacacccgtgccgttggtggtaccgactaaatgcaattcaacgaaaaatttgagtctcacgattgtgcgtctgggtggcctggacgatagacaggccacaaggtcggagggtgttgcaaggcgaaaaagaagcctggtttaggacgctattcatgctcggttaagcattgggacggaatcgctttagcaatggcaacggaatgaaaaatcttcgaaacgaccaaaaaaaaaaaaaaaaaaagaccctaaaaaaaaaaaaaaaacctacctacccctgttcgaagcaccgaattagttagtccaccgttcacaaccccagaaagccaagccacgttacgatggggtccttccccggagttgcccgtttg

SEQ ID NO: 17733 - DNA, 987 bp, Triticum aestivum
  Clone ID: PAT_TA_17733
ccacgcgtccgccttcaacctcacttgggaggttgaaggtatagactccagcaacagccttaatgtcccggatgacacctgctatgaatgttgcttcagttgttggcattcagttagacaaggtgatttctgaagttaaaccacatgagaaaaagaagttcatatctgaacttcaaaaggagcacaagttagttgcgatggttggtgatggcatcaatgatgctgcagccctagctttagctgatgttggaatcgcaatgggtgggggtgttggtgcagctagtgatgtatcttcagttgttctcatgggtaataggttatctcagcttgttgatgctttagagttaagtaaagaaaccatgagaacagtgaagcaaaatctttggtgggcttttctgtataacattgttgggctacccgttgctgctggagcattgctgccagtgacgggtacgatgctgaccccgtcaatagctggagcactgatgggttttagttcagtcagcgtgatggccaattccttgcttttgagggcgaggatgagttcaaggcatcatgttcagagcagacaaaagcctcacaacaccatttctggtgtgtcagacggagctgatgaggtagagcaaagttatccatcaaaatggaggagtacctgactgaagtttgaagtgacgacatacttattacttcacgaacatttgattctagttcagtcacatagccacaggtgagtaaaaacactgatgacactgtaatcaccaagagtcttaaacattacgtgatgtagaagtcctcgaaccagtgacggatcttgggtcttatcaacagggtaccatacttttgacacacgatttaattaattgttgtgggtggatgaagtatcacatgctcaccacgatacaatacaaagttcactggctgatcagtgtagtagtaatattgtgcccaatttaattgtagtgtgcggatattgcaaattcaatgcat

SEQ ID NO: 17734 - DNA, 1098 bp, Triticum aestivum
  Clone ID: PAT_TA_17734
ggcccgcgccgctcccccgccgtcgccgccgctccccagatcccccaccctagcctcgctcgccccgaagtcaaacaacagacaacgcatttcctcgaacacctagcctccctccatggccacctccgccctcgccaccctctcggccaccgccgccgccgcgggggccaggcgcgtcctcctctcgcgcggcccctcctccctctccttcgcctcccgccgcctcgcgtccgcgggccccctccgcgccgggcccctgccccgcgcggcgacgcgggccctctccgcgaccgcgtccccggccgccacaacgaccatcgcggtcggcgaccggctccccgacgcgacgctgtcctacttcgacgcccccgacggcgagctgaagacggtgacggtccgcgacctcaccgcgggcaagaaggtggtcctgttcgcggtcccgggcgcgttcacgcccacctgcacccagaagcacctcccggggttcgtggccagggccggggagctccgcgccaagggggtggacaccgtggcctgtgtctccgtcaacgacgcgttcgtgatgcgcgcgtggaaggagagcctcggcgtcggcgacgaggtgctgctgctgtcggacggcaacggggagctgacgcgcgccatgggcgtggagctggacctgtcggacaagccggtggggctcggcgtccggtcgcgccgctacgcgctgctggccgacgacggcgtgcgccttcaccaacagcagcgctgagggacatgctcaaggcgctctgaggcctgaaccgcgaccctctccgctcgcgccacggctatcgtccgtgacgtcgtcagctcggttcgtcctccgttttactgaaggcctttttttgcttcgtttttcctgaataataataataatcggtgcggcagcggcggcctggtctgtgtttgctgctgctgctgtcaccttgatgtgcggtggcgagtactgagtagtgcaacgtagctttgtgaagtttgtggagaactatgagtcgtggccgtgtcctggtttgcaacctggcatggcatggaatatcaacttttgcttgctgtttgcgtcgtaaaaaaaaaaaa

SEQ ID NO: 17735 - DNA, 1353 bp, Triticum aestivum
  Clone ID: PAT_TA_17735
cccccgctcgacgcaccgatccagccgctcgcttcctcgcgacctcccgatttcgccatctcgctcgctcgtcgctcgccgtccccgcctatgtagccgatcgttgggcgcccaggaccacagcctgtctatcccgcccgctcggtgtttggggctctgcggcggccgcgccacctcaattgcagagtcttgcccctacaagccggcgccgctgcccaatctgcacatcagcgctcggccaagaggaagtagccagccagcaagcatccccgtgttgatttgaagacacgcgatagagggccgcacaagggttacatgcatccgcactggggggcagcggtgctgggagatttccaggagcaaggcgaagtcggggacgaaggcccgaagaagcaatctgtgcctccctatcgctgcgtcctgctcctcaatatgtcaccttatttatggcgcccttatccctcatgctgctgatttaaacctgccctactcttcttctcataggttgatcaagggttgcgcttcagcgactgcctcgccgaccacggggaagcaaggataagaagtgacggctatagcgctaggaaattggaaaccctagcaattgatcttctttataaaacgtgtttggcaagggacgtggaacctgcctcagggaagaagagattgaccacgtgagagaagagaccagcttcatcctttatcggacagccaattttttttttgccaattgctagttcatattgtgcatgtgttcgaagcctgcagacatgtggctcctggagtttgtaggtagacctactatattgctctcggatacgtgtgagagctttattatttcccctttttctttccaattcggttacaagatggcttcactgatgattacctctcaaaccacctatgtggttaggaggcgaggaaagttttcatacaacacccacggttcaatattgaagtgttcctgaagaggtcgaaggatggacggtcaatcatccacaggcactggcctaaagttgcaaagaccttcaacatgaatgaaggctcaatattcgccttccgcttcagcagttttccagatgagatgcatctgtctatataccgtctatgatgctaatttcgaaaggttctacatgttgcatgtgaaacttgatgctggtgcagttgtgtaatggggtagctgagtgctgaagctatatcatgttgtactctgatgtatttcaattatgaaatcctgcttccttaatatggaaatgaaatatattatgtgcttaatatgaatttcaattagattaaaattgattattgataatagggcaattagcctgctaatggtgaattcccgtcgacccg

SEQ ID NO: 17736 - DNA, 1001 bp, Triticum aestivum
  Clone ID: PAT_TA_17736
ccctcgtgagcagagctccacatcgatcagtactcaaagctactccactctcggccgagggactcagtgtcacggcgacccaggaccgaggaagaatcatggattccgtgacggtgtcgacggcggcgaagcccaccctccgcgtggcggccttctgcggctccctccgcaaggactcgtggcaccgcggcctcatccgcgccgccgaggagctgtgcgaggagtccatcccggggctgcgcatcgaccacgtggacatctccggcctgcccatggccaacccggacctggagaccgacggcggcgagggcttcccgccggccgtcgaggcgctccgcgacagggtccgcgccgccgactgcttcctcttcgcctcacccgagtacaactactcggtcacggcgtccctcaagaacgcgctggactgggcgtccaggggcaacaactgctgggcggacagggcggcggcgatcgtgtgcgcggggggcgacttcggcggggccagggcgtcgctccacctccgccaggtcgggatcttcctcgacctccacttcatcaacaagccggagctccacatcagagcgttcgcggagccgcccaagttcgacggcgagggcaacctcatcgacgccgtgaccagggagcggctcaagaaggtgctcctctcgctccaggccttcgcgctcaggctccagcacaacaacaaggacgactgactgactcaagatcggtgatgcttggcagttggcaccgtgtaccgtatgtgcatttccctaaagtttgatgacgttctgctccgtgcaccagtattcgtggttccgtgaaacactgtaggaagtgtgtgctaccttttgtgtaataaatcgccgaagaattgcatcgtactgtaaaacgggcccgtgcctatgcgcctttccgttcctactagcgcccgagggcgccggtccatgtcgggctggcaatccggggtacccgctattctcgggagaaaccccttccaa

SEQ ID NO: 17737 - DNA, 1821 bp, Triticum aestivum
  unsure (1)..(1821): unsure at all n locations
  Clone ID: PAT_TA_17737
tccgttgagctcaaagggattagacatgagaaaaaggccaggtgttacgtgtagcctatgctaaaagccgcttggacctgcatcggtggcttcacagtcaaacagccttgctgcagcagccatcgaggctgcatcatttgcccagcagtatgatgctgtgggttgggccccaaaaggtacaatgctgaggacaatgtagatggtaattcagaatctcagaaagatgtttctgctccacagtccggatttgtttgggatgagaaatcgggctattactttgattcttcttctggattctattatgatggaaatactggcctttactacgacagtaatgttggagtttggtattcgtatgatcagaaaactcaacagtatcttccatgtaatgaaagcaacaacaataaggcaaccggggacatggccaatgaaagtcaaagtaatggcggtaagaaagtggtgatttctgcacctgcagccacggttaaacaaagtgaggaaacttcattgcctgaagctgttcaagctgcggccaatgcagcgttggctgctgaaaagaaagaaaaagagaaagcaaaggagataaagttggcctcgaaaactaatctcttagccaataagaagaagatgaataatgtcctagcaatgtggaagcaaaggaataaagaaggccaggctgcacatgttgcccttgatgataaggaaccatccagatccgttgttgacaaattaaacaattcacccagtgcgattggattctcattgaaggccaaaccaaagtctgattttggaaattctaaggacatgaacttggttgctggatataattctcttggccgagaaactggaggctctcaaatactggattctgacataaagcctagacctgtcagtaatagcttaggaactactgttatgggtgtcataagaggttctggcaggggagcagtcaacacatttcatgcatcatctgatgctggtggcagtatttcttctgatataaccgcaagcacaagtgggttaatgacaaacaccgagacacacactgcttccacacccttcaaaacagatttatcctctctaggatcatatgcttcacctgcagtttctgggagtgctaagcgacgtttctccgaggcaccagggcaatctcagtacagagatcgggctgcagaaagacgaagtctatatggatcaacttcatcgcttcccaatgatggactggatacaactggtgaatattcgtctcgaaagggttcaagtgagatgggatcaatgccatttcctccaggggtgggtgaacgttctgttggtgaaagtgacaacactgaaaattatgaggtgatcactgctgacagagcaatagacgaaaacaatgtgggcaatcgaattctgcgcaacatgggctggcaagaaggactgggccttggaaaggatggcagtggcatcaaggagccggtgcaggccaagcctggtgacgtgagagccgggcttggtagtcagcagaagagagctgctgacccatcactggaggcccgagctggcgatagctataaaaccataatccagaagaaggccattgcgagattcagggagatgtcctaagtgctttctttatttcatcgtcgtgtataattagtccggatactcgtttttatcggtgttaatgtcaaaacccccaatgctgtgtgcttttgctgcggtttttctcctttctgccgcgggccccatacttcgggttttttgcgccccgtgccagtttttcgtgtcccccatgaaaaaaaacccaggggggggcccggaccaatnccctanatgatt

SEQ ID NO: 17738 - DNA, 398 bp, Triticum aestivum
  unsure (1)..(398): unsure at all n locations
  Clone ID: PAT_TA_17738
ttctcccacgggtccgccgctcccaggagctcggcaagagcctccgcgacatcctcatcaagaagatcaggggtcagtaagggcatctctcagcgggcagcatttcagcaacattcgacggtactacaggaggtttacaacgtgattcgtcatggggtgctccatgttgaacatgtaatctctccatggtgggatgtagtaactgagctgatgatattttttttgaactacaaatctgtttacagcaagttgataataactcacctgcatgccaagaatctgttcatgtcttggatcataggcaaggttatgataaattgtttgtggaggaatttttatggtacaccttagtaatgtactgttctcggtgtcaaaannnnnnnnntnnnnnntnnnnt

SEQ ID NO: 17739 - DNA, 838 bp, Triticum aestivum
  Clone ID: PAT_TA_17739
tgaagcttcattcaggcagcgatagttcggggcagcgacggcgcgatgcaggcactggcgcgagcggcgcgggggctgtggccggcggcggctgcggcggggagggggcaggcgcagctgcaggcggcgcggccgcggccgaggtacctctttcctgtcaagatctgttgaatttgacggattatttggtctctgtcccatctctgcgactggcatttactgtatgcagctttgccgatttgagacaggacatctttcaagagcttaacaagatcaggtgcgcgcgacactgtcacataggccgggctgcgggcgctcgaggcgatcatgcggtacggcggcattcagcggctcgtcaagcgtccacccgatcaccacctcaagaacaccaggggtcgcgtactcgcgccctctgtgggcagggcgctcgtcccacgcccgggagttcggcaggagcctcacaaggtagccctccgggggaacatcaggggtcagtaagggcatctctccagcgggcagcttcgcagctacattagggcgagaatccttgatatttataactcgatttcgtggcagatgttttttattgtcatggtaatatatatcaattgaagagattagttgttgatttgattatatggatatgccttgagccgcttttttaaaaaaccacatgtgtgctgaagaatcgtttcatttcttggattcacacacaaatctgcgataaatgattgcaagaatttttatggtaaatcagtcccctacaacttggtgccgaccctgcaactccgtgctatcgggcccgcccccggcggccgaaaaaaaaaaaaaaaaaaaa

SEQ ID NO: 17740 - DNA, 2548 bp, Triticum aestivum
  Clone ID: PAT_TA_17740
ccgccaactattttttggcgatgaattgtcagctctcgacgcattacatacattagctgatatctctgtgaatattctacaaccttcttctatcgctgaatctgaatcatcggcacagtttaaggatggaagcaaagacaatgaatctgatgataagcctagtgtgcctgcagcagtatcattatttgacaaaaaagataagcccagaaaaacgaaaaagatcaaaaggcagtcagaaattgcaagcaacgaggtggttaccaggaaaaaagctagactttctaaagatcaccatcatgacgggagtacttctgacgtaaagcaggatgattgtaaatgtggtgttaaaatggagaaaaagaaaagaaagtcttccacattgaagatctccaaagatgagaagaatacactaaaagatagtgagaagaccgaggcttccgctgaagaagggaaggtatcttctaataaaggtaggcatactcatgtcagtccagtttcaaaacaaaacaagtccaaagcacaggaaagttctccagcacatgctgattttggaaaagaagccatggatacggtggacatgacagaaaatgcaataactcagcaatcggactcggcatcaaagtctaaaagccggcgcaagttaggcattttgaaagcacttgctccagagagcaagcctgctgagggcgctgatgattcgtgcgataatgtttcctacccagtgaataacgttactgaactcaaggacaagctctctcactgcttatcttcacgtttccctccggagatggtgcatgtctgagtggttctatagtgcaattgattatccatggtttgcgaagagtgaattcgtggagtacttgaatcatgtaaagctgggtcatgtaccaaggctgactcgtgtcgagtggggtgttataaggagttctcttggaaagccacgtcgattgtcaaagcagtttttacaagaggagagggaaaagctttctcagtatcgcgagtcagtcagacaacactatgctgaacttcagtctggtgttcgagaaggtctaccaactgatcttgctcggcccttagcagttgggcagcgcgttatagcctgtcatcccaaaacaagagaacttcatgatgggagtgttttgactgtcgaccgtagtcgctgtcgggttcaatttgatcgtccggagctgggtgttgagtttgtgatggatattgattgtatgccgttacacccactggaaaatttccctgagtctctcagacgccaaaatatcgtgaataaatactacagcagcttctcagaagtaaagtttgaggatcggtccaaagagtatggtggtggaggtgcaccaaggttcatagcaaatggggatgcatttgattcgattgcacaggccaaaaccacagcaaacgaggctacagtcgctgcacatcaggcaatgtacggccagccatgtacgccgtcacagattcaggaaagggaagcagatataagggctcttgctgaactatcgcgtgctcttgcccacgcggtcgccttgctggtagagttgaggcacatgaacgaagaagtgtctggaaagcaaaaggatggggaaattattagagatttggagcacttcaggaagcaatacgccatggttcttgtccagctgagagattcgaatgatcatgtggcttcagccctgctttgtctgcggcaacggaacacatttcatgggcagccaacgcagtcatatcctaataaatccacggaaaatggtggagcttttaacagaacaccagacccatctagtaacctttttggttatattaatcaggagtctggatcccaagtgatggagattattgagacttcaaggtccaaagctaaaacgatggttgatgtcgctgttcaggcaatgtgcaaagtaagtgaaggagagaacgcttttgccaagataggggaagcactggacaatctgaacctccgtggcaccggctctggttcgagcatactaggcataaggcggataccacccgattccgggcaggcgaattcagataacagcgcctcgggccgcttcgaccctgctgcagcaactaataacatttccagtccaagagtattgcccaacggcagcgactccgaagcccagttcccgtcggagctgatttcgtcctgtgtagcgaccatcctgatgatacagaattgcacggagaagcagtatcaccctgcggaagtggcgcacattctcgactcggcgctgtcgcggctgcaaccgtgcagctcgcagaacgtccccatcttcagggagattgagatgtgcatgggtatcatcaagaaccagatgctggcgctgatacccacccctagtggctagtgttcatgcatggccgaacattctcttctttcgttatttatatatacatatgtaggaagaaagaaacttgacaatggtatgtggcttgtattctaaaagcttacaagagtctgtataaggtgtacctaacctatcttattagttattaatatactattatcgtgtcaaaaaaaaaaaaaaaaaaa

SEQ ID NO: 17741 - DNA, 391 bp, Triticum aestivum
  Clone ID: PAT_TA_17741
cgtccgcccacgcgtccgcctttccgccgcggcaactgtgagccggcccgatcgagccccccacctcgagagaccgccataattcattccatccatccatccgctgccgcctatataagcgcggccattgggcgctcgtggcggtgttcgtcacatcaggcgcgcgcaggccgagatcagatcggcgacggcgaccatgttcagcgggacgcagcagaagtgcaaggtgtgcaccaagacggtgtacccagcagctactcctcgtttgaaggggtgccctactgcaagccccatttcgcgcagctgttcaaggagaccgggagctacaacaagagcttccagtcacaatcacccgcgaaatctgcgacggagaagctgactcctgagctga

SEQ ID NO: 17742 - DNA, 737 bp, Triticum aestivum
  unsure (1)..(737): unsure at all n locations
  Clone ID: PAT_TA_17742
ctcatctcacctccctttcccccccttccccgcccacgtcgccggtgcgttgtgggtttctttccgccgcggcaactgtgagccggcccgatcgagcgagccgccccccacgcacctcaagaaaccgccataattccatccatccatccgctgccgcgtcctacgcggccatttggggcgctcgtggggtgttcgtcacatcaaccaggccaagatcagatcggcggcgacgacggcgaccatgttcagcgggacgcagcagaagtgcaaggtgtgcaccaagacggtgtaccccatggaccagctctccaccgacggcgccgtcttccaccgcgcctgcttcaagtgccaccactgcaagtccaccctctcctttagcagctactcctcgttcgaaggggtgccctactgcaagccccatttcgcgcagctgttcaaggagaccgggagctacaacaagagcttccaatcacaatcacccgcaaaatctgcaacggagaagctgactcctgagctgaccagatcgccaagcaaagctgcgggcatgttttcgggaacacaggacaagtgtgccacttgtggtaaaacagcataccctcttgagaaggtaacagttgaagagaagtcctaccacaagtcctgcttcaaatgctctcatggaggctgcgccctctcgccgtccaactacgcggnnttggaaggcatcctctactgcaagcacccattctcccagcttt

SEQ ID NO: 17743 - DNA, 1202 bp, Triticum aestivum
  unsure (1)..(1202): unsure at all n locations
  Clone ID: PAT_TA_17743
ctccccctcactcccctcccatctccctttcctttcctccgtctgccctccgcctttttctttccgccgcggcaactgtgagccggcccgatcgagcggcccgccccccacgcccatcaagagaggccgccataattcattccatccatccctccgctgccgcgtatataagcgcggggcgcgcggcgctcgtggggtgcatcaaccagggccgcatcaggcgcgcgcaggccgaggtcagatcggcggcggcggcggcggcggcagcggaaaccatgttcaagcgggacgcacgcagtagtgcaaggtgtgcaccaagacggtgtaccccatggcaccaggctctccaccgaccgcgccgtcttccaccgcgcctgcttcaagtgccaccactggcaaggtccaccctctcctttagcagctactcctcctttgtaaggggtgccctactgcaagccccatttcgcgcagctgttctaaggagaccgggagctacaacaagagcttccagtcacaatcaccccgcgaaatctgcgacggagaagttgactcctgagctgaccagatcgccaaagcaaagctgcgggcatgttttcgggaacacaggacaagtgcgccacttgtggtaaaacagcataccctcttgagaaggtgacagttgaagagaagtcctaccacaagtcctgcttcaaatgctctcatgggaggctgcgccctctcgccgtccaactacgcggccttggaaggcatcctctactgcaagcaccatttctcccagcttttcaaggagaaggggagctacaaccatctgatcaagtgcgcatcggtcaagcgcgcagcagaggcgcaaacagcacaggcggcggcacaaacagcgccggcggctgctgaatcctcctgattatgctgtcatcttcatagtgggctttgagggcgaaagtttggaaagcgcctctttttttacgattgtaacctgctgtgtgctgtgttctagctctggggataccaggactatatttcgtgtccccatatgtggctagctcgatcacgttgttgaaccatggagttgaatgtcatttcggaagaaattgttgtgcatcaagtactgtgtgctttttttctgttcgttgatataaggagttctttgcgtgcctcagtgcttnncaatacttcangcataccattttgctgtctggtttgat

SEQ ID NO: 17744 - DNA, 527 bp, Triticum aestivum
  Clone ID: PAT_TA_17744
tgacccccgacctgttcgacaatgggtactacagggcgctggtgaacagccagggcgtgttcacctccgacatggcgctcatcaaggaccgcaccaccgcgcccatcgtgaggcagttcgcgcagagcaaggacgccttcttcgcgcagttcgccaagtccatggccaagctcgccaccgcgccgaggcccggcgggaacgtgggcgagatccgccgcagctgcttcagccccaacgcccggcgcgccatcgacactgtcgtcgacgccggcgaggaggagggattcgcggcttctgcctgatgtggatcaacggattagcgtgtgtacgcttgctgctagtcgtgcgctagatagcatgcacgtgcatggcttcgtgtatgtcagctgttaatttctgctcccgtgtgtgtgtgcctgctttggctcgatagtctgtagcgtaataagagacttcatcagggagtcactgagtgcttgcttgctcaaggttcaacatttcaatgaaatttcacccggcgggtaccg

SEQ ID NO: 17745 - DNA, 1174 bp, Triticum aestivum
  unsure (1)..(1174): unsure at all n locations
  Clone ID: PAT_TA_17745
cacgcccaccgcaccgcaccaactatggcgatggcgagcagcagcggcggcgcaagcgcactggttctggccttcgttaccgtcgccgttctgctctccccggccctgtccgcacctctggacggcgccggcttccactcggcgacgtgcccgcagctggagagcatcgtgctgtcctccgtccaggcggcgctccagcgtgaggtggcgctcgccgccggccatggggcccaacaccacgctgcagccgcgggcgctgcagctcgtggaggacatccgcgccaaggtgcacgccgcgtgcggcgccaccgtgtcctgcgccgacatctcggcgctcgccacccgcgacgccgtcgtgctctcatgcgggcccaactacaccgtgccgcagggccagttcgacagcctcgcccctgcgtcggcgaacgtcgtcgacagtcttccgtcgccgcgcaccgncagcgtgtccacccttgcgcgcgccttcagcgtcaaggggcctcggcgacgtcgccgacctcgtggcgctctccggagcgcacaccattggccggtcgcagtgcggcagcttctccgaccggtctcagcgcgccgacgacaccttctccaggaagctcgccgccaactgcagcaagcacccggggcggctgcagaacctggacgtgatcaccccggacctgttcgacaacgcgtactacaaggcgttggggttcaaccagggcgtgttcacctccgacatggcgctggtcaagaacaagacgacggcggccatcgtgaagcggttcgccgagagcaaggacgccttcttcgggcagttcgccaggtccatggagaagctcgccagggtgcccaagccggccggcaacgtcggcgagatccggcgcttcagctgcttcaggagcaacgcccagcgtgccgacgctgccgtcgacgccgccggtgaggaggaggaggagggcttctccgcctccgcttgatctgatggttcggtcaagtactaccgtgagtaagatggtcgtcggcaggcaggctagctaccagtgcgttgtgttagcgtgcatgcacggcatggccgtaggccgtagccaatcgtgtttgagttctcggcatgcttcgttttcttgcgtgcagcagtgttggtgtgtgtagcaataaagagacagaggtttcgatc

SEQ ID NO: 17746 - DNA, 943 bp, Triticum aestivum
  unsure (1)..(943): unsure at all n locations
  Clone ID: PAT_TA_17746
cggnacgcgtgggcgccacgtgatcgcccgtgcatgcatgtgccgccgtgcatgtgagccagaggctgctgcttagccgccttcacttttttgctctctgtagaaaaactttccatttctatattacaccaagacagacacatggttggaagggatccatggagcggttggtgcgtgatctaaagccggattggtgccgctgtttctgcgctctgcgtctcacccggttttgttgattgcttcccgttataaatgacgcccactgcttgccgtgaggaagccacaagcccactcaactcaagctcgagcttcacttcagccccacaaatggcgagcagctcactggtagtactggccgccatggccaccgtggccgcgctgctgctctccccggccacatccctgcccgtcttcaccggcgatgcctccccgggcttccacgccgcgtcgtgcccgcagctggacggcatcgtgtggtcgtccgtcgaggcggcgctgcggcaggaggtggcggtggcggcgggcctgctccgcctctacttccacgactgcttcccgcagggctgcgacgccttcttcgggcagttcgccaggtccatggagaagctcgccagggtgcccaagccggccggcaacgtcggcgagatccggcgcttcagctgcttcaggagcaacgcccagcgtgccgacgctgccgtcgacgccgccggtgaggaggaggaggagggcttctccgcctccgcttgatctgatggttcggtcaagtactaccgtgagtaagatggtcgtcggcaggcaggctagctaccagtgcgttgtgttagcgtgcatgcacggcatggccgtaggccgtagccaatcgtgtttgagttctcggcatgcttcgttttcttgcgtgcagcagtgttggtgtgtgtagcaataaagagacagaggtttcgat

SEQ ID NO: 17747 - DNA, 1286 bp, Triticum aestivum
  Clone ID: PAT_TA_17747
ctgtgcggcgctcgaggcggcaggtcgggacgacgcctagccttagctagctagcttactccacagtgtgtccacacccaccgcaccgcaccaactatggcgatggcgagcagcagcggcggcgcaggcgcactggttctggccttcgttaccgtcgccgttctgctctccccggcgctgtccgcccctctggacggcgccggcttccactcggcgacgtgcccgcagctggagagcatcgtgctgtcctccgtgcaggcggcgctccagcgcgaggtggcgctcgccgccggcctcctccgcatcttcttccacgactgcttcccgcagggctgcgacgcgtccgtgtacctcaagggcagcggcacggagcaggccatggggcccaacaccacgctgcagccgcgggcgctgcagctcgtggaggacatccgcgccaaggtgcacgccgcgtgcggcgccaccgtgtcctgcgccgacatctcggcgctcgccacccgcgacgccgtcgtgctctccggcgggcccaactacaccgtgccccagggccagttcgacagcctcgccccggcgtcacagaacgccgtcaacgccctcccgtcgccggccaccgccagcgtgtccgccctcgcgcgcgccttcagcgccaagggcctccgcgacctggccgacctcgtggcgctctccggcgcgcacaccgtcgggaggacgggctgcccgttcttccgcgacagggctcagcgcatggacgacgccttctcccggaggctggcggccaactgcagcgccccctcgccccggccacagaacctggacgtggtgacccccgacctgttcgacaacgggtactacaaggcgctggtgaacagccagggcgtgttcacctccgacatggcgctcatcaaggaccgcaccacggcacccatcgtcaggcagttcgcgcagagcaaggacgccttcttcgcgcagttcgccaagtccatggccaagctggccaccgcgcccaggcccggcggcaacgtcggcgagatccgccgcagctgcttcagccgcaacgcccggcgcgccatcgacaccgtcgtcgacgccggtgacgaggagggattcacggcttctgcctgatgtcgatcgaatgattagctgttagtttctgctcgcgtgtgtacgtgtgttgctgctttggctctgtagtgtgtaataagagacttcatcagcgagtcactgagtgcttgcttgcgcaaggttcaacatttcaatgaaatttccccgaaatatttgtaagcagt

SEQ ID NO: 17748 - DNA, 1661 bp, Triticum aestivum
  Clone ID: PAT_TA_17748
ctcggcgcgagcgccacccagccctctccagctagcttcacctcaaactcgagcttcacttcaggccccaaaaaagtggcgagcagctcagcagtcctggccgtcctggtcaccgcggccgcgctgctctccccggccatctccctgcccgtcttcaccggccgacgcctccccggacttccacgcggccgtcgtgcgcgcagctggacggccatcgtgtggtcgtccgtggaggcggcgctgcggcaggaggtggccgtggcggcgggcatgctccgcctctacttccacgactgcttcccgcagggctgcgacgcctccatcctcctcaacaacacggccgcccgcgagaccgcgctcgagccccaacctcaccatccaggccgcgcgccatgcacgcccatcgacgtccatcccgcgccagggcgcaccgcctgtctgcccgggacgccgtcgtctcctgcgccgacatcacccctgctcgccacccggcgaccatcatcgtcatctccgggcgggccctggttcaacgtgccgcagggaaacctcgacagcctcgcccccgcggcgcaggccaaggtgttcgacctcccggcgcccgacaccgccagcgtggcgacgctggtggagtccttcggcaccaggggcctcggcgacgtggccgacctcgtggcgctctccggcgcgcacaccatccggcgcgcgcagtgcggcagcttcgacgaccgctcccagcgcgccgacgacaccttctcccgcgagcccgccgccaacgggcagcaggcgccccggaccggcctgccgaccgtggagcgtggtcacgccgcccgaccttctagaccgcgtgacttccaggccgccggtgcccacccagggcgtgttcacctccgacatggcgctcggtaaagaacgcacccacgcggcccttcgcgcacagtttgcgcaaacccaagacgccctccttcggcgaccggcccaggcccggggacaaccccgcatcgcgcccagagccggccggcaccccggacccctcggccggccgtccgtgcgtcgcaacgaccggcccgggcgggaccccgtccgtgtccgcggtcgagcggagggattcgccggtggtgctggccgtccatcggcgggttagcacgtgcatgactgcggctgctcccgcgctgcatgtcgtctagagcgtgttcatcgtgcgtggcgtggttgagtgtgtcatatgtgagttctctagtggtcgaatgagtgtctgtaagtttggcctgttgtgggtaaacatgttgcttcttagagaataacccagtgagtcgacgctgccgtcagcgcgtcactgtgtgattgcttggacaagtttcaacacttcaatgaaatttcaccgaaatattaataagcaaagtgagtaagatggtcgtcggcaggcaggctagctaccagtgcgttgtgttagcgtgcatgcacggcatggccgtaggccgtagccaatcgtgtttgagttctcggcatgcttcgttttcttgcgtgcagcagtgttggtgtgtgtagcaataaagagacagaggtttcgatcgtcgaaaaaaaaaatcttgatgaactatgtcatacgtttttctgctaaaaaaaaaaaaaaaaaaaaaaaaaaaaaaaaaaaaaaaaaaaaa

SEQ ID NO: 17749 - DNA, 1078 bp, Triticum aestivum
  unsure (1)..(1078): unsure at all n locations
  Clone ID: PAT_TA_17749
cgggccttcgtgtctgttcccccgcaggggggggaagaaggtaagactcctggtgtctgcgctggtgctctaaacgaaccagagatcatcgcatccgaatcggcagatgcttgtgaagaagtttgtcatactgaggaagctaatctctcgccggttatccagatacctgagcacaacccaagttggatgatccgcaactgacggctatgtagtcgccccagaaccaaccagcagaagacaatgttgcaaaagaattttccattgacgacatgtgcaatgtattcagcgggttgagagttcactgtcgaggtatattttgatcctgcagagtccgagatttgtccgagaaacagaaggatcattgccaggaggaggagaacacctgaagaggatgaatacatgcgaggctttaacccatgggcaccgaatgtgctgcctctggaatcggacccggatgcagagaaggttgatctgaagcatcagacggcggaagaccgcaagaatgccgaagagtggatgatcgactacgcgcttcggagggcggtgaataatctcggccctgctcggaagaagaaagtggagcttctggtccaggcctttgagactgtcctaccgcaggatgagaagaaaagcatttcacctacaaggcctgcccaagcttgcaactgataattctagagttagtggttgaactaatcgtggagtatgttgacgactcgcgagctactaactcggtggtcactgcaatattagtgccagagacccgctccaagttggacgagaaataactacagtacttactagtcagcagagatcgatcgctcgctcgctagagatctctctctggttaaggtaacatggagagggtaaactactcactgatggagagtttcctgtctagtctagttgctgagctgcaaaggagtagctcaacaaccgagctgtgtgtgtgtaaatatatgtgtgtcatagtcctgatgcttggtatttatgtatactgatgtttgtgagagttgcgaaaaatatcaagggcgctgaggtgctgcattnactttgccctgagatcaatcaataaaac

SEQ ID NO: 17750 - DNA, 838 bp, Triticum aestivum
  unsure (1)..(838): unsure at all n locations
  Clone ID: PAT_TA_17750
agttccactacgagtaagcatccaccatttgtccgtcgccactagccacagaatccaacgaagagagagacagagtacactccgctcgccggccgttccattttcctccgccctccccgccttgtcccgttgctgagttgccgtcggctcgcccgaagcagttcgccgccgttgaaggaccatcccagctcgctcgccgccatgaaggtgcgtcctgatgtcgatcggtcgagctggggggctgatttgggttcccttttgcgactcttggttctactccagcgttttgctgatttttggtctcggttgtgtgacggctacagaaggttgtggtgaagctggacgtgaacgacgacaggcacaaggccaaggcgctcaaggccgtctccggtctccacggcatcgaccagctgggcgtggacatgaaggagcagaagatgaccatcgtgggcaccgtcgaccccgtcgccgtcgtcgccaagctgcgcaagctcttcccgggcgcgcagatcttctccgttggcccggctaaggaggagaagaaggacgacaagaaggacggcggcggccacaagaaggccggcggagacaagaaggacggcgacaagaaggacggcggcgacaagaaagaccgagacgagaaggacggcggcgacaagaagccggccgtgccggtgtgcccgccctactggtacccgatgccgccgcagccgcgctacatcgtccacagcgccgaggaggaccccaactcgtgcgtcatctgctgaacgacgncgacgcgccgccgccgcccatcccctgtacatttcgtcgctgtgtaccctacctgtcttcctct

SEQ ID NO: 17751 - DNA, 810 bp, Triticum aestivum
  unsure (1)..(810): unsure at all n locations
  Clone ID: PAT_TA_17751
gccgcggtccggtccgtgtccgtcgccagtaggcacattatccatcgccagagcccagcgagagacacagagtactacactccacacgccggcctttccatttcgctctgctctcccgcctcgtcccgtcgctgagttcccgtcggctcgtccgggaagagcagttcgccgccgttgaagcgccctccccggtcgctcgccgccatgaagaaggttgtgctcaagctggatgtgcacgacgacaggcacaaggccaaggcgctaaaggccgtctccggcctccacggcatcgaccagctgggcgtggacatcaaggaccagaagatgaccatcgtgggcaccgtcgaccccgtcgccgtcgtcggcaagctgcgcaagctcttccccgccgtgcagatcctctccgtcggcccgggcaaggaggagaagaaggacgacaagaaggacggcggcggggacaagaaggagggcgacaagaaagacggggacaagaaggacggggcgacaagaagcagcaggaggcgaagccggccatgtccgtgtacccgccctacggctacgcgcactacggctacccgccgccgccgcccccgcgctacgtcgtccacagcgccgaggaggaccccaactcgtgcgtcatctgctgatcatcggcgccgacgcccaccccccttgttaatttcgtcgccgtcctgcctgtcttcctctgctngccggtggttggtgggcgctgcagggatcgacggcgtcgtttatacacttagatatacagtacgtatgaccgtgtaattaccggttgcatcggcagct

SEQ ID NO: 17752 - DNA, 898 bp, Triticum aestivum
  unsure (1)..(898): unsure at all n locations
  Clone ID: PAT_TA_17752
caggcccagtaatactacgagtaaccgtccgcggacgcgtgggtaccatttatccgtcgccagtagccacaaaaatcatcaccagagcccagagagagacacagagtactacactccgcacgccggccgttccatttcgctccgccctcccgccttgtcccgttgctgagttcccgtcggctcgcccggaggagcagttcgccgccgttgaagcgccctccccggtcgctcgccgccatgaagaaggttgtgctcaagctggatgtgcacgacgacaggcacaaggccaaggcgctcaaggccgtctccggcctccacggcatcgaccagctgggcgtggacatgaaggaccagaagatgaccatcgtgggcaccgtcgaccccgtcgccgtcgtcggcaagctgcgcaagctcttccccggcgtgcagatcctctccgtcggcccggccaaggaggagaagaaggacgacaagaagcggcggcgaccccgccggagacaagaaagagggcgacaagaaggagggcggcgataagaaagacggggacaagaaggacggcggcgacaagaagcagcaggaggcgaagccgcccatgtcggtgtacccgccctacagctacgcgcactacggctacccgccgccgccgcgctacttcgtccgcagcgccgaggaggaccccaattcgtgcgtcatctgctgatcggagtcggngcgcgcgccgcccacccctgccccttggacattccgtcgctgtcctcctctgctgccagtggacagtggttggtagttgctctactcatcagccgcagcgatcgacgcgttacagttacgtactccttgcgttctgatttactcgncgtagttttacttcaattttaactannacacgacgagtaat

SEQ ID NO: 17753 - DNA, 1621 bp, Triticum aestivum
  Clone ID: PAT_TA_17753
atccgaacaagatcgacacaagacagtacgtcgtctgcagttagcacacacctacacgcacgaaagacgcgtacgtcgtagatcgatcgaagaggcttgctgagatggagatgccgagggtctctgaggaaacttccgcgccgccctcccgcctccccccgatgccgcgcgaccgcccacacggcgagacacactaccaccctgcacacgccgccccttccagttccctccgccatcccgccttgcccccgtgctgcgtccgcgccgcctcgcccctccgtgcaggtcgcccccgttgaaggaccccccccggccgctcgccgccatgaagaaggttgtgctcgagacgcacgagcacggcgacaggcacaaggccgtcgcgctcaagggcggcaccgggcgccaccgccccgggcagttggtcctcgctacggacgcccgcggccaccgtagcccccgccgccgcggtaccgcgaccggcgcgccgtctacgcccccatgcacagcgtcggcgccggcgcggcactggagcagaccaggcacggtagtaaagacggtggcgatcacgagagtccgcctcggcaagcaccgccgcggccagtagaaagtgggtggcaagttgcactactaatcagcctacctcccgcagcggcagatcgacggcgtgcgttacagacagttacgtacgtatagtataatacgaccgtgtcatcaccggttgcaccgataactgctgtatgccctaacgtcgcccggctgatgacggcccgcggagcggaccccccattcgtacgtcatcggctgcctgcccttcggcccctcccctgcgcctgcgacagtgaggacccctcctaccgaggcccccgtgctgctactcccgccgccggtacgtaccactccgttgtagttgttgtcatcgtgagccttcctttcgcttctcttacgaccaccgcggtgcagtaggagcacggggactaggctattatgctcaagaccctatacgctccagcgagagcgactgtttctcttttgttctgcacttgctactactggtctgcttgacacatcaaataataaagtgtttaataaaatattcgacagctgagtatagtgtacacacggtcatcctcaacgtcctcatgcagcacctcatgcagctcgccgccctcgccgtgctcgccatggttacgggaggaagaggagcgacggcgtcgaaggccgctggcggctcacgggcggcggagtacctgacggcggcggcccggatcgcggtggccgtgctggtgttcgacgcgtaccggtacgcgtggcaccgcctggcgcacatcaaccggttcatttaccggcacctccactcgtggcaccaccgcatcgtggtgccctacgcgttcggcgccatctacggccacccgatcgaggtcctcatcgccgacacggccggggcctcgctcgccgtcctcgttaccggcctgtcgccatcgtcgccgcgcgccacggccgtgttcctcaccctctgcaccgtgaaggccatcgacaaccactgtggcgtgtgcctgctgccgcgccgcctgcagtcggtcttggacggcgccgcgtaccacggcgtgcccacatgccgcgc

SEQ ID NO: 17754 - DNA, 649 bp, Triticum aestivum
  unsure (1)..(649): unsure at all n locations
  Clone ID: PAT_TA_17754
ctccgatctagatccaggggcgtaacatggtgccaaaacccctccctccgcgccccaaggacctgcaaaaggaccctgcttgtcatggcatcccaggtcatcctggtgaggatatgttccatgcacaggcaacctccaagggcatgcagtgcaggtcctgctggtgaggtgttgttccactggcaggcaaccatcatgggtcctccaccctttccatatgctaaaggtgttttcttggtgaacattcatttcccgccaacataccccttcatggctcccatatgatcttttaagacgtaagtcttccatccaaacatcaatagtaatggaagcatatgtcttgacattcttaaggagcagtggagccctgctttgacaatctctaaggttttgctttctatctgctccctgcttactgatcccattcgacctaaccctcttgtcccagccccagctcacatgtacatatccgatcggccaaaatacgtgacgccaacccatattcggatcacgcttaatgaaatgatatggagtttccggcaatactggcgggaagtatgtctcattcctgcgcctgtgaatcgatcatcaagatcatgcatcacataaccacatgcgcgtaggaatctngcttcgtaaaaaaaaaaaa

SEQ ID NO: 17755 - DNA, 897 bp, Triticum aestivum
  Clone ID: PAT_TA_17755
gcacgagagcaaccgctgcaggccaccacacgctctctcgcgccactccccgcctcccgattcccggccgccgccgccgccgccgagtccgaccatgcacgcggcagcgaccgccccggcgctggcgccgcccgtcctcctccccctcttcctacccaccggcgccggctcctccgcccggccgcgccgcgccgcgcgggccgcagtccggtgcgagctcgccgcctcctccgcggcgcccgcggccgcccccggatccgtggctggcccccgctgggcccagaggacggtcgtcatcccgccgcagcgccgcggctgccacatcatcacccacaagatcatgcacgcgatcaggagcgacctctccgagttcaagtgcggcctggcgcatctcttcttgcaccacacgagcgcttcactcactcttaatgagaactacgaccccgatgtccaaactgacactgaaacattccttagtcgaattgtcccagagggtccatctgctccatggaggcacaccattgaaggatctgatgacatgccagcacatatcaaatcatcaatgtttggctgtgccttgacaattcctatcactgacgggcgtctcaacatgggaacttggcagggtatatggctctgtgaacaccgtgattacgctactcctcgcacaattgtgattacactcagtgggatatgaatggtcaatgctaggagcggcaaatacagtgttgtgattctgatgtgcactgaaattggaactttgctccaactgttatatgagctgccccgagatatcttatttgtagtcttgtttgtgtagttttgtataaggggaataaatagtactccctctgtaaactaatataagagtgtttagaacactaaaaaaaggggggg

SEQ ID NO: 17756 - DNA, 1237 bp, Triticum aestivum
  unsure (1)..(1237): unsure at all n locations
  Clone ID: PAT_TA_17756
ccgtccccccgcgttcagcgtggtcgcggccgaggtcaatttcaaggatcggtgatgtgattgggacatacaatgaccttcgagatcgaatattttctaaatacccagatttgttccccgagaaggtgtacaacatggagaactttacatggtccttcggcattctcttctcacgtctggttcgtttagaatcaatggatggaaaggttgcactaggttccttgggcagaatatgcttaaaccacagcccctgtagggagattgcactccgtggattaggacaacgtcaacccaagggcacaatcgtcagcagctgtatgcgttcgtggccaccacgctgtccaagacgttccaaatccagaagggaaacaaatcctgtgggcgagccaattcacttcccccgatggggtttggaccaaaagtgaggggacaaattccaagtagtggtactctgtgccggactggccgcttcccgacaccgacctctgatgcgaagccggaatggcgagctcttcgaagtggagaagctatatcgacgcattgcctaggcagccttactcgcttttgtactggactcgcactgagataggaattcactagtgattagcgtggtcgcggccgaggtcaatttcaaggatcggtgatgtgattgggacatacaatgaccttcgagatcgaatattttctaaatacccagatttgttccccgagaaggtgtacaacatggagaactttagatggtccttcggcattctcttctcacgtctggttcgtttagaatcaatggatggaaaggttgcactagttccttgggcagatatgcttaaccatagccctgaggtagatgcattcctggattatgacaagtcatcgcaaggaatagtcttcaccactgatcgttcgtatcaaccaggtgagcaggtgttcatatcctatgggaagaaatccagtgggtgagctattgctttcctatgggttttgtaaccaaaaagaggggaaacaaatccaaatggattcaagtttgaaattcttgggggtctccttaaacaagtcctgatgagtgctacaaaagagaaattacaagcactaaagaaacacggtttgtcaagagtctgaaagtttccccttgaagggtcacaggtgggccagttgagctgatggcttatgcctccctgtagtcagtcctcctgaaatgatcaacccttggggaaatggggtgcgccaccaacaaggtcnc

SEQ ID NO: 17757 - DNA, 2054 bp, Triticum aestivum
  Clone ID: PAT_TA_17757
cttttcctgtagcattcacattgaaacacacgtagaactagaaatgcctgcaatacatgatgaggtttgttagcaccgcagcttcgtgaattttcagtgattccaaaagatttgcttccaatattcaagtaacattgcttgtgttccattgctagcatccctgttgctgaaaggtaaggcagccctgcctcaaaattcgtcctcgccggccgcatttccttgacgctcctcctcctctgttttacatcttgtccagccattggagtgcgaccatggcgctacgtgcggctgtgacgggtctcctgcagccggccgctgtccctgtatgtgacggcttcatctgccttgtccccatgctgtccgccggatttgcagaggacctttacctggccagtcgttttggggggtccaaggcaacacgcgagtttgaaatcccacgcccgtttgcccttggggacgtcctgcgcgaaaccggcaagggtgctgggttcctcactgttgatgagattggcatgatgttgcctaagctgctcctgcgccctgaggattcttattacatatttggtgcaagtgctgctgctgccggaatgctactcttgtctgccgaagaaccaattgagcctaatggtataaatttcctttttaatcactttgatttgatgtattgattgctcgctatgttgcttctgtgcggcgccgcgccccgtggccctccgtgctgctgcgaccggtggcctccggccggcccctgcgcccctgtccgggggcggcacttgcctggcccctggccggccggcccgaggagcccgttgcggctggcacccactccgctgcgggtcgcagtgcccagatgtagcgccggtatcccccgccggcccttgcggtttacaggaacggctgcaggaggttgacacggggcgtagcgcagctggctttactccacctcaccatctgcctaagctgcgcccagaggatctttatcatatcctgggcggtggtgctgtcgtcgcgggcttggtgatgatgtccgagggagagaaaaatgatgataaagatgggcaaacatctgagatcatacatgatctaaaggagaagctgagtgaagttaccgagagagcggagaaccccgctgctgagactaagaggctccttgaagatgtggccaatgtcagggaagctaacaagcaacatagatttgaggtctggatggataccattcgatccattcatgaaaaggaacttgctaggcttgaggctggcagtgacaagaaggatgatgggagtggcaatgacaacaagggcaataagagtggcaagaaagacaatgagtgtgacaagaagggcaatgagagtgacaagagtggtggtaagagtgataagaaggatgaaaagccgctcgcaaagaagctgttagaactgttgatggcaccatccaccgtggaaacttggtacaaggatatcacctccaactgggccaagtggagttacttatttggcatggtcccagttttctatgctctcaaaatggcagattatgcaaagattttgaagggcgatcttagcggtatagatcctcgggttgaggtggtggagagcagggcttgcccatgtggcattccctggccgcagagatgctctagatgtggcggaggactcccaaacttcgttggcgattcgggactcgtcagtttccctggtattccaggcgtcaagggcgaaaccttcacagccaccactcccactccagtcccaagggcgacatctcctcggccaccgcagccgtgaagtgaatatgttgctagcgtgagtgacagtgcctctgcgtaggcctgaactgttttctgttcaatgaatattgtgcaactggtttagctgcgttttgagcttctctgatctgggatgtagaaccagtttgtacttaagctgtcttctgcatgatactattgaaggtacgcttctctgatctggcacgttagagaaccagtttgtcatgaagctgtcttcctgcatgatactattgaacgttacgaaacttagctgggaaaaaaaaaaaa

SEQ ID NO: 17758 - DNA, 995 bp, Triticum aestivum
  Clone ID: PAT_TA_17758
cttggggtgtcgacattactgagaaccatgcacaatggttgtgcgaaccaagcaatgggtcttaccggacttctactgcttggggtgtcgacatatcaaatttctatctaactcggttcggtgaactccttattcataaacctgctgaaggcttcctccttagcttgttagctaccatcttgactccattgaagttgatgctttcaaagttcgctgagagctactactccattacaatgaagaagcatgacatggttcctgaccatagtttttttgagggcatagtgggatgttgggttgaacttgcacccaaggatcattacaagaatctagaggaaggcagcatcctgattaagaagtcaaagaccttcagcttttgcaaagaaggtgtgtttgttgaaggtgaatctacgctggtagagagtgacatagttatcttcggaacaggattcaatggcgatcaaaacattaagctgcatgttcacatcaaactacttccagagtattttgattggctcaacatccatgactgtatcactccacagggattgtgtacatcctaagattccgcaactcgctgtcatcggatattctgagagctatgcaaatctccacacttctgaactacgggccaagtggctagcacatttcatggatggtggatttaggttaccaagtgttaaagcaatgcatagggatgtcctagaatgggagaagttcatgaagcggtactttctttgcggaaccattgcaggtctatgctctggccgaagattatgtcccagcgattatattgatcttcaccctaagtaagggcggatcttaagccaggattctcttgtatggggcttgattactagtctatgcttcttcaaacatgtacatgcttctcgactataatattacctgctggcttattatttattcaaattcaataaaacgtgttgtcattcaccgttccctaaaaaaaaaaaaaaaaaaaaaaaaaaaaaaaa

SEQ ID NO: 17759 - DNA, 1453 bp, Triticum aestivum
  Clone ID: PAT_TA_17759
ggggggggggggggggaggtctgaggagtctgggcggtcaggttggtagccctgaagaaccctctcgcaggcaaccggaaggggagaggtccgaggggctgccagctgagatgatcggagggcctggtgaagctcggctggcctcaggtaagatggcaaagttgaaggagttgttggacagaagtgaaaatcgcatttgtgctgactgcaggcgcacctgatcccaaatgggcatcatgctaatattggagtattcatatgcgtaaaatgttctggcgttcacatcaagtctcggctacacatatctcaaaggtcctgtcagtggacacatctaatattggggtattcatatgcgtaaaatgttctggcgttcacagaagtgtcggtacacatatctcaaaggtcatgtcagtgacactagataagtggtctgacgatgaaattgactccatggtaagaagttggtggaaactcgcaagccaacgcaatctatgaggcctttctcccagaaggctaccgcaagccacacccagattccgcccaggaagagcgacaaaagtttatcaagtccaaatatgaacttcaagaattcctggagccaagcttacggattgtctctaatcatcctagtgatgccggaaaacaagcatctaactcacattctgctagttccaagagtgagattggcatggttgagttcatcgggatactgaatgtcaaagtcatcggaggcaccaaattagctatcagagatatgtctagcagcgacccttatgtcgtcttgaccctcggacaacagaaagcacagacttcagtgatcaaaggaaacctgaaccccgtctggaatgaagaactcaagctctctgttcctcagaagtacgggcctctgaagctgcaagtgttggaccatgatatggtttccaaggacgacctgatgggggaggccgagatcgacctgcagcccatgatcaatgcggcagcatcctttggagatccagagctgctcggcgacatccagatcggccggtggctcaagtccggcgacaacgctctaaccgccgacagtgctgtcatggtgaccggaggcaaggtgaagcaggaggtcactctgaagctgcagcacaccgagtcgggggaggtgacggtggagatggaatggatggctctaaacatttagaggatccggatacgatggcaaatttgtattttgatttgtattttgctgcaaaggatccattgaatcgactttttttggaaaaataataatttttgctactagtagtaggcaataacaaacataacctgaactcaagccttggctctgtggttgggcatgcggttgtgcagcctaacgacccgagttcaattcctagaattgacaggtgatgtacatgggttttcccccatttattgaagatcaagtttggtgtgtggtggaatcactcatcaaaaa

SEQ ID NO: 17760 - DNA, 494 bp, Triticum aestivum
  unsure (1)..(494): unsure at all n locations
  Clone ID: PAT_TA_17760
ggattgttgatgcctttanaccttgatggctgcctgttngaaataatactcatggaggttttctacagagacatacggacaaacacaagcaatctgtgtgagcttaatccatctcacattgaggttgaatgcttgattgactgaacggccacctggattgcagtatatatatcatactatgcgctaacttcactggaacattttgagaggatcggcaggtggtacaaatcggcctgcttgttcataatggaagttacttaaaaccgactgatattagcttgtttttcctttctcttcgtgtgagcgcaaacgtgcacatattcgttataaaatctccacatttttggtgcctaggcatattcatccgctgtgtagatcagactgtaagagtgaccacacataccccacatgtgctgctcccttgaaagcttagggacagcctctgattatttgtaatctgtaaaactgtgagtgaaaaaggattgttcttctct

SEQ ID NO: 17761 - DNA, 1598 bp, Triticum aestivum
  Clone ID: PAT_TA_17761
catcgtcgtctcgctcctcttctacctcgccggcctcgtgctgctcaccctgtccgcggcgatctcgcccttccggccgtcgtcgtgccaggggctctcgtgcccgccggcctcacggacccagttctcggtcttcttcgcggcgctgtacctgacctccatcggcacggggggcgtcaagtcggcgctcctgccgttcggggcggagcagtacgacgacagcagcccggaggagagtcggaggaagcagtccttcttcacctggttcttcggcgccatcaacctcggcatcttcgtcgccgggacgctcgtgtcgtggctgcagcagaacgtgtcctgggcgctcggcttcggcgtctccgcgctctgcctcctcctggcggcggcgggcttcctggccggcacgccctggtacagggtgcagctccccgccggtagcccgctcagggacatactcagggtggtggtggcgtccgtcaagaagaggaagaccaggctgcctgcagccgcgggtcaaggtgaccttggcctgcacgaggtggcggaagacgacgacctgcagaagctggcgcacaccaaagggctcaggtgtctggacaaggccgcggcgaagggcggcgacggccacgaaggcccgtggaatctgtgcacggtgagcgaggtggaggccgtcaagatcctggcgcgcatggtgcccatctgggtgacgtgcgtgctgtacgcggcgtccctggggcagatgaccaccaccttcatccagcaggggatgaccatggacaacaagctgctcgggaaggtgaaggtgccggtggcgtcgatggtgtcgatcgaggtggtgttcatgctgctgtgggtgcttctgcacgacgccgtcatcatgccgctcgcccggaggtggggccgagccgggagcgccgggctgtcccagctgcagcggatgggcgtggggagggtcctggtggttctggccatggcgacggcggcgctggtggagagccggcggctgcgcgtggccggcgcgggcaggaagatgggcatcgcgtggcaggtgccgcagttcgtgctggtggccgggtcggacgtgttctgcgggatcgcgcagctggagttcttctacggggaggcgccggcgtcgatgcgcagcatctgctccgccttctccttcctcgcgctgtcgctggggttctacgtcaactcggtggtggtgacggcggtggcggcgttgaggcccgggtggctgacgcgcgacctcaacgaggggcacctggattactacttctggctgtgggccgtcatcagcgccggtaacctgctgctctacctgctgcttgccgcccggtacacgcccaaacaagtcctccgccactcgccatcgccatagccgccggcaccgagttagctaatgcactgctccgtactatgatgaatgtctgaatgatgatgtaacttggacacatcacgccatagaagtctcgctggatataactcttgttttgtacatgctcagagggtgttgttaacgataacaagctgggagatatgaaaggcagtttttctttatattagcaaaacaattgatgaataattttcagttcgtt

SEQ ID NO: 17762 - DNA, 645 bp, Triticum aestivum
  Clone ID: PAT_TA_17762
cggcacgaggaactgttgagaagagtcgagaaagccaccgaggaagcacttgccggccggctcgggacgaccaccagtacgcgccagcttctcggttctcgtctaggagcaacaacaatggccatcacttctctgcagctgccctctcagatccgcggccatactcctgctagaaatggccgcgcccgcacaaggtcacgggctactccgcttagctgcaaacacaaccagtcaaccattgtccaagtagccagcaggacatctcgtagaagtaccctggcatacatttcgtctgccttctttgcaatgttcctggtggctgaacatgcagaagctagaacctcgagacaagagaacaagaggaaagtaatggagaagctggagaaggtccgggaggaggccctgcgctcaaaggagaagaaagaggacacgagcaaggagtctgtggcgaacttgttgatgcctcctactttggtcgatgcttacatctgaaaaggcatcgtgtcgttgtaaattttatgtttatgctaagtgctacttaacactattctgaatgtactaataacaattggaaccaagcaaccttgcaaaagaactttccggtgtcctcgctgcattgtttttcataaaaaaaaaaaaaaaaaa

SEQ ID NO: 17763 - DNA, 647 bp, Triticum aestivum
  unsure (1)..(647): unsure at all n locations
  Clone ID: PAT_TA_17763
agcgggaagccggggacctcccccgggacgcacgcgtgaggggggaaaccaccacagcagagaagaagaatcaagccaggcgagcagaggagagggaagacatggatgtgcgcgaggggacgcggaggatgaggggtgcttccatccctgctccgctcgagggggatggcgagagcctgctgctgatgtatctgcctcagccggcgccggcgtcggcgtcggcggcgatgatgcccacgccgccgccctcgttggaggacttcgaagctttaggagaagatggcaggctgttgtggccgtccaaagaattgctcaggcagatgttggtggccatcgccccggccggatcgattccgcccgctgtctaattaattacgagtagctttctttctactcgatcgtctgcccatatgtaataaaattgtgaccatcgatgagggcgactactttgtttgtatgcactgtcttgttttaatcgatgatggactgcctactgtctaataaattgttgtttgtttggcaaaaaaaaagggaggtaaaaaaagggggccgtaccaatcnctatataatctataccccctacngcgtcttanactctactggaaanctgcgtaccaantaaccctnaaaancccttccacgntaag

SEQ ID NO: 17764 - DNA, 998 bp, Triticum aestivum
  Clone ID: PAT_TA_17764
gccggccggtccgggaattaatagaaagaccaacccctcaagagacacatccttctcatccttgcctcttgcgttctcttctccgtagcttgcagataagtaagcttgtccgttgtgcggagaggggaggcggataggtacatacacatggaagggttgcagagatcgtcctccactttcagaaggtccggctcgtcgggcctggtgtgggacgagcggttcctgaccgagggcgccgaggcgaaggccgccggcgagggcggcaccgatgaagcccaaccggagatgcggcgctcccggagcacaggcggcgtcgggatgatgctgcgccgcggtggcgatgataagaagcagcagcagcagaaaaaaaaggagcaacaaggccagaagaaggacgaggagcgcgatccccaggtgttccggaccaaggaggtggccccggacgtggaccctccgtcgccgagggtgtccggctgcatcctctgtgccatcttcggcggctccagctccggcccgggagccgcggcgcgccgaggccgcgccaagccgaagaggaggcaacggtcggcggtgtaaaggttgatcgggccatggtggatgtcatgcgagctgtgtttatactggagtgacgatgatgatatactactgatattggttggtttgtattgtactctgctctgcgttactgcgtacgtagtctatacgtgtcaggttagttcctcttttttgggttagtttctgggttcagatccgtgagcagcagcagctgctgagatctgtgatgttctttcttgatcttgcgcatgaattttttcccgtcccattggttgcttttgagcagcaggtcatcttactccttttgacgttcggcttggaccggcaacaaaacagacacgtgcgattgggcggcagatctttggggcgccgggcatgtgtgttcatgctgcccaagctatggcgaatttcctcgtccttgcacctcggccgcgaccacgcta

SEQ ID NO: 17765 - DNA, 571 bp, Triticum aestivum
  Clone ID: PAT_TA_17765
atcggtggaccgggcggcggtcatggagatgccttgtgaacagccggcggtcaagctcatcggctggctgagcccgtacgtgcaccgggccgaggtggccctgcgcctcaaggcgtcccctacgacctcctccacgacgacatggccagcaagagcgacctgctgctcacccacaaccccgtccacaagaaggtccccgtgctcctccacggccaccgctccatccccgaatcgctcgtcatcgtcgagtacgtcgacgaggccttccccgccggcccgccgctgctcccctctgaccccctcgcccgcgccaacgcccgcttctgggcacgattcctcgacgacaagtgctggaaggccctgtgggtggcgctgtgggcggagcccggcgaggcgcgggcggcggcggcgagggaggccaacgagggcctggcgctgctggaggcgcagctgccggtgtggaagcggttcttcggcggcgacgccatcggcctccttgacatggctgccagcggggtggcgcgctggctgggcgtgttcgaggagatggccggggtgcggctgctgaccg

SEQ ID NO: 17766 - DNA, 1809 bp, Triticum aestivum
  Clone ID: PAT_TA_17766
ctacaggcttctcgtagacaactccggtggcgctgatccggcgcgccagcatctgtccccgcagggcggcgggagcgggcagccgccagtgccgcgctccccgacaccgctcgacctcgtcgccccgtcctcccctcaccacaggcgcctctccgcctcgccccggcgcccggctcacccgcaggtgcgtctcccatcgccctacggggagatcccctccggcgccgcggcccaccacgcgcgctcgctctcgcagcccctcttcctctctctcgactcgctcccaccgccgccgtacgccgatctggcgcccccccccgccatcgccccctccccgccgtcttcaagccccgacacgccgtgcttcggcctgccgcggcgtacggccagacaccgccgctctcagcagcgacatccccttcgggttctcgcagctcagcccgcccctgccgcccccggcgccggtgaagcgcgagggcggacaacggggcaagctggcggcacgattggagggcgacgacgctgcgttgtacgaccttgtcaacgcctacatggacctggacgggatggacgcgctcaactcctccgaggaccgccacgacgaccgtgacattcacagccgtgccagcggcacccgcgctgccagcgcggccgagagcagcgaggaacgaagccgagagccagtccacctcaggggagaggaaggacggcggcagcactcgccgctgtcggcataggtccatggacagcttcatggggtcgctctaccaggccagaaatgcgaatctagccaaagcatgatgagttgaagcatggtgatcgtatgtgctatgtgcgagcggagagaaaataatatcttttgattatatcagacaggttgtaggattgatagcagtggttgggcaacggatgctgcccgagttcttttgtttaaggtggtgcctcgcacagcgtggagcatggtcgtcgtcgtaccgtattgtctgtcgtatattcgtgctgtacatgagtaccttacctggtgagtcactgtggtagtcttctcattaaagattcttgccgaggagtggttacagaggcgactacgctttcagcacagttgacaatgatgcagagggactctggaggacttgcgactcagaacaatgagttgaaaataaggctgcaagcaatggagcaacaggcacagctgagagatgctctgaatgaagcactgacgggtgaggtccagcggctgaaacttgcaaccggtgagattacggatgctcgtatgtcgaaggcgggtctacagcagcagatgaactcccagctgattcaaatgcagcagctgcaaatacagcagcagcaacagcagcagtcatcacagacgcagcaggctcagcaacagcaacagcagcagcagcagcagcagcaacagcagtcgcagcaatcagcatagaccaagttacaaagaacctggatctctgtagcagaggagaaacgcgaatctagacaagcatgatgagttgaaggatggtgatcgtatgtgcgagcggagagaaaataatatcttttgattatatcagacaggttgtaggattgatagcagtggttgggcaacggatgctgcccgagttcttttgtttaaggtggtcagcgtggagcatggtcgtcgtcgtaccgtattatctgtcgtatattcgtgctgtacatgagtaccttcctggtgagtcactgtggtagtcttctcattaaagattcttcccgacgagttgtttctgcgagtctttgagattattatattacaaaatctacaaaaacccccccccc

SEQ ID NO: 17767 - DNA, 1729 bp, Triticum aestivum
  Clone ID: PAT_TA_17767
cgctgttcactcctcccctcccctccagcgctcgcgcaacgcggcggttcgacccagcacgacgctagctcctttttggtgtggagctacctagctagttaacgccgtggacgacgaagatggtggctagcgccaggatgcttctcgttgccgccgtggtagggtttttggcaaccacggcgtgccaagccgcccagcggaactacgccaccgcgctcaccaagtcgctgctctacttcgaggcgcagcgctccggcaggctgccgccgacccagcgcgtccagtggcgcggcaactcggccctcaaggacggcgccgaccacggggtggatcttaccggcggctactacgactccggcgacaacgtcaagttcgggttccccatggcgttcacggcgaccatgctgtcgtggagcgtggtggagcaccggggccggctggccgcagcgggggagctgggccacgcgctcgaggcggtgcgctggggcgccgactacctggccaaggcgcacgcccgccccgatgtgctctacgtgaatgtcggcgacggcgactccgaccacgcgtgctgggagcggccggaggacatggacacgccccggaggtcgtacttggtgaacgccacccacccgggctccgatgtcgccgccgagacggcggcggcactggccgcggcctccgtcgcgttcacggggccgcgcggcgactcccggtacgcgtctacgcttctgaagcacgcgaaacaggtgctccagtccgcctcgtacatccctgcccgcttccagacccgcacgcctgcggccggcagtgcctgcactgcccgcggcgtccacgaccggctcctgtcggctcctgtcgggcgccccatcgccaccggccgccacgggtacgaggcctacatcgccggcgccaacaacgtcggcggggtgcggcactcgttttcctgggacgacaagttcgtcggagcccaggcactggtcgccaagctcatcctccaagggaagctacccaacaacggccgccacgccgagatgaggagcaacgtggagagcttcctctgcaacgtccttcagcacggtgacggccgcagcgggcggctcaccccaggcggcatgctctacctgcagccctggtctaacctgcaggacgtcacgacggcgatgttcgtcctcgtcacgcacgccgaccacctggcggcggcgagggcttccctgcagtgcggcggcgtgaggctgccaccggcgcagctcgtctcgttcgcacggtcacaggtggactacatccttggcaagaacccaatgaagatgagctacatggttggggttggaaagaggtacccgttgcagccgcaccaccgcggcgcgtcgctgccatccattaggaaatacccggggaagatctcctgcggcaagggagccgagtacttccacaggtctgcgcccaacttgaatgtgattgacggcgccatcgtcggagggcctgacaacaacgaccattacgacgattctcggggaaattaccagcaaggcgagccatcgacctacactgtcgcgcccatcgtcggagttcttgctaggcttctccataactgatgttctgttcctgttttcgtcaagagatgtgcaatgtcaatgccatccttgtaatttaggcagatataacttttttaataaaagacttataccgacaacaacacaggcattgtttccttccaaactttgaaaagaac

SEQ ID NO: 17768 - DNA, 949 bp, Triticum aestivum
  Clone ID: PAT_TA_17768
gctgcgctgcggccccacgcctcgacgtctcgcttccgctgcaatccaccctgctctgctctgctctctcctcttcctttcccagcggaggagcctcagctgctcccgccgcgagatccggctccaccccgagagttcgctcgtcgtccgatcgcctgatcggcggcggccatgggctgcgctggatccacacccaaagttgatgagagcagtaagaatctaaggaagcctaagccttggaagcacactcagccaataacaccagcgcaactcaaacagatgcgtgatgaattctgggacacagctccacactatggtggacagaaagagatttgggacgcactcagggccgctacagacgccgatttaacccttgcgcagaccatagtggacagtgccggaatcatcgtatcgaatcctgacctcacgctttgttacgacgagagaggtgcaaagtacgagctgcccaattacgttctgagtgagccgacaaacctgatccgtgatggctgaacaaataaaaactcggcgtcggcataaaacggacgcttgatacagaaacgatgctcgtctagacgtgcacacgtttgaggagagtagtacataaagctggtccgtgtaagttacgtaaaatcgttggtttgtcgctggttcggggtcgtgttcatatcatatcggtggaatgaatcatgggaagggtcattggctatcaacagtcacgctgctggctattgctatttgccagggcggttgtagtccttgagctgtctatctgtacccctttcctctgtcctgctgaagggagctgcaccagtggtgtcgctgtgattttgacccatgcgttgcgcttgcgggttgctctatatagcaatcataatggggacagactgcttgattgctgcttcttatttgtccctttaaacggtcctataaacgtaccaacaccact

SEQ ID NO: 17769 - DNA, 599 bp, Triticum aestivum
  Clone ID: PAT_TA_17769
gccggccgggtcggggtccgccttagccagtctcaacctcgccctaccagctcaacctacgatacgccatctcgcctacggtacctgcccgagaaggataattcaagatggcgaccgagttgaccgtccagtcggagcgtgctttccagaagcagcctcacatcttccagaactcgaagacaaaaaaaaaaaaaaaaaaaaaaaacttgttcgtttcgctggtttcgttgcgagtcggcgctcgggatattgcgtctagatattcttggtccggtcatactctgcgcgattgctgggagcatcgcctgtactcctctactgatttcatcgctggtcgattcggtcggcgtttcaagggtccatgatatggctcctttacataatatacatctccaaaccaaaaaaaaaaaaaaaaaaggcccctaaaatggttgtgctatagatgcaatcgcgaataaaaaaggattcacgaagacaattgttttgggttgatggttcaatcgggcgtgatatggctaggaaaagggtcgtcatgatctcaagattacgttcatacctttgaaaaaaaaaaataaaaaaaaaaaaaaaaaaggccccta

SEQ ID NO: 17770 - DNA, 812 bp, Triticum aestivum
  Clone ID: PAT_TA_17770
gccggccggttcgggaaactactgtccgccttagccagtctcaacctcgccctaccagctcaacctacgatacgccatctcgcctacggtacctgcccgagaaggataattcaagatggcgaccgagttgaccgtccagtcggagcgtgctttccagaagcagcctcacatcttccagaactcgaagaccaagaccaagtccacccgaccgggcaagggtggccgacgatggtacaaggacgtcggtctgggtttccgaacccccaagaccgccattgagggcagctacatcgacaagaagtgccccttcactggtctcgtctctatccgtggccgtatcctgaccggtaccgtcgtttccaccaagatgcaccgaaccatcatcatccgccgcgagtaccttcactttattcagaagtactcccgatacgagaagcgacacaagaacgttgccgccgtccgttcccccgccctgcgtgtcctgccccgaaccggcaagtctgttaagaagttctccaagttttaagttgggactatcctaccttctggcattttttcggcgtgataagcatcagggcaaatggaaagtttcccctgaagggtcgggcaccggatattgcgttgcaaatggttgtgctatagatgcaatcgcgaataaaaaaggattcacgaagacaattgttttgggttgatggttcaatcgggcgtgatatggctaggaaaagggtcgtcatgatctcaagattacgttcatacctttgactattcaccgaccaaaaaatgccagtgctgtgaggagctgatgatttgac

SEQ ID NO: 17771 - DNA, 958 bp, Triticum aestivum
  Clone ID: PAT_TA_17771
gtcggccgctcgacgcggcgggcgggatctcacatcatcaccttcaatccaaaccaacttcacttacaatcttctgctttcacccaagaagcagaatcagctacagcaactagatctactcgatcaactaccaaaaaccccaatcatcatgacggaaccactttccaaggtcgactcagctgtccaaggtctctcaagctcaccccccaaggaggagaagaagacgcggcgacaaagttcagcagcggcacctggtgtctacaacatcaatgacctcgaggccgagggaattgaactcgagctcgctcccgagactcaaaagactggatggaaaatcaacaagagctctagcacagtagaggatgctgctatcctcaagcttcacctcacgaaacctcccgtcaagagaattgcccttcacttcccattaggactggaggtgcaagcacgaaacctcaagggtgtaacaatcaaggacgcccttgatgccatccacaaggcgtacaagaagcggtccgatgatgagcttgacaagccctacctcgctggtttcgagtgggacaaggaagagtcatggacccaacttattgttcacacccaggctcagcccacagccacaacattggacggaccttcgggtggcggcggcggcaagaagaagaagaacaagaagaacgaggaataatctctctcggcaaccatgatatatcttccaatacttcctataattcttgttcgtttcgctggtttcgttgcgagtcggcgctcgggatattgcgtctagatattctcggtccggtcatactctgcgcgattgctgggagcatcgcctgtactcctctactgatagttgtcatcgctggtcgattcggtcggcgtttcaaggttccatgatgtcatggctcctttacataatatacatctccaaaccgaaaaaaaaaaaaaaaaaaggccccta

SEQ ID NO: 17772 - DNA, 1601 bp, Triticum aestivum
  Clone ID: PAT_TA_17772
cggccgctcgccggccgggccgggatcacacatcatcaccttcaatccaaaccaacttcacttacaatcttctgctttcacccaagaagcagaatcagctacagcaactagatctactcgatcaactaccaaaaaccccaatcatcatgacggaaccactttccaaggtcgactcagctgtccaaggtctctcaagctcaccccccaaggaggagaagaagacgcggcgacaaagttcagcagcggcacctggtgtctacaacatcaatgacctcgaggccgagggaattgaactcgagctcgctcccgagactcaaaagactggatggaaaatcaacaagagctctagcacagtagaggatgctgctatcctcaagcttcacctcacgaaacctcccgtcaagagaattgcccttcacttcccattaggactggaggtgcaagcacgaaacctcaagggtgtaacaatcaaggacgcccttgatgccatccacaaggcgtacaagaagcggtccgatgatgagcttgacaagccctacctcgctggtttcgagtgggacaaggaagagtcatggacccaacttattgttcacacccaggctcagcccacagccacaacattggacggaccttcgggtggcggcggcggcaagaagaagaagaacaagaagaacgaggaataatctctctcggcaaccatgatatatcttccaatacttcctataattcttccgccttagccagtctcaacctcgccctaccagctcaacctacgatacgccatctcgcctacggtacctgcccgagaaggataattcaagatggcgaccgagttgaccgtccagtcggagcgtgctttccagaagcagcctcacatcttccagaactcgaagaccaagaccaagtccacccgaccgggcaagggtggccgacgatggtacaaggacgtcggtctgggtttccgaacccccaagaccgccattgagggcagctacatcgacaagaagtgccccttcactggtctcgtctctatccgtggccgtatcctgaccggtaccgtcgtttccaccaagatgcaccgaaccatcatcatccgccgcgagtaccttcactttattcagaagtactcccgatacgagaagcgacacaagaacgttgccgcccacgtttcccccgctttccgtgtccaggagggtgaccaggttaccgttggccagtgccgacctctcagcaagactgtccgcttcaacgtcctgcgtgtcctgccccgaaccggcaagtctgttaagaagttctccaagttttaagttgggactatcctaccttctggcattttttcggcgtgataagcatcagggcaaatggaaagtttcccctgaagggtcgggcaccggatattgcgttgcaaatggttgtgctatagatgcaatcgcgaataaaaaaggattcacgaagacaattgttttgggttgatggttcaatcgggcgtgatatggctaggaaaagggtcgtcatgatctcaagattacgttcatacctttgactattcaccgaccaaaaaaccccagtgctgtgaaaaaaaaaaaaaaaaaaggccccta

SEQ ID NO: 17773 - DNA, 693 bp, Triticum aestivum
  Clone ID: PAT_TA_17773
attggctcgccgcagagactcgccggctcgccaccctgagctacaaggtggcgagagcagcgaaggggccgagcgctgtcgtatgtcgtgcggcggccacaccgcatggccccactcacggcaactacgcgcacccatacaccggcctatgtcgcgcgcggaagcagcgaaggggccgagcgctgccgtgtgtcgtgcgacagccacaccgcacgtagccactcacggcaactacgcgcacgcatgcaccggccgccgtcgcggcgtgagcttctcctgtccgcgcactgccgcaaccacacctgagttcttccaacacgcaccgcccatggtcagacctgtggagccacacatgcaccgccgcgaagcgctgcttgatcccctccatggactcgcgctacgccgccgcagaccgtcgccctagccgcggagagggccaagatccgtggagctgctcttggagtgagcatatcgtccccgtgcatgtctggctggggtatcgtttggttggggcgttgggcggcagggatggcgaattcctcctcagggggcggcctgtcgtatttccgttcctttgcttcactcactgtttcaggtcgtcgtgtgtttccttggtttgttatgcctgaattgagcttctctgcagaataatgaggttgatgctaacatgtacctgcccgggcggccgctcga

SEQ ID NO: 17774 - DNA, 638 bp, Triticum aestivum
  unsure (1)..(638): unsure at all n locations
  Clone ID: PAT_TA_17774
cttctcttctcccctcgtcccctttctcccccagctcgagccctaggagggcgccgccggccgctgccacccatccaacgcggcgccggtgctccgccgcgcccccgcaggttccccgtcccatactcactgcattcgccaccccatctcctccttcccccgcccatcctcagcgcacccggacgcccgatcctacctcagctccctccgtcgctcgtcgccggcacccggttgacctgctccgtcgagcttgccgccggatccacaccagagagctcacttctcctagctcccttcccatgccggcttcctgttcctgggctatttcgagtttgtacagtgtctggagctgctccctgctgccgaacgaatctctgctcccgtcagaagctgtctgcggctggcttcgcgagaagcaggctatttccagaagctggagaggatccgaacgggcccttactctcttgaaaccagattgattttctgcattacaatctccctcttttttttattcaggcgtgaggacaaagaaccaaatgtcttgacctcgaaggggctgcttggcactacaacactgggggagtcaatcactaacgcctcctctctgctgcagcctacactgtatgtatctctcgtnn

SEQ ID NO: 17775 - DNA, 719 bp, Triticum aestivum
  unsure (1)..(719): unsure at all n locations
  Clone ID: PAT_TA_17775
aaatccttttctctccctttactttcctttcctttttttctcctctgatcccgcaacagnaatcctatatnctatacaagcccgttcacaaaattcccagcgtatttggtacaaacagataagctgaagctcctgaaataccagacagaagatggagtaaaaaccgaacacatactaatactcacagaatgatactatgttctgatacagctctggtttgtagctggcaggaggtttggcctcagacggcgtcccacgcgcctccttcgcgctccggggcacggtacgaagaccctaggtcgtctcccgattgccgccttaacatgctagccctctgcatcagacgcacaagttgctggacgacctcggagatcggcggccggtacgccggtgccggcggcgctgtctgcgcgtcttcgtccccccaacgggcctgcgtgtttgctgggtacatccctgccattgccgggcccacctgctcggcttgcgcatcgccgtcgtgttccccccgggctgcccaccccgcatgcccccgcccggccctctccctcgttccgccgagccccttgccccccgcaagtggcccggactcctctgctcctatcccgtgctcgtctctcctgaccgttggcgtgcctggcgcgccctattctcggccacggtaccctgccgggcccaccaccccgcctgttaccgctaggagcgcgatgccggccgaa

SEQ ID NO: 17776 - DNA, 553 bp, Triticum aestivum
  Clone ID: PAT_TA_17776
cgcgcggtggagaagggcggatcttcgtacgatgatgttggccggctcatggacgtgctgacggcccgtcggagctccgtcgaggttggccaagacatccaggccagctgatgggctggtacgacggtgtgtgtgttaatttgggcagcttggaactttccttttgctgattaatggccgctagatccgctggcgatcttttgctagtacgacagccatgacgccatggaatttaggtcctatttggttcataggtgctaggactttttttagtcccatcttataagtctcaagtccttaaaaagtccctacctgtttggttcctaggacttataaatccttataagaccatattacaactataagtccctataaatccctccttaagagtcttattttataagtctcaaatgcccactttaagttcctataagtcctttctgtttgggttagatgtccttaagccaataaatccctagaaacgaacaccctaattgtacgtcgctgttctctgagaaaagtgtaaaatgagtaagaaaacttttctttttgc

SEQ ID NO: 17777 - DNA, 1395 bp, Triticum aestivum
  unsure (1)..(1395): unsure at all n locations
  Clone ID: PAT_TA_17777
gaattgcggacggtgccgcttgcgtctgatctagtatttgtactcgatctcatcctccacgccggccgtagtactttccggctagctcgccagccatggctgtccacgacgagccgctgcacatcctcttcttcccgttcctggcctccggccacctcattccgatcgccgacatggccgcgctcttcgccggccgcggcgtcaggtgcaccatcctcaccacgcccgtcaacgccgccatcatccgctccgccgtcaagcgcgccaacgacgccttcgccggcaccggctgtcccgccatcgacatcgctgtcgtgcctttccccgacgtcgggctcccgccgggggtggagaacggcacggccctctcgtcccaggacgaccgcgacaagttcttccacgcggcgactctgctccgggagccattcgaccggttcctggccgaccaccgcaccgacgctgtcgtgtccgacagcttcttccactggtctgtcgacgccgccgcggagcggggcgtcccgcgcatcgcgttcctcggcagcagcatgttcgcgcgctcctgcagcgacagcatgctgcgccacaacccgctggagaacgcccccgacgaccccgacgccttcgtcgccctgccggggctgccgcaccgcatcgagctgaggcgaagccagatgatggacccggctaagaaagccgtggccagtgggagttcttctacggccgtgaacgccgccgaccagaggagcttcggcgaggtgttcaacagcttcctcgaccggtccgtcgtgaacttccgcgtgtgggtcatcggcgccgccgcaggccaaagactctgctgaatggatgcccgaaggcttcgcggacctcatagcgcacggcgaccgcggcttcctaatccgaggctgggcgccgcagatgctgatcctgagccacgccgccctgggcgggttcgtgacgcactgcggctggaactccgtgctggaggccgtgagcgccggcgtgccgatggtgacttggccgcggtacgccggaccagttcaaacaacgaggagctcgtggtggagctgctcaaggtgggcgtcaagcatccggggccaaaggactacgcgtcccggcatccgaagcccacgangtgatncccggcgaagtgatngccngatccatccaaaangctgatggaaaacgacgcatccaagaagaaggcaaagactcnggttaagaaggnaagccccgttnnaaaaggcggtnttcctacaatattttggccgtcaatggactnctgacgcctntngatccttcaagttggcaaaaatcaagcaacttatgntggacacggttgtgtaattggcaactggaattcctttccgataaaggcncaatcctgnattttcaanc

SEQ ID NO: 17778 - DNA, 1118 bp, Triticum aestivum
  Clone ID: PAT_TA_17778
tcggcacgaccgcgcactttactccgctctgactgactccccgctcgcccaggtggatacatagataggctgatagatatagctttggaaggatcggatcggatcgacccaagcggctgcccaagtacgccagcgtcccatcctcgtcggccgagcgagcaagtgcagccccggctagcggcagcggggaacagacatggtgtccctgcagtcggcgctcctgccggaggccagcaagcggcccccgtgcctctccttcgccgacgccagcgtcgtcgcgtccaccgccaccagcaagaagcggaagcgggacggcgaggtggaggaggaggacgaggagcacgatgggatcgagctcaatttcgacgccgcgccgctcccgctcgagtggcagcgctgcctcgacatcaagtcggggcagatccactactacaacaccaggacgcacaagaggacgtccaaggaccctaggcggcacggcggcgcggcgcccgcggtggaggaggacgtcgcgaattgcgggccgcaagggctggacctggacctgaacctggcgttcgagccgcggcatagctcgcccgtcaaggagctgcagaagaaggccgaggccaagccagcggcggcgggaggcgatcgtcacggggatcaggcgccgggcagcgcgtccggcggcatggagatggtggcggccgtgtgcatgcggtgccacatgctggtgatgatgtgccgcgcgtgcccggcctgccccaactgcaagttcctgcacccgacgagccggcccacgccgccgccgccggagccggcgccgctcaagctcgggctccagctgctctgctgcagggactagctcgctcctatcgatcatgcatgcatggaccaagctagcattcgaatatccgatcgatcgtctcatggtgcacctagataagtgcaacgaggactgttacagtgcaccacaagtaatgttgtactctatgtgaccatccatgtagccgcgggcgtgtacgtacatgtgcaagtaataaacaatgatagtaacaaaatatcgttgttcacacgtacgtactgtattgcatgtagaggccatggccggctatagctattacggtaaaaaaaaa

SEQ ID NO: 17779 - DNA, 574 bp, Triticum aestivum
  Clone ID: PAT_TA_17779
gtcggcgtcactccacctgccaagctgcctgccatggaggggtggttcggcttgtgtttcatagcactatgcacgccgcttgccctttggcttctcaagctcgccggcagcaagtacaagccacagaagcaccaccagctgccgccagggccatggactctaccgatcatcggcagcctccaccatgtcgccagcgccctccctcaccgcaggatgatggacatgtctcgccgacacggcccactgatgcacctcatgctaggcgaggtcccaaccgtgatcgtctcgagcgccgaggcggcggcgctggtgatgaggaccaacgaccccgccttcgcggaccggccgcagagcgtgacgtccgacatcttcggctgcagcggcaagaacatcggcttcgccccctacggcgaccattggcgccagatgcgcaaggtgtgcatcgtggagctcctcagctccaggcaggtgaagcgcatagagagcatcagggccgaggaggtgggtaacctcctccgctccatcgccgccttggatggcgccaccgttaacgtcagcgagaagatgatggagc

SEQ ID NO: 17780 - DNA, 826 bp, Triticum aestivum
  Clone ID: PAT_TA_17780
gccgatgaccgggcatcgccgtccacgcagcagccctccgcgcggcggccgaccgtcgtgctgctgctgtggctggccctcgccttctgcctcgccgtccttttcatccagtcctccttcacctccccgagtgcgccccacgcccgaaccctagattctccggaccagccctctgctgaggcgagcaggctggatctcgactccgaccaggtccgggagctctcggggttccagtcccgcgtccagcaatgcgtggcaagcaggggacttggcctcacagcagatattgttgatcattgcaagctagtccttaagtttcctgaaggaaccaacagcacttggtataatgctcagttcaagttttttgagaaactacaatacgaatagtcagtaccgcagactgacgacttgtggtgacagggagtacttagatgtgcgacctgatggatggctggattatgcacctaaaagaatagcacagcttggtgccaagaaatgctacaatcgtactctgtgtgaagagcttcttagtattttgctgcctgctagaccccctttccatccacgccagtttgcgacatgcgcagtcgttggcaactcaggagatctcttaaaaacagagtttggacaagaaattgacgctcatgatgctgtcttccgagacaatgaggcacctgtcaataagaaatatgcaaaatatgttgggttgaaaagggacttccgactggttgtcaggggtgctgctcgaaatatggcaccaatactgaagggttcatgtaatgctttaatcctgatttcttccaattgacttcaatcctggctttcc

SEQ ID NO: 17781 - DNA, 821 bp, Triticum aestivum
  Clone ID: PAT_TA_17781
ggtcgaccaccgcgtccgataggttcgtatcgctcctattctcccccagatcgggggagcagcagtctcagcggagccgccagggaaggagagggcggccggggaagcagcagccccagcggaggggcgcagcaaggtgaggggaggcgcagaaagcagcgcgcctggcagagcccagctcgcctggccttgcctcgcctcgccatggggatcggctacgtcatcggcatcctcggcggcgccctcctcgcccacgccgcctacgccaccatccaatatcgtgcggtgctgaagatgccggaggaggagttctcggggccgccagtggatgtgatgatgcagctgctcctggggcttgccttatgcatgtgggcaggtgtctctgttccacgcgaagttcctttcggtgctcccccattctgaggagaataggatcgtatcgctcccagcaaacctggatttcatgatcttcaaccaccgtggaagggcgctgccttcagacgcagacttgaagttgaagatatgaacaaattctgttcctttcttgtcatgtaaccttttgcccaagaggaggatccatcccgttattcttgtcagtcatgtctaagagggggaaagctttttcttggtcataacttgtttatgctgtaactctagaatttgtgatgcggacacctgtcctatatattttgaggtggttggctcgagaacctgatctagtgcaagtttatagctgaatcatcacttcatcattaaagcatccatccatattatattcttccacactggagcgtttgcaaaatttataaaaaaaaaaaaaa

SEQ ID NO: 17782 - DNA, 553 bp, Triticum aestivum
  Clone ID: PAT_TA_17782
ttaactagtggatccccgggcctgcggatttggcacgaggccacgatgagaaactagcttggagactttcctcgatgctggctcgtcctcctccgatgtcatcgcgccgcgttgccgtgataggcgcaggagctgccggcctggtggcggcgcgtgagctgaggcgcgaaggccacgttcccgtcgtcttagagcgcgccgcggccattggcggcacctggcgctacgacgccggcgttgacgcccactccagcgtctacgcctctctccgcgtcaacagctcccgcgagtgcatgggctttctcgatttccccttcgttgctggcaccgagggcgacccgcgcaggttcccggggcacggggaggtgctccggtacctcgaagcgttcgcgctgcggttcgatctccatgagctggtccggctccagacggaggtggtcagcgtccgccgcagggtccataacgcgggcgtagcgggatggagtgtctcgtactgctcgacaaagctcgccggcgtcggtaacgaggtagaggaggaggtgttcgactccgt

SEQ ID NO: 17783 - DNA, 639 bp, Triticum aestivum
  Clone ID: PAT_TA_17783
atttccattgtactatatagaaaacacagctttcaaaactcacaaaatggcctctcctttccgccttatgcgacctatctcccaggttgctcgatctggcgtcgtttctttcgcagcccgacctttctccagcacagccgcgcgattcgctgtccaggatatcaagacaaccaaggagtttaaggacctcgtttccgcaacagacaaggctgtccttgttgactgctttgctacctggtgtggtccttgcaaggctatttctcccatcctcagcaagctgtccgaacaacctgctctctctgataacattgaatttgtcaagtttgatgttgatgagctgcctgacctgactgccgagttgggcgttcgcgccatgccaactttcttcgtcttcaagggcggcaaaaaggtcgatgagctggtcggtgctaacccccaggctcttcagtctatgcttgccaaacatgctagttaagctgttctattgctttgtcatcttgtattctatgtcttgattcacaagatagaacttgtgggatgtgacctggctcatatgggctatctatgaaatgaagtgcaagaggtaactctgtatattagcatagctagactttgcaattgagaattgcagtgggtagc

SEQ ID NO: 17784 - DNA, 939 bp, Triticum aestivum
  unsure (1)..(939): unsure at all n locations
  Clone ID: PAT_TA_17784
gaggaattcggcacgaggggagccacaaggaaggcctacgggatcgctgccgtgcccttccacaacgacagcatagggagtagtcgaggccgaggcgcctcttgaactgaccagatgcaaggtacaatgaactgaaagaagaagggcattttcatcaaaggaacatttattggtttgtccgttgacggttgcctgaaggaggaccaagaccacgagtttaagatgggttgcctctgattccctgttgcgattggggtgccttgcctccttgacaccctcccttgccggcaccttcgcaccaaggcgcacaaccggctcaccgcaagtacacctacgccgccgcctccccggggggttgcaaggtgaagtggacggccgaggagaagccgcacggggctgggctctcaagtgggaggcggagctcgcctccccccaatgacgtcagctttgatcacaagtggaagttggagcccaagtccaagcccggtgccgccagcaaggccaagaccaagctcgaggaagccagcgaggatgacaagaataagccggcgatgaagtgcacgcacatcgaggaggtcctcgccggttgcgacgccatccgcaaggatgatgactatctaatggtgattccctattcccacattttttgccctcatgttgcaagctctaaagctgcccctgcaatttaccatcacaagacatgtctggacagcaagtctcctgtgacaattactcttaattcgtcgttataattgtttgatggtttgcttgttccaacctcgatatctgcctttagattcccgttgttgtctttgtagtggaaggtaccacttggtggtatgttgctattttcactttgttctgaacaaggcatgtatagatttcagattttaattcctatctctttgtcgtaaaaaaaaaaaaaaaaaaaaaangttt

SEQ ID NO: 17785 - DNA, 829 bp, Triticum aestivum
  Clone ID: PAT_TA_17785
gccggccgggttccgataccagcccactctcgccgtcgatatgggtggtatgcaggagcgtattaccaccacccagaagggttccattacctcggtccaggctgtctacgtccctgctgacgatttgactgatcctgctcctgccaccaccttcgcccatttggacgccaccactgtcttgtctcgtggtatctctgagttgggtatctaccccgctgtcgaccctctcgactccaagtcccgtatgctggacccccgagttgttggtcaggagcactacgacaccgccacccgtgttcagcagatcctccaggagtacaagtctcttcaggacatcattgctattctgggtatggatgagttgtctgaggccgacaagcttactgtcgagcgtgcccgtaagatccagcgtttcctgagccagcctttcactgttgcccaggttttcactggtattgagggtaagctcgtcgaccttaaggagaccatcaactccttcaaggccattctgagcggtgagggtgataaccttcccgagggtgccttctacatggttggtgacttcgcctccgccaaggccaagggtgagaagattcttgctgagcttgagggtcagtaagaggtttaagtattgaagttaatgccgcgggagacgggaggagagaaatgaggacatttgtgtagggcagaggaaacaaggtccaggaggtttctcatgggctccatcaagtctcttttgtgagctgtgtaccaagaaatcaacaaaattcctcttgtagccatataaaacttttctttctattaaaaaaaaaaaaaaaaaaggccccta

SEQ ID NO: 17786 - DNA, 540 bp, Triticum aestivum
  unsure (1)..(540): unsure at all n locations
  Clone ID: PAT_TA_17786
ggcaaaanggttgatggtnggaantgtnntggatgatgnggatnatcattgtccatgtaataggatcatgaccntnatgttgatgagactgcnaccggcagggatccataggagttgctttatttattgtatgacctgcgtgtcactgaataacgccatgtaattactttacttcattgctaaaccgttagccatggtagtagaagtaatagttggcgagataacttcatggagacacgatgatggagatcatgatgatggagatcatggtgtcatgccggtgaagatgatgatcatggagccccgaagatggagatcaaaaggagcaaaatgatattggccatatcatgtcactttttgattgcatgtgatgtttatcatgtttatgcatcttatttgcttagaacgacggtagtaaataagatgatccctcataataatttcaagaaagtgttccccctaactgtgcaccattgcaaaagttcgttgtttcgaagcaccacgtgatgatcgggtgtgatagattctaacattcacata

SEQ ID NO: 17787 - DNA, 616 bp, Triticum aestivum
  Clone ID: PAT_TA_17787
ccccgtgtccgattctacaaaatctaccagaccaaatcgaaatcatggataagctcatcaacgccgccaaggagtaccttgatgatgacaaggataaacgccaagaccagtctcaacaaagccacggacagcagcaaggctacggtggaggtcaacaacaacagggctatggccaacaacaaggttacggacaggagggcggctatggacagcagcagggaggccagtatggccagcagcagcagtaccctcctcctggcggcatccaagcacaaggtgctggtgcattcggaggcttccacggcggagatgtcgacttcaacaacgccaaggaggaggctcaccagaaggccggatcttctggtgacaaggacctctttggcagcattctaggtgctctcggacagaagaagaacaagcttgccgacgaggaccttgatgaagaagatgccatcaagcagcacaagaacacatacgataacgacgaaccacagcaggacagtaagagcctcggtacggccgctgctatgcaagccctcaagatgttcacacagggccaaagccagagcagtgctggcggtaacagtcagactgcattcctaggtctcgccttggc

SEQ ID NO: 17788 - DNA, 482 bp, Triticum aestivum
  Clone ID: PAT_TA_17788
gatggtttcccgtgccatcgtacccacccttttggtgctacttctggccatttgctgcacaaccactgttgtccatggcaaggagtggaccgttggtgacaacaagggatggagcttcggcgtctctggatgggagagtggcaagcacatccaatccggcgacgtgcttgtgttcaagtacaaccctagtatgcacaacgttgtgcaggtgggagaaggcgactacaactcatgcagggtctcgggcccgtcgaggacctacacctccggcaatgaccacatccagctcgcccgcgaaggcaaaacgttcttcatttgcagccatccgggtcactgccagcaaggcatgaagatcgccgtcactgcttaatagatctcgagcatatgagtgtctttgtatttttacttttttaccaagtctttatggtgtgctagctcatgatgaattggtgatagaagaaataaattgatcctagtgcagt

SEQ ID NO: 17789 - DNA, 739 bp, Triticum aestivum
  Clone ID: PAT_TA_17789
ggaggagtcgaccatttgatcatttttcttgtcttgtggtcttcggtatcaacaaaaaatcaagagcaacaccatcaatggcacgggcaaccatggtacccacccccttttggtgccttctcgacgtttgctccgcaaccaccgtcgtccatggcaaggagtggaccgttggtgacaacaagggatggagcttcggcgtctcaggatgggagagtggcaaacacatccagtccggcgacgtgcttgtgtgctcaaacaacacgcgcttgtacactgtggtgcgggtgggagaaggcgactacaactcatgcagggtctcgggcccgtcgaggacctacacctccggcactgaccacatccacactctcccacggcaggcaaaggcgtctccgtatctgcagccttccccgggtcactgccatgcaaaggcatgaacgtgtcgctgtcactgcttaagcgatctcgttctcatgccgtgtcttttgttattttgtactttttgaccaattctttatcgtgtgctagggcatgttgatttggtgatagaagaaatagattgatcctagctcagtcatgacatcatgtgtccctgctaaatagatattgcgcatatgtgtgtctttgtatttgtacttttttaccaagtctttatggtgtgctagctcatgatgaattgtctatagaagaaataaaatgatcctagtgcagtgtatgcatcatgttttcatggaaccttgat

SEQ ID NO: 17790 - DNA, 1194 bp, Triticum aestivum
  unsure (1)..(1194): unsure at all n locations
  Clone ID: PAT_TA_17790
natatccatccaccagcaaaccctcgtttcacccaccacctaccacggacaagcagccacgccagccagagcgcgctgcacccccacctcgccgccgatgaagcacccagcgcacgagccgggccgatcatggaggcgtaggcggtcccgatcggctgcacggaggaggagtgagcgctgactggagccggcacaaataccaccgcctgtatgccggatagggcagacagcagaatgccccagggaaaggagggactcggagcacatcggcgagactgatgcttcgagcatcctgcgcgagcttatttatcgagcgctgctgcatacacccggccgcgattgtcacagagggatcccaggttcctgctagagcatttatcctatcgttgctggccttctctggatcatcagttgaagagtgtgtaagtcgcactatggagccctgattttcatgaaaatcaataagtgtatcgagcactccatttgggtccattatgtggaaagctcttactcgaccattgccatcaagagagtaaatacaattctcacagacaatagatggtttccgtgaaggaatcttcaagtttctgggggattcttcaccagtgtcatcttctccgagcacaccggctcgaaggacagtctccagcattccagcagtctgatatctcaatgcaaatgccttctgctcaggaaagaacccaatctgctgatatttatctacagtgaacatgttggtctctttgattttgtactccgcccactccggttcaggatcctcctcgtctgcaaatgttatcccggacgatgcctgcttgatatacagcgattgcatgaggctgatgaggtcgccctctccgtaggtgctggcggacaggcgcgtgctgatctcctgctgcaccctcccgtgcgcatcgaattggtagaagacgccgttccacttgccgacgttgaggtcgaagaagctgcagaggttgtcgatgctcatggcctcgtcctcgtccacctccggcgcgcccgtgaccgccgcccgggcgcagagccggccgcgccggagctgggggaggcggtggtgggccggccggacgccgcgtcgacgtcgaatgccccgtggatgcggaaccgcggaggcgcccagacggaggcccacgagggtttccgccatggccagcggagtgaagctcgtgccgaatc

SEQ ID NO: 17791 - DNA, 858 bp, Triticum aestivum
  unsure (1)..(858): unsure at all n locations
  Clone ID: PAT_TA_17791
gtccgcggnagcgtgggcgcggngcgggggccctgtccaagcgcgtgatccatttcctcctcgcttccttctctctcggtctcggtgcgtgcgtcactccgtcggcccgtccccctcaccggcgacttgtcgcctcgcggccactcccagccccagcgtgggcgcgtgtgttgcgagccatggccggcgagaagaggatgttcggcttcgaggaggtcgccaagcacaacgtcgccaaggactgctggctcgtcatcgccggcaaggtgtatgatgtcacccctttcatggatgagcatcctggtggagatgaggtactgctggcagtaaccgggaaagatgcaaccagcgatttcgaagatatcggacacagtgattccgcaagggagatgatggagaagtaccacatcggggaaattgatgcttcaaccatcccagcaaagcgtacatttgtacctcctcagcaagggtcccatgtccaggccaaggatagcgacctcctcatcaagatcctgcagtttcttgttcccattttaatcttggggcttgcatttggtatccggcactacagcaaatctgagtaggctgttgttggcgagttgcttcggagaaatagctttcaagtaatatggtttgagttagaacaacataataatggtattggttggctggtttgagttagaacaacataatgatggtactcgttgggtggcagtgtgttgtctcattgatcatacaaggcactctcaatttgaaacatccatatgtatgcccagattactcgaattatgtttacattctcaacatatggtggagtctctacatatttttttaanaaaaaaaannnanannnnnnng

SEQ ID NO: 17792 - DNA, 965 bp, Triticum aestivum
  Clone ID: PAT_TA_17792
tttacgcagcggggtacccctgtaacaagcgcgtgatccttttccggctcctgggggctttccaaatccccgggtgccttgtgcccattccgtctcggtgcctgcgtcactccctcggcctgcccttccccctcacccccgacctcacggctcgcggccgcgcctagggcgagcgtgggcgcgtgtgttgcgagccatggccggcgagaagaagatgttcggcttcgaggaggtcgccaagcacaacgtcgccaaggactgctggctcgtcatcgccggcaaggtgtatgatgttacccctttcatggatgagcatcctggtggagatgaggtactgctggcagtaaccgggaaagatgcaaccagcgatttcgaagatatcggacacagtgattccgcaagggagatgatggagaagtaccacatcggggagattgatgcttcaaccatcccagcaaagcgtacatttgtacctcctcagcaagggtcccatgtccaggccaaggatagcgacctcctcatcaagatcctgcagtttcttgttcccattttaatcttggggcttgcatttggtatccggcactacagcaaatctgagtaggctgttgttggcgagttgcttcggagaaatagctttcaagtaatatggtttgagttagaacaacataataatggtattggttggctggtttgagttagaacaacataatgatggtactcgttgggtggcagtgtgttgtctcattgatcatacaaggcactctcagttccaaacatccatatatatgcccagattactcgaattatgtttacattctcaacataggatgatggagtgtctacaattgaggatgatgggaatattgctatgctattaaacaatctcaatttcagaataaaaatgggcatcatacgttgcagtgatgttcccacataaaaaaaaaaaaaaaaaaaaaacccccccc

SEQ ID NO: 17793 - DNA, 2344 bp, Triticum aestivum
  unsure (1)..(2344): unsure at all n locations
  Clone ID: PAT_TA_17793
atccgatccacggtctttcgttctctctcctgccgctgttgcatttcctgatcctgcttcccccggtggctttcttgctcctccttaaaaggaagaaatatttttttcctcgtcagcgctccagacgcggaaggggagcggaaccaggcctttcgtcctctttctacggccaagacgtccacaagctacgcgcgggtccctccttcttcccacaggcggatcagggagcctctgcagattgaccttggtttggattcggattcaggtttgatccaacccaaatccaaatcgtctgatttggcaaggatttgatcaacaactggggatcctgagttgaatatgatatcaaatccggtgaattggtacagttttgggcctggatagaagctgtagggatgccagattggacggcgggcgagtttgaaggtaaattcaacgatgaatttgctcgggataataacaacttgcaagaagatggagcagggcctttgaatatctcaaataagaaactgaagcatgggattgccactgaagagaagctgcatggtgttgtgtcgacgacaattatttctgataattgagtagatgaatgcagcttccgccaccttacaggttgcagttgcttacttggatgtgagaaaccgcaagctgcattcaagtgcgtttgcatcgagtggcaagaagcgcgcataagcaaccagttttcccaaataagatcaatagacatgaagaaagccgggatgcaaaggatacacaaaatatggaaacttcggacaagtttgttgatcataggagcattgagacgcagacaaatccaattgatcgttctatagcactcttactttttcatcagccatcagaccaagtggttggagctgttgacaatcctcgccactaaaatctcataacgagaaccacaaggcctatgctaaaaactaggttggttaatgttgcgaaaattactggagatggctcgtggaaattcaaggatcgcctttattcatatgtaatcatcatctccgtgaatgcaggagcaattgtgaatgtttatccgatatggtatggtatgcaccgttttaatcgttagtcggctgccgagcaaaagaaggttaatgtatatggagaacaggcttaccaggggggtgcaatggaattgttgtccactgaccagatatgcaatggagatggaaaccttgatatgattcgcgagcgatattcatcagaaaatgccttgcaacagttggaggacaggaagttttctgtatcttccggatctcaattaagctcctcccagaatttactgaagcaaaagcaccactcagataaaacttcaccaagtaacattacttctgattgctattcagatagaaactgccagttcagtccatctggatcttttgcacagaggaacttgatggttcaaaaacaagtggctgatttgcaaccaggacagctcataaatgatgaaggacaacttggtcaacaaacattgactagaagggcttcatatccttgtgagaactatgaggttgaaaagaagggctttggaaaaagaagtaaggatacactgggtacatcagtagtggtggatggctcttttgtgtcgtctctttcttctgataattctgttgaagaaagcagcttccgacaacttcaggatgcagttagtcagttggacgtgaaaaccaaactgtgcattagagatggtttgtaccgcttggcaagaagcgcgcaaaatagaccagttttcccaaatgcgatgaatagacatgaagaaagccgggatgtaaaggatgcacaaaatatggaaacttcgggcaagtttgttgatcataggagcattgagacgcagacaaatccaattgatcgttctatagcactcctactttttcatcagccatcagaccaagtggctggagctgttgacaatcctcgccactaaaatctcataacgagaaccacaaggcctatgctaaaaactaggttggttaatgttgcgaaaattactggagatggctcgtggagattcaaggatcgcctattcatatattgtaatcatcatctccgtgaatgcaggagcaatcgtgaatgtttatccgatatggtacggtacgtaccgttttaatcgttagtcggctgcaaggaaaaaaaaagtacaccagttaaccagccagctgtgactgttggtaccatattgtgaattcgttcgtgaggttgactttgtgttgttgtctgactaacattttgtgtaatctcaagacagacagatattgacttgtatattcaaatgactattttgtgtaatcttgccacggagggaaaggagtagaagtatatgnaccaa

SEQ ID NO: 17794 - DNA, 589 bp, Triticum aestivum
  Clone ID: PAT_TA_17794
catccaccctctctccctctccatccaccctctctccctcttctccttcttcgattccagaaggagatacgccgaggaggaggagcaagcgaaagttcgccagtgagtagcggcgccggcgatcgacatggcagcgcacaagcggctccacgacgggttcgagcaggaccccgaccagcccgagaagaagcggatggagcggtcggtctcgttctccacggtgatccgggaggccatggtgatgaagcaggtgcagagtgtgttcctggtgctggagcctctcctgcgccgagtggtgcaggaggagatccaggcggggctggtgcgcagcccgcggtacatcgagaggtcctcgccggagacgccgccggcggcggagcggctcgcgttgaggctggcgttcctcaacccgccgatgctgccgatcttcaccggcagcaagatcgaggacgtgaacggcgagcccctccaggtcatcctcgtcgacgccgacaccggctcgccccgcggcgcgctcccgcagttcatgcgcgtcgagctggtgccgctcttcggcgacttcccgccggattcccgcgaggagtggacg

SEQ ID NO: 17795 - DNA, 870 bp, Triticum aestivum
  Clone ID: PAT_TA_17795
gtggcgcgctcgccggccggccgcgtcatcatcctccactaacttcgcagcaggccaggtcaagtaaacttgcaccaccatcacaactggcaatatgaagttgaacatcagctaccctgccaatggcagccagaagctcatcgacattgaggatgagcgcaaggtccgtgtcttcatggacaagcgcatgggcgctgaggttcccggtgactccgtcggcgatgagttcaagggctacatcttccgcatcaccggtggaaacgacaagcagggtttccccatgaagcagggtgtcatgcaccctacccgtgtccgcctcctcctctctgagggtcactcctgctaccgcccccgccgcactggtgagcgcaagagaaagtctgtccgtggctgcatcgtcgccatggatctttccgtccttgctctcagcattgtcaagcagggtgatgctgatatccccggcctcaccgacgtcgttcaccccaagcgccttggtcccaagcgtgccaccaagatccgcaagttcttcggcctcaccaaggatgacgatgtccgcaagtacgttattcgacgagaggttcagcccaagggtgagggtaagtccccttacaccaaggctcctcgcattcagcgacttgtcaccccccagcgtctgcagcacaagcgtcaccgtgctgctctcaagcgacgacaggccgagaaggtcaaggacgaggccaacgagtatgcccaggtcctggccaagcgtattgccgaggccaaggtcaacaaggccgatgcccgcaagcgacgtgccagctctatgcgcaagtaaggttctggcgtttaatgaaaaaaagggggatcataccttggtcttgtggttgcatg

SEQ ID NO: 17796 - DNA, 527 bp, Triticum aestivum
  Clone ID: PAT_TA_17796
tgcgaacgcgtccgcccacgcgtgcgcccaccggaatgaaagaacacttcttcccttcttcctcctcgtcctccaagccaagccaagaaactcctcgtctctccaccctccgtccgtgaaggaaggaggcaatcgggtatggggaagatgtgctgcagccaggaggaggacgaggcggggttcaacctgctgccgctggtgatggccgccttcgtcatcatgctgctgttcgtcgtctgctcgccgcagccccggcgcaggcgctgcgtcgtcgtcccgtgctactgacctgacctggcatcatggcggtgcggtggtgggagcctcgaccacgatcggcggctctgaaggcaggcaagtggttctgtggtggtaggcgtttggttggtgtctgaattttctgactgatgcgtgttgggtggaagaataatctcaatttctgctgaattcgatcggactgtaaagctaaagtcattctcttgttgcgaaaaaaaaaaaaaaaaacctaagtctctcttgttgttgtc

SEQ ID NO: 17797 - DNA, 538 bp, Triticum aestivum
  Clone ID: PAT_TA_17797
ggcggacccaccgcgggacaggcaccgagcccctatttggaagaaagaacttcttcccttcttcctcgtctcgtctcctccttcctcctcgtcctccaagccaagaaactcctcatctccaccgtccgcccgtgaaggaaggaggcgatcggccatggggaagatgtgctgcagccaggaggaggacgaggcggggttcaacctgctgccgctggtgatggccgccttcgtcatcatgctgctcttcgtcgtctgctcgccgccgccccggcgcaggcgctgcgtcgtcgtcccgtgctactgacctgacctgacctcatggtggccgggtggtgggagcctcgatcggcggcgctgcaggcaggcaagtggctggtgctgtggtaggcgtttgtttggttggtgtctgaattttctgactgatgcgtgttgggcggaagaataatctcaatttctgctgaattcgatcggactgtaaagctaaagtcattctcttgttgcaagtctgtcttgttgttattaattacccgtgtgattg

SEQ ID NO: 17798 - DNA, 792 bp, Triticum aestivum
  Clone ID: PAT_TA_17798
gcctccagtgcacatccaccactcgcagaaggccgaccgacccaccggtacgcggatgagggggagagaggtctttaagatagatgcagcaggaagcccactgccccaagaaagaacgacttcttcccttcttcctcctcgtcctccaagccaagccaagaaactcctcgtctctccagccctccctccgcgccacgaaggaaggactccttcccttgttcctcgcccagtctccttgttcctccaagccaagaaactgctctgtctgtgagaaaagcgagcgggcgatcggccatggggaagatgtgctgcagccaggaggaggaggaggcggggttcaacctgctgccgctggtgatggccgccttcgtcatcatgctgctgttcgtcgtctgctcgccgcagccccggcgcaggcgctgcgtcgtcgtcccgtgctactgacgtggcatcatggtggtggtgcggtggtgggagcctcgacctcgatcggcggcgctcaaggcaggcaagtggctgctactgtggtggtaggcgtttggttggtgtctggatttttctgactgatgcgtgttgggttgggtggaagaataatctcaatttctgctgaattccatcggactgtaaagctaaagtcattctcttgttgcaagtctatcttgttgttaattatacccgtgttgatcgaagaacgtacaaaagaatattcgccgagtgcgggcctaatccactcaccttgatttggtgcctgaatttcttcttcaaaaaaaaaaaaaaaaaaaaaaacccccc

SEQ ID NO: 17799 - DNA, 659 bp, Triticum aestivum
  Clone ID: PAT_TA_17799
agttggggccttttgaggaaattattcatttcatctacaaggacatgtttttcaataagactgatccaccaaggttacttgatattgtggtcactgctgataagtttgaggtgattggagcaatcaagcactgtaaaactctgatgctgcagtccccgctgactcttgaaattgcccttctttatttggagttcacttctgagaaggtagaactgaatgaaattcttggtcctgttcatactgcttgtgctgattttgtggccaatacatacaaagatctgttaagtcatgaggaagccgtgctccagttgcggctctccgctatgatttccatctttaagagcagtgctcttattcttcccaacgaagactatgcatttacctttttgctgaaatggctggagaaagagtactctgataaggaagagagaaaggatgtgtttcagagaatcgtggtttctcttatccggttcacgcacctgtctgaagaagctctgcttgattttacctcttgtaatctagtttcgagtcctgttgacgcgatcaatattgtatctaatgcaatgcatttcaaggctacttcatctcgaagaattgcttactggaggtatgagcagcgtgattatcttgtgaggcccgtctcattatcttatcttatg

SEQ ID NO: 17800 - DNA, 1029 bp, Triticum aestivum
  Clone ID: PAT_TA_17800
aggctaaaggtacaacctcagcccgttcatcaactcgctataattgtatctacccaaattatacatcatctattctcccgagtatatcagtgttcaagcttgcccaaaatgagaccctccctcttcaagcccctcctaccccgccatacctggttctctgccgcgggaacttcttcttctcttcctcaactctccaacacaatcagatctgttagatttttctcagctacatccgcagtcatgggtaacaaggttttcttcgatatctcctgggagggtcccgtcttccagaacggcaagccgacttccgaggtcaagaagcagaccggtcgcatcaacttcaaccttttcgacgatgtggtccccaagaccgctgagaacttccgcgctctctgcactggcgagaagggtttcggttacgagggctcttctttccaccgaatcatccctgacttcatgcttcagggtggtgacttcacccgtggcaacggcactggtggcaagtccatctacggtgagaagttcgctgacgagaacttcaccttgaagcacgacaagcctggtctgctctccatggccaacgccggccccaacaccaacggctcccagttcttcgtcaccaccgtcgtcacctcttggctcaacggccgccacgttgtcttcggtgaggtcgctgatgaagagtcccttaacgtcgtcaaggctcttgaagctactggctccggcagcggtgccatcaagtacacccagaagcccaagatcgagaagtccggtgagctgtaaacagctgaaactggacgacgtggtgagcgggaatttgggattgcacaacaaaacctcacttgagggctggcgacatggagctagttagtcacaggctagtagaagcatctagctattgaacaatgtggaccaataaacccaaaaaaaaaaaaaaaaaaggcccctagggaaaaaaaaaaaaaaaaaaaaaaaaaaaaaaaaaaaaaaaaaaaaaaaaaagaaaaaaaaaaaaaaaaaaggccccta

SEQ ID NO: 17801 - DNA, 1402 bp, Triticum aestivum
  Clone ID: PAT_TA_17801
gccctctccccctcgcgcgcccgcgcactcgctcgctcgcccacgcactagcccgggaagcgaattgccatttcgggaaagggggagaggggaatcagatcgggcagacggccggggccgatggccgccggcgacgtcgccaccgtcttcctggagatgagcctcggcactcgcctcgccgtctccttccccgccgcatccaccaccgtcgccgacctcaagcgcagagtgagccatgagcacgccgcatgtttccccaactatggccagatcgccgtccagtccgtcaaggtcgagcagggaggctcgtggttccacctcgccgactccatggccgtccgggacgcgttccagttccacggggccaacgaaacctggcacctccaagtagacgctctgcctcaccctcagcatctcgaccaaggaatggccaccgagggacactccaaggattcctctgctgctcactctgaaccaagctgtgagatgctggctgaccaggttaaagttgaagttggagcggactctgaaccaagctgtgagatgctgactgatcaggttaaagttgaagttggagcggaggagccattggcagccaagggcgagagaagcagcaacggggctgatccgaaggggtcgaaagaagcagaggccacatcaacagaacagggggcatgtgagaggaaaaggctgcggccaaggaccagagctggcaaaacacccgtcaccaaggcggcgaacagcagcggcagctcggagtcggaggagatggacatcaacaccgtcggcgtcgacgcgccgccgtcgcagttcgtcgtcatgctcaaggaatgccactttgtcaccaagaacggacagtacctgaacgtgccgcgggagttcggcgtggcgcatcggtacgcggagaggaagaaggtgctgctgcggatggggggcgagtcgtggacggtgaacctgaagcacgtccacaatgtgcgtggcaaggcccgcacgtcgttccggtacgggtggcaccagttctgcgtcgacaaccacctccgcgtcggcgagacatgcttcttccgagcgctcggccaaggcggcggcggcgaccgccatgtgctcaaggtggaggtgcgcaggctggacggcagctacgccagctgatatgcctctgtccgttgcatcggcatagccgtctcaagcagggctcttatcttagactgcaatgcattgcattgtggtagcccaatattaatatgcagtttgctcctttatactctatgtttcgcttgcatatgctagtttttatcaacctcctcattatctaattaattagctttggctgacaatttactgcgctagctttgtgtgacaatgtattgtgcatttgtgctagctatagaatctgaaaatgtgatct

SEQ ID NO: 17802 - DNA, 335 bp, Triticum aestivum
  unsure (1)..(335): unsure at all n locations
  Clone ID: PAT_TA_17802
cgtggagggcttgatggcacaagcgcctagggcaccctgctcttccggtagttacaaaaattctacgtgatttcaatcttcccgtttcgaataaacaagaccatcttcttgtgtgtgatgcatgtcagatggccaagagccatcagctaccttattctcgttcaactagtgaatctgcagctcctttagagctgattttctcagatgtttggggtcctggacccgtctctgtaggaagacaaaaatactatgtcagttttattgatgattccagcaagtttagctggatatatttgctcaaaaaataaacctgatgtctttngaaaaaaacanaa

SEQ ID NO: 17803 - DNA, 1088 bp, Triticum aestivum
  Clone ID: PAT_TA_17803
ctccattccccaatatcaaatcagaagacgaaccagaggacgagagaggggaatggccggcgctgctgatgcaggggtttgtggagtttgtttcaaccattgcaagtatgagagcaagggaagcggtttcagcatgcttgcatgggaggagttcaagaatgcaggggttgtgccttgcaatgaaagggaccgtttcaacaatgcgacaagagagaaggtgacgtttgtggcaaaccaacgggcatacactgtaaagtgttacaagggtcgcagaaagagcgctatgtatgggagaggttggaggaagttctatgaagacaacaatctgggcaagggtcagatggtggtgttctacctggatgaacctttgcctacggcatctattttgtggttccaggtgggcaacggctcgaagccattgaagattcagatttcaggtaatgaggatggagaagcttcaagcgatgatagtgaaggcattgtttgcactagggggcttttgcttaatgagacagaggatgctcagctacaggggctgctgcctctcagtgatggtttcatcgggtttgcttttgttcaccgcctcacaaggactgacattcgcttgggcatgatgaaaatacccaagaaagttgctgctgccacgccgtttgaagaacagggggttgttggtatttctgtggatggtcggagattcaaaaaaatctcatacaaaactgctgatgatggccgcattgtgtttggcagcaagaagtgggaagacttcgcagctagcagaggactcaaagtcaacacagctgttcttattggcttcaagagcagcgagagggatgatgtccatgtcctggttatcttgaagaagcttggctaggcaccagccacagcaactgatgacaagcagagctgcgtctataatactcatcttttgggtattctatatatttctgtgtcgaagtctgtatgacgaaccttttttcatttttatgccatgctgaacctgtcagtgtagttttgcgtttcttatgtgtccaccaaacaatgcggcttgaataatatatgatgggaaccttttttaaaaaaaaaaaaaa

SEQ ID NO: 17804 - DNA, 510 bp, Triticum aestivum
  Clone ID: PAT_TA_17804
gccggccgggtccgggatccagccacacttcacggcatccattccagagcaacagcaggttcagtttcagtttccatctggttcgagtggtttttcggtcgcttgccgatggcggacatagcgatgctggtggccgacgaggcgttcgagaagaggctgcagcgaggggcgcccttcgccggcgccggcgaggaggcgtccaaaggacgggagaacttcggggccgtgaccaaggtgtggggctcctgggcgtcgggggtcaaggtgcgcgtcgcgctgctcgtcaaggcggacgtcgccgagccgaaggcaccggtcgccatggcagcctttgacggcttattctctgcttaattagccatctccttctttctgaaatggagttaatttggaggagttttacctgcatctccactcctcccctgagtcaatttcagtattgcttgtcacttgtacataaccatgatggagtttactgattcgcaaaaaaaaaaaaaaaaaaggccccta

SEQ ID NO: 17805 - DNA, 806 bp, Triticum aestivum
  unsure (1)..(806): unsure at all n locations
  Clone ID: PAT_TA_17805
gcaggtgtccggcccagatccacacatccagagcaaagagcatccagattccagactccagagcaacagtttcaagctgagttgagatgttttttgactccaggttgccaatgcagcacattgcgatgaggatgttcggtttcagttgccatttgggtgcagcggcatgttcggtcgccgggcgcaggcggacatagcgatgctggtggcggaggaggcgggcgagaagaggctggagcgaggggcgcgcgtcgccggcgccgacgaggaggcgtgcagcgggcgggtgaacttcggggccgggggcggccgaggccgccgccgccggcgggggggtgaaggtgcgctggcgcgctgctgcgtccagggccgaggtggcggccgagcccctagggcagcccggcccgcttgggcagcctttgcacggcttcttcatctgcttgatttaggagtttcccttcttcttagttaacgggatcttataatttgggaaggagtcattctaagtcatcagcagtttcacctcccctgcaatcaatttcacgtgttgatttagcactaattataccaatgacgtactttactgaattgcaatatttgcacagccctaattccgagtgtgaattacagtaattcggaggagtttaccgtgtggagtacctctcccccttaagccagtgtcatgtaactccggtttgttgtacataaccgtgtgctttactggtttgcaacaaggaagaagtgtactttctgtactgctgctcttcatttgcacggcaaaaaaaaaaaaanannannnnnnnnnn

SEQ ID NO: 17806 - DNA, 712 bp, Triticum aestivum
  unsure (1)..(712): unsure at all n locations
  Clone ID: PAT_TA_17806
taatcggtagtataacgtaaacacacnctgctccggtaaaaacccagctcacagatgagggctatgggtttttgaacgtcaggacgcaagagtaagtgacatactttacactgtcaccaaaggactacaccaaatatacgcgccaatgacttcgaagagatccttccatcagcgtccactctcgggtcagccaggacagagaccaccgccgatgaagccggtttgtttccagcaaagctctcgttcttggggtgcgctttgaggtgatcggtgtggttggacgttgaaccttttaggggaacggccatggaatgtaaaatccttctgttcttgaccttatcggactgactggaggtgaggttctccgtggagttatgtgatgcgttgtgcataccactggagtagacaggaacaatggtggtcggcgatatatcaaactggaacacttcggtgcacattccggagctcaacataggacctgacattgcttcactaaaccattgtggcagtaattcatcatcgtctctgtatatgcttccatctccaggaggtaaagccatcagtttattttttattgctttagcagattccatgacttctccagaattcaactgagcaacatggccaggaattgccaaactagtatcttcttgtccttggttacatgaagtcttcccatcagagtgacacatgcgcgaagaggctttctcac

SEQ ID NO: 17807 - DNA, 1078 bp, Triticum aestivum
  Clone ID: PAT_TA_17807
acacccacgctacagagcagagtagagtcttgctccagtatctgccctctcctgcctatagagcatccataacgtgaagttcacggacaaacatgtctccggtgaaggtgttcgggcacccgatgttgacaaacgtcgcacgggtgctgctcttcctggaggaggtgggcgccgagtacgagctcgtgcccgtcgacttcgtcgccggcgagcacaagaggccccaacacgtccagctaaacccgtttgcgaagatgcctgggttccaagatggcgaatcattacacatcagtacacacatcaagtcgcgcgccatcgcgaagtacatcctccgcaagtacggggggacagccggcctggacctcctcggagaaaacagcggaatcgaagaattagcaatggtggacgtgtggacggaggtggaggcccagcagtactacccggccatctcgcccgtggtgttcgagtgcatcatcattcccttcatcatccctggcggtggcgcggcgccgaaccagaccgtcgtcgacgagagcctggagcggctgaggggtgtgctggggatctatgaggcccggctggagaagagcaggtacttggccggggactccatcagcttcgccgatctgaaccacatcccgttcaccttctacttcatgaccaccccgtacgccaaggtgtttgatgactaccccaaggtgaaggcctggtgggagatgctcatggagaggcccgcggtgcagagagtctgcaagcatatgcctacggagtttaagctaggtgcgcagtactagatgtttatgcactccgcgcgggtgtgtgccgtgccggtgccggtgatgattccattcaagagaagagacctcccgtgtgtgggtgggtaatcatctgcccgtctagttcgatcgagtatacgctttcagtttcagcagcacgcgaggagtccgcttgcgcttctgttcgtgcgctggattccttgctttaagttgtgcactagtctctacctaatctatatctataactatatttatatctatacctactaattcctattaataaaaggaataacgcttcttgt

SEQ ID NO: 17808 - DNA, 1675 bp, Triticum aestivum
  unsure (1)..(1675): unsure at all n locations
  Clone ID: PAT_TA_17808
cggccgctcgaggccnnggccgggcccgggcccacacacacacacgctacagagcagagcagagtcttgctccagtatctgccctctcctgcctatagagcatccataacgtgaagttcacggacaaacatgtctccggtgaaggtgttcgggcacccgatgttgacaaacgtcgcacgggtgctgctcttcctggaggaggtgggcgccgagtacgagctcgtgcccgtcgacttcgtcgccggcgagcataagaggccccaacacgtccagctaaacccgtttgcgaagatgcctgggttccaagatggcgaatcattacacatcagtacacacatcagtacacacgaatcattcctgtctaggagtatcatgttaaaaatccattggttggtttctctaatctaacaaatcgatgagtgagtgcagagtcgcgcgccatcgcgaagtacatcctccgcaagtacggggggacagccggcctggacctcctcggagaaaacagcggaatcgaagaattagcaatggtggacgtgtggacggaggtggaggcccagcagtactacccggccatctcgcccgtggtgttcgagtgcatcatcattcccttcatcatccctggcggtggcgcggcgccgaaccagaccgtcgtggacgagagcctggagcggctgaggggtgtgctggggatctacgaggcccggctggagaagagcaggtacttggccggggactccatcagcttcgccgatctgaaccacatcccgttcaccttctacttcatgaccaccccgtacgccaaggtgtttgatgactaccccaaggtgaaggcctggtgggagatgctcatggagaggcccgcggtgcagagggtctgcaagcatatgcctacggagtttaagctaggtgcacagtactagatgtttctccgcgcgagtgtgtgccgtgccgtgccggtgatgattccattcaagagaagagacctcccgtgggtgggtgatcatctgcccgtctagttcgttcgtgtatacgctttcagtttcagcagcacgaggagtccgcttgcgcttctgttcgtgcgagcctggattccttgctttaagttgtgcactagtactccctccgttccataatatagtgtctatagatttttgcaaaagtcaaacattacaaactttgaccatatttatagaaaaaagtaggtacatctagaatagcaaatgcacatcattgaatacatcatgagttatattttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccctttaaaagaaccaaattttatttccggggggtgggaaggaaaaattttttttttgggggccccaaatttaatttctggggggggggtttaaaaagggggggaggggaaaaacccggggggaccccaatttaatggcttggggaaaaatcccctttttcccagggggggaaaaacaaaaaaggccccccccgatggcctttccaaaaagtggcccaccctaaaggggaaatggaaccccccctttagggggcctttaaggggggggggggggggggtttcccc

SEQ ID NO: 17809 - DNA, 1507 bp, Triticum aestivum
  unsure (1)..(1507): unsure at all n locations
  Clone ID: PAT_TA_17809
gcggcgtccctcgccccccctagcgctacacacacacgctttagagcagagcagagtcttgcatccagtatctgccctctcctgcctgcctgtagagcatccatcacgtgaagttcacggacaaacatgtctccggtgaaggtgttcgggcacccgatgttgacaaacgtcgcacgggtgctgctcttcctggaggaggtcggcgccgagtacgagctcgtgcccatggacttcgtcgccggcgagcacaagaggccccaacacgtccagctaaacccgtttgcgaagatgcctgggttccaagatggcgaatctcgtcctgttcgagtcgcgcgccatcgccaagtacatcctccgcaagtacggggggacaggccggcctggacctcctcgcggagaaaacagcggaatcgaagaattagcaatggtggacgtgtggacggaggtggaggcccagcagtactacccggccatctcgcccgtggtgttcgagtgcatcatcatccccttcatcatccctggcggtggcgcggcgccgaaccagaccgtcgtggacgagagcctggagcggctgaggggtgtgctggggatctacgaggcccggctggagaagagcaggtacttggccggggactccatcagcttcgccgatctgaaccacatcccgttcaccttctacttcatgaccaccccgtacgccaaggtgtttgatgactaccccaaggtgaaggcctggtgggagatgctcatggcgaggccagcggtgcagagggtctgcaagcatatgcctaccgagtttaagctaggtgcgcagtactaggtgtttatgcactccgcgcgggtgtgtgccgtgccgtgccgtgccgtgccggtgatgattccgttcaagagaagagacctccctcccgtgggtgggtgatcatctgcccgtctacttccagtagtatacgctttcagtttcagcagcacgccaggagtccgcttgcgcttctgttcgtgcgctggattccttgctttaatttatgcactagtactagttagtaaataaacaacggactggtcaatgctgctaatccgtactgtacgtccattatagtagtatccctaccgaggtcatacgctttcaagtttcaggcaagcagcgaggtagtccggcttgcgcttcatgttcgtgcgagcctggattccttgctttaatttgtgcactagtagtaaataaacaacggaatcaataagctccgaacgtactgtttttaagacccccctaaaaaaaaaaaacacctcgtgtcctgcccgggcggccgctcgtcctcgcggggtgaatccttaattaattttccggggcccctttggggggggggaacatgcaaattggggcccaattccccctttaggggggccntttaaaatttatggggggggtttttaaaaaggggggggggggaaaacccgggggttaccaaaataaaaccctttggaaaaaaacccctttttcccggggggggaa

SEQ ID NO: 17810 - DNA, 642 bp, Triticum aestivum
  unsure (1)..(642): unsure at all n locations
  Clone ID: PAT_TA_17810
ntgttntttccatgtcgttatgcacaaccacaaaggaccacaagggacccaaaggtcagctgcgcgatgttgtcttttgtcctttttttttttttttagacagcggcgatacataacatatcatagcatccaagcattgtagcatcctcatctagagttatatatacataaagacggtgatgatacatcctgataacaggatcgctattattattgtagaatgcctaggcgcagttccagtattatgttaagaaacccacaagaaactaccacccagcagggcagatatcttccaagctttggcccaagaactcaatgatgtcagtagtgacagttgatctcttgttcttctcaaatgcaagcgccgcagcttttctgagcaatagagagccagctatgcacccaagaaccataggattcacactagtctctttaggttgcttatttgacaagagaaagtgccgtgcccatgatgaaaatactgccacgcttccagagagaatgtcgccttgaccaccacatcgccttggagaaccaaaggtactcacttgtgtgacttttttaccgtcactaattacatctgcttttcctttcctcatgatggttacaccaccaattttttggcaaagtgcagtcagttgc

SEQ ID NO: 17811 - DNA, 1027 bp, Triticum aestivum
  Clone ID: PAT_TA_17811
ctcgcgccggccgccgcacctgatccaatccagtccccctccgatctcaccgggaaacctccgatcgaagcaaagccaaggctctctcgtcctcctcctcaagatgcagatctttgtgaagaccctcactggcaaaaccatcacccttgaggtcgagtcttctgacaccatcgacaatgttaaggccaagatccaggataaggagggtatccctccggaccagcagcgactcatcttcgccggcaagcagctcgaggatggccgcaccttggctgactacaacatccaggaaggagtccaccctccacctggtgctcaggctccgtggtggcatgcagattttcgtcaagaccctcactggcaagaccattaccctcgaggtcgagtcttctgacacgatcgacaacgtcaaggcgaagatacaggacaaggagggcattcccccggaccagcagcgcctcatcttcgccggcaagcagctagaagatggccgcacccttgctgactacaacatccagaaggagtccaccctccacttggtgctcaggcttcgtggtggaatgcagattttcatcaagactctgaccggcaagaccatcaccctggaggtcgagtcctcggacaccattgacaatgtgaaggcaaagatccaggacaaggagggcatccccccggaccagcagcgcctgatctttgctggtaagcagcttgaggatggccgcaccctggcggactacaacatccagaaggagtccacccttcacttggtgctccggctccgtggtggccagtaagctcctggacatggtgcgtctgtttctgggttcgcaagtcttggtgctttagttggagttgcctgtgtctgtctagtgtctcgtctgggtctgtcgttggtgtatttttttctacagtactgtgatgcagtgttaggtctgaaacttctgctgttgtgcaacatatttggtgaactatgaataagtgagccctgaatttggtctataattctgttgttgtgaggttggtctgt

SEQ ID NO: 17812 - DNA, 1740 bp, Triticum aestivum
  Clone ID: PAT_TA_17812
cccccccccccccaccccgcctcgcccccccccgcctccccgtcctggcgcgcggctacttccacctgctgctgcgggtcttcgtcttcttgcggcttcgccgtcttttcgggggcgtcggctgtctgttccccggctttcccggagcggcctcagccgcatccgcccctcccgcgcatccggcttagctgcatccatccatcctgcaggtccatcaaatcaaatccgaagggaagctagagcagccacccacccagacatcaaatcaaatcacctcatcacatcaaatcaaaggggaccaaaaggatatctctacctcccctcgccggcccgctcgtataaaatccccctttctacacacccgcaattccttgcttcctcaatctcgactcatctctccattgtagtggtaatttcttgcgatccgttcgagctcgatcaaagcgagaagccacccacacacatacttagccgtagcagtggtattacttgccgccgatcaatcagcagactcagggcatagcggttgctactacatacattcataatgtcgtcgtcctcctcctcgtcggctgtcttcaacctggaccacctcgcgccgtcccccaccgagcagctctgctacgtccactgcaactgctgcgacaccatccttgcggtcggtgtgccgtgcagcagcctgttcaagacggtgacggtgaggtgcggccactgcgccaacctgctctccgtcaacctccgcgccctcctgctcccgcccacggcgcctccggcaaaccagctccagttcggccactccttgctttcccctacttccccccatggcctcttggacgaggttgcgttccagacgccgagcctactgatggaccaggcgagcaccaacctgagcggcttcacgggccgcagcaacagcaagctgcgccagcaacctgccggcgatgccgatgcctgccgccaagcctgcgcagcaggaaaccgagcagtcggcaaagagcgccccatcggcgaacaggcgtaaggaccagctcttcttgtcagctccggaggaagcgtcagagagttccctccgcctacaaccgcttcatcaaggatgagattcagcgcatcaaggccggcaacccggacatcacccaccgcgaggccttcagcgcagccgcaaagaattgggcccatttcccgcacatccacttcggcctcatgccggatcagggattcaagaggaccttcaaggctcaggatggcgccgaagacatgcttcgcaaggatggtctctatgctgcggcggccgcggcggctgccaacatgagcgtcactccgctttaattacctagctataatgagcatgcctctcgagttctccggacgttccaagttcgctaactctcttctgcggcgccaactagggttccttgttagatagtattatcaatatcgcgtgtgtgtgttagatctactactttcatttctgtctgctgttggggctgggaacggagaatcgagttgagtacctaggtttctcagttctcatggtcatctctcagctggctatctataggtgtagtgagctgtcttctatgtttccatttcttcatcttttctatgtttgtctttttcacttcctgaacttcctacaccctgtagaaaactaggtgtgtcttaagaacatgttttctgcatctagtgatgtggtacgttttcccttcccttgcatgtatttttgatcaacgaaaaaaaaaa

SEQ ID NO: 17813 - DNA, 1405 bp, Triticum aestivum
  Clone ID: PAT_TA_17813
gagattttgcagcatccgctagaggagtaggtccagaggattcgaggtgagcgattcttacttctgcccgcgtccggtctgtcggctcggtcgccgcacttctccgctgaggcagatctgccttgcccgatccttgggggagattatggccgtgataaaggtgcgagtgagcaaactccgcgaggcaaagagtgttgaggacagcaggcacaagagtgccagtcgcgagccaaaggaaggccagagcagcaacccaaagagggccaatggcgaggcaccagttgagcctcagcagagggaagtttgtgcattttgcgacgatggtggtgaattaatctgctgtgatggtggatgtctgagatccttccacccaaccaaagaacatggtgaaagatctatgtgcacaagccttgggctaaatgaagcaaagtggcaaaagcataaagcactaggggaaaaaggggttatatttctgcgagaactgcaagcataagcagcatcaatgttttgcttgtggattattggggtcttcaaacttaacagcaggtcctgaggtattccaatgtaaggagcaaaagtgtgggcacttttaccacccgggatgtgttgctaaaatactctaccctgataacaaagccaaggcaacatgttttgagcaatgtgttgctggtggactggaattcagttgtcccgtgcataaatgtaagcggtgtaaggaagcagagaacaagcatgacaaggaaatgcaattcgcagtatgcaggcgctgtccaactgtataccaccggaagtgcttgccaagggatatttccttgatagaggacgaggaagaggctactccgcaaagggcatgggatggcattctacctgatcaaattttaatctactgcaggaagcatgagattcaagaagagctaggaactcccaagaggggaccatattgtctttccagatgtgagaaatcctggtgcagcagaaaggcatagaggtgcatctcaggggcacgatatacccgacgaagacgagctacttgaccgcctagcgtcctgcaatccatctcagtcccctgagccggcagaaacaggccgcggtagggtgaagcccatcgattctttcgcgccgaagcacttgttcccgcatccacagccaggctcctgcggttggcttgatgactgatgatccattccttgtctcccaccttgccgtgtagagaaaccatcggttacaggctccctcttatacatttcatgtcatctcgagaagaacaaaaggaaatgttatgtagccctttgttaagtttgatacgtatgtcatttccactatttggttggctagacactctataacatgacaatgcgccaaataaacattccgtttaccggattaaaaaaaaaaaaaaaaaaaa

SEQ ID NO: 17814 - DNA, 1003 bp, Triticum aestivum
  unsure (1)..(1003): unsure at all n locations
  Clone ID: PAT_TA_17814
ccttcttctgtggatataggataagctcgctgcacacgagcaggaggaagcgaagacgaagcgcgcacaccgagcgagcggcggcaacacggagcccgtccatggcgtccctctccccctccctccacctcccttgcaattcaagaattggcttccttgggaagtcacaaggcatacttcttcgtgttatccctgctggcagagttggtttcattagaaaaacagtggaatgcaaggaatctagaatcggaaagaagccgattgaagttccatcaaatgttactctaacactagaggagcagtttgtcaaagctaagggtccactaggagagttgacattaaactatcccgccgaagtaaaagttgtgaaagaagagactggcaaattgagagtattcaagactgtggaaaccaaaagggcgaatcagatgcatggccttttcagaaccctgacggacaacatcatcgtgggggtgtcaaaaggatttgacaagaggcttcagttagtgggggttgggtaccgtgcgacggtggagggcaaagacctggtgatgaacctgggattctcgcaccctgtccggatggctgtcccagaaggacttcaagtcaaggtggaggagaacacgagaatcatcgtgagtgggtacgataagagcgaaatcggccagtttgctgccaccataaagaagtggaggcctccggagccatacaaggggaagggtatccggtaccaggacgagattgtcaggaggaaggagggcaaagctgggaagaagaaatagaaggctgtttatttatttgtttgcatttcttacgtacttttgttctgttttccctctgtaatccgccatcttccgagtactaccatgttctttagcccttgcacaatttgtagagaaaaatgtcacagtttacgtcatagcgatgtgtaacaccctcgccggggggcaaggaaagaactcaatcaatccaatgtttgctcaacnggaaacactatgaatgg

SEQ ID NO: 17815 - DNA, 654 bp, Triticum aestivum
  Clone ID: PAT_TA_17815
accatacacccatggccgccgccgccgaccaccagcacggccacatcgacaaggagaaggagaaggagctcctctcatcggtggttggcgacatccgctgttactccggttccgaccccctccgcccatggctccgggggatccggaggctggaggggcgctacctccggcgacgctgcgggagaagctaccgaggttcctccagaagtgcgccgaagagttccaggacgagccccggtaccgcgacgacccgcgatacctccgcgtctggatccagatgatggactatgtgaaggacgcaaagccattgctgaagaagttggagaggaacagaataggcctcaagagagctgcgttttatatggcttatgcgatatattatgagaagcgtaggaggtttcaggaggcagagcagatgtaccgcgtgggaatccagaaccttgcagagcctatcgaggagttacacaaatcacatgatcaatttatctatcgcatggagttataccagaagaggaaagataaagaaggaatgcccagcagagttaaaccacttccttagatgtgcaaaccaagttgatggtcaaagcagaaattatacagaacttaagtccaatcctgtgcaaaaattgggaagtagttcaaattcttcattgt

SEQ ID NO: 17816 - DNA, 606 bp, Triticum aestivum
  Clone ID: PAT_TA_17816
ggcagaaccttcaaaagttccgtgacgacaacaacagaaccttcaaaagttccgtgacgacaacaacagttgcagaaacttcgagcagaggagccaaagacgaaaaagcacgccgtgcaaaaatgacaataccacacctgttaaggactccgctaaaaataggaagacaaagaagcaggtcaggagcagaattcaactgtcggaagatgatgtggtggcaatattcttctcatttgatgaggctggaaaaggatacatcgcaccctgggatcttgaaaaaatggccaatataaatgatttcatctggacagattttgagctatctaagatgatccattgctttgatagtgacaaagatggaaagataagcctcgaggaattccgcaccatcgtgtctcgatgcaacatgttgcaggagccagaggagtgatgatgacagggcaaatagacggtgcctctccgaaacctaactattaagacggcatggatttgaaggtgaaactgggcaaagaatgctggagcctggaggcatgagtcgatgaaagtcccaagactgaacgggacctctgttcacattgagctgcatatcaaggtccttgtaaggag

SEQ ID NO: 17817 - DNA, 677 bp, Triticum aestivum
  Clone ID: PAT_TA_17817
gcaaagtagctcacacatccatcggcgccagactactgactcagatcctccaccgaccaccagacccagaccgatggcttcttcttccgtgctgctcggaggaggcgcgggcgccgccgccttcaccggcgccgctgccggcaaggctcttcccaggccgtgcttcctcgccgctcgcccgcacaccgccagcggtggccgcctctgcctgcaaacccctcctagagcgactcctgctaacgacgccgtcgagaccgtgaggggggcggccggggaggccggagacaaggtctcggaaggggcggacagcgtgacgaaggcggccagcgacgcggcgggcaaggtacaggaggcggtagagggcgccgtggagggagccaaggacctgggcgagaaggcgaagcaggcgacggaggaggcgtgggacgccaccaaagacgccgcacagggcgtcgccgacgacgtcaccgccgcggttgaggatgtgagcaaatgagctcaacatttgcgtatcagattgaatatttaacatgcatgatgtgcacgcgagtgtcttttgtgggtcacgttattaatgatgtatgctttgtataagagctacaacgttggtcaaaagttgtgctaaaagagcatctacaatcgcacacccgtacccgtcaaaaaaaaaaaaaaaaaaa

SEQ ID NO: 17818 - DNA, 1024 bp, Triticum aestivum
  unsure (1)..(1024): unsure at all n locations
  Clone ID: PAT_TA_17818
gacttcggcacgagcgcaagtgcaaagtagctcatacatccatcggcgccagactactgactcagctcctccaccgaccaccagacccagaccgatggcttcttcttccgtgctgctcggaggaggcgcgggcgccgccgccttcaccggcgccgccgccggcaaggctcttcccaggccgtgcttcctcgccgctcgtccccacaccgtcagcggcggacgcctctgcctgcaaacccctcctagggcgactcccgctaacgacgccgtcgagaacgtgaagggggcggccggggaggccggagacaaggtctcggaaggggcggacagcgtgtcgaaggcggcgggcgacgcggcgggcaaggtacaggaggccgtggagggcgcggtggagggagccaaggacctcggcgagaaggcgaagcaggcgacggaggaggcgtgggatgccaccaaagacgccgcgcagggcgccgccgacaacgtgaccgccgcggtcgaggatgtgagcaaatgagctcaacatttgcgtatcagttattcagttggccgattgagtattcaacatgcatgatgtgcatgcgagtgtctgttttgtgggtctcatcattaatgatgtatgctttgtataagagctacaacgttggtcaaaagctgtgctaagaaaccttacacacgagtctattgcgcaccattattatgctaacgaaaagttgctagaaaaaaaaaaaaaaaaaaagntttaatcttcttggtcgaaaatttcgaaccttaaattgcncaaagggccnncttttnccttgccctttggaacgccggccattcggacggggcttttaatggttggtnggnatttattccaattggcaaatttccaggggggaaacccgnatttntttggatttaaaaanataaanaaaaaaaatcttgnnaggtccttttanantggccggggggccnntnaatttccccccggtnggggtcccaanntaagggacccaattnccctantaggancnnttnt

SEQ ID NO: 17819 - DNA, 1014 bp, Triticum aestivum
  Clone ID: PAT_TA_17819
tttttttaaaaatagaagtactcaagtatattgaaatttcatgtatgggaccaacataatgcacaatcaaaatttatcttaacgaatccagtatatgcacaaacaatacagaagtgagaacgccgattgttctctttgcctagaatattgccagtgactgatttcccgcataattcactgctatcccgttcttgaaggcttgggcttgttcttcctgatttgctatcaaatttcatttctgagtagtttgctcatggccaactctaaattcttaaaacgtttttatttgggggggaatgcaagcccttcatttacatcaaactaaccaataactcaccacctggggtttcctccttatactaaactcctacttattcaccactatcatcaattgaaagtgagttaccaggaagaacattgctcagccactacgggactgcgaggaactctcgggccggccgccccggccaaagcacccaaacaggttcctaaatacacggcgaatccgaccttcgccgccgtccacctgcccttctccttctggccatgtcacccgcctcggcccgacgccgttgctgaaaccaccatccagctccgtgtagacaaccggcagttgctctctgggcccgccggcgaaccttccaacggcgaatccgccgcgggggagtcgccagatggtgagcccggcatccgcctccgcctcaggcacggctgccgccggaagctcgctgcggcagatggggcaggagttgcggagggagagccaggggaggatgcagtcctggtggtagacgtgcttgcacggcatctcccgagccgcggcgccgggctcgaaggcctcctggcacaccgcgcagtgggccccgcctcccccggcgaccgtcacggacggcatcgactccaccgcggccttggacgccggcgggcgcggcgcggcagcctccagcctcgagaactggtcgagcaggcggtggaaccccgaccccatgaggaggtgcgagacgtcgccgggca

SEQ ID NO: 17820 - DNA, 815 bp, Triticum aestivum
  Clone ID: PAT_TA_17820
ggccgctcgagccggcgggcgggaattcatcaacgccgaagagaagagaggagacctgctatcgtttgatcgatcccgcagtcgagtcatcgggggttcgcccgccaccgcgttcgacggcgagcaagaaccaggaaggaaggcttcgatcgatgaagcggaaccaagaagaagcgcgcggccacctcctcgccgggaccgcctcccgccacgacgctgcggacgcggaggcgccggcgccgatcaccaagggatgcgcgacgttctgggtgggcgcggaggaggagggcgaggcgccgcggcggttcgcggtgccggtggcgctgctctggcaccccctgatcctggagctgctcggggaggcgcgggacaagtacgggtacgcgcacgaaggcgccatcgtcgtcccctgcggcatcgagcggttccagaaggcggtcgacgcggcgagggcccaagaacggcaccgtcaccaccaccatcatcacttcagtcttcctcaccttgccgggtgctttaggccctcgcacgctgttgcttaggatcgtcaagcccgcggcttagcgtccagtttgcgcgtttttcttggtttcttggtgtggtgatcaaattggtaggcatccaacaccaagaagaagctcagcacatgtagcgtagttgatcgagctgcccatgaagaacgcagattctatctgtgaccgatccatcatcgacgcagattctatctgtgattgatccgctgatctgtacagattttattgtgtacatgacgagaattccttgttgttgcttcagatcgacgcggtccgcttttc

SEQ ID NO: 17821 - DNA, 767 bp, Triticum aestivum
  unsure (1)..(767): unsure at all n locations
  Clone ID: PAT_TA_17821
ccccctcgtcgccgccggggtccctaacctcgacctcggctcgccccgatcgagagggtgaccccggcggacgccgcggacacgctgctcctcttggcgaccggggccgggcatcagcccgatccgctcgctcatcgagttcggcttcgcggccaagcagcgagctgatgtgaggctctactatggcgccaggaatctggaaacaatggcgtatcaggagagatttgcagagtgggagtcatctgggctcaagattgtgccggtcctgtcacggccagatgatggcctggaaaggtgaaaggggttatgttcagcgcgcgttcttggaagccaagaacattgccaatcctacttccactggggctgtgctatgcgggcaaagccaaatgatcgaggaggtcacctcggcccttacagcagatggcgtatcacaggataaaatcttgaagaacttctagagcacagatctcctgaatgtaactcatgcttctttggttgggccgtaccgtgccttcctgtttgtattagaatttctgtaatttgattcatcgatacttctcaacacaagatacgagtagatatacatgttatcagagtttgttttgctccaaaaaaaaaatgtgctacctctgggagatgataagatccacccaaaaaaaaaaaaaaaaacggtccncggncgccaccgcngtggagctccagcttttgttcccctttagtgagggnnaattgcgcgcttggcgtaataatggnnatagctgtttcct

SEQ ID NO: 17822 - DNA, 494 bp, Triticum aestivum
  Clone ID: PAT_TA_17822
aactagtcttttcttcactgtgtgacaaactagttagcacctgcagcagcatccggggagagaaataatggtgtacaaggcagtggaggccattgctctgaggagccagcttcagagaagaaacatcagtgcgagaagccatgagcatcaggtgaaggccaaagagaatgagcttatatggggcattgttctctggatcatcaggaaggtttgcccggccttctaggccatgctgccatgtacggaggattagggtgtaacagccgaaggcggattctttttgctttgagcagagattttgcatacgtcatgtgtttttatgtatttatgttatgtatgtatgtattgtttggccagttcaggcaagtgcgtgtgtatcacttctagttagtaggaaccatcaatgtcatgtaatatcagtgcccaagaactccggtcttggccgaactgagtgtattttgtgttttacctatgaataatgttagctaatatct

SEQ ID NO: 17823 - DNA, 573 bp, Triticum aestivum
  Clone ID: PAT_TA_17823
gggggcccaaacctcgtaaacacctcccatttgattttaattgtatcaattgatcgggaggtgttgatcgtcgtaaaccatgagcaaaggcgccataatcggcgcgtcgaccgtcctggtggtggcggtcgtcgctgccgtctgcgtcgtgtcctcaagagaagctaagaatgaggaggacagcaccgagcttacggcgtcggtgaagtcgatcaagtccttctgccagcccgtggactacaaggcggcgtgcgagcagacgctgggggagacggccggcaatgcgacgaccacgacggagctggccaaggccatcttcaaggccacctcggagcggatcgagaaggccgtggaggagtccagcctgctcaacgagctcaaacacgacccacgcacgtcgggcgcgctcaagaactgcaaggagatgctccactacgccatcgacgacctcaggaccaccttcgaccagctcggcggcttcgagatgaccaacttcaagcacgccatggacgacctcaagacgtggctcacctccgcgctcacgtaccaggagacgtgccttgacggcttcgc

SEQ ID NO: 17824 - DNA, 1116 bp, Triticum aestivum
  Clone ID: PAT_TA_17824
gtttcatttgtttcggagcggagcgaggcgaggagaagccagctgagctgagctgaggagggaggagacagggcggccccattcccactccctcccactccctcactccctgctctgctctgcagctagcacaccattcattgattcactcgcccgctcgctcgctccattgcttcttctatctatcccttgctctgctcgctctgctcattccacgcgcactgtccactccatccatccccatccccatccatccgtcaccgacccgcctgcatttactcccgtctccggcggcggcggcggctgagctgatctaggttgggggcggggcatggagggggacgacaagtggaagctgtccaagaaggggcggagcagatcgggccggaactactactacggcgacgcgtccgggtccggggccagcaccagcgggggcctgagccggagctactcggccagcgtcaccgccacccgggacggcagcgccggcgccagcggaagcgggagctcgtcgtcggagcagcagaagaaggaggaggccgagtcaaggaggcggctgtccaagaagtgcgtggaggcggtgaaggagcaccgcgcgcgcttctacatcgtccgccgctgcgtctccatgctcgtctgctggcgcgactactaggacctgccggccacctccggcaggccggccgccacattctttcaatcgtttgcttcttctttccactgctgctgtagctacgtaccggcgtacatttcttccccctttctccgcctagccgagctctccatccatcccagcctacataatcttagccgcttcttcttcttcttcttcttcttcttcttcttcttcttcttcttcttcttgctgcttgcttaattactttcttgatgtttttccccactgtgatttgggcatgtacagtacatcagccatgagcgccaccaccagcaccacaggtaatctacctagcgccccgtgccgtcacaatcagccaccattactagctagctagctcaggagctccatttcgctctgtttttcctagtaccacggagacttaaatttgtgcagctagcttcatttcaatcaaatttgtcctagcaaaaaaaaaa

SEQ ID NO: 17825 - DNA, 819 bp, Triticum aestivum
  unsure (1)..(819): unsure at all n locations
  Clone ID: PAT_TA_17825
ggccgctttcgaggccggcccgggccgcggaaaaaaaaaaaaaaaaaaaaggaacccactgggtcggggaaattgtataagattaagaaagtagaagattaagaaagctcgtgggttagagatatagaaaagaaaaagtagaaaaggattaaaaaagagggaattcctaatccaatcaaaaaacccattttggtcttagtgtggatagaggatcttcctatgttatactatataactctcatccgtgaaatataactctcatccatgaattgatttgatagatccgatattcataatattgaattgattcagtattatcagaatgcaagccctacccttgaatttacaagatacccctttttcctctccatgggattacatcccgagttattgtgaaaataaaaaataaagaggttatggaagtcaatattctcgcatttattgctactgcactgttcattctagttcctacttcttttttacttattatttatgtaaaaacagtcagccaaaataattaattggaattccaattaatcattgaagattacatcccgagttattgtgaaaataaaaaataaagaggttatggaagtcaatattctcgcatttattgctactgcactgttcattctagttcctacttcttttttacttattatttatgtaaaaacagtcagccaaaataattaattggaattccaattaatcattgaagaaattaaaaagggggtcgataaaaaaaaacccaaccttgatccgacttgacccgcgctgcagccgttattgtgtacgtccctaatgggnaaaaccggnggt

SEQ ID NO: 17826 - DNA, 584 bp, Triticum aestivum
  Clone ID: PAT_TA_17826
gcatccgactccctccctcgcctccgacccatcacacacacacagcgcgagcgtcttatccgggcctgcgcgaagagaagagaagagtgcagaggagcatacagagtaagcaacagcaatggtgagggctccttgctgcgagaagttggggctcaagagaggcccgtggacggcgaaggaggacatgaccctggtggctcacatcgagaagcacgggcacagcaactggcgggcgctgccgaagcaggccggcctgctgcgctgcggcaagagctgccgcctccgatggatcaactacctgcgccccgacatcaagcgcggcaacttcaccagcgaggaggaagaagccatcatccaactccacgccatgctcggcaacagatggtccaccattgccgccaggctgcctgggaggacggacaacgagatcaagaacgtctggcacacacacctcaagaagcgactcgagtcctcgtccaagccatccggccaggcagcgcctaagcgcaaagccaagaagcctgctgtggctgggagcgcgatcgagggaccgacctccgagccggcgtcgtcgtcaccggggc

SEQ ID NO: 17827 - DNA, 1048 bp, Triticum aestivum
  unsure (1)..(1048): unsure at all n locations
  Clone ID: PAT_TA_17827
gccaggctgctgggaggacggacaacgagatcaagaacgtctggcacacacacctcaagaagcgactcgagtcgtcctccaagccgtccggccaggcagcgcttaagcgcaacgccaagaagcctgtggctgtagcgagcacagccgatggcccggcctccgtgccagtgttgtcaccggagcagcccatctcgtcgtccgccaccgattcctcgatgccatcgtcgttggagaacacggacagctttacatcggaggagtttcagattgaagacagtttttggtcggaaacactggcaatgacggtggacagctccgattccgccatggaggccggcgtcaccccaaacagtgcatcgccgtcgtccagcaacgacgagatggacttctgggtcagactgttcatgcaagctggtgaagtgcagagtttgtctcagatttaggcagaggatatcggctcctcggctagtttcttgttcatttcttgtctctcaatattctttaaaatctttggcatatactacttcgttctgatcatttggtgggtgtatacctgtaaaacggaagagcttgggaagggaaaaataatcgttcatagcggtgttcatccagcaaaaaatgtgtcacggcactagtgttgcaaacttctttgttgtatgcctacaagaattggcgtccaattgatacccttttgttttggaaaaatatgtctttgattgctttgtgatatcaaggactgaaagcctgataataccttttagtcggagttttatattgtgaaaagctgttttactcaagtaaccttatattaaaaacaccaaagagcgctgttaaaactctggnttgctaaacatagtgtaagagcatgcaacccgggagcgangaacaaggtagcacatgagttgggccaaatcggccgtatgtgtttagctgagatgtgtatgcattggggaaaagatgtacccttnatgtctgccntgtgttgngcgatctgcctacacaccgttaaccaataantttgctngcttcaaanaanaaaanaggtgag

SEQ ID NO: 17828 - DNA, 1035 bp, Triticum aestivum
  Clone ID: PAT_TA_17828
agcagctcaggctgccagctacctccctcgcctcggaccgtcaaccacacagagcgaaccgtctatcacacccacctcaacgaaaagaacagagcggaggagagcacacagagccagcaaagccagcaatggggaggacgccttgctgcgagaagatggggcgcaagaagggcccgtggacggcggaggaggacgtgaccctgctggctcacaacatcgagcagcacgggcacagcaactggcgggcgctgccgaagcaggccgggctgctgcgctgcggcaagagctgccgcctccggtggattaactacctgcgccccgacatcaagcgcggcaacttcaccgcgagacgaggaaagacgccatcatccaacctccacgccatgctcggcaacaggatggtccaccattgcggccaggctgcctgggaggacggacaacgagatcaagaacgtctggcacacacacctcaagaagcgactcgaatcctcgtccaagccgtccggccaggcagcgcctaagcgcaaagccaagaagcctgcggtggctgcggcactgcgagcgcgcccgagggcccgacctccgagccggcggcgtcgtcaccggggcagtccctctccatgtcgccggggcagtccctctcgacgtcgtccgccgccgactactcgatgccctcgtcgttggagaacacgggcagctcttcctcggggtcggaggagttccagattgaagacagcttctggtcggagacactggcgatgtcggtggacagctccggttccgggatggaaaccagcgacaccttcggcgtagatagtgcagcgccgtcgtcgagcaacgatgagatggacttctgggtcacactgttcatgcaggctggtgacatacagagtttgtcgcagatttagacgtttccgagaccacaaagccatgaaaacatggctcgccagcaccccccgcggtccgggcgggcggcccggccgaccctggacctggagtccgggacgtcctccggggccatttggccggaagttt

SEQ ID NO: 17829 - DNA, 826 bp, Triticum aestivum
  unsure (1)..(826): unsure at all n locations
  Clone ID: PAT_TA_17829
gtggcgtctagcgagatgggagcagactaacaccgtggagtggggagaccagctgcgcctacatgctacatctcgatccatatagaggagcacgacgaccctcttcagtctgtgctgaaggcaatgaggatggcacataggaagatcagctccatggaatcgcactgcacgaactggagcgcatcgatgtgctcaaaaacacgcttcgacggggtgatcctatggctcatcttgtcaagcgcaaagatacagactttcttctcaatgacttgggagatgatgaaaagatgaaggaatctggatttatagttcctcaaaatgtacctgctcacagctggctgaagcgtggggtagatcctcctccaaaccgttatggcataaaaccaggccgtcattgggatggagtggaccgcagcaatggatacgagaaggacatgtacaagctaaagaatgacaagcaggccacggagcaggaggcctacctttggtccgtcgcagatatgtgagcgccgcagctgtcccaagaacatgtccgatggcatgctggctggatccgttgctgaggttgcccaatgtgcctgaaaggaaagaaagcgatgcccttgaacatcatttcttcgaacacatgatgaccgtaaatgatttgctcgagtagccacgcagttttgttgtgtatttgctggattctgctactgaattctcctcgacacatttaaacattttgtaacatgtatgttttggcacggaggagtaccggtgccatccttctgttgtatatgggatttggccgaaacatagaaacttttagnagcaagtncngggttta

SEQ ID NO: 17830 - DNA, 640 bp, Triticum aestivum
  Clone ID: PAT_TA_17830
ctcgtcgctcgtgctgtggtgtgctcgttcgattgcctcaggtcggacggacggacgcgagctgagggcaggaggggccggatccggtggtccggagtgcgagctagcggccccggttgtcgcggcggcggaggagtagttggtggagtgccagaggaagcgggagcgggagcgacggcggcggtcgcggctacgaggtcgacgggatggactcgggcaagtacgtgcggtacacgccggagcaggtggaggcgctggagcgggtgtacgccgagtgccccaaaccgacttccacgcgcaggcagcagctgctccgcaagtgccccattctgtccaacatcgagcccaggcagatcaaggtctggttccagaaccgaaggtgccgtgataagcagcggaaggagtcttcgaggcttcaggccgtgaacagaaaactgagcgccatgaacaagctgctcatggaagagaatgagcgtctccagaagcaggtctcccagttggttcatgagaatgcatacatgaagcaacagctgcagaatccttcgttggccaatgatacaagttgtgagtcaaatgtgaccactcctccaaaccctctacgggatgcaagtaacccagctggactccttgcaattgcgga

SEQ ID NO: 17831 - DNA, 1047 bp, Triticum aestivum
  Clone ID: PAT_TA_17831
gttacagtagaagataagcaagcaaaaagtgtgcttctggtgaagtacatgaataattatctaggtatcggttgtgatgcgaaggttgcacttgacattcataatctccgcgaggaaaatccagacaagttctacagtcagttcctaaacaaggtgctgtatgcaagggaaggcgcgaagagtatcatcgataggacattcgcagacctaccttggcaagttaggctagaggttgacggagctgagattgatataccagaggattcagaaggcgtcctaattgcgaacatcccaagctatatgggaggggttgacttgtggcagaacgaggaggagaatctcgacaactttgacccacagtcgatccatgacaagatgcttgaagtagttagcatcagtggaacctggcacctggggacacttcaggtcggtctttctcgtgcgtggaggatcgctcagggccaattgatcaagctacggttctctgcccctttcccggttcaggtggacggggaaccttgggtccagcactcgtgcacgctgaagatatcccatcatggacaggctttcatgctaaagcgagcaatcgagtcgtcgcttggccatgccaccgcgatcgtcacggacgtgcttgaaaatgccgagaccagtcaagtgatcacggcgtcgcagaagagagccctcctacaagaaatggccctaaggctcgcgtaaatcctcgccgcgtttgcaggaggcgaacgccgcggagcattgcttgctgtggttgaaccgcaacggcgggagcatcttgtcctcgacggtggtatgaaacccaggaaggctgtttttttttttgaggcaggctgttttttttttttgacatgcaggaaggctgttggatgaatgtgcaaagggatatgtgcagtgtggttgttgtgttgtgtatacgtgatgtaggtctttgtgcagtcacggaataccactgggtgttgaagcttgcaaaggaagatgatgttcttgtctgatactagtatttgcccacgttgaaacaattagagcatctct

SEQ ID NO: 17832 - DNA, 1595 bp, Triticum aestivum
  Clone ID: PAT_TA_17832
aggggaagcagtgtgtgtcggcgcggcggagcaatggcggaaagccgagccgggcgctggtgctctacgccgccggccacgcggcgctgctcgccgggggcggaggggggaagggccacctcgacgcgttcgcctccatcgcctcctgcggcttcctctccgtccgcacccccgccgtcaacgaggatggaggggacaggaacagcgacacgattctcgagctggcgcagctgctcgacgtgtacgatgccctctaccctgccaaggatggggaaactgcccgggtggatccgcaggagctagtagtccccaagctatccgagaggttcatggggctgagagctgctatggtcaccaattgccccggtgttagttcattcgcggcgaatcttggcttccacgttttcggaactgaggatttcgccgcacggtcaggttcaggcagcagttctaaggacgctagaataatcgaccgggcgttcgctctgctgggatttgcggagtggaatgtccaggacgcgtctgaattcgatctggtctttgtgcatgccgcaatggagaacacagccagcaagctggggaaattagggatgaagacggatctcaaccggcttgacaaattggtggcttccgtcatggaagctgcgccggtcggttcagctgtcgccgcccgtattcatgtgtctgtgatcttgagctatggatctgctactgaaaataaggaagaggcatgcctcatcgtagactcttcaaccgaaactgattccgacttgaagttactccggccacgccaggagctacactatgaaagcaggtaagacgttggatgatgtcaggaatcatcatccaatgctactggcacagtggcaacaaggagtaacacgttctgatttggccaaagagttctcttttgaggaatttataaagcgtgccggaaactttgctatgcttgctgagcgctttctacatgaggttgcatttaagctctggaaagcgccaaaatatggagcatagttctgtctgaggaggttttctcttaataaggcgtggaatcacctaataaaagaggtgttagacaagtacttctttcaaatgggtactgcggcagatattgcaaatagatgagttctgtactctcctatggtcctcatttggtatcacccatgctccatgccgacgatgccgtggtactgggaactcataggctcattaccagtagtagttacttcgtggagttctgttgtgagcctctctaacgcttaactttcatgaaacaatgccattcttcgcagctttgcttgaaatttcttaacgtggcagttgtttctgcgtctagctctgtatcagctttgtaccatgtgcggatcactgtatgctattgctggaaatgatgacccacgcgtccggtgaaacaatgccatccttcgcagctttgcttgaaatttcttaacgtggcagttgtttctgtgtctagctctgtatcggctttgtaccatgtgcggatcactgtaatgtagatgctattcctggaaatgatgaccggctggagcatcaattttaataacaaatactggaatgtgttttcctaaagaagg

SEQ ID NO: 17833 - DNA, 595 bp, Triticum aestivum
  Clone ID: PAT_TA_17833
cagccccacaacgaaccaagtgtgatctagccactccctgcttcctgctgtgagtaatggcgaccatggtggccttgagctccttcgccggtgccgccgtcgtcggccgctccgcctcctggtctccggcggtgccgcgccggcgcgctctcctcgtcagggcccagaccgagccggatgtcgagccgaccaaggagacgatgacgagcgcatcgacatcctcccccagccccaccccaagcccgagcccgaccccggtggcgcccaagcccaaggccaaggctaacccctcggtctgggacgcgctcgcgttcagcggcccggcgccggagcgcatcaacggccggctcgccatggtgggcttcgtggcggcactctccgtcgaggcggcgcgcggcggcgggctactcgaccaggtcggcagcggcgccgggctgggatggttcctgacaaccgcggctgtgttctccgtggcatctctggtgccgctgcttcagggacagagcgtggagagcaagtccagcggcgtatggaccgccgacgccgagctatggaacggccgcttcgccatgctcggcctcgtcgcactcgccgt

SEQ ID NO: 17834 - DNA, 865 bp, Triticum aestivum
  Clone ID: PAT_TA_17834
gccagaggccacatcggccaagtgtcatcaccatcagttctaaactagcgagctgcaccttctctacgttctcttccttcgctagcttttctctgcctcgaggaatggcgaccatgctgactttgagctccttcgccgtcgcccgccggcccgccgcccgttctccggtgggggccccgcgccggcgcgccctcagccgtcaagggcccaggccggaccctgacatggcactccacccaaggagacgacgagcgcgtccgacctcctcatccccaccgcacgagccctgccccgaccccgatcccggacagcacccaaagcccatgaccaaggaaggccaacccctccggtctgggcacgccgctgggccttcacgcggcccggcgccgggagcgcaccaagcggcgggcctgggcgatgggtgggattccgtggcggcgctgtccgttgtagggcggcgcgctggcgggtgggctccttcgaccacggccggggagcggcgctggggctgggctggtttcctggcagaccgccggggtgttctccgtgggcgtccctggtgccgctgctgcaagggccacagcgtgggtagaccaattccagcgggcctctggagccccgatcgccgagctctggaacggccccttcgccatgctcggcctcgtcgcgctcgccgcaaccgagttcagtacgggcgcgcctttcttcaacatctaagaccacgtaatgtaagcgctgtggatccttttctgctgacagatcgtattagtactcaccgttgttgcctcgttgcaattttgcattcctctagatatatgcattctgttgatcccctaaacaaaacccccagcactttggttatgtt

SEQ ID NO: 17835 - DNA, 1928 bp, Triticum aestivum
  Clone ID: PAT_TA_17835
ctgatactttcttgtagatatttgatccgccgcagactacttttgactggcactccaagccaaaatagcctacaggagctgtggtcattgctcaactttattctgccaaatatttttaattcatctgggaattttgaggaatggtttaatgcaccgtttgcatgtgatgttagcattaatgatgaggaagagctattgatcatacatcgtttgcatcaagttttgcgtccatttttgctccgtaggaaaaaagatgaagtggaaaagtatctcccttcaaaaacacaagtaatactgaagtgtgacttttcagcttggcaaaaagcatactacgagcaagtcgcaagcaagggaaaggttgccctaggatctggactcaaaccaaaggctgtggcaaacctatcgatgcagcttaggaagtgctgcaatcatccttacttatttgtagagcaatataacatgtatcagcgcgggcacgtggttagagcatcagggaagtttgaattgctcgatcggctacttccaaaactgcatagggctggtcacagggttctgcttttttctcagatgacaagattgcttaatattttggaagtatatttgcagatgtacaatttcaagtatatgaggcttgatggatcaacgaaaactgaagaacgagggaaattattggcagattttaataagaaggactcagagtacttcatttttcttctcagcacacgagctggaggccttggattgaacttgcagactgcagatacagttattatttttgatagtgattggaatcctcagatggatcagcaagctgaagaccgtgctcatcgtataggacagaaaaatgaagtgcgtgtatttgttcttgttagtgttggatcaattgaagaagagatcttggatcgtgcaaaacagaagatgggtattgatgcaaaagttatccaggctgggttgttcaacaacacctccacagctcaggataggaaagcgttgctacaggagatcttgaagagaggaactagtacacttggaactgacatccctagtgagcgtgaaataaatcgtttggctgctcgaactgaggaagagttctggttatttgagaagatggatgaagagaggcgacgacgagaaaactataaatccaggctgatgcagggacctgaggttccagaatgggtttttgatatcagtgaaaccttagctgagaagctccttgcggaagaagccaaaaatcctgtgataaacacaaagaggcgaagaaaggaggttgtctattcggactcttatgttgatcaatggatgaaatctgacgaggtatacgaagacatcccaaagatgactccaagagcaaaacggagtgcttatttatccgatatacaggaggttgatttacatgatagggcaaaaaggctcaaatattctgacagcgccgatggcgcaggcaactcaacctggacaccagagaaaggaagagctggagtttcttcctacagcaaggatgagaacgaagacgacaatgacgaagatgaagtcaccgccggtggtttgcagcagggtggtagcttcacctggaataccctcaggaggaaaaggtcaagccactccactaatccgtcgtcggaccctaaagggcgctcggcattttaatgcccatctgataggagtgccatttagatgcatgtctgctttcttccttgtgaggaaaagtgctccgatatagagaaactaatacagtttcttcagaagtgcatctaagctcatcaactttaggactagtgcagtattttatgaattggttggtattaaactgtatctccaccagaactcggaatgtttcctgatatgttcgatgcttaaatataaacaatggtcctcatgtcatgggggtaaaaaaaaaaaaaaaaaaaaaaaaaataaaaaaaaaa

SEQ ID NO: 17836 - DNA, 591 bp, Triticum aestivum
  Clone ID: PAT_TA_17836
gattcggcacgaggatggaccctgacggcgacgcgcggcatcagcagcggcggcggcgagccggaggaggagggcccggcggtgtcgctccggccgctgggcctggcggacgtggacgacttcatggcgtgggcgtcggacgagcgcgtgatgcgccacctgaagcgccccctgtgcgcgacgagggagcaggccgtggcgcagatcagggacaccgtgctcggccacccgtggttccgcgccgtctgcgtggcggggcgccccgtggggcaggtgtccgtgtggccctacccggacgacggcggccaccgggccaacctcggctacgcgctggcgcaccgccactggggccgcggcatcgcctccgccgccatcaggatggtaactccgttagctggtaacccgggcggagctccggttcggcctcgcgcgtcgagtgactgacttgctgtgttcttggcgcgcgcaggtggtggggagggtgttcgaggagctgccggggctggggaggctggaggcggtgacggacgtcgggaacgcgaggtcgcagagggcgctggagaaggccgggttccagagggaaggggtgct

SEQ ID NO: 17837 - DNA, 568 bp, Triticum aestivum
  Clone ID: PAT_TA_17837
gagctcccctgtcgctcccgcgggcggctcgggagctaaccctagccgccgccgcgagcaccccacccaccgtctcttccaccactcgccgccgccggtggcagtcgccgggcaaagcccgtgcggctcggcggcggcggggcctttctcctcctccgtccgtggctggctggcgcgggccggttgcttcggcggatgctcgggcagcagcgcacgtccggggcgacccttctggctggcgaggctgcgcacgaggatgtgggtgagcgaggcgcgcgtaggaggcgcgctggattgcagatctggtgcatcgagggcgcgcggtgctgcatggtgaccgcgttcggttcgcgggcgcggatggtggcggcggctcagcgaggcaacggcggtcgccgtggtgggctcaacgcgaaggcttggctggtcgctgggcgtccgcgctggtggtggcgcagcttcggccgtgtgatctccagctggggatctggatctggctggtctgctcccgatctgcgatcgatgggctggctgtcggcgggtggtggtgcccagacctctcttcctg

SEQ ID NO: 17838 - DNA, 1361 bp, Triticum aestivum
  Clone ID: PAT_TA_17838
cccacgcgtccgcggacgcgtgggcggacgcgtgggcacagcacccaaccctacgatccctctctcggaatggatgccaccacggcgaagcagctcaggcggctccgcacgctcggccgcggcgcgtccggcgctgtcgtctggctcgcctctgacgacgcctccggccagctgctcgcggtcaagtctgccggcgccggcgcggccgacacgctgcggcgcgagggtagtgtcatggcggggctctgctccccgcacatcgtcccgtgcctcggctcccgcgccgcgcccggcggcgagtaccagctcttcctcgagttcgcgccgcgcggctcgctcgccgacgaggccgccaggagcggcggcagcctcgcggagcgcgccatccaggggtacgcggcggacgtggccagggggctggcctacctccacgggaactcgctggtgcacggggacgtcaaggcgaggaacgtcatggtcggcgccgacggccgagccaagctcgcggacttcgggtgcgcgagggccgcggattccgaccggacgatcggcggcactccggccttcatggcgcccgaggtggcgcgcggggaggagcagggcctggcggccgacgtgtgggcgctcggctgcaccgtcatcgagatggccaccggccacgccccctggagcgacatggacgacgtcttcgcggcggtccaccggatcggatacacggacgccgtgcccgagcctgcccgcgtcgctgtcgccgcaggccaaggacttcctgcgcaagtgcttggcaagaaacccgcgccaccgatccaccgccgcgcagctcctagagcacccgttcctcgcgtccgccttccacgacgtcgacgcggagccggcgaagcaggattggatcatgtcccccaagagcacactcaacgcggacttttgggagtcggacgaggaaagcgaaacagaggacatgctgacgagcgcggccgaaaggatcggctcgctggcgagcccttgctcggccttgccagactgggagtccgacgatggctggatcgtcgtgcacggcggacgccctgaagcttcagaaacaacgacgcccacggcgatcgccggcacagacttcggtccttggagtgaagaaggattggaagccgaggttgatgtccatttcgctggtgctgatgccggcaggtggtacgaccttgtgcggaatgtggatggggcgcattatttcggttggtacgagagagatttgggtgtcagtgtcgttactgatagaccgttgtgcctcattgttagtcacggacgcaaaattgtaaaattcggttgtcattgcgacagagaaagaacaatgcattttggttttgccc

SEQ ID NO: 17839 - DNA, 609 bp, Triticum aestivum
  unsure (1)..(609): unsure at all n locations
  Clone ID: PAT_TA_17839
cgacattttcgccacccaacccggcaaatcgccaatcgccgtcgtcttcttctttgtctcctccagcgagccacagcccacaggaatcctctccgaccaagaagagaagagaagagagaagggatgggagggttccagcggcaggtgaaggagcggaccatggaggtgaaggtggcggtgctcaagggcgtcagggtcgtcggcgacttcggcaagaagacgtggaacaaggtcaaggccatcaagcgctgatcgatccatccatcgcatctcacccgatgtgtgcttcgttccttcgctccagtccactagttgcttcatgtagtactgcctgataggatagccgtctggccttgtgctcttttttttttcggttgtggttgtgatttggtttgttggatctgttttgaggcagcttttgatgcatgtgaaaaattgtctgtcaagtgtgatctatatttaggccttgttttaaatctcctcgataattataaataataaatcgccttctaaaaaaaaaacaaaaggccgaccgtttagacaattcgccgttagggcgcggtaatcccgcggcgctccctgcccacttttaatncttnanaatccctt

SEQ ID NO: 17840 - DNA, 483 bp, Triticum aestivum
  unsure (1)..(483): unsure at all n locations
  Clone ID: PAT_TA_17840
natctactagcaagcaagaggcatgttcgtccgtcggagttagcagcctgagagctcgtggcttggtggcgttcctgcagatcatggcgctgctggtgtgcttggtgatgatgagcagcagctacacctgccatggcgccggccgatctctgatgggagtgtctgtcggggaggagaaggtgccgcacgtcgagattcctgcaaaatgcttcgtgccgccatgccactaagctaccatgcttatcgtcgcaagcttgaactactactactgctgaggcttgaatctggagtactttgcttacgcgtgtacaagggatcttgaaactagaggcttgaatctagtacttctcatgaataaaaagaataaatgaaactaggaagcaccgcacagcatggcaaatcgatttggcacgttagatcctgtactgtactttcgagtcaacgagagaaatgaaattagatcgtgtcacacgttatttcttc

SEQ ID NO: 17841 - DNA, 1029 bp, Triticum aestivum
  unsure (1)..(1029): unsure at all n locations
  Clone ID: PAT_TA_17841
gcagtcgggggcattcgtatttcatagtngaggtgaaattcttggatttatgaaagacgaacaactgcgaaagcatttgccaaggatgttttcattaatcaagaacgaaagttgggggctcgaagacgatcagataccgtcctagtctcaactcctcatagaccctgatctctctgaagctcatactctgaggcaatggttcgacggtggaggaagggatgcttctactcagtccatatcgagggatcacactcctgcagcatcaaggaacgaggtccgaatgacagttgctaaaatcaaggacgatggtcttggnaatgggagacaaacctgattgggttacggtgaaagcctccattatattcttcaagagcgacaacttctgctacacagcttgccctaccaaggaaggtgaccggcagtgcaataagaaagtgacaaaggggacctctggcttgtgggtgtgtgacaaatgcgacaaggagtttccagagtgcgactacaggtatcttctgcagcttcagattcaagatcactcgggaacaacttgggtgacagcgtttcaggagaccgcgcaagagttactaggctgctcggcgctagaactcgtcacatacaaagagaacggagaccctcgttttgcagagaccatgctcagctgtttgttcatggattacctgctcaggctgaaagtcaaagaagaaacgtacagcgacgagcggagagtgaagaacacattggtcaaagtggagaggtttgatcctgctgccgaaagtagatatctgctcgatttactttcaaggtcggtggcatcatattgagcagcgagttgcgcccgaagaggtgtggcggtgtccataacatgttctcttttgctcgcaaggcccaaggtttacttaccatattagagattcaggatttattcagttcataccgatgtttttgatgtgatggtaacagtaagcatgccaatgtatcggcctatgtagactttctgtccttgtttaatttttaacggatcaattcaga

SEQ ID NO: 17842 - DNA, 921 bp, Triticum aestivum
  unsure (1)..(921): unsure at all n locations
  Clone ID: PAT_TA_17842
ttcggcacgccgctccgacgaacggaaccaacaaatccccaagccaatctcgtctccgatcgactccagctccccttcctccggtcctccccgccgccccaagatgcagatctttgtcaagaccctcactggcaagaccatcacccttgaggtcgagtcgtctgataccatcgacaatgtcaaggctaagatccaggacaaggagggcatccccccggaccagcagcgcctcatctttgctggcaagcagctggaggacggcaggacccttgctgactacaacatccagaaggagtccaccctccaccttgtcctccgtcttcgtggaggcatgcagatctttgtgaagaccctcactggcaagaccattacgcttgaggtggagtcatccgacaccatcgacaatgtgaaggcaaagatccaggacaaggagggcatccccccggaccagcagcgcctcatctttgctggcaagcagctggaggacggcaggacccttgctgactacaacatccagaaggagtccaccctccaccttgtcctccgtcttcgtggaggcatgcagatctttgtcaagaccctcactggcaagaccattacgcttgaggtggagtcatccgacaccatcgacaatgtgaaggcaaagatccaggacaaggagggcattcccccggaccagcagcgtctcatcttcgctggcaagcagctggaggacggcaggacccttgctgactacaacatccagaaaggagtccaccctccaccttggtgctgcgtctttcgagggaggcatgcagatcttttgggaaccccccttanctggcaagaaccattacactttggaggggggagtccttcggacaccatagacaatgnccaaggggaaaattccaggacaagggggggcatttccccggacca

SEQ ID NO: 17843 - DNA, 2148 bp, Triticum aestivum
  Clone ID: PAT_TA_17843
tgagcagcaagttaactaccgatcgagagtggcatatataggctatagcacttagtttgcagagcaaacaagcatggagaagctctccatggcggagactatgtactgcgccatggcccttgcggatctggcggctgctgccgccgaggaggcggcgggcgtgaaacacacctgatgcagagcacaagatgaaccagaagcacctgtgccacaccaccaagatacacgtgccgaacgtacagctccccggccccacctcgtactggcacgagaattcaactaccacaacccacagctgaggaacacggtgcatgtgcccaggactccctgggctgttgtgcgcttcgtcaccgacaaccccgggatgtggtacctccattgccactttgagttccaaatcatcatgggtatggcgacggcgttcatcgtggagaacgggccaacgtcggagaccagcctgcccccgccgccgccggaattcaagaggtgtggcgccaatggcctcactcagccatagagctaattaatctgggtaaggacgtgtgtgtagaagttgggccctgaacttatataattattattagtgcaaaataaaaacactgaagatgcaggcaaggatttgcatggatccttcattgtattgccggatgattcttatcgtaaaagtgggcgacctcagcaactgctctggcaagccgagagcttcgtcctcgacgtggtgcgcgggaagacgtacctgctgcggattgtgaacacggcgctcttctcggagtattacttcaaggtcgctgggcacacgttcacagtagtgggcgccgacgggtactacctgacgccctacaagacggacatggtgacagtcgcgccaggggaggccatcgacgtgctcatggccgctgatgcccagccggcgcactaccatatggtggcgctcgcaaaccagccgccggagcctgacccgcagatcccggggttcgtgtcccgcggcctcgtccgctacgccggatccacccacaacaacaacgggctgccggtgccgacgccgctcatgcccagccagcacaacaccatgccgtcctactacttccacagcaacctcaccggcctcgcccacccagaccgccatcgcgttcccatgcacgtcgacgagcgcctcttcttcacgctcggcctcggctccatctgccgcggcaccaacaagacatgcgagcgtgggcggagtccggagaccattgtggtggccaccatgaacaacgtgtccttccgccatccgaccaacgcgtcgctcctcgagaggtactacgacggccggacaagtggcctctacacggaggacctccccgaccatccgccgcacccgtacaactacaccgaccgctccctcatcccgccggggccgctggagaaggcgctcgagccgacgttcaaggcgaccaagctacggaggttccgctacaacacctcggttgagatcatcttccagagcacggcgctgctgcagagcgactccaaccccatgcacctccatggctacgacttcttcgtcctcgccacggggctcggcaactacaaccccaagacggaccccaagaagttcaactaccacaacccacagctgaggaacacggtgcatgtgcccaggaccggctgggcagctgtgcgcttcgtcaccgacaaccccgggatgtggtacctccattgccactttgagttccacatcatcatgggcatggcgacggcgttcatcgtggagaacgggccaacgtcggagaccagcctgcccccgccgccgccggaattcaagaggtgtggcgccaatggcctcactcagccatagagctaattaatctgggtaaggacgtgcgtgcggaagttgggccctgaacttatttattattagtgcaaaataagaacaatgaagatgcacgcaaggatttgcatggatccttcattgtattgccggatgattcttattgtaaaagttgatattattttttaatttatttctccattgtaatgtgtgaactgtaagttggtccagtagctagggttcagttttaaagagaggtatacgaactggctgatatcataaacaaaatcctgtatttagatgtattttatgcgctgaagattatggcactgctgttg

SEQ ID NO: 17844 - DNA, 1009 bp, Triticum aestivum
  unsure (1)..(1009): unsure at all n locations
  Clone ID: PAT_TA_17844
gtaccgcctccccccctccgccgcgctggccgcccgccacgtcctcccctgggccgccgccctctggcgcccccccggccggcgggcctccccggccggcggcgccctcccgctctccgccgccatcggcgatgagagtggtattgcaccgaagcagccttctgctgtggtgataagtgctgcaatttatcatcgccatgtttgtcatggacacatggcaagtacttcatgcacagatacatgcacatcaacaagtttctgtataagcacatccattccaagcaccacactcttgtagtcccttattccttcggggctctttacaaccaccctctcgacgggccttattctggacacgatcggcggtgctctctccttcctcctctctggtatgactccacgaacatccatattctttttctcgtttgcgaccatcaagacggtggatgaccactgcgggctgtggcttcccggtaacatcctccatgcgttgttcaacaacaacactgcttaccatgatatccaccaccagctctatggcaacaaatacaacttttcgcaacctttcttcgtcctttgggataagattctggggacatacatgccctactctctcgagaaccggaaagggggtgggttcgagtcccggccagttaagtcagtagagcagaccaaggctgattaatacgtgcatattctctgattctcgttctgcttagatccgatacacactgtcctatcacgccgcctgattctctaactatgaaaatgctgtagaagccttatgtcctggttcatatagtgagggtttttcgtgttttctaacactttctttctttcgatttggtttgggagtcccatcttgtatcaaggtatagtgggtaaaatattgtattgtatgaaagaatactcggcatccacttggatttgtctcctctggatcggtctgtacttccatccacatggtgatgttaacaaagaaggatgatattaacacttcanaaaaaaa

SEQ ID NO: 17845 - DNA, 584 bp, Triticum aestivum
  unsure (1)..(584): unsure at all n locations
  Clone ID: PAT_TA_17845
cccacgcgtccgcagaaggttgcatctgccatcacctggcagagccctaaagacaanagcacttacctgaaataaaggtcgtaaacttcggcagcaaagccatggatctcaacataacagtgacgggtctggagagcggcatcaagagctccggctcgaacaagacggtgctgacatccgccgcggcgctcgacgagaactccttcgagcagccagaaaaggtggcgccggtgtcgagcccggtggccgacgccaagcagcaaatgggcgtgtcagtgagcccttactccctcacctcgttcgatctcctgctggggcccagcaaacactcaatcatatgaagaagctagctcgagtggaaggaaatcatagagatagttaccacgtatattgtagattgtagtattattctctgtgcctggattgtatgtctgaaagaaacattacgtggccgtctctctgaagcttattacagcaaacattgtgctccgtaactagaagcgatatttgcaaatgttcatcaccttccgtcgtagtctaagtggttaggatactcggctctcacccgagagacccgggttcaa

SEQ ID NO: 17846 - DNA, 697 bp, Triticum aestivum
  unsure (1)..(697): unsure at all n locations
  Clone ID: PAT_TA_17846
gcggggacggcgaggatacatcgcggcttttatccccttcgatttttgtccgaatgtttgctcgttcgtttgatccgagacttgcgcatctcttgtgatctaatctgtctgttgtctcggttgggaatcgaacggagcaggtgctgcagaacgacatcgacctcctcaacccgccggcggagctcgagaagctcaagcacaagaagaagcgcctcgtgcagtcccccaactccttcttcatggatgtcaagtgccagggctgcttcaacatgtaagagcgtatgatcttttccgcgctttagtcttcttgtgttcatagttaataatatactgcacagtaacattaagatggtggattggattcttgacttgggcacttgatgtaaaaaagatgctatcaatgatttagattgctctgctttaggaatggcataaaggttaggtttatgcacatagaactgcctgctatatgagaaaatatgtagatttagcacccggtgcatcttgtacgacgttgtggttcgttgatgttcgtcgaagttgggttagtttgcgtgcatttatacaacatacaaacgtcacctgatggttcagctcgaaatgttgagctgattgctagtttccatgatcattcctnctcacctncctgattacccatgctgtttgcctggccctgacttgattatatctacgtatc

SEQ ID NO: 17847 - DNA, 638 bp, Triticum aestivum
  Clone ID: PAT_TA_17847
ggtgaaaccttcaccggagtccaaggaaaaagaagggtttgttgagaagcttcctgggaagcatgataatgttcaggagaatgtgtcagattcccctagtaaaagtctgggcttagctggtcgtcctgtggctggtgtcaagaaagtgaagaagatagttatcaagaagattgtgaggaggattgttggcaaggatgttgtctttgttgcaacaagaaggattgtgaggccacccaagaagggttctgctgttcagcgccctcgcaccaggaccctgacagctgttcatgatggtatcttggaggatgtcgtgtacccagctgagattgtggggaagcgtgtcagataccgtttggatggtgccaaggtcatcaagatctacttggacccaaaggagcgcaacaacactgaatacaagctggagaccttctctgcagtctaccgcaggctttgtgggaaagacgttgtctttgagtaccctgtgactgaaaccgcctgaagatccatgccttatgtctccattttcatatctttctgatccgaatgttttggtcgaggtctcagttagttgtgctatcaatgtattccagaaacatagttttgttaacgatctggggttaggaagtttgatggagatt

SEQ ID NO: 17848 - DNA, 721 bp, Triticum aestivum
  unsure (1)..(721): unsure at all n locations
  Clone ID: PAT_TA_17848
gaaggacaagggcgtcgagccctccgagttcgaggacaccgtcgcgcaggctttctttgacctggagaatggcaaccaggagctcaagagcgacctcaaggacctgtacatcaacactgcaatccagatggatgttgttggcaacaggaaggccgtggtgatccatgtgccgtaccgtctgcgcaagcccttcaggaagatccatgtcaggctcgtcagggagctggagaagaagtttagcggcaaggatgtggtctttgttgcaacaagaaggattgtgaggccacccaagaagggttctgctgttcagcgccctcgcaccaggaccctgacagctgttcatgatggtatcttggaggatgtcgtgtacccagctgagattgtggggaagcgtgtcagataccgtttgggatggtgccaaggtcatcaagatctacttggacccaaaggagcgcaacaacactgaatacaagctggagaccttctctgcaatccaacgcaagctttgtgggaaaagacttgtcctttgagtacctgtgactgaaaccgcctgaagatcaagccctgaattcccaattcatatcttctgatcaaatgttttggntaagnctggtagttgtgcaacaatgtatcagaaacatagtttgtaacaaccggggtaggaatttgntaaatgcatgaacgtaacaanttaagtttgcattaattaganctagcccgt

SEQ ID NO: 17849 - DNA, 986 bp, Triticum aestivum
  Clone ID: PAT_TA_17849
gcaaagctcgagcatagcaacagcactaaagctaactagagcttccagcaatggcgacctccccggtgctcttcctcctcctcgctgttttggccgccggtgccagcgcggccaccttcaacatcaagaacaactgcggctccacaatttggccggcgggcatcccggtgggtgggggcttcgcgctgggcgcaggccagacgtccagcatcaacgtgcccgcgggcaccaaagccgggaggatatgggctcgcaccgggtgctccttcaatggcggcagcgggagctgccagaccggcgactgcggcggccagctgtcctgctccctctccgggcggccaccagcaacgctggccgagtacaccatcggcggcggcagcacccaggacttctacgacatctcagtgatcgacggcttcaaccttgccatggacttctcgtgcagcaccggcgacgcgctccagtgcagggaccccagctgcccgccgccgcaagcctaccaacaccccgacgaccgcgccacacacgcctgcaatggcaacagtaactaccagatcaccttctgcccatgaagcctctatacgtcgcaccgcgaatcaataaaaggcgtacgtagatatacggccatataaataaaaggtgtactgcttaatacatcacattgtcatattacagccaccgtactacatgttagcccactactatgagcgtttcattgatatttgtgtacacagtacagggcaataaaaaattacctatctaccctagattggacagcaccctgacgcaacatggtcagctattagtattacttgctcacgccgatgtcacgacattgacatcggcgtgccaaaggagccaccacatgtgtgtgaatagcacatggggccctacgcggccatcatgtgtacagctagcttgtttgtttcaacaccaaaagaaatgtggactattctcctgcatgttgatccgtcgtgtttgttttc

SEQ ID NO: 17850 - DNA, 186 bp, Triticum aestivum
  Clone ID: PAT_TA_17850
tcgagcggccgcccgggcaggtacacatccatcataaataaaaagtatacctacataatctgaaaccatagcatcagtcaacctgaactcttatatacccctagccaaatgcaattttttcacttttaagcaactacaatttctgctgcaagaggtctcaggaacacctcggccgcgaccacgcta

SEQ ID NO: 17851 - DNA, 454 bp, Triticum aestivum
  Clone ID: PAT_TA_17851
ttcccgagcaaaccctagcctcccacgatggtgctgcagaacgacatcgacctgctgaacccgccggcggagctcgagaagctcaagcacaagaagaagcgcctcgtccagtcccccaattccttcttcatggacgtcaagtgccagggctgcttcaacatgctgccaaacagtgctctgccagccaacgggtggtaaggccaggctcaccgagggttgctccttccgccgcaagggcgactaaaccgaaggctatcttaaaaagcaagctgttgttgaactcgttagtttttcaagggtgttggtctgaaaattttgcaatgtcggcaaattgaatccatctttggtaatttggtatctagctcgagcaatattactatgacactgtactatgttctgtttggcctgtgagatcagactagtagttcctgccaggaaatatggttgtctggtg

SEQ ID NO: 17852 - DNA, 550 bp, Triticum aestivum
  Clone ID: PAT_TA_17852
tttgctctctcgtttgatccgagacttgcgcatctcctgtgatctaatctgtctgttgtctcggttgggaatcgaacggagcaggtgctgcagaacgacatcgacctcctcaacccgccggcggagctcgagaagctcaagcacaagaagaagcgcctcgtgcagtcccccaactccttcttcatggatgtcaagtgccagggctgcttcaacataacgactgtgttcagccactctcagaccgtggtggtgtgccctggctgccagacggtgctttgccaacccaccggaggaaaggcgaggctcaccgagggatgctccttccgccggaagggcgactaagctacactcctgtttatgtgaaaatgaagcccagccgaaccttacttttcaagtaactagttatccccgatgtgtactggtcaaattttgttaattatgcttgcccatttgccagcctgaacgttgtagcaacgtgttctatgtcatgcacttttgatttgccaaaaaaaaaaaaaaaatgaaaaaaaaaaataacacagggcgtgac

SEQ ID NO: 17853 - DNA, 569 bp, Triticum aestivum
  Clone ID: PAT_TA_17853
ccctgtcgacccagcgtccgccgcctcctcggatcgtccctgccggagagacgccagagagcgcgagcaaaccctaacctccgacgatggtgctgcagaacgacatcgacctcctcaacccgccggcggagctcgagaagctcaagcacaagaagaagcgcctcgtccagtcccccaactccttcttcatggacgtcaagtgccagggctgcttcaacatcactactgtgttcagccactcccagactgtcgtggtgtgcccgggctgccaaacagtgctctgccagccaacgggtggcaaggccaggctaaccgagggttgctccttccgccgcaagggcgactaaacctctgaaggaagccaagacgttgttgaactttgagctattccagggtgttggtctgaagattttgcaatgtcggcaaattgaacccatctttggtaatatgatatctagcttgagtattattatgatgaccactgtactatgttccgtttgggttgtgagatcagactagtagtacctgcctggcaatatggttgtctttgatgaattgttattccttct

SEQ ID NO: 17854 - DNA, 884 bp, Triticum aestivum
  Clone ID: PAT_TA_17854
taccggtaccgaaattccgggctagcgccggcgcctccattcgttttcctcactctctcctccagctcggggtccggcggcgaagggaaggcaagatgtacaccgcgaggaagaagatccagaaggagaagggccttgagccctccgagttcgaggactccgttgcccaggctttctttgatctggagaacgggaaccaggagctcaagagcgacctcaaggacctgtacatcaacaatgctatccagatggatgttaccgggagcaggaaggctgttgtcatccacgtcccataccgcctgcgcaaggccttcaggaagatccatgtcagactcgtcagggagctggagaagaaattcagcggcaaggatgtggtaattgttgctacaaggaggattgtgaggccacccaagaagggttcagctgttctgcgccctcgcaccaggactctgactgctgttcacgatggcatcttggaggatgttgtctacccagctgagattgtggggaagcgtgtcagataccgtctggatggttccaagattatcaagattttcttggacccaaaggagaggaacaacactgaatacaagctggagacctgcactgcggtctaccgcaggctgtgtgggaaagatgtggtctttgagtaccctatgaccgaaaatgcataaatatgatgccctctggatatctccactctatttcgttgattctgaatgttatgttgggtctccctatgtacttcaaaaacatagtttgatgctaaagttgcctaggaatttggtacggggaagtggcagtggacgtgaacaatgttaagtttgagcatttaaattaaactttgcctgataacgttgcgagttattaaaaaaaaggggggg

SEQ ID NO: 17855 - DNA, 878 bp, Triticum aestivum
  Clone ID: PAT_TA_17855
ccacgcgtccggattcaaataggaggaactgttctgttctccagtggaatccagacatgtccacccagctaattcttgcatcagatgacgacaactctccttctttgagagtatgggatgtgaggaaaaccattgcacctgtacgggaatttgtgggacattcaaaaggtgtaattggtatgtcatggtgcccctatgacagttcattcttgcttacttgtgctaaagacaatagaacaatatgctgggatacagttagtggagagattatcagtgagctaccaacaagctctaatggtaacttcgacatccactggtaccggaaaattccaggtgttgtagcagcatcttcatatgatgggaagatcggtgtacacaacttggagttctccagcctttatgcagctggtgatagcactgttgggtgcctcagcacgtccaagagctgcagctccaaaatggttgaaatgccccacgggtgcatctttcggctttggtggcaaacttgtttccttccatccggcccaaggcacacaagcgggtacttctgaggtgcatgtgcataatttggtgattgagcagagtctagtaagccggtcaactgaatttgaagctgctatgcagaatagggacaaaagtgcactgcgtgctttgtgtgaccaaaaatcacaagaatctttatccgaggaggagaaagaaacatggagcttcttaagggttatgttcgaggatggggatactgccagaacaaaattgcttgttcatcttggattcaatccacctcaagaaccgactgtgaatgcaactgatgagctgagcaaagcattggctgatacacttaatattgatcatggtacctgcccgggcggccgctcgaa

SEQ ID NO: 17856 - DNA, 953 bp, Triticum aestivum
  Clone ID: PAT_TA_17856
agcaagagcactaaagctaactagagcttccagcaatggcgacctccgcggtgctcttcctcctcctcgctgtttttgccgccggtgccagcgcggccaccttcaacatcaagaacaactgcggctccacaatttggccggcgggcatcccggtgggtgggggcttcgagctgggcgcaggccagacgtccagcatcaacgtgcccgcgggcaccaaagccgggaggatatgggctcgcaccgggtgctccttcaatggcggcagcgggagctgccggaccggcgactgcggcggccagctgtcctgctccctctccgggcggccaccagcaacgctggccgagtacaccatcggcggcggcggcacccaggacttctacgacatctcggtgatcgacggcttcaaccttgccatggacttctcgtgcagcaccggcgacgcgctccagtgcagggatcccagctgcccgccgccgcaagcctaccaacaccccaacgaccaagccacacacgcctgcagtggcaataataactaccagatcaccttctgcccatgaaggctgttcacgtcgcaccacgaatcaataaaaggcgtacgtagatatacggccctataaataaaaggcgtgctggggatgcctgggcgaatgtattttaaaccccccgttctacatgttagcccactactatgagcgtttcattgatatttgtgtacccagtccagggcaataaaaaaattccctttcaaaaaaaaaaaaaaaaaaaaaaaaaaaaaaaaaaaaaaaaattctgatccaaatgttttggttgaggtcttggttagttgtgctatcaatgtattccagaaacatagttttgttaactatctggggttaggaagtttgatgaagatggcaatgaacgtgaacaatgttaaagttttgagcatttaaattatgaacctatgctccgtt

SEQ ID NO: 17857 - DNA, 952 bp, Triticum aestivum
  Clone ID: PAT_TA_17857
ctatattggatactgatgattgaacttaaaaggtaaagccctttcataccagtacacgaccatcataaataaaaagtataactacataatccgaaaccatagcgtcagtcaacctaaactcctatatacccctaggcagaaccgattttttcacttttaagcaactgcaatttctgctgcaagaggtctcaggaactcatcctcatccttaggagggtggatggtaacaaggtcaggcaaaggtgtagatggtccttgtttccccttgggatcccagtcaagcatgatcttaaccttgatacccagcacaccctgtctcagaagaacatgcctcacagctccatcaatatactggttgacaggatggccagaagagatcatatagccatctttgaacttcatggacttagcacgctgtgccctaagcttcccactcacaataacctcacagcccttcgcaccactctccatgacaaatcggagtacaccatagcatgctcttcggacggcgaggccaccgagccagcttgtagcggagggactcggcctgagcgacggcgcagaggcccgcggttcaggaccttctcggcgtagagctccacaccgccgtccggaaagttgaagcgcttctgcaccaccgaagtcagctcccttatcctccggcccttctcgccgaggacgttctgggtgcgggtggcgcggatgatgatctcggtgcgcatgggggtgacccggatctcgacgccggcgaagccgtcctccccgagctcgcgggtcagcatctcgttcagctcggccaggaacacgccgtcggcgacgaactttcgcttcttgctgatctggagagccatgttggagaaaggagggggagcgggagggggagtgggagggggacggagatgatttggcggcggcggcggtagataaaccctcgtgccgaattcggcacgag

SEQ ID NO: 17858 - DNA, 753 bp, Triticum aestivum
  unsure (1)..(753): unsure at all n locations
  Clone ID: PAT_TA_17858
ctgtacatcaacactgcaatccagatggatgttgttggcaacaggaaggccgtggtgatccatgtgccgtaccgtctgcgcaagcccttcaggaagatccatgtcaggctcgtcagggagctggagaagaagtttagcggcaaggatgttgtctttgttgcaacaagaaggattgtgaggccacccaagaagggttctgctgttcagcgccctcgcaccaggaccctgacagctgttcatgatggtatcttggaggatgtcgtgtacccagctgagattgtggggaagcgtgtcagataccgtttggatggtgccaaggtcatcaagatctacttggacccaaaggagcgcaacaacactgaatacaagctggagaccttctctgcagtctaccgcaggctttgtgggaaagacgttgtctttgagtaccctgtgactgaaaccgcctgaagatccatgccttatgtctccattttcatatctttctgatccgaatgttttggtcgaggtctcagttagttgtgctatcaatgtattccagaaacatagttttgttaacgatctggggttaggaagtttgatggagattggcaatgaacgtgaacaatgttaaagttttgagcatttaaattatgaacctctgctcggttatcttgttgcacttgattgtcatttctaattgagcgttgctacatgtaagaccaagattgtacgatttatgtacgacaaacagcagcagctgtgganaattcc

SEQ ID NO: 17859 - DNA, 636 bp, Triticum aestivum
  Clone ID: PAT_TA_17859
caggtcagccgccgcctcctcggatcgtccctgccggagagacgccagagagcgccagcaaaccctaacctccgacgatggtgctccagaacgacatcgacctgctcaacccgccggcggagctcgagaagctcaagcacaagaagaagcgcctcgtgcagtcccccaactccttcttcatggatgtcaagtgccagggctgcttcaacatcactactgtgttcagccactcccagactgtcgtggtgtgcccaggctgccaaacagtgctctgccagccaacgggtggcaaggccaggctaaccgagggttgctccttccgccgcaagggcgactaaacatccaaaggctatctaaaaaagccagcggttgttgaactttgagttattccagggtgttagtctgaagattttgcaatgtctggcaaattgaacccatctttggtaatgtgatatctagcttgagtattattatgatgaccactgtactatgttccgtttgggttgtgagatcagactagtagtacctgcctggcaatatgcttgtctttgatgagttgttattccttctgatgttgtctctggtgtatgacgcttgaaatgtctattgcttgcattatttgttgcaaaaaaaaaa

SEQ ID NO: 17860 - DNA, 639 bp, Triticum aestivum
  Clone ID: PAT_TA_17860
ttcgagccggccaggccgggactttctctaccccctcgccgccgccgcctcttcggatcgtccctgccggagaccagagagcgcggtgcccgagcaaaccctagcctcccacgatggtgctgcagaacgacatcgacctgctgaacccgccggcggagctcgagaagctcaagcacaagaagaagcgcctcgtccagtctcccaactccttcttcatggacgtcaagtgccagggctgcttcaacatcactactgtgttcagccactcacagaccgtcgtggtgtgcccaggctgccaaacggtgctctgccagccaacgggtggcaaggccaggctcaccgagggttgctccttccgccgcaagggcgactaaacagaagtctatctttaaaagcaagccgatgttgaactctagtttttcaggggtgttggtctgaaaattttgcaatgtctggcaaattgaatccatctttggtaatttggtatctagctcgagcaatattccgtttgggctgtgagatcagactagtagtacctgccaggtaatatggtggtctgatgaattgttgttcctaatgatgctgtttgccctcgctggtatatgactcttggaaaaaaaaaaaaaaaaaaggccccta

SEQ ID NO: 17861 - DNA, 1098 bp, Triticum aestivum
  Clone ID: PAT_TA_17861
ctcgagtttttttttttttttttttttttttttttttttttttttttttttacacatatcctgcacgatgtgcataaaacttaaaacatcatggaacctacaaattaataatcatagtttacacattactgtatatcagaccacggattctaacaataccacacaacaataaatctggaatcatatatttgttactgatgatagaacttaaaaaggttaagcccttttgtaccagtacacatccatcataaataaaaaagtataactacataatctgaaaccatagcatcagtcaacctaaactcttatataccactaggcagatggaatttttttcacttttaagcaactgcaatttctgctgcaagaggcctcaggaactcatcctcatccttaggagggtggatggtaacaaggtcaggtaaaggtgtagctggtccttgtttccccttcggatcccagtcaagcatgatcttaaccttgatacccagcacaccctgtctcagaagaacatgcctcacagctccatcaatatactggttgacaggatggccagaagagatcatatagccatccttgaacttcatggacttagcacgctgtgccctaagcttcccactcacaataacctcacagcccttcgcaccactctccatgacaaatcggagtacaccatagcacgctcttcggacggcgaggccaccgagcagcttgtagcggagggactcggcctgagcgacggcgcagaggccgcggttcaggaccttctcggcgtacagctcgacgccgccgtccggaaagttgaagcgcttctgcaccaccgacgtcagctcccttatcctccggcccttctcgccgaggacgttcttgggtgcgggtggcgcggatgatgatctcggtgcgcatgggggtgacccggatctcgacgccggcgaagccgtcctccccgagctcgcgggtcagcatctcgttcagctcggccagaaacacgccgtcggcgacgaactttcgcttcttgctgatctgaagagccatgttggagaagggaggggggggggagatgatttggcggcggcggcggcggccctcgtgccgaat

SEQ ID NO: 17862 - DNA, 766 bp, Triticum aestivum
  Clone ID: PAT_TA_17862
atccctttgttaaccctcctaaagggaacaaaagctggagctccaccgcggtggcggccgctctagaactagtggatcccccgggctgcaggaattcggcacgagccgccgccgccgcctcctcttcggattgccgctgctggagaccagagagcgcggttcccgagcaaaccctagcctcccacgatggtgctgcagaacgacatcgacctgctgaacccgccggcggagctcgagaagctcaagcacaagaagaagcgcctcgtccagtcccccaattccttcttcatggacgtcaagtgccagggctgcttcaacatcactactgtgttcagccactcacagactgttgtggtgtgcccaggctgccaaacagtgctctgccagccaacgggtggtaaggccaggctcaccgagggttgctccttccgccgcaagggcgactaaaccgaaggctatcttaaaaagcaagctgttgttgaactcgttagtttttcaagggtgttggtctgaaaattttgcaatgtcggcaaattgaatccatctttggtaatttggtatctagctcgagcaatattactatgacactgtactatgttctgtttggcctgtgagatcagactagtagttcctgccaggaaatatggttgtctggtgaattgttgttccttctgatgttgcttgccctctatggtatatgacttgaatcgtttgttgcttgtattttctgtttgtgtttgttgcccacttgtctcccctgaaaaaa

SEQ ID NO: 17863 - DNA, 826 bp, Triticum aestivum
  Clone ID: PAT_TA_17863
acccctcgacaccctcaggcgaagaaagggcgaaagcaccatgtacacggcgaggaagaagatccagaaggacaagggcctcgagccctctgagttcgaggactccgtcgcgcaggcattcttcgacctggagaatggcagccaggagctcaagagcgacgttaaagacctctacatcaacgccgccttccagatggatgttgcagggaacaggaaggccgtggtcatccacgtgccgtacaggctccgcaagaacttcaggaagatccacgtcaggctcgtcagggagctcgagaagaagttcagcggcaaggatgttgttattgttgcaacaaggcggattgtgaggccacccaagaagggttctgctgttgttcgccctcgtaccaggactttgaccgctgttcatgatggtcttttggaggatgttgtgtacccagctgagattgtggggaaacgtgtcagatatcgcctagatggctcgaagatcattaagatcttcttgtacccaaaggaacgcaacaacacagagtacaagttggataccttcactgcagtgtaccgcaggctttgtggcaaggatgttgtgtacgagtacctggttgccgaaactgcttgaagatccatcttgatttgcatattggccctcttgttcatgtattgaatttgcgacggcttgcttgagcttgttgttgctcggatcatgtattcgaaaaatcaaaattatagctgtgatgccaaacctaaatatttgctagttcgagatggtaatgagtgaaaagtgttgaattttgagctttaaaaaaaaaaaaaaaaaactcgagac

SEQ ID NO: 17864 - DNA, 692 bp, Triticum aestivum
  Clone ID: PAT_TA_17864
gccggccgggtcgggagtttctccttcccctcgcagccgccgcctcctcggatcgtccctgccggagagacgccagagagagcgagcaaaccctaacctccgacgatggtgctgcagaacgacatcgacctcctgaacccgccggcggagctcgagaagctcaagcacaagaagaagcgcctcgtccagtcccccaactccttcttcatggacgttaagtgccagggctgcttcaacatcactactgtgttcagccactcccagactgtcgtggtgtgcccaggctgccaaacagtgctctgccagccaacgggtggcaaggccaggctaaccgagggttgctccttccgccgcaagggcgactaaacctccgaagtctatctgaaaaagcaagccgttgttgaactttgagtttttccagggtgttagtctgaagattttgcaatgtctggcaaattgaacccatctttggtaatgtgatatctagcttgagtagtattatgatgaccactgtactatgttccgtttgggttgtgagatcagactagtagtacctgcctggcaatatggttgtctttgatgaattgttattccttctgatgttgcttgccgtccttggtatatgacttttgaaatgtttattgcttgaatttgctgtgtgttacatcaaaaaaaaaaaaaaaaaaaaaaaa

SEQ ID NO: 17865 - DNA, 983 bp, Triticum aestivum
  Clone ID: PAT_TA_17865
actgtatatcagaccacggattctaacaataccatgcgacaagaaatcaggaagcatagatttgttactgatgattgaacttaaaaaggtgaagcccttttgtaccagtacacatccatcataaataaaaagtatacctacataatctgaaaccatagcatcagtcaacctgaactcttatatacccctagccaaatgcaattttttcacttttaagcaactacaatttctgctgcaagaggtctcaggaactcatcctcatccttaggagggtggatggtaacaaggtcaggtaaaggtgtagctggtccttgtttccccttcggatcccagtcaagcatgatcttaaccttgatacccagcacaccctgtctcagaagaacatgcctcacagctccatcaatatattggttgacaggatggcctgaagagatcatatagccatccttgaacttcatggacttggcacgctgtgccctaagcttcccactcacaataacctcacagcccttcgcaccactctccatgacaaatcggagtacaccatagcatgctcttcggacggcgaggccaccaagcagcttgtagcggagggactcagcctgagcgacggcgcagaggccgcggttcaggaccttctcggcgtagagctccacgccgccgtccggaaagttgaagcgcttctgcaccaccgacgtcagctcccttatcctcctgcccttctcgccgaggacgttctgggtgcgggtggcgcggatgatgatctcggtgcgcatgggggtgacccggatctcgacgccggcgaagccgtcctccccgagctcgcgggtcagcatctcgttcagctcggccaggaacacgccgtcggcgacgaacttccgcttcttgctgatctgaagagccatgttggagaagcgagggggagggagatgattttgcggcggcggcggcggaagataaaccctaggggcatagcctcgtgc

SEQ ID NO: 17866 - DNA, 848 bp, Triticum aestivum
  Clone ID: PAT_TA_17866
gggctggcaaggaacaaaactcgaagcatagcaacagcactaaagctaactagagcttccagcaatggcgacctccccggtgctcttcctcctcctcgctgttttcgccgccggtgccagcgcggccaccttcaacatcaagaacaactgtggcttcacaatttggccggcgggcatcccggtgggtggggggcttcgcgctgggctcagggcagacgtccagcatcaacgtgcccgccgggcacccaagccgggaggatatgggcccgcaccgggtgctccttcaatgggcggtagcgggaagctgccaaaccggcgactgcggcggccaagctatcctgctccctctcccgggcggggcaacaagcaacgctgggccgagtacaccatccggcggcggaacaccaggacttctacgacatctcggtgatcgacggcttcaacttgcatggactctcgtgcagcaccggcgacgcgctccagtgcaaggaccccagctgcccgccgccgcaagcctaccaacaccccaacgacgtcgccacacacgcctgcagtggcaataataactaccagatcaccttctgtccatgaagcctctatacgtcgcaccgcgaatcaataaaaggcgtacgtagatatacggccatataaataaaaggtgtactgcttaatacatcacattgtcatattacagccgccgtactacatgttagcccactactatgagcgtttcattgatatttgtgtacacagtacagggcaataaaaaaattacctatctaccttaaaaaaaaaaaaaaaaaactcgagacacctcggccgcgaccacgctaatcactagtgaattc

SEQ ID NO: 17867 - DNA, 620 bp, Triticum aestivum
  Clone ID: PAT_TA_17867
gcgcctccgctcctctcccccgccgccaccccctccccgcatcgtctcccacgccaagaccgccgccgccgcccgtcaagatggtgctgcagaacgacatcgacctcctcaacccgccggcggagctcgagaagctcaagcacaagaagaagcgcctcgtgcagtcccccaactccttcttcatggatgtcaagtgccagggctgcttcaacataacgactgtgttcagccactctcagaccgtggtggtgtgccctggctgccagacggtgctttgccaacccaccggaggaaaggcgaggctcaccgagggatgctccttccgccggaagggcgactaagctacactcctgtttatgtgaaaatgaagcccagccgaaccttacttttcaagtaactagttatccccgatgtgtactggtcaaattttgttaattatgcttgcccatttgccagcctgaacgttgtagcaacgtgttctatgtcatgcacttttgatttgcctgttgttggttcttctgtttgtctggctgcctggtggtctctgagtttggttttgaggatttagtttttgttatgtagtagtgatagcctgctgcattttcttgacaaaaaaaaaa

SEQ ID NO: 17868 - DNA, 813 bp, Triticum aestivum
  unsure (1)..(813): unsure at all n locations
  Clone ID: PAT_TA_17868
caaccctcgacctccctcacgcgaagaaagggcgaaagcaccatgtacacggcgaggaagaagatccagaaggacaagggcctcgagccctccgagttcgaggactccgtcgcgcaggcattcttcgacctggagaatggcagccaggagctcaagagcgacgttaaagacctctacatcaacgccgccttccagatggatgttacagggaacaggaaggccgtagtcatccacgtgccgtacaggctccgcaagaacttcaggaagatccacgtcaggcttgtcagggagctcgagaagaagttcagcggcaaggatgttgttattgttgcaacaaggcggattgtgaggccacccaagaagggttctgctgttgttcgccctcgtaccagaactttgaccgctgttcatgatggtcttttggaggatgttgtgtacccagctgagattgtggggaaacgtgtcagatatcgcctagatggctcgaagatcattaagatcttcttggacccgaaggaacgcaacaacacagagtacaagttggataccttcactgcagtgtaccgcaggctttgtggcaaggatgttgtgtacgagtacccggttgccgaaactgcttgaagatccatatttatttgcatattggccctcttgttcatgtattgaatttgcgacggcttgcttgagctcgttgtttctcggatcatgtattcgaaaaatcaaaaatatagctgtgatgccaaacctaaatatttgctagttcgagatggtaacgagtaaaagtgttaatttnagctttaaattaagttgcac

SEQ ID NO: 17869 - DNA, 897 bp, Triticum aestivum
  Clone ID: PAT_TA_17869
gccggccggttccggaaacctacctccgtggccgcctccaaaccctaccgccacccctcgacctccctcaggcgaagaaagggcgaaagcaccatgtacacggcgaggaagaagatccagaaggacaagggcctcgagccctccgagttcgaggactccgtcgcgcaggcattcttcgacctggagaatggcagccaggagctcaagagcgacgttaaagacctctacatcaacgccgccttccagatggatgttgcagggaacaggaaggccgtggtcatccacgtgccgtacaggctccgcaagaacttcaggaagatccacgtcaggcttgtcagggagctcgagaagaagttcagcggcaaggatgttgttattgttgcaacaaggcggattgtgaggccacccaagaagggttctgctgttgttcgccctcgtaccaggactttgaccgctgttcatgatggtcttttggaggatgttgtgtacccagctgagattgtggggaaacgtgtcagatatcgcctagatggctcgaagatcatcaagatcttcttggacccaaaggaacgcaacaacacagagtacaaattggataccttcactgcagtgtaccgcaggctttgtggcaaggatgttgtgtacgagtacccggttgcccgaaactgcttgaagatccatcttaatttgcatattggccctcttgttcatgtattgaatttgccgacggcttgccttgagctcgttgttgctcggatcatgtcttcgaaaaatcaaaattatagctgtgatgccaaacctaaatatttgctagttcgagatggtaatgagtgaaaagcgttgaattttgagctttaaaaaaaaaaaaaaaaaaaaaaaaagtcgacgcggccgcga

SEQ ID NO: 17870 - DNA, 879 bp, Triticum aestivum
  Clone ID: PAT_TA_17870
cggccgggccggaggttcctccaaaccctagcgccggcgcctcctcttctctgctccctcgtctcctcgcgcgcagggcccggcgaaagggaagcaagatgtacaccgccaggaagaagatccagaaggacaagggcgtcgagccctccgagttcgaggacaccgttgcgcaggctttctttgacctggagaatggcaaccaggagctcaagagcgacctcaaggacctgtacatcaacactgcaatccagatggatgttgttggcaacaggaaggccgtggtgatccatgtgccgtaccgtctgcgcaagcccttcaggaagatccatgtcaggctcgtcagggagctggagaagaagtttagcggcaaggatgttgtctttgttgcaacaagaaggattgtgaggccacccaagaagggttctgctgttcagcgccctcgcaccaggaccctgacagctgttcatgatggtatcttggaggatgtcgtgtacccagctgagattgtggggaagcgtgtcagataccgtttggatggtgccaaggtcatcaagatctacttggacccaaaggagcgcaacaacactgaatacaagctggagaccttctctgcagtctaccgcaggctttgtgggaaagacgttgtctttgagtaccctgtgactgaaaccgcctgaagatccatgccttatgtctccattttcatatctttctgatccgaatgttttggtcgaggtctcagttagttgtgctatcaatgtattccagaaacatagttttgttaacgatctggggttaggaagtttgatggagattggcaatgaacgtgaacaatgttaaagtttgggccatttaattatgaacctttggtcgggtatt

SEQ ID NO: 17871 - DNA, 1190 bp, Triticum aestivum
  Clone ID: PAT_TA_17871
cggccgctcaggcggcgggcgggaatctcctcctacagcaaagctcgagcacagcaagagcactaaagctaactagagcttccagcaatggcgacctccgcggtgctcttcctcctcctcgctgtttttgccgccggtgccagcgcggccaccttcaacatcaagaacaactgcggctccacaatttggccggcgggcatcccggtgggtgggggcttcgagctgggcgcaggccagacgtccagcatcaacgtgcccgcgggcaccaaagccgggaggatatgggctcgcaccgggtgctccttcaatggcggcagcgggagctgccggaccggcgactgcggcggccagctgtcctgctccctctccgggcggccaccagcaacgctggccgagtacaccatcggcggcggcggcacccaggacttctacgacatctcggtgatcgacggcttcaaccttgccatggacttctcgtgcagcaccggcgacgcgctccagtgcagggatcccagctgcccgccgccgcaagcctaccaacaccccaacgaccaagccacacacgcctgcagtggcaataataactaccagatcaccttctgcccatgaaggctgttcacgtcgcaccacgaatcaataaaaggcgtacgtagatatacggccctataaataaaaggcgtgctgcttaatacatcacattatcatattacaaccactgtagaaagggctcttctggatgatggtcaacctgctagagacaggcagccgaggcttctctcattcgaagctgatgcacctgaaaatggccaaggcctttttagttctcaatttccagagggtgagaagaattccctgtccacaaatgcaaagcatcctggccggccagcaaagaaagtggcagaaactgatccggatgctgtattacggtcaaataaagaacagcaggattttctacggtcatcatttgtgccaactgaaactaatatgattcaagagacatcgtcaggttcccatcttgaaagtcctgacatgggagtgccaggaagcattcatctaatggaagggatatctccaaacctgacatttggacctcattttggaatggatgttagtcaccaacatcaactgcctaatcaaccaaggatgatgccgaataactttatgcaggtacctcggccgcgaccacgcta

SEQ ID NO: 17872 - DNA, 829 bp, Triticum aestivum
  Clone ID: PAT_TA_17872
cgggaagaaggggtagagaaaatgcctcgagccgaggtccgagactcatcctcctacagcaaagctcgagcatagcaacagcactaaagctaactagagcttccagcaatggcgacctccccggtgctcttcctcctcctcgctgttttcgccgccggtgccagcgcggccaccttcaacatcaagaacaactgtggcttcacaatttggccggcgggcatcccggtgggtgggggcttcgcgctgggctcagggcagacgtccagcatcaacgtgcccgcgggcacccaagccgggaggatatgggcccgcaccgggtgctccttcaatggcggtagcgggagctgccagaccggcgactgcggcggccagctatcctgctccctctccgggcggccaccagcaacgctggccgagtacaccatcggcggcggcagcacccaggacttctacgacatctcggtgatcgacggcttcaaccttgccatggacttctcgtgcagcaccggcgacgcgctccagtgcagggaccccagctgcccgccgccgcaagcctaccaacaccccaacgacgtcgccacacacgcctgcagtggcaataataactaccagatcaccttctgtccatgaagcctctatacgtcgcaccgcgaatcaataaaaggcgtacgtagatatacggccatataaataaaaggtgtactgcttaatacatcacattgtcatattacagccgccgtactacatgttagcccactactatgagcgtttcattgatatttgtgtacacagtacagggcaataaaaaaattacctatctaccttaaaa

SEQ ID NO: 17873 - DNA, 671 bp, Triticum aestivum
  Clone ID: PAT_TA_17873
gcgcctccgctcctctccaccgccgccaccccgtccccgcatcctctcccacgcgaagaccgccgccgcccgtcaagatggtgctgcagaacgacatcgacctcctcaacccgccggcggagctcgagaagctcaagcacaagaagaagcgcctcgtgcagtcccccaactccttcttcatggatgtcaagtgccagggctgcttcaacataacaactgtgttcagccactctcagaccgtggtggtgtgccctggctgccagacggtgctctgccaacccaccggaggaaaagcgaggctcaccgagggatgctccttccgccggaagggcgactaagctgcacgcctgtttatgggaaaatgaagccctgctgaaccttacttttcaagtaactagttatcctgaatgtgtactggtcaaattttgttaattatgcttgcccgtttgccagcctgaacgttgtaccaacgtgttctatgtcatgcactttttgagtggcctgttgttggtgcttctgtttgtctggctgcctggtgatatctaagtttggttcttgttatgtagtagtaatagcctgctgcattctcttgacagtgttcagtgtttggtatatatggcaaatccgacccctcaaactcggcgggcacgccttatatttcaaaaaaaaaa

SEQ ID NO: 17874 - DNA, 657 bp, Triticum aestivum
  Clone ID: PAT_TA_17874
aaataaaaaaaaaaaatctctacccctcgccgccgccgcctcctcttcggattgtgtccctgccggagaccagagagcgcggtgcccgagcaaaccctagcctcccacgatggtgctgcagaatgacatcgacctgctgaacccgccggcggagctcgagaagctcaagcacaagaagaagcgcctcgtccagtcccccaactccttcttcatggacgtcaagtgccaaggctgcttcaacatcactacggtgttcagccactcccagaccgtcgtggtgtgcccaggctgccaaacagttctctgccagccaacgggtggtaaggccaggctcactgagggttgctccttccgccgcaagggcgactaaatggaaggctatcttaaaaagcaagccgttgttgaactctttagtttttcaggggtgttggtcgaaaattttgcaatgtcggcaaattgaatccatctttggtaatttggtatctagctcgagcaatattactatgacactgtactatgttccgtttgggctgtgagatcagactagttgtacctgccaggtaatatggtgggtctgatgaattgttgtttctaatgatgctgcttgcccttgctggtatatgactcttgaatcgtttgttgcttgtaaaaaaaaaa

SEQ ID NO: 17875 - DNA, 723 bp, Triticum aestivum
  Clone ID: PAT_TA_17875
aagacgaacaactgcgaaagcatttgccaaggatgttttcattaatcaagaacgaaagttgggggctcgaagacgatcagataccgtcctagtctcaaccataaacgatgccgaccagggatcggcggatgttgcttataggactccgcatcgtctcccacgccaagaccgccgccgttcgtcaagatggtgctgcagaacgacatcgacctcctcaacccgccggcggagctcgagaagctcaagcacaagaagaagcgcctcgtgcagtcccccaactccttcttcatggatgtcaagtgccagggctgcttcaacataacgactgtgttcagccactctcagaccgtggtggtgtgccctggctgccagacggtgctctgccaacccaccggaggaaaggcgaggctcaccgagggatgctccttccgccggaagggcgactaagctgcacgcctgtttatgggaaaaatgaagccccgctgaaccttacttttcaagtaactagttatccccgatgtgtactggtcaattttttgttaattatgcctgcccgtttgccagcctgaacgttgtagcaacgtgttctatgtcatgcacttttgagtcgcctgttgttggttcttctgtttgtctggctgcctggtgatatctaagtttggttcttgttatgtagcagtaatagcctgctgcattttcttgaaaaaaaaaaaaaaaaaaaaa

SEQ ID NO: 17876 - DNA, 797 bp, Triticum aestivum
  Clone ID: PAT_TA_17876
cggagccatccctccgcagctagcttcttagagggactatcgccgtttaggcgacggaagtttgaggcaataacaggtctgtgatgcccttagatgttctgggccgcacgcgcgctacactgatgtattcaacgagtatatagccttggccgacaggcccgggtaatcttgggaaatttcatcgtgatggggatagatcattgcaattgttggtcttcaacgaggaatgcctagtaagcgcgagcaaaccctagcctccgacgatggtgctgcagaacgacatcgacctcctcaacccgccggcggagctcgagaagctcaagcacaagaagaagcgcctcgtccagtcccccaactcgttcttcatggacgtcaagtgccagggctgcttcaacatcactactgtgttcagccactcccagactgtcgtggtgtgcccgggctgccaaacagtgctctgccagccaacgggtggcaaggccaggctaaccgagggttgctccttccgccgcaagggcgactaaacctctgaaggaagccaagacgttgttgaactttgagttattccagggtgttagtctgaagattttgcaatgtcggcaaattgaacccatctttggtaatatgatatctagcttgagtattattatgatgaccactgtactatgttccgtttgggttgtgagatcatactagtagtacctgcctggcaatatggttgtctttgatgaattgttattccttctgatgttgcttgctgtctctggtatatgactcttgagatgtttattgcttgc

SEQ ID NO: 17877 - DNA, 899 bp, Triticum aestivum
  Clone ID: PAT_TA_17877
cggccgctcaaggcggcaggccgggactcatcctcctacagcaaagctcgagcacagcaagagcactgaagctaactagagcttgcagcaatggcgacctccgcggtgctcttcctcctcctggctgttttcgccgccggtgccagcgcggccaccttcaacatcaagaacaactgcggctccacaatttggccggcgggcatcccggtgggtgggggcttcgcgctgggcgcaggccagacgtccagcatcaacgtgcccgcgggcaccaaagccgggaggatatgggcccgcaccgggtgctccttcaatggcggcagcgggagctgccggaccggcgactgcggcggccagctgtcctgctccctctccgggcggccgccggcaacgctggccgagtacaccatcggcggcggcagcacccaggacttctacgacatctcggtgatcgacggcttcaaccttgccatggacttctcgtgcagcaccggcgacgcgctccggtgcagggaccccagctgcccgccgccgcaagcctaccaacaccccaacgaccgcgccacacacgcctgcaatggcaatagtaactaccagatcaccttctgcccatgaagcctctttacgtcgcaccgcgaatcaatagaagacgtacgtagataaacggccggataaataaaaggtgtactgcttaatactacatcacatagtcatattacatccactgtactgcatgttagcccactactatgagcgtttcattgatatttgtgtacacagtacggggcaataaaaaattacctatctaccctaaaaaaaaaaaaaaaaaaaaaaaaaaaaaaaaaaaaactcgagactagcttcacctcggccgcgaccacgcttaatcacttagtgaattc

SEQ ID NO: 17878 - DNA, 1006 bp, Triticum aestivum
  unsure (1)..(1006): unsure at all n locations
  Clone ID: PAT_TA_17878
tttactaaagggaacaaaagctggagctccaccgcggtggcggccgctctagaactagtggatcccccgggctgcaggaattcggcacgagctgctccctcctctcctcgcgcgcagggcccggcgaaagggaagcaagatgtacaccgccaggaagaagatccagaaggacaagggcgtcgagccctccgagttcgaggacaccgtcgcgcaggctttctttgacctggagaatggcaaccaggagctcaagagcgacctcaaggacctgtacatcaacactgcaatccagatggatgttgttggcaacaggaaggccgtggtgatccatgtgccgtaccgtctgcgcaagcccttcaggaagatccatgtcaggctcgtcagggagctggagaagaagtttagcggcaaggatgtggtctttgttgcaacaagaaggattgtgaggccacccaagaagggttctgctgttcagcgccctcgcaccaggaccctgacagctgttcatgatggtatcttggaggatgtcgtgtacccagctgagattgtggggaagcgtgtcagataccgtttggatggtgccaaggtcatcaagatctacttggacccaaaggagcgcaacaacactgaatacaagctggagaccttctctgcagtctaccgcaggctttgtgggaaagacgttgtctttgagtaccctgtgactgaaaccgcctgaagatccatgccttgaatgtctccatttcatatctttctgatccaaatgttttggttgaggtcttggttagttgtgctatcaatgtattccagaaacatagttttgttaactatctggggttaggaagtttgatgaagatggcaatgaacgtgaacaatgttaaagttttgagcatttaaattatgaacctatgctccgttatcttgttgcacttgattgtcatctctaattgttcaacatctatgcttagtcactgcaattcactattgcattnctgttggtattgtc

SEQ ID NO: 17879 - DNA, 1407 bp, Triticum aestivum
  unsure (1)..(1407): unsure at all n locations
  Clone ID: PAT_TA_17879
aattcggcacgaggctgctccctcgtctcctctcgcgcagggcccggcgaaagggaagcaagatgtacaccgccaggaagaagatccagaaggacaagggcgtcgagccctccgagttcgaggacaccgtcgcgcaggctttctttgacctggagaacggcaaccaggagcttaagagcgacctcaaggacctgtacatcaacactgcaatccagatggatgttgttgggaacaggaaggccgtggtgatccatgtgccataccgtctgcgcaagcccttcaggaagatccatgtcaggctcgtcagggagctcgagaagaagtttagcggcaaggatgttgtctttgttgcaacaagaaggatcgtgaggccacccaagaagggttctgctgttcagcgccctcgcaccaggaccctgacagctgttcatgatggtatcttggaggatgttgtgtacccagctgagattgtggggaagcgtgtcaggtaccgtttggatggtgccaaggtcatcaagatctacttggacccgaaggagcgcaacaacactgagtacaagctggagaccttctctgcagtctaccgcaggctttgtgggaaagacgttgtctttgagtaccctgtgactgaaactgcctgaagatccatgccttgaatgtcctccattttcatatctttctgatccaaatgttttggtcgaggtctcagttagttgtgctatcaatgtattccagaaacatagttttgttaacgatctggggttaggaagtttgatggagatggcaatgaacgtgaacaatgttaaagttttgagcattctcgtgccgaattcggcacnagcgtccctgccggagagacgccagagagcgccagcaaaccctaacctccgacgatggtgctccagaacgacatcgacctgctcaacccgccggcggagctcgagaagctcaagcacaagaagaagcgcctcgtgcagtcccccaactccttcttcatggacgtcaagtgccagggctgcttcaacatcactactgtgttcagccactcccagactgtggtggtgtgccctggctgccaaacagtgctctgccagccaacgggcggcaaggccaggctaaccgaaggttgctccttccgccgcaagggcgactaaacatccaaaggctatctaaaaaagccagccgttgttgaactttgagttattccagggtgttagtctgaagattttgcaatgtgggcaaattgaacccatctttggtaatgtgctatctagcttgagtattattatgatgaccactgtactatgttatgtttgggttgtgagatcagactagtagtacctgcctggcaatatggttgtctttgatgaattgttaaaaaaaaaaaaaaaaaaaaaaaaaaaaaaa

SEQ ID NO: 17880 - DNA, 1520 bp, Triticum aestivum
  Clone ID: PAT_TA_17880
gcgcaatgtccctcgccggccgcaccggccgggtcccctgccccccccccggcggcccccccgccgcgcccttcggcccccgcgtcggggccaccatcggggccgtcctccccgcggtcgtcgccggccccgccctcgccctcttcgtcgcccactccaacctcttctgggccgagcgcctcggccgcgaccacctcgccggcatgaaggacctctgggtcaagcactgcggcatctcccacacgggttccttcaaggacctcggcatgaccgtgctcgtcagccaggtcaaccgcctccgccgcgccccgctctcccgccccatcgccggcgtcggatgcgcctccacgggggacacctccgccgcgctctccgcctactgcgcggctgccgggatcccagccatcgtcttcctcccggccaaccgcatctcgctcgagcagctcatccagcccatcgccaacggcgccaccgtgctctccctcgacacggactttgatggctgtatgcggctcatcagggaggtgactgccgagctgcccatttaccttgccaattcgctcaattcgctcaggctggaggggcagaagacggcagccattgagatactgcagcagttcgattgggaggtcccagattgggtcattgtaccgggaggcaatcttggaaacatatatgctttctacaagggattcgagatgtgccgtgttcttggtctcgttgatcgtctgccacggcttgtctgcgcacaggccgccaatgccaacccgctgtaccgctactacaagtcagggtggacacaattccagccacaggtggctgagccaacatttgcgtcggcgattcagatcggtgaccctgtatcggtcgaccgtgcggtggttgcactcaaggcaacaaatggcatcgtcgcagaagccacagaggaggagctcatgaacgcaatgtccctcgctgaccgcaccggcatgtttgcctgcccgcacaccggggtcgctctcgcggcgctcttcaagcttcgggaagagggcaccatcggggcaaacgaccgcacggtggtcgtcagcacggcgcacggcctcaagttctcccagtccaagatcgactaccatgatcagaagattgaggacatggcctgcaagtacgccaacccaccggtcagcgtgaaggccgacttcggcgccgtcatggacgtcctcaagaagaggctcaagggtaagctttgagcatgccctcctgctgctgctgctgacccctccgattggctactgcgattcgattgtcttgtgcatctgattcaaatgtgattggtttgctgtgtggagcattcaaacccttgatttgaaatcttgtaggtgagtgagactcttgtaggcgtgtcggcggggaatggttagggggtggggttgattatctcttgtaccgtgttgtgttctatggataataaacggttgtgttgtgttgctgttcattgaataatcaatcattcagtctgtttgctccaaaaaaaaaaaaaaaaa

SEQ ID NO: 17881 - DNA, 939 bp, Triticum aestivum
  Clone ID: PAT_TA_17881
acggacgcgtgggctggcctagagcacaaaatgcagtggccgagcaggtgagaagaagatggctgccaccagcctcggttcctctccctccaagactgccactgccaaactaggaggcatctccagatcttccccgtcctacacccagctcgccttctgctccaggcatgctttccacaagataggaaccgctgccgccccgcaaaggcctcagaatgagctcaagcacgcaagaccctgcgcgaccacggacaacgaccgggcggcgccggcggaggcgcaggaaagtacaaccatcagcgctggcgtgaacccggtggcgtccggcaacggccagcagccgcagccgggcgaaccgccgaagcgggtgccgctgacggcgcgggagcggctgcgcgcggcgcgcgtgctgggcaagtacgcggagccagggggcggggcgtcgccggcggacaagaagggctcttcatcgtccaagccggagttcgggagccgggtgctggacgcgctgcgggagacggacggcgggaagaagggcgggcggaagcggtcggggctgccggaggcgccgagcaacctgctggacgacaccaagcgcggcatgcccaaggacgggtggacgttcgactggctggcggcgctgcccgtgggcacggacgtgctcatcgtcgccgcgtccttcgggatcatcaccaccgtcatgttcgggaccacgtacctcgtgtggaagctcggcgccatacatttcaacgagtactgattaatcaagcctgtttggctttctctgcgtggttctgtaaaaataatgccgtctatcgtaatgatgaggcagattttgagcacaggaatacaccgtgatttgtaagaattaaacccaacgattttgctggagtattatagaaaacgtttcatagatgttaagtaaaaaaaaaaaaaaaa

SEQ ID NO: 17882 - DNA, 894 bp, Triticum aestivum
  Clone ID: PAT_TA_17882
cagcacctgttactgtccaggtggaagatgatgacccagaggaaccaccagggtttggtttgagtgaccttcagcgcagcaacatcgtagtaaagcaggatcagccatgtgatgatgggcagaatcatacccaagcgaaaccagatggtgctgggcgtgggggccctggtagcggggcggacgccagacgaggtggggcctgtcatcccgcctggtgttgctgcgccccctggatgtggggaaccgccctgcgatcggctattgcaccctcgtcggctccggggcaccgggcctcctcccgagttcctgttggctgctggccaagtggagctagtttcgccagcaaaggcatcagcccctgttactgtccaggtggaagatgatgatccagaggaaccaccagggtttggtttgagtgaccttcagcgcagcaacatggtagtaaagcaggagcagccatgtgatgatgggcagaatcatacccaagtgaaaccaaatggtggtgagctagtgggagctggtagcttgggggacgccgatgatgaggatcctgatgtgcctcctggatttgatgcgcctcctggatttggttaacagcctcctggatttggttgacagccctgcgatcttctatgacagtgtcgtcgtttctgtggcagcaatgcgcgagaagatttcttgtttgctgctttgagggtgtagctgttcatacgagaaccttgagtcatgaaagtgaacctgtacattctgtgatggtggcaactgccaagttcataccgcccttggctttagctttgttgtgttaatcagaagacatatattgacaatagactaaatattttgcccgaacaatggcgtcgtcctatgcatcatctccagattgtgatacacagt

SEQ ID NO: 17883 - DNA, 1052 bp, Triticum aestivum
  Clone ID: PAT_TA_17883
gctgccccatcttctttaaggatttatccgatcaggagcgcttgacaaaggtcccatgtacttcaggctgtccaaggttagggacagagttccaggtgcctctccagatcaagacgccgaggaggcaacctgctgtggcgttcttgaattcactgcaagggaaggctctgcacaactcccaccacatgtctggaacaatttgtttcagagtgacatcccagaggttcctttgattgaggttttgtatgcaagtttgcccaaagggacatatgcgaaacttaagccggaaggagtgggattctcggatctccctaaccatagagctgtccttgaaacggcactgcgcaatcacgcaacgctatctgaaaatgatgttgtcatggtcaactacggacaactgcagtataagttgaaggttcttgagttgaagcccgcatcaagtgtttctgtgctggagacggatgttgaagttgacattgagggaccagattcagttttcgacaatgaagaaaatcaacatgtgcttgtgccgctcgagactgggaaggtcgaatctggagctgtggaagaagggaagttcaggtactacaaattttctgtcgaggaaggtgtggctgagaaagttgcgtctggttgtgcaaatattgaggttaagatagagtctgatacaagtggcggtgacactgatatttatgtttcaaggcatcctttagtattcccaactcagcaccgtcatgagtggtcatctcatgagatgggatctaaggttcttatactcaaaccaaaggatgctactttggtcagtggcctttacagtgttggggtttacggtttcaaggccacagcgaagtttcaactttctgtagctatcaaggatgttattgatagccataggattggtgagcagggtagtgtgtcatcagccggcaatggtgactcagtggtttgtaagaactgcaaacgacatatatctagccggacctcagtacttcatgaggcatactgtgtgaggcacaatgttatttgcctgcatgatggatgtggagtagttc

SEQ ID NO: 17884 - DNA, 1544 bp, Triticum aestivum
  Clone ID: PAT_TA_17884
tcgccgccgggttccttccctatcccccgccggggcgtcaaggcgtactcgggcggatcagggatcggcgatggatttcgagctgcggagcgcgcgggagaagctggagagggagcagcgggagcggatgcagcgcgctaaggccaaagccgaccgcgagcgccgcgccaaggccgaggccgcgcgccgccgcgacgcgctcgaggcctcaaacagggagcgccgcctcgacgccgcccgggcgcaggaagaggctgaccagaaaatggaagaggtgatgcaactaggaaaggggatctctttttcacacatgtttgaagcactgcgatatgacggtccaggggataagattaagctgccaccatcttctttcaatggatttatccgatcaacggagcgcttagacaaaggtcccatgtacttcacccgctgtccaaggttagggacagagtttcaggtgccttgcgatatcaagtacgtcgaggcaggcaacctgctgtggcgttcttgaattcactgcaagggaaggctgttcacgatttccagcacatagcgaaaacaactactttcagaatgacatacgggaggtacctttaatcgaaggattgatgagcagggtagtgtatgatcaacagtcaatggtgactcagtggtttgtaagaactgcaaacgacatatatctagccggacctcagtacttcatgaggcatactgtgtgaggcacaatgttatttgcatgcatgatggatgtggagtagttcttcgtaaggaagcagcagcagatcatgtgcattgcagtaagtgtggacaagctttccagcagagagaaatggagaagcacatgaaagtcttccatgagccgctgaactgcccctgcggggtagttctagaaaaggaagaaatggtcaaacaccaatcctcaacctgcccatttcgcctgattgtgtgccgtttctgtggcgacacggttcaagctggtggacaaccgctggatgttcgagatcggcttcgaaacatgtgcgaacatgagagtatctgtggatccaggactgcaccatgcgactcttgtgggcgatcggtcatgcttaaggagatggacattcatgcaattgctgtccatcaaaagagctgatttttataaccctacggaccgaacctctgtactgcatatatgttggtatttgttaaatctcccattgtttgctagtccatggaaaacagtggcgcggtggtgtccgttatctgtttgtatcttccttctgtatacatattatttatactctactccttgtttttccactaggccaatcaaaaaacatcgggtttggacggaggggctactcagcctttatcatcacctgggcctcttcctccccagggaggaataccctctaattggcgcagcatcttctgctatgctggtatcgtttggggcgtgtttcctcctaccaatgtagcccctccgctgccgcgtcgcggccagtgtggacaagctgtccgcctcccagttagggcgactctagggagtcgtcgcaataaccata

SEQ ID NO: 17885 - DNA, 912 bp, Triticum aestivum
  Clone ID: PAT_TA_17885
ctcatctctcattcttcttgcactctcggcctcccatcctcctcttctttatctttaagcttgcatttctctcttgtaagaaatggcgaccaaaggcggccgattcattattcattaaccgaggaatatcaccatataatttctcttcttttcttgccgtattcccttctcttgctcacctcttctccattgctactaaccggaaatatttgcccttggaagggccctctccaggttagtcaagggtaatggtttctctgttcctctatccttttgcttgatttacgtctaagaacctgctagctgcttccattttccttggttttcttcgatagtttgattttcatcttgctgtgtttgttgacgtcatgaaactaattactcttttgaaggttattactttgccaatagtaacaatatggattttacatcctcttaattagctttttgctgctcttgccacaaacaaatgaagacgttttattagctatctaggtgctagtgctatgcacctcatcaaagtaggtcaatatgacattttcaatcctgacataacaatacctagcttctgagtcagggcgcctgttagttgagcgagtctgtcgggacatgaaggctcgtcctagccgccagccggagatatagggtactatggcgagcaatttacagaacaaaagtccactcacaagggagtttcgactcgagttcttacaaagtattacgaataatttttctgacgaccgcataattggcaagggtgggtttggagtagtttacaagggagtattggacaatggggaagagattgccctgaagaaacttaatcacacagggcttgacgacaaggaatttacaaatgagttcaataacattattagggctcatcatcaaaacattgtacagtttgttggc

SEQ ID NO: 17886 - DNA, 727 bp, Triticum aestivum
  unsure (1)..(727): unsure at all n locations
  Clone ID: PAT_TA_17886
ggcccgctcgaggggccggccgggcccgggacccaaactcaaacccctcaccggcgaagcacccacaccctcacccacccctcttctccgatggcccgcacgaagcagacggcgcgcaagtccactggcggcaaggcgccgaggaagcagctggcgaccaaggcggcgcgcaagtcggccccggccaccggcggcgtgaagaagccccaccgcttccgcccgggcaccgtggcgctccgggagatccgcaagtaccagaagagcacggagctgctcatccgcaagctccccttccagcgcctggtgagggagatcgcccaggacttcaagaccgacctgaggttccagtcctccgccgtgtcggcgctgcaggaggccgccgaggcgtacctggttggcctgttcgaggacaccaacctctgcgccatccacgccaagcgcgtcaccatcatgcccaaggacatccagctcgcacgccgcatccgcggggagcgcgcctaggttttcattcgccgccgttgacaatactgggtagtagctgctcgtgtctggtgttttctgtctgtggtgttgatatgatgtgccgtcttgtcctatgtagcctggaatgaaattgcaatgaaaagttcagctatcatatgaaattgcaatgaaaagttcagttatcatctggtgctaaaannnnnnnaanaaaaaaaaggaaaaaaaaaaaaaaaaaaggccccta

SEQ ID NO: 17887 - DNA, 797 bp, Triticum aestivum
  Clone ID: PAT_TA_17887
caccgggctgtcgacgcaggcgctggagacgatccacaggatcaacatgggcgttcccaagatcacgcccggcaacgacacgctggggaggacgtggttgccggaccagagcttccaggtcaacaccgacctagcgcagcacaaagacgccaagcccctgacgatcaaatacgacgagaaatcggcactctcgtccgcgtacacggcgccggcggaggtctacgcgacggcgacgaggctgagcacggcgggcgagaccagcaccatcaacgtgcagttcaacatcagctggaggttcgacgccccggccgggtcggattacctgctccggttccactggtgcgacatcgtcagcaaggcagccatgggaatggccttcaacgtctacgtcggcggggcggtggtgctcgacaactacgagatttcgcgtgacacgttcaaccggctatccataccggtgtacaaggacttcctcctgggcgccaaggacgccaagggcgccatcaccgtgagcatcgggtcgtccaccgaggacaacgcgttgcctgacggcttcctcaacggcctcgagatcatgagtatagtcgggagcgccagcgccggcgccggcgctcccgccacgtccccgcccagttcaaaggtcaaaatcgggatcatcgccggctcggccgtctgcggggccacgctggtgatggtgctcgggttcatcgccttcaggatgctgcgcgggagggagccggagaagaagaagccggccgacgcctggtcgccgttctcggcgagcgcgctgggctctc

SEQ ID NO: 17888 - DNA, 1067 bp, Triticum aestivum
  Clone ID: PAT_TA_17888
gccggccgggtttcagacaccgcccgctataacagttcaccttggcctcaccaaccccccaccccagctcactcactcactcactctcacacacccactttacttcctccactcttcaggtcacatcggcagctgctagccaagtagccaagccaacgaagagatcgagaaagcgagagcgtagcaagaaggtggcatcatggcgacggcggtgcagtggccggtgatggtggtggtggtgatgatggccgtgatggcggcgcgcgtgggggcggacatggacgcggaccggagcgagtgcgcggagcagctggtggggctggcgccgtgcctgcagtacgtgcaggggcaggcacggtcgccggcgccggactgctgcggcgggctgagccaggtgctggacaagagccccaagtgcctgtgcgtgctggtcaaggacaaggacgaccccaacctgggcatcaagatcaacgcctccctcgcgctcgccctcccctccgcctgcggcaacaccaaggccaacgtctcccactgcccacagctgctgcaccttcctccgaactctaaggacgccgccatcttcagccccggcggcgacaagggcaccgctgcagctccagccaaggacaacacggcgtcgacggccaactcccgcgcgcagcaggccaccagcgcgggcaccgcctcctcgacggcaaccgccggcgttgcactggcggcgttgctcgccggctaccttgcgctgctcctgccggcggacttcctggccaccgccgcctccttctagtccatctcgtacgtgcgcgtctgtctccttcccccctacggcgctaccgaagatcgatcaagaccaggggagtcaggaaccagtcactgtgtttgggagaatgaaatgcctcaagtaggatcgatcatgcatgttgtagtatgtgacagagatggtagtggtggtagtggttggtttgttggtgttgtattgaactcttatgttttcgctctatggatatgacgcaataattccacacttacggatgcggctaaaataaaaaaaaaaaaaaaaaaaaaaa

SEQ ID NO: 17889 - DNA, 711 bp, Triticum aestivum
  Clone ID: PAT_TA_17889
gccactcgccgccccccatacgacccctccacgtcctcctccccttccctctccgagggcgctcgtctccaacttcccctactacgtagctcaccaaccaccgcccctatcaaggaccagcgcaccgggccgcctggattgccgcatggaggacgttcaggagggctgggagaagcaagtggagaagaagggcgaggaaggtttgcgcagcaaagtgaagcaaatgggcctcaagtactgggatgtgctgtgttccaaagatgcggaatggcctcaaggaagaactttcgctgtggtttggacatgccgcaagcaagccaaagagttgaataactgtcttcaatcaagcttcaccggaatgaatgcaatagctaggggaagatatagaagaaggcttacaatggtatgggcaagagagcaaggagaagaacaaataatctttatgcacgggataaatggaaagccatggttctccaatgcctgtacgtacactggaatttggcagttgcttactggttatcttagttgattgatgctgaattcctagagaccttttgtgaacatttgggtttgtccagatgcataacctggtatgatctcaaggaatccatgtagtacttttatcgacttgcaagttgtgctagatagcattatccgaaaaaaaaaaaaaaaaaaggccaaaaaaaaaccaaaaaaaaaaaaaaaaaaaaa

SEQ ID NO: 17890 - DNA, 1362 bp, Triticum aestivum
  Clone ID: PAT_TA_17890
ctcgtgtcgcatcgcgtacgagccgacccccccccccaccccccattccgccgcctcccttctcttctctctcctcactccctctcgccgcagagaagatggcgtccgacggcagcggcgttgtcacggtgtacggcagcggcaacaacggcgccggtacgcagctggagcccaagtcgtccccgttctctgtcaaggtgggcctggcccagatgctccgcggcggcgtcatcatggacgtcgtcaacgccgagcaggcgcgcatcgccgaggaggccggcgcctgcgccgtcatggcgctcgagcgcgtccccgccgacatccgcgcccagggcggcgtcgcccgcatgtccgacccgggcctcatccgcgaaatcaagcgcgccgtcaccatccccgtcatggccaaggcccgcatcgggcacttcgtcgaggcccagatcctcgagtccatcggcgtcgactacgtggacgagagcgaggtcctcacgctcgccgacgacgcccaccacatcaacaagcacaacttccgcgtccccttcgtctgcggctagccgcaacctgggcgaggccctccgccgcatccgcgagggcgcccgccatcgatccgcaccaagggtagaggccggcaccggcaatctcatcgaggccgtccgccacgtccgctccgtcatgggcgacgtgcgtgccctccgcagcatggacgacgacgaggtattcacctatgccaagagcatcgccgcaccatacgacctcgtcatgcagaccaagcagctcggccgcctgcccgtcgtccagttcgccgccggcggggtcgccacgccggccgatgcggccctcatgatgcagctcggctgcgacggtgtcttcgtcggctccggtgtcttcaagagcggcgaccccgcgcgccgcgcgcgcgccatcgtgcaggccgtcacccactacagcgaccctaatgtgctcgccgaggtgagctgcgacctgggtgaggccatggtgggcatcaacctctccgatcccaaggtcgagcgctttgcggcgcgctccgagtgatctttgttggccaccatcaataccagctcccaaaataatactccatggatcaatgataaggacaaaaaagaagtacttagaaacgattcctagttattatcatgtgatttcttcatgatgatcattctagctccgataacaattcaaggggtagcaagcatgcacctccagtcagtcagtcggtcagtcgctcgctttatatatgtacacacatgttgtcgtcttccatttcatttctgttgttgttaacacaagttaagtatccatccatccttttcttccgtgttaaaaacatgtactccccctact

SEQ ID NO: 17891 - DNA, 587 bp, Triticum aestivum
  Clone ID: PAT_TA_17891
ccccgcgtccggtgatgaactcctgaacaaaggaagttctcgtcatggagattatcatctatggaatgtgagccatgttgtatttgtcaggaggaatatgtggaaggagatgatcttgggacgcttcactgcggtcacgacttccatgcgggctgcatcaggcaatggctggtggtgaagaacctgtgtccgatctgcaagaacaccgccctgaagacctaaggcagcagcagagagcagcaacaaggctcgtcgtgggtggcaccgatctccgttcaaccaattgcaagatcattttattgattcataataccgcacttttttggccaaagggtttttgcattcacctacagtttgattaaaaactaaaaatccaaacttccttgaaaaaaagttcgaaaactggtcatggtttgaaaacaaaaaagatgggttcaaaactggtactgcctgtaagtcgcctgcgcgtcgcggcaaataatcccttggatctgtgtctagtactcatttgactaaatattgatggatgaatggcatatgatggatgctagtttaaagatgaaaaaaaaaaaaaaaaaggcggccgc

SEQ ID NO: 17892 - DNA, 1381 bp, Triticum aestivum
  Clone ID: PAT_TA_17892
aatgccaccgctcagcaggttagcccctatggtgtatggccctcttcaggttctatcaggcaacctggttcatggtatcaccaggcacctgcttttcagcgcgcatttgatgaactagaagagtctatgcctgtggtcagtggaatcaacttgcaataccagcatcctggaaatgtagtccctggtattccacaaaccgcacaccgtttcactggccatggagcttcatcatcaagagctggcagtttggacaacataattcttggtagagaggaagttactgggaggaatcttgtagctcccggcttccctaatgcacagcccctcatgctgcactagacatgagacatttggtgccagaattgtctaattggaattctgacaatcctggtgctaccatccctggaaatgtgtcttctgtatcaagagctaatgccagttcaacgattagtcgaccagcaggctcaacatctctcactcatcagaacctacatcgacggcatcctagaaatttatcagaggaaataggtcgtctatctggagcacttcgtggtccgcagcacccgcgcttaaggtcagggtttctattggaacgtcagggtgatggtgtttggggtgttccattcccaatgaggaatactagggagggaagaagattaatggagatacggaatgcactagaaatgattcagagaggggagaatgtcagatttgagtctattttctatggtggcgtcgacattcatgatagacacagagatatgcgtcttgacatagacaatatgtcttatgaggaactattagcattggaggaaagaataggaaatgttagcactgggctcaccgagaacgatgtgatgaagctcctgaagcaaaggaaattctcgtcatggagattatcatctgtggaatatgagccatgttgtatttgtcaggaagaatatgtggacggtgatgatctcgggacgcttcactgcgggcacgacttccatgccagctgcatcaggcaatggctagtggtgaagaacctgtgtccgatctgcaaaagcaccgccctgaagacctaaggcagcagcaaggctcgtcggatgtccgttcagtcgaccgcaagatcattttattgattcataataccgcaactttttggccaaagggttttgcattaacctaaagcttgattaaaaaaaaatccaaaattccttgaaaaaaaaaagattcaaaagtggtcatggtttcgaaaaacaaagaatggttcaaaactggtattacctgtaagccgccgtcgtgtcgcggcaaataatcctgggatctgtgtctggtactcatttgactaaatattcatcgtggatgcaatggcataatggatgctagtttacccatg

SEQ ID NO: 17893 - DNA, 1152 bp, Triticum aestivum
  unsure (1)..(1152): unsure at all n locations
  Clone ID: PAT_TA_17893
gnatagttctagatcgaggcggcgaagnacatcgggattcagaagctgctgctgctgagatacttggacatgcaggcctcagcttggcccttgggtcctgccattagatcctgtgggcttctccggaataggatgctggttgatcctgcgttcctcttcaaaattgggacggagatagttattgacacatgttgcgcgacttttgcggaggttcagaagaggggcgatgagttttggtcagaattcgagttgtatgcagcagatatgttggtaggcgtagttgttaatgttgctttagttggcatgttagcaccatatgctcgattccgtggggggtctgcatcagcaggtcttcttgggcgtgttaggcatgcttatgatgctctcccgagcagtgtttttgaagctgaaaggccaggatacagtttttccattcaacaacggctcggatcataccttctcaagggacttttatatggtgcagttggattttcttgtggtcttgttggccaaggcattgcaaacttgataatgactgcaaagcggagtgtgaagaagtcagagaatgatgtacctgttccacctcttctgaaaacttctgctttgtggggtgtgttccttggtgtctcgtccaacacccgttatcaggtaattaatggtcttgagcggttggttgaggcttcgcctcttggcaagcgtgtcccagctgcttctttggcattcactgtcagcgtgcgctttgcaaataacgtctatggaggaatgcaatttgtggattgggccagaatgagtggttgtcaatgaggtgtattgcatccatgtttttcatgttaccatccatactgatgttgtatgtgatctgctgtttgataaagcaatgaaacttgtcgaatttgcccctctccgagttaaagatttgataccattattgacaacagcttggctgcagaattctaaaaataaacatgaaggtgctccgtagattgattggagtcttgatatgttgagattgtgttaggctgctagaaagtaccatcggaaatgaatcaggaagaggcgtggtataattgttgaaatttaagcatgtaagtgcttagcgattcatgcagtgatttgtagctccagcaatcagaagagtttaaatggtcaaaa

SEQ ID NO: 17894 - DNA, 621 bp, Triticum aestivum
  Clone ID: PAT_TA_17894
ccgcccctcccccaaccaatcttgcccggaacaaacgacgcgagctccctccctccatcgcgtagcttcctctcctctccacgcgcccgaactaaccaactagagcgagctcccctccccttcccgccgctggcgaccggaggctaccccgcgcgcccgccagccccgccgtcgcctccccgtctcgcggctccaccccgtggcccgttgccggcgagccgccggctgcgaggaagaaggcaggcacggcgctcggcacaccactggtatgactcatcctcgcattcttacttcgcctttgtttccttcagcttcttgatcctgaaattttaagataaattggactcagggcaatggataaaatctagatgccaagttgacttttttcctgcggatttgcttatcgtgaagatgcacaaagggttaatagctcaagcattggattgttggcaaaatagaagttccttcaccaaaggaagaaagtagttgcaccgattcggaagctactagagatactgaaaactttgaaactagtggcgatgacgacaatgatcgtaatcacaagcacccgagaccactgccacgttcttgcacttatatattatctcaatcacagcattg

SEQ ID NO: 17895 - DNA, 811 bp, Triticum aestivum
  Clone ID: PAT_TA_17895
gcgcgagcgccgaccccgaccccgaccccggcttagatcccggcggcccctgttttgagacggagcttcccccccgggcctcgctccatggtgtcgcttacgccttctcaacctgtcggcgccgccgcagtccttatcgccgccgcccctatctcaagccgtcggcgctgccgcagcccctagcctccgacgttgcttctgccacggccccccttctcggcctcaaccggtattctctcatggttctagcctgccgagtggaagacttgggacaagataatggcaagccttgctgattctttcttggctgatcttgatgaactttcagacaatgaagcctaccctgaagaagacaatgctgaggcagtgggtatggatgaggatggtgacgatgatatgcctgatcttgagtctcttaattatgatgatcttgacagcgtctcgaaactgcagaagacacaacgttattctgacataatgcaaaaagttgaaggagcacttgagaaagacacatatttgtctaatcaaggtttcatcctggaggaggatccagagtaccagcttattgtagattgcaatgccttatcagtagatattgagaatgagctcattataatacataatttcatccgtgacaagtacaggctgaagtttcctgaactggaatcccttgttcatcatccgattgattatgcccgtgttgttaagaagattgcaaatgaggtggatataacactagtagatctggaagggcttttaccttctgcagttataatggttgtctctgtgacagcatcgacaactagtggga

SEQ ID NO: 17896 - DNA, 1087 bp, Triticum aestivum
  Clone ID: PAT_TA_17896
gtaaaaatggcagcatccctgccgtcgctcccgcccccgccgacgccgtcgccggcggccaccaccctggccagcaacctcctctccttcccggcgccgcggccgcgcctcgccgccacgcaccgccgcgcggtcgtggccgccgcctcgtccaggccccctccccctccccctccgccgccgtccccggagggaggcgacgaggaggtggagagggccatggggatggacggcggcatccccgggacatccggcgagctgctgcgccgcgtctcctcccgcgcctacggcatgcgccgccacctcatggagtcgctcgactccctcggcctacgacgtgttggagacaaacccatgggagggaacaacagcccaagccagtctatgtgctggctagaagaaacaatcaactatggacaatgaaaacccgtaggaaccgcagtgaagtcgaaagggaacttggaatgcttttctcaaagggaggaggttcaggggttgggactaaatcaaagtactctggctccaagtttagtatggttgttgaagatctcacagagggagtactggtgtttgaagacgaggacgatgctgcaaagtactgtgaccttctacagggcggtggtcaaggatgcgagggaattgcagagttagaggcttcatcagttttcaacatgtgccgtcaaatgaaagctcttgctgtccttttccggcgtggaaggattcctccaacgcctcaaagccttgagcgtgacttgagggcaagaaaccggtcactggaagactaggtggatctttgagacacacggtgtagatatgtcaattgtattcttctagctgttgaagcacaggccctatgccttgtatactaaatggtacatagatgattcaagccacacgaaaaaaaagggtgaaaaataactggtatatagattcaatgatagccaagatggagtgaaagtcaagtctgactgagtacatatttagcttgagattagcaatctctgtaaaactgaatattcttgtaattatttacattctatttacagtgaataaatgagattttaagttactaaaaaaaaaaaaaaaa

SEQ ID NO: 17897 - DNA, 700 bp, Triticum aestivum
  unsure (1)..(700): unsure at all n locations
  Clone ID: PAT_TA_17897
tatagtttcggggtgctgccttcttgaagttataagtggtgaaagcagcagcaaatcgacttggggggaagatatgcatgtccttgtggaatggacatggaagctgcgagaagaagagagacttttggaaattgtagatccagacgtggaagaatacccagaggagcaagtacttcgtttcatcaaggtggcacttctgtgtacccaagcaacagcacagcagaggccatccatgaagcaggtggtccatatgctagctaatgaaacagaaatcgatcttcaaaacgccgtcccaccgggtgtgctgaaagaaccccgtcgtaaaatgggtagtttgggggatttggctctggacacgtcctcgagtcagagcaccagagccaacgtggctggctcctgcaccacacagaccagagacatgaacagctgtaattttagcacaacggagattttacctaggtgatgtggtggaccaatttgcaaacttgtttgccacctccatcagagtgccatgaggttttgatgcgtcgagtgctgacaaggtttttgttgaaatggaaaattgcacataatgtacgctagcgattctcagctcccgccctcagcgtcccnttctcaagttacnaagttatctangctgggtaaacntncaacntantctggcttcaaaggacttnaaantccgaaggnaattctctnn

SEQ ID NO: 17898 - DNA, 1115 bp, Triticum aestivum
  Clone ID: PAT_TA_17898
tagtttggtcccggccaaaggaccgtaactgggatccacaagcacaggatcaattccggccagctcgctatatctgttgaggtgatggtaactgtcatggatgtaaacttgtcgatccgaaaccgtcatcgaggttttccccaaatcaatctcgctcctcggctgttttcgacgactccgtcctcctgccagagtggcaacccgcatgtccggccgcctaccactgtcgctccgaacagaagtcggacgagtcgaccacgagtacccacccgggcggtcgctgtcgatgactcggacctcctgccagatttgcagcccgcatgtcctgccgcctcccacactatctctgcctagccgtctcactagacgaagatgcgtacgaagtcgagacgcattcagctaagcaccatatgcaggtttaacacgtgctttggaatttggattgaactgtgcttgggtctgggtcctcggccgatgccggtccatgccagccaatggttcttacaagaagtgttctaatctatttttttctgtttccttatcaacaggacattggccggttctgaaactttactcggcatctgtcactacaggttgcatgcaatttcatactgttagtttcagattttccaattttctctatgcatatagtagatgcttctatgaatctgtacccatctttggttcatcttatttaattcagttaaagttatattgaaaatttcccacggctcctttccaatggtgtgcgtcctccgtggctttctctccggctaggcctattttctgcgttgtactgtcctgctttcgctttgtggcttttctccgtcctggtggccctccttcctgggctgccatagcctgatctccgtgtgggctcccctggctcccggttcagctgtcgagttccctgttcctcgcagtccccctggcctgctctttcatgttctctgtcccctggacagtttctttcagctcagcgaatcgtgttctttgtgccaaatgtgctgtccggggatcgaccggtatttcgtttattatcgcgagcttcgtccttggtagtccgtgcttggtactgtggtgggtcctgatgactaattcaggatattctgtgg

SEQ ID NO: 17899 - DNA, 962 bp, Triticum aestivum
  Clone ID: PAT_TA_17899
gagattcaatcatctcagtgactcgttttcttttttccaaatgaactgaattgggatagataggtattactttaattattgtgattttggttcatgttatttcgtgaaaggaactatggtggatgcaaatttcttgatggattaactttatatcttctgttttcaaaccaagattgtggtgaatgggtgttgatatgaggtgcaggttgaccaacgggtggaccggtgccggcgtgaggatagggccggtggatggaacagaagacagtggacgatattgacattggagaacgggcgcatctccataggtggaagtttatttacctggacgatgttggggatattctgtggcccaagttccctacagaataatgcccagtctaatctcaatagtgggcatgatagcctcaaacttctcttttcaacattgaagaagcggtttactcggatcagtgggcatgcacttagaaaaatagcgacagagtacgaggagatattcctggtgggaataaatggcttgtcatgctcatacgttaggctgttccgtggccctagttcccttccgcctgttgccccctcggacctctgtagtccgcctgtcccccccttactccccgaaactgctatgcagacgatgcactacatgcacgacagctgcacgatgtcaatctagccatctgttgcacttagataatatgcactgacgcactgatgtgctccaccgtcctctgatcgcctgctttccctccggtgcacaccagctctccttagaaaaatagctagagagtacgaggagatattcctggagtaaataaatggcttgttatgctgatacgttagacagaagcaaaatgttatttatcatgctcctgttgtatccacagacatatgaatacctactttcccaccgttgtacacaaactgattttagtatttgtgcatactctttgtcttaaaaaacc

SEQ ID NO: 17900 - DNA, 1262 bp, Triticum aestivum
  Clone ID: PAT_TA_17900
atgatgaacgctcttgcctatcttgggcttcgtgacatcctagctacagagatggtgtgcaagtctttgcattcgtggatccgcagcgagttatcgtggaagtgtatccacattgaaccggtattgagcgggaagatctctgatcctgatcgtctatttctgacacagaagattccaggtgatttgcagtgtctaaatataaatgactgcataaatatcaccgacaatggtttgaatgctgttctccaaagcaatccgacgttaacaaagttgagtattgcacgctgcccgcggttaactttggatggccttattgccaatctaaagtcatttaatatgaaagcagtgtcgggtattaagagcctcagaattgacaaaaacttcaatttaccaaaagaggattatgaggagttattatccttgttgagcatcgacaagagacaggagttgcacaaccggggctccgcgattccgtcattcttaatcattttttattaagattgcaatgacggatatgctcttgatattgagatgtgccccatctgtcaaagttacaaacttgtttttgactgccctgaaggggagtgcagtgacaagagatctggcaagtgccgagcatgtgaggtttgcatcaagagatgccggcagtgtggaaggtgcttagaacgaaatgagaagtttgaagagaaatttgatctggtctacctttgctacaagtgtcgaggcgatccggcttcaccatctctcggtgtggaaaaggatctggtctccattttatccagtggaagaataccttctccttgaacatggaggagcaacagtccatgtccagccattcagccatctttcttagcattactgatgaagaaaaaaaaatatagtttgctattcatgaaggtgtgtggtcgtttgacagatggtacatttgcttgcaagaaaaacaaaaaaagatgttactaattccagcagaaataaagggatgattcccactattacagcctcaccagcgacaaggagggatgtttcttcatggaatttgcagttcaagagtgtataggtacatggtgagattggtgtcggtgtgttgcttgatgctgcatcttcctgtgaagaagactgaagacgaacttattccttagcttccaagtatattatatctgtatatgcgtgacattgtaatagtttgtcctggatacgtcgtgtcgtatgacttggtaacttgtttcatagaaataaataaatcaatgacttctaactattta

SEQ ID NO: 17901 - DNA, 1839 bp, Triticum aestivum
  unsure (1)..(1839): unsure at all n locations
  Clone ID: PAT_TA_17901
accagggcagtacttctacacctcaaaatgatgatgggtttgctggcatttgagaacaaccaggggctctggaatggcggatattattcacagttttttggaattggaggagttatggtgactgttgcaattctttggttatctacgggttattttggaggaattggtgctccttttgctccatacttttggccatatttaggacaagtccccaagaagaaagaacggcaaaggcccgtgagagtctacatggatggatgctttgacctcatgcactatggccacgcaaacgcgttgcgacaggccaagttgctgggagatcaactggtagtgggcgttgtcagtgacgaggagattgtggcgaataagggcccgcctgtgctttcgatggaagagaggttgacgcttgttagtggattaaagtgggtggatgaagtcatacccaatgcaccctatgagattacggaggaatttatgaataccctcttcagtaaatacaacattgattacattatacatggagatgacccttgtcttctacctgatggaacggatgcttatgccttagcaaagaaggctggacgatacaagcaaatcaggcgtactgaaggtgtctcaagcaccgatatagtcgggagaatattgcaaacattcaagcataaagagggtgttagtgagaatgctggagtggaatcatgcgatcagatgaaaacccagctatccaattttcttccaacttcccgccggataatgcagttttcaaatgggcaggctccttcaccaggtgctcgtgttgtttatatagatggtgcatttgaccttttccatgctggtcatgttgagatccttagaagtgctaggcaacttggtgacttccttcttgtcggtgttcatgatgaccagtccatcagggaaaaaagaaggctnaccctcctatcatgcaacctnccatgagcgttcccccggggggcccgccccccgccccgttgacgaagttataataggcgcaccattggaggtttcaagggatatggtatgttataaatttctccatggggcgtacaattgtgtgttttacctgatttgatcactacattcaacatttcattggttgtgcatgggacagtagtcgagggtggttctgctagtgaagttgatccgtatgcccttccaaagagcatgggtattttccaagtagtcacaagccccaaaacaataacatctgtttcggtcgctacaagaataattgataaccacgaagcgtacaagaaaagaaacttgaaaaagaaggcgagtgaagacaagtactacacgcaaaagaaatttgtctacggagactaatgctgcaaaggagcttacatttttgcagcaagctgaggaaatatatggcgcctctctgcattgaagagttattctacaacagattgcaacaattcctcagctatagaaagtagccagtgataagttgatggccattcggcagagggaatcggctcaaggaaataaattaacagactgccacattcttctactgttgcccttttcggctggaatgtccacttaacagcaagaattcacatacatgattctttttttactttgttatccctggaggggaaatattcatcgctgaacaccttcagcagaccattgttgtattcttgtatggtattactgggtttgtgaagtgattagggttgcatacttcctaattgtactaagttatagtttaaagtatatatactgctgagaaacaacctagtgatgacctgttggcatttgtttgatttgtctaaccagagaacgttatgttcaaaaaaaaaaaaaaaaaactcgcga

SEQ ID NO: 17902 - DNA, 795 bp, Triticum aestivum
  unsure (1)..(795): unsure at all n locations
  Clone ID: PAT_TA_17902
ggccgctcccgaggccggcccggtttcgggnaaaaaaaaaaaaaaaaaaaaaaaaaaaaaaaaaaaaaaaaaaaaaaaaaaaaaaaattaccaacagcagcaaccgtcaaaatggtcaagaagagaaagaacaacggccgaaacaagaagggccgcggccacgtcaagcccatccgatgcagcaactgctcgcgatgcacccccaaggataaggccatcaagagattcaccatccgcaacatggttgagtctgctgctatccgtgacatctccgatgcctccgtcttcgcggagtacaccgtccccaagatgtacctgaagctgcagtactgtgtctcttgcgccatccacggcaagattgtccggtatgttgtcctcctatccaggagtgtgacgactgcgccatggttgcgtatgtgcttttagatgaaccttggcggtaccatatgaaacatattccagcctgccccagcgcagttgcatgctcctggtacgtaattaatgatttatgaaaactgacatgatataatagtgtccgatccgttgtcggccgacgcaaccgtgcccctcctcctcgcgtccgctacaacaaggacggcaagaagatcgtccctactgcccctaaggcttagatgggttgatacttgggatggagtccggttatgatagcagcattcaaaaaatggatgggatgaatacctttgggattatgagactaagaaattccaaaaatcaactgggacgacgtttgatggtctacgcgtcttcaaaaaaaaaaaaaaaaaaaggccccta

SEQ ID NO: 17903 - DNA, 659 bp, Triticum aestivum
  unsure (1)..(659): unsure at all n locations
  Clone ID: PAT_TA_17903
gccggccgggtcgggttgtatgatgacaaactcttccatgccgcacggccctctggccggcccgggccggacttgcgtggacctgaattaacaacagcagcaaccgtcaaaatggtcaagaagagaaagaacaacggccgaaacaagaagggccgcggccacgtcaagcccatccgatgcagcaactgctcgcgatgcacccccaaggataaggccatcaagagattcaccatccgcaacatggttgagtctgctgctatccgtgacatctccgatgcctccgtcttcgcggagtacaccgtccccaagatgtacctgaagctgcagtactgtgtctcttgcgccatccacggcaagattgtccgtgtccgatccgttgtcggccgacgcaaccgtgcccctcctcctcgcgtccgctacaacaaggacggcaagaagatcgtccctactgcccctaaggcttagatgggttgatacttgggatggagtccggttatgatagcagcattcaaaaaatggatgggatgaatacctttgggattatgagactaagaaattccaaaaatcaactggacgacgtttgatgtctacgcgtctttgacaaaaaaaaaaaaaaaaaaaggcccctaaaagatacaagnnnnnnnnaaaggccccta

SEQ ID NO: 17904 - DNA, 981 bp, Triticum aestivum
  Clone ID: PAT_TA_17904
ctgtgcggcgctcgaggcggccggtcgtgtactgatcagagctttggaggttgattttaagaaagttgttggtattagttggtacctttgggccatgcaccttagcgtggtcgcggccgaggtctcccatgtgagttcaattaataaagtggataaaattgtagttttgttgtgatataatgattttcaacttgaactatacctatgagtatccattcttgatgaatacaaagcttttttgaacaacctgctatagattttttaaggttggtatgtttaccatacgattatctttgtctcattttttattttaattttggcagaaagttagattgagtgcagcataatgtaaataacttatgagtttgcccaaaagcaaacgactattcgaggagatttactagattctccttcagatgacttcgtttcctaccacagaattactacaaattcttctgttgatccacatgatgctatatctgaatgcatttgaaattgcaatattcacatgggtcatggcgacatttggtttaagatcatgcatcctggtgaaatcaggttacggcaccactcgagttgtcataagtgtaatctgccaagtcctttgtggttacagcaccctaccactatacgccgtcgtctcccatatggggaattccttcaagaagactatatttgatgaaaatgtgactgaaagacttgccaactaggctaaaaaggctccaagtgacgcaggaaccccaaataaaattactacagatcccacacgtccgccaactcgtggggagcaagggaccgctaggctaatataattgtgtacattgattgctttacaaagggtcctatagtaacaatttcgacaattgtaaatatatatgttttagaggccaaaaatatcttttgataataaaaaaaaataaagaaatatttttagagggcacacatatcttttataatgctagctattcatgtgttcaagat

SEQ ID NO: 17905 - DNA, 940 bp, Triticum aestivum
  Clone ID: PAT_TA_17905
gttgaagaggcgcttcacagccatcaagcagtgaaagaaatcttctgggtatactgtttcacaaccacctgaaggagcaggaaatttgggctgtcagggtctttagaaaggccaagggatgatcctacttctatcaggtcatcccaaattatgtgtccaagagcgatcctgaaggcttatcaaacttcggaattgaaggaatgtcgcctgaacttgtcaaaactgccactgatatgattggctcaatgaaaccagaggagcttcagaaaatgttcgaagttgcttcttcattgaatagcactagctccgctggtccaaatctgggacccaatatgccagaaatgtctcctgatatgcttaagatggcatctgacatgattgctagtatgcctcctgatgacgtacagaaaatgatgagttttgcttctcagatgggtgggcctggtggtgcccccagaagttctgagaatattaactttggaccttcagtgagagctacaacgagtaattctgcccgtggatcatcatctcaacctgttttggagaaccctgatgaactatcaaatgaccataggatgagccagtcgtcttctagtcttccaccttctacagctgatatgcaagaaaccatgaaaaattctatgaaagaccctgcaatgcggcagatgcttacatccatgatgaagaacatgagccctgagatgatggcaaatatgagtgagcagtttggaatgaaactgtcaaaggaggatgctgcaaaagctcaacaagccatgtcgtcattatctccagaggatttggatagaatgatgagatggatggagcgagcgcagaaaggggtagacgtcgcgaagaagacaaagaactggctcctaggccggcgaggcttgatcctcgctattgtcatgctgatcctagccttcatccttcagaagcttgg

SEQ ID NO: 17906 - DNA, 825 bp, Triticum aestivum
  Clone ID: PAT_TA_17906
gaggggaaaaacgatccgctctgcaccgaggccacaaagggcaggaagaaatggcagggaaacccgttagcctcaagggcgtcgccctcatcagcggcggtgccgccgacagcgctgtcgccggcgccctccacttcgtccaagacccctcctccgggtataccgaggtgagggggtgggtctcgggcctcgccccgggcctccacggcttccacatccacgccttcggcgacaccaccaacggctgcaactccaccggaccccatttcaatcctcataataagtcccatggagcaccggttgatgacgaacgacatgtgggcgacctgggaaacatacaagccaacaaggatggtgttgcagaaatcttcataaaggacttgcagatttcactaagggggcctcattccatattgggaagggcagttgttgttcatgctgattctgatgacctgggaaagggtggccatgaactcagtaagtcaacaggaaatgcaggagccagaattggatgtggtatcattggaattcagcctgctgtttaacaaaaaaaatataagagccgttggagtccatgttggtattgcagcgcgcagacaaggaaacagtgatatcgttgaagatcatacattttgatgtgatatcattgtgatctattatgtaattgtacacaagttctcttcatatcttttgttgttctcgttatatcttctttgcgggtaagtactcttgataataaaatatttttaaataaataaaagcaagtataaaagagttgtgccaacttaaaaaaaaaaaaaaaaaaacaaactcgaaaaaactcga

SEQ ID NO: 17907 - DNA, 842 bp, Triticum aestivum
  unsure (1)..(842): unsure at all n locations
  Clone ID: PAT_TA_17907
ccccgcgtccgggctagctagctacacgtacgttccctagctagctagccactagccagctctagctagttgcatcttgatcgaatggcgggcgcagtgaagattggttcatggggtctacccagcggaaaactttgcgacatcaacagctacagcagcccccaacgcctcatcagcatcaccgcgtatagcaacgaaacccctggaggctgcatcgttggcttctccttcacctacgtggaccagaccggaggggccatcaacgtcggcacatggggcaacacctggggaggcgtcaaaacgatttatatgaaccagggggagcatgtgaacgatgtgagcggcacctccaacagcagaggggtgacctcgctcaagatagtcaccaaccagggggaccgcggcacgtacgggtgtccggcgggcgacgcattcagcgtgccgctgcggcagggcaagaacgaggtggtggccttcttcggccactccgacgacaccctcaagtccctgggcgtctacgtgccgggggccaaggagtgccccgtcaagattggcccctggggcggccacctcggctcctccagggacctctacgccagcaacatgccggtgcagctgcagagcatcgccgtccgcagcagcgagaggtcccggcggccgcgtcttcggttctcctacaactacttgggacaagccggcagcgcatcagcgttggccctggggctcccaagacaaaaggcaacagcgcaacatcgccatgaacgaggacaactactcacttcatcancggcactacgatactacgggtcactcgctcaattcgatcaaccaaagacactacg

SEQ ID NO: 17908 - DNA, 1698 bp, Triticum aestivum
  Clone ID: PAT_TA_17908
ggactgcattgtctgttagcggccagcggcctaaaccccgctatgagcatggagcaactgttctacaagacaaaatgtatatatttggtggaaaccacaatggccgttatcttagtgaccttcaggttttggatctgaagagtttgacttggtccaagattgatgccaaattgcaagctggaacatctgattcagctaaaacagcacaagtctctccatgtgctggccattctttgatatcatgcggtaacaaattcttctctgttgctgggcatacaaaagatccatctgacagcattacagtgaaggaatttgatccacatacttgtacctggtcgattgtcaagacttacggaaaaccaccggtttctcgtggaggtcagtcagtgactcttgttggaacaactctagtcgtgttcggtggcgaagatgcaaagcgatgtcttttgaatgatttgcacattcttgatcttgaaaccatgacatgggatgatgtggatgcaatgggcgccccgcctgctccttggtccgcccatgttgctgcttgccgtgctgaccgctatcttctaatttttggcggcggatctcatgcgacatgttttaatgacctacatgtccttgatttgcagacgatggaatggtcgagacccaaacagcagggcccgattccaagcccacgagctggtcacgcaggtgcaactgttggagagaattggtacattgttggtggtggcaataacaaaagcggtgtctccgaaacacttgtgcttaacatgtcaactctggcatggtcggttgttagcactgtagaaggacgtgttcctcttgccagtgagggcatgactttattgtacagcaattatagtggagaagattatctcatttcttttggaggatacaatggacggtatagcaatgaggtgtatgctcttaaacttagtgtaaagttagatttgcagtcgagcacaaaggaccaacccacctcagatagtacgtctagggtgctggaacctgaggttgaaatttctcaagatgggaagatacgggagattgccatggacaatgctgattcgaaaaacagaaatgatgaagcaaatgaacaacttttggcagcccttaaagctgagaaagacgaactagaggcaacgcttaacagggaaggactgcaaactgtacagcttaaagaagagataactgaagcagaggccagaaatgctgagctgacaaaggaacttcaagctgtccgtgggcaacttgccgctgagcagtcgagatgttttaaactggaggtggacgtggcggagctgcggcaaaagcttcagagtctggatgcactggagagggaggtggagctccttcgtaggcagaaggcggcttccgagcaggagcaggcggcgctggacgccaagcagaagaagcaagctggctcgggcggcgtgtggggctggcttgtcggaacccctccagacgacgatgattccgagtcgtcgtgatagggcaggcaaattcattcattcatgcttctttctccttctttacccccatacatatatactatatatacacaggcagcgatcagttggtatacttgcttgtactctacattaattctattctacagacaaacgtactacttcccgccatttgatgatttgtccgcccggcaatttcttcttctctatttcatttgaggaccaa

SEQ ID NO: 17909 - DNA, 1249 bp, Triticum aestivum
  Clone ID: PAT_TA_17909
gagttttttttttttttttttggaataaagctttgatcaacaaacagtttaaaaaaatgtgaatgatgggatacaaaaatgatactgtcgaggagtaactgaaatacggcatgaattttgcgctaccatataagttaaatattgttgactaaccgtcgttaaagcaactgtatctcaggaaacagacaccttgcatatccggaactactacatcccacaataacaatatactttgaagtgccacatatgggaatctgcaggactccaaatgtatgagcagatcaaaacaagttcccacagatcaagcttagaatcctacagatccagctaagtcaagcaacaaaacaccacaaaaggggacaccttgcttttcagtcaattcgagaaccgggatctccactctacacgcacgggagttgtcgaagccaactgaaattcagcatgaaagagggcttcactcctcatcatcttcctcctcttcttcatcttcatcatcgtcgtcttcatcaaatccctcttcatccctcgcgccttcaaattcatcttcagcctcattgttaaaatacttcaaaggattaggccacaattcttccttgataacatctgccacctcatccatcactccatcagaaaaacttttgttctttgcatcattgaaccaagtgaagaaactctcatcaatcaatagtcgtttctccccattctccatgtatgcctttccatttgcaatatccattccattcttccaattgatggtggtggccttcacagttattttcccatcatcactgaatgaacatgtttttgtaagctttgtatcttcaaaatatggattagaagagaatgcaagagtaatggagtagcctgatttaatatcttgaaactcatccacatcgatagacaccaagtgtttgaatatcttttgatcatcttcagtcagaagttcaccaagcataggatggcttagaaacgcagtcaaccagaagtccggaatttccttgataatttcattccgtcgagtataaactggcctgcgaacttcattgtacttctgttccacctccaagactttatcactggcttcctcattaaccctctcgatctcgtcctggatctcctggagcttctcgatggagagcagtagggcgtcgtcgatgctgttgccctcctccgcctccatcctcggcctcttccccttctgctccgccgtcgccatctcgaccaaaccctccgcgagccggacgcgtgg

SEQ ID NO: 17910 - DNA, 698 bp, Triticum aestivum
  unsure (1)..(698): unsure at all n locations
  Clone ID: PAT_TA_17910
cccgctagcttcctgccttctcttcttgggtgttcattcttggatacatgaaggtccacaaggtgaagatgcctggcttgtgcttggtgttgttcatggtggccatgttgcttcccggatctgaaggcaaaatttgcaaggagtatagcaaaacctacactgtttctgaatgcacaagcaaaccatgcgtcgagcactgccatgatgagggtttcgctgaaggggagtgtaaaacaagtgagtatgaacttgatgattatcgattctgtctctgcaagaaacaatgttgatgatgcttcaagatgtcaagcaataataagatcttgaggcggagctatctgtaacatcccaaaatattccgattttggaatgttaaataaataaaagatacatgacaggtggttgcatcttgtaagggactaggctcaattaatagacagatctccggaaagaaaaactccggaaaataaaaaaaacaaaaggtaataagatcgtgaggcgagacaagcaataaatactcccttcgatccttattagtagtgttgatgatgcctcaagatgtcaagcgaaaagtaataagatcgcgaggctaagacaagcaataaatactcccttcgatccttagtgcgacgggtaatatggatcagagtgatacatatatttgttgcacgtgtggnancnnatnttttggccgcccc

SEQ ID NO: 17911 - DNA, 714 bp, Triticum aestivum
  Clone ID: PAT_TA_17911
ccccagtccagtccccacctctcgagagggtttagaagcttccagacctcccccaaaggcgaatcggcgatgagttccaccggagcaggcgtcgccggccgcggcaaggcgaaggcgaccaagtcggtgtcgcggtcgtccaaggccgggctccagttccccgtcggccgcatcgcgcgctacctcaaggccggcaagtacgccgagcgcgttggcgccggcgcccccgtctacctctccgccgtcctcgagtacctcgccgccgaggtgctggagctggccgggaacgcggcgcgggacaacaagaagaccaggatcgtgccgcggcacatccagctggcggtgcgcaacgacgaggagctgagcaagctgctgggctcggtgacgatcgccaacggcggcgtgatgcccaacatcaaccaggtgctgctgcccaagaaggccgggcccaagggggagctgggctcggcctcgcaggagttctgagcgcgcgcggcttcaaggcgaggaaggggaggccgtcctgtcatgtgatcttgtctgcctgtgttcatctgaagttgtgggttggggtgtttcgggagtctgaaactcccgatggaaaaaaaccctggtgtcttctcaactctgtcgtggttgagtgaatgagtcgatcgatcggtagaagaggagaggaaatatatactcctatgtggtttcttatatgcgaacata

SEQ ID NO: 17912 - DNA, 973 bp, Triticum aestivum
  Clone ID: PAT_TA_17912
gtcaaatatgttagaggagttgctgtgccgttaggaaaaactaagtctcttgttgagagatttgaaaagagagagagctctagcattgattgttcatcgccaactggctcttgtggtgatcatacagtgaaagctgatagccctcccaccagttcggcagaagcaagtcgcacatatgaaagggacttgccaacagtggacgagatgacgactccaatcgatttggtgcggaaccatgatgaatttataaatgttgtaaaatctcggttgacaaagctagagatggtgcggcatgtctttaacctaaatggcatcaaaggagcaattgctgcggtcgcaaagttgcctgatattgctgttcaagctgatgttgttagtactctcaagggaaaacttggtcttttcaacctagatattttctcaagccttctgcctgttcttgccgggttactgaacagcaaaactgaaaggcatgctattgttgctttggagatgttattggatcttataaagatttttggaccggttattcattcaacattgtcaagtagttcacctgttggagtagatcttcaagctgaacaaaggttgcagcgttgcacccggtgttttaaccatttgcaaaagattgtgcaagctctacaaccgttgatgatgcggagcggccagtcggcgcagcttgctcaagagctgaacatgtccttgcaagacctggtggtcttctgaagctagccggaagctcaagttcactgtcagagtagataccattctttttgttacaggaaatggaagcgccatatggtggcggggtagcctgttgtctgttgtggtggtcgtgtaattgtttgttgttccgtgttgtacatgtgagcgagcgagcgagagagcttggctgttcatcagtctgtaattagcccccattttactgcttggacagccccggacggacggcggaggggggtggaaattaatg

SEQ ID NO: 17913 - DNA, 1097 bp, Triticum aestivum
  unsure (1)..(1097): unsure at all n locations
  Clone ID: PAT_TA_17913
ttaatggtcagcccatggtagtcataaagaactcgagcggccggccgggcaggtacatcgagcagcttggacgctacaaaaagtctacataccgagtcggtctcccactggagcttaacatttcttgacttgagcctaaatctagaacaaaatagttcaatcaccagctgtcttaaaaacttcagcttaggcgaaactatgaacgctgcataaaagttcttctgtgacaaatgctgcagtttaccatcggcacagagacgattgaagttaaagaacagccaaacatcctggtaatccatctcaagcgcttcaagtacatcgagcagcttggccgctacaaaaagctgacataccgagttgttttcccactggagcttaaactcatgaacacggtcgacaattcagacttggaatattccctctttgctgtgctagtccacgtcggaagtgggccaaatcatggccactacatcagcgtggtaaagaagccacaaccactggttgttcttcgatgatgagactgttgagatgaccgatgagtccatggtacagacattcttcggctcggcacaggagttcagtggtaacaccgacaatggctacatactcttctacgaaagcgtcgctaaaacaagctgatgccttcccgcgtatctcgtgattagcaacacagttttttttcattttgtcgccacacctcctgctccgtgctatatagaagattcggtaaacttaagaataattagaatggcaaagaccattcaaccttagatgctttggtggagtcagtgcttagcaataaagaagctgtgacgagttttgcgggtgggtgctgtagccgccgaagcttgcagtcttcttgctgttgtgtttccgttgtggtgtggcgcaagtttgtatcgatctggaataatgtttcttaagaagatcttatcatgtgaagagatgcttgtatccggaagagtcttggcttggtcttcctgggcntttggttnatctgaaacacactancctntcctccccnanggggggggggcccgggtaaccccaaattcgncccctaataagtggngtccntaatttacnccgncgcctca

SEQ ID NO: 17914 - DNA, 426 bp, Triticum aestivum
  Clone ID: PAT_TA_17914
cggccatgcatgcgccatcccgccggccggccaataaatcagggagcgtttgggtggcctacagtgcgtacgtttcggatattgatttcttcgtggagtctagtgttcgtgcgtgtgtggttggtggtagttgtttggttttgttagtgtgagtgcgtcgtgggtgccgtgtactcctgtgtgtgtgtcaagtgttgccacctgcgattccattttcattccgtgcgatgaataaattaagaaggggtcttctggacgcgtctagcgggcgcacggccgcctaggatgcttagcgagcggcccgacacttcagataatttcttgtctctccttttaactagaatagtcatctagtagtccctttttctgctatgtattaaatgtcaacatatgtatctcctcctatgcatgtgtttgttcgtactc

SEQ ID NO: 17915 - DNA, 1490 bp, Triticum aestivum
  Clone ID: PAT_TA_17915
cccacgcgtccggccctttccccgtccgattctccacaccggcacaccccacctctgccgccgccgcgcgctcagatgccaatcctccgtcagatttttcgtctcctccggcgacctggcgtcgccatctctcatgacccactgcgccgcctctcctctacctcgcgacctctcctctctttcatggcctctgccccgccttactggtcgccaccaccgcttgcacggcgaagtttccctctcatgatggttccagatctacctgtccgtcgtgtttcccgatttccacctggatctcggagcatgactagtgggacaaccttgcaagatatgaatactatagccggcaaacatgatgcatcttcgaatattgtggacatctctggttgtgatgaaaacgggaggagtgcaaccaatagaaggagcgcattggtagcaagcgatgccgaagaagatgatattcttgacctgggatttcttccaaaaagcacacaccgtgatggttctttatacaggaacactcattcgtggaaaaggatgtataatgttgatgactgtagtgagactcggctaccagatcccacagattgtgacatccgcaatggagaatgcattcggcatcaacctaatcgcgtgttacaaattttctcattaaagttggctgaacttactctggatcttggcccagtagagttgtatggatacatagcagtgcgggattatctggatacattgcgtaattatgttgtcaatataagcagggatgatcccatcattgtgaagcagggttctctcatcgacatggctggccctaagcgagggatagatttgatttccagtattctagtggaatatgacatgaggatcaaggtaggtgaggaagaaagggatgattaccagctgattgatggtgtacagacatagacgacctgggcccatggaatcgtgcattgaaaaatcgcatccaaggcgactgtggtgcggttgacttaaccatagcacgtgttgatgacgcagtcatggcgaatattgaagttgccgtgtcagaagtgcagagcagttttgatctatgcttgcgctgttttatcggtggttataacgaaggaattcggctcttcaatggtacagttggcgagtcacgtcatttaaagaggtctgtggttgctgtagtggatggttccactctggttttgaagttcaaggcggcctcggggccatctggttcagcggaacgatgttgttccttccaggcagacacgcatggacttgatactcgagagataaagactgattttgggttgatctcagtgaaggtgacttggtcgactctgcgtaccaggcttattgtagggcttgaataaagtttgtcaaaaagttgtgtctgaggaatgggccaagacccggtcaacagtctagagtgagttgtacgtggacactgttgaactgtttagggtatctttacatgtttctggttaacatgtttcagtact

SEQ ID NO: 17916 - DNA, 929 bp, Triticum aestivum
  Clone ID: PAT_TA_17916
actccccacccgcacacagcgcacccaacacaatcacacacacacaagtcgattgacccaacacaaactcaacagcaatggcgggcgagaagggtctggtgctgctgaacttctgggtgagcccgttcgggcagcgctgcctcatcgctcttgcagaaaaaggcctcccctacgagtacgtcgaagagaacctcatggccggcaagagcgaccgcctcctccgctccaaccccatccacaagaagatcccagtgctcctccacgacggccgccccgtcaacgagtctctcatcatcctcaactacctcgacgacgccttcccggacaccccgtccctcctcccctccgacccctacgagcgctcgcaggctcgcttctgggccgactacgtcgacaagaaggtctacgactgcggcacccggctctggaagctcaagggcgagccgcacgcgcaggcgcgggccgagatggtggaaatcctcaagaatctggacggggcgctcggggataagtccttcttcggcggcgatgccttcgggttcgtcgacgccgcgttcgcgcccttcacgtcgtggttccacagctacgagaagtacggcgagttcagcgtggcggaggtggcgccgaagatcgcggcgtgggcaaagcggtgcggcgagcgggagagcgtcgccaagagcctctactcgcctgacaagatttacgagttcatcggcgtgctcaagaagatgcacggcgtcgagtaagccgaccggccggccggggggaagcaataagttcgatcgtgtgtacggtcattggtggtacgtagtagttgttgcttggtcgtgtacttgtgacgcgtctgtgtgtgtgtgtgtatgtcaacgcgtcttcttcagttggggcagcaccgagttgccacctgcgattctatttcatgtgtgaac

SEQ ID NO: 17917 - DNA, 1128 bp, Triticum aestivum
  Clone ID: PAT_TA_17917
tcgagggccggccggggccggggaaaaaaaaaaaaaaaaaaaactccccacccgcacacagcgcacccaacacaaacacacacacacaagtcgattgacccaacacaaactcaacagcaatggcgggcgagaagggtctggtgctgctgaacttctgggtgagcccgttcgggcagcgctgcctcatcgctcttgcagaaaaaggcctcccctacgagtacgtcgaagagaacctcatggccggcaagagcgaccgcctcctccgctccaaccccatccacaagaagatcccagtgctcctccacgacggccgccccgtcaacgagtctctcatcatcctcaactacctcgacgacgccttcccggacaccccgtccctcctcccctccgacccctacgagcgctcgcaggctcgcttctgggccgactacgtcgacaagaaggtctacgactgcggcacccggctctggaagctcaagggcgagccgcacgcgcaggcgcgggccgagatggtggaaatcctcaagaatctggacggggcgctcggggataagtccttcttcggcggcgatgccttcgggttcgtcgacgccgcgttcgcgcccttcacgtcgtggttccacagctacgagaagtacggcgagttcagcgtggcggaggtggcgcccaagatcgcggcgtgggccaagcgctgcggcgagcgggagagcgtcgccaagagcctctactcgccggacaaggtgtacgacttcatcggcctgctcaagaagaagtacggcatcgagtagggcgcgcgggcgggcgggcgccatgcaggcgacagccggccggccgtccggagggaaggaacaaataaatcatggagcgatttgggtggcctacaatgcgtacgtctggatatttgtttctttcttcgtggaataaagtgttccgtgtgtgtgtggttggtggtagttggttgggtcagtcagtgtgggtgcgtgttgcgtactcgtgatgtgtgtgtgtcaatgtgtcaaccctggtcttcagtggtggcagctgtgattccatttccattccgtgcgatgaataaattaagagggggtcttcgttgtttaaaaaaaaaaaaaaaaaaaaaaaaaaaaa

SEQ ID NO: 17918 - DNA, 1240 bp, Triticum aestivum
  Clone ID: PAT_TA_17918
cccacgcgtccgcgacggtccccttttctccccctccccctccgtggcagcccgacggcctaccaacaccaaaccgaagcacaccgcgactgcgccactccctgcgttccgagtgacagaggccatggcgctcgccacctcccaccgccacctcgtccgccccgccgccgcggcccctcgcgtgccgctgcgtcccctccgcttcgccgccccccgatctctcccgaggatttgttgccaatctatcaactcagctaacgtgttgggagcttcctcaatgacagctgacgacgcagttccacagccagttgtactgatagaccaagactcagaccgtgatgcaaccattgtgcaactgagttttggagatcgtttgggggcactacttgatacgatgaaggcactcaaggacctgggccttgatgtgacgaaaggaagtgtggcaactgattcatctgtcacacaaacaaagttccacatcatgcgattagggcgtaaggttgaggaccctgacatgttggaaacaatacggctgaccatcattaacaaccttctgcagtatcatcccgaatcaagcgagaagctagctatgggtgaattttttggaattaaagcccctgagaagaaggttgatgttgacgttgcaacacatgtaattgtgcaagatgatggaccgaaaagaagcatgctttacatagagacagctgatcgaccaggcttactcttggaagtaatcaagatcattactgacgtaaacgttgatgtggaatcagctgagattgatactgagggcttggttgccaaggacaagtttcatgtgagttacagaggcgcaaaacttaacagctcgttatctcaggtgctggttaattgtttgcgctattacctccggaggcccgagacagatgaagacagctattgatgattgttctgtggcggctcgttttgagttcctgcctatgaagccttttgcacttcaatttctgttgtaagcaaaacaaaatatggcacatgtgttccgaaaatgcattaaaactgggccgtctgatgcagttatgttctatggttggacatgtggcccttgggagctttagcagccccatcccattggtttcctagaggaatcacattggaaagcattcacgcgtgccgagtgtggtctgtaagttcatagtactataattcatgtgcatgtaaaaaaccaggttacgtatgtgaagatcgtgtcttgcttaatgtc

SEQ ID NO: 17919 - DNA, 2070 bp, Triticum aestivum
  unsure (1)..(2070): unsure at all n locations
  Clone ID: PAT_TA_17919
ccgcatgcggcccccccacacacgtacacaacacaaacacaaacacaagcatcgatcgagcaacccagacgcaacgcaggagcaatggcgggcgagaagggcctggtgctgctggacttctgggtgacgcccgttcgggcagcggcgtccgcatcgcgctggccgagaagaggcctgccctacgactgtacgggaggaggacctgatggccggcaagagcgaccgcctcctccgcgccaacccggtgcacaagaagatcccggtgctcctccacgacggccgccccgtcaacgagtccctcatcatcctccatgtaccctggaggacgccttcccggacgccccggcactcctcccctccgacccctacgcgcgcgcgcaggcccgcttctgggcccgactacgtcgacaagaaggtctacgactgcggctccccgcctctggaagctcaagggcgagccgcaggcgcaggcgcgcgccgagagcgctggacctccctcaagagccctagacgtgcggctcgccgcctatgccttgctcaggcggcgagaagttcgggcttgcgcgcgtcgagcttgcgcgaccttctcagggcccttcaccgcgtgctagaggtacggccgagtttcggcctgcaggaggttggcgccctagatcgcggcgtgggccaagcgcactgcggcgagcgggagagcgtcgacaagagcctctactcgccggacagggtgtacgacttcatcggcctgctcaagaagaagtactggcatcgagtgggcgcgcgggacggacgggcggccatgcatgcgccagcccgccggccggccaataaatcagggagcgtttgggtggcctacagtgcgtacgtctcggatattgcttacttcgtggagtgtagtgttcgttgcgtgtgttgttggtggtagttggatggttatgttaatgtgagtgcgtcgtgggctgccgtgtactgcctgtgtgggtgttctattgttgctaccttcggttccattaacttttccggtgcgtagtgaataaatttggttgttggttggatcagtcagtgtgtgtgggtgcgtgttgtgtactcagtactcgtgatgtgtgtgtgtgtcaatgtgtcaacccttggtgcctgcggtgggggcagcaccgagttgccacctgccttttccatttccattcccgggctgatgaataaattaaaaaagagtctcatgtgtttgatctagttcatggtaacaatgtggttcttaaaaggcaggacacgcagggacttgatagtccagaggaacaatgttgtttcttccggggagactcgcttggacgtgatcctcgggcgatcatggcttactgtgggttgagcttcagtgaaggtgacttggtcgactctgcgtaccaggcttattgtagggcttgaataaagtttgtcaaaaagttgtgtctgaggaatgggccaagacccggtcaacagtctagagtgagttgtacgtggacactgttgaactgtttagggtatctttacatgtttctggttaacatgtttcagtactattacctgacaatcctagccatttggggtacactggttctggtatctgtacatagtgttgttcgtgctcagtcagagcatctcagtcgctttttgactactggagggcaaaaaacggctcccagcaacttctctttcttagcaccaagacacacgagtaggtcccttggaacaatnggttcaaanccaagatatcatctcnaagactanccccnnaganaagtttcaactttggatctggtttggggataatnatggccgaaagatcatatccacaacaaggganacgttgggatctgtcaaaagctggnaatttgaagncaaaggtcanaactntggttcttntagggatgtataatccnaananaaatnccagnggcgctttncccacgtcaacgagtccgtcatcatgctccagaacatcgaggacgccttccaggacgccttggccgtcctcccgtccgacctctactcgcgcgcgcaggcgcgcttgtgggccgactacttggacgagaacgtcta

SEQ ID NO: 17920 - DNA, 731 bp, Triticum aestivum
  Clone ID: PAT_TA_17920
ccacgcgtccgcctcacccccccgccccgggcgttcctcaacttccggcgcaagctgaaccctcggacccgaccgcggcagccgccgatccagcccccgccgcgatggaattcgccctcgtcgacggcgagaagttctcgccctcctgctccacgcttgtcatgcccgcgctttcgatcggcaacgtggggcagctcgccgtggacctgctgataccttcggcgaaggcgaggcgcgtggcgtacctcgacgagccctccgtgctgccctgcatcggcaacgacgccttcggaccggacgccgtcggcgacctcgcgctcgcgctcgaagaatacgaatcaccgtctcacgggctggctttcattcaacaaagatctccagttattacggggatgatggtttcgtttgccaaaaatgttgctaatttcatcagtagcattgggaaggaccatgttgttattctttcaagtttagattctggcaagagaagagtaattgatgcatccagtgatatgctgtattacctttcaagctgcaatgaggatggttctgatccagaatgtgagaaactagggtggaagaaacttgaggaatatgatccatctcaacgactgtggaaatgtcttgctagtctaattgagggtggtgttctttcagaagatatggctgatgatcctgaagagatgaccgcaagtgattactacgcgaccttgccacttgcagctctattc

SEQ ID NO: 17921 - DNA, 773 bp, Triticum aestivum
  Clone ID: PAT_TA_17921
tgcctgcgagctccctgacgtgtccctcggcccgaattccgcccgcgtccgtttggccttggttttaaacccggagttggttaatgattgcattattgtgacagcatgcaacttatatgattctgattgttgtttaaagaatcaatttaagagtttgcgccttgctagtcacttccttcaggatgtctcatccattaattctcaagactgggacatattgaaacttgcaacagctctgaagatggtatgttaccctgaagacgatatcttgtttggtaatcctgatgagatgttttcaacagatgagttatcaaagttagtggctgatgcacataagtacgaagacagtgggatcattaaaggagctattttgaggctctataatttagtggtgtatctccttaattgtaaggcaaagtatcagaggagattggcctccttcgtcaaggaggctaaagaatcatatgaagctgagcaagttgttagagagaggggttcccttcgaactgatgcttttgaagcggacatacaagaagttggggtacaaatggttgcaggataaggtcttagtgttggatcagtttctgcccattcgtagtgatctcttccgttagcaattgctctccagctgtagctgatatcgtgaggatctatgtgcttttatatttaactttcgaacttattgaagttggcatgagcgtttctatgtgcttttatatttaacttcgaacttattgaagtggcatgagcgttttcaaccaagtgccttttgt

SEQ ID NO: 17922 - DNA, 834 bp, Triticum aestivum
  Clone ID: PAT_TA_17922
cggtcaccgggcagatgtcgtccacgcttatcgagcagggcatggctatggacaagcgcgtcggcgcctttgttgtgtcgcctgcgtccctgtctaccttcgacgtcatcagcgtcctggtctgggttcctatttatgacgccgtcctggtgccgctcgcccggcgtgtcaccggcgaggacaggggcttcacgcagctccagcgcattggtgtcggcctggcactgtccgcggccggcatggcgtacgctgcgttgattgagacaaggcggctggcggcaccggcgacctcgatgagcatcatgtggcaggcgccgtgctacttcgtgctgggcgcggccgaggtgttcaccagcatcggcatgctcgagttcttctacgaccagtcccctgtgtccatgaagagcctcggcgcggcgctcgcgctgctcgccatcgctggcggtaactacctcaactctgtcctactgggcgctgtcgcgtccaccaccgggtggatcgcggacaatctcgaccaaggccaccttgactacttcttctggttcatggctgctctcagcgcgctcaacctgttgcagttcgtctactgctcgaccagatacaaaagcatagatcagcattagtacagtactacctctcttcatttttataagatgttttagactttcagacacggttcaaaacagtactccctccgtccgaaaaagatgtcccaagcttgttcctcaaatgaatgtatctgacactaacttggtgctagatatatccatttgaaggacaaactttttcggacacagaagtacaaaggaaactgtctgaacgtcttataaaaac

SEQ ID NO: 17923 - DNA, 596 bp, Triticum aestivum
  Clone ID: PAT_TA_17923
ccgccgccggcggtcgtccgtccgcacgtcgtccctcccgcgttccgacctccgtccgcgcgcccccgagaggcgtcctcttcgccgagaaatgccggcgaggagggtggccatcgatctgctccggaacgcctcccgcgaggccttccaggcggccgtctccaccatgctgaagccgcccacctccaagcccctccaccacgaccaccggtgaagaggcagccagcgcggcggtcgggctctcggaacaacgcatccgcttcgcctcgcagcaagcaaccccagcaaccgcgtacgtgcgtgcgtacgcacggggcggcatgcaacgcgacgtgtctccacccactacgtaccttcttcctgcgatccatggctccggattggacggacgccgtgtctccggtagacgaagctccgtcgtcatattctatgtgtgtgcgtttggctccactgtacgtcactcccgtgtactacaatgttaagcgtgaagacgtacgtagtgtaccatacatatacatggataatatatctccaatggcaaggaggagccatgcatacacctcgtcaaaaaaaaaaaaaaaaaaaaaaaaaaaaaa

SEQ ID NO: 17924 - DNA, 1860 bp, Triticum aestivum
  Clone ID: PAT_TA_17924
ccccgcgtccgacgatctgggcttgctgcctccgaggagcgtggctacgaggcgagcactcctattacgctcctccttctcggccccgagcgcttcaccatctgcgagatgcggatcccggggcttctcgcggcggcggggacgctgctggtgctgcttctcgccgtcgccggtgcggctgcgcaggaggcggcggcagcgggggacgtgcggccggaggagatcgcggcgaacgcgagggcccaggaggaggcggtgctcgcggccgagctggggcagctcagggcgaaggtcgccgcgctagagtcgagcattgcagcacagacactggagctgaatagcaaggatggcggcatcgaaacactgactaagtttactggggagatgtcacagaacattgctactctgcagaatgagataacttccctccagtcaaagggatctatagctgcaaaggagcaggcaggcaaggtcaatgcccgggctattgagcttgagaagcagattgagaagctcaagaaggacatagaagcacagaataacaaaaaggcgaccatggaggctagagccaccgatgcagagaagaaggtgcaagagctgaatgctaagctggatagacttcaaaagacaagcggcgagcaaaaggttaggattcagaagactaaaaatgctcttaaagctgcagaggaggagctgatgaaggtgcagttagaagcaacagcaaaatcagagcagctcggagaggttcatggagcatggttgccaccttggttagcagcacatgcagctcactatatggagttgatgtcaagtcactggagtgaacatggaaaacctgctgtcaacaatttattgcaaaaggcgtcagagaaaacagtgcaggcgaaggaatgggctgaaccccatatagaaactgttaaggcgaaatggattcctgtcattaaagaaaattgggctactgcaaagaaaaaggcggaaccttatgtgcaaatggtctcagcaaaatcagtagagctttatcaagcatcaaaggatgctatctcacctcatgttgtgaaagcacatgagcttgctgatccctatttccaggaagccaagaagttatccaaaccttatattgatcaagttgctaaggccagtaaaccacatgttgacaaacttaaaaccaccctgaagccttacactgaaaaggcaggccaggaatatgaaaagcttcgcgagacagctagtttataccatcagcaggctcaggtaactatcttggattacatgcaccaacatgaattattaaaacaatttgcgaatggagagttggtgtggtttctggctgctgcttggctccttatgcccgtatatgttttgtacatactcctaacagaagtcttctgcatcaccaagaagaagaaaatcccacggagtgacaagggcaaagttttggtcaatggccataggagacacaagcgccgacatgcggacaagtagaccgtagactgtttgcctatgttctgcagcactgtagttgaagatcaagtacgatgaggcattattcattcactgacgagtctgctggatacaaattaggagacgcctggtcctggttaaatcatgtgtaatatataccctgagttatactgcacgcaaaccgtgtctccattttggcccccatgtattgtagcggccgtttctgtgcgatcacgttgctgagtagcgattacgaggttaaatctgcagatattcgttttagtggacacttttgcagctgttagcgtgttttgagtgtacttggggtaatccgtgcccacaactccctctcgtacttcttgcactgaaagtcagataaacatcactaaaaaaaaaaaa

SEQ ID NO: 17925 - DNA, 561 bp, Triticum aestivum
  unsure (1)..(561): unsure at all n locations
  Clone ID: PAT_TA_17925
gccttcgacgcanagntagggaagagaagcagccagacgcccatcgctcgctccctctccctccaatggccgcggccatgagaccctcctcccccccctaccctctcccgcctcccccgacctgctcgtcccgcctcccccagctccgctgcttcgtcggcctccggtgttccgcccctcgcgtccaggtcaggaggcaattagacgcggttgcaggaattggcagtggtgcgcgtggatgcggtggacgattcagagcgcctgcttccagtgcgtcccagccttgttatagctccatcgtcattagaaacgacaattctcaaaatgccgattttccacgtaactactccaaaagggagaagaaaccatttcctataccagtactggagttaaggcgccgagcgagacagaggatgaaggaagctgaagggaagcctagggggccgccgccacctccgaaaatggattgctggtccagagactaataccagaggcatacagagtgtacaacgcaagaatttcgctgatcaacaacttgaagaggctgatgaaagtagtacc

SEQ ID NO: 17926 - DNA, 816 bp, Triticum aestivum
  unsure (1)..(816): unsure at all n locations
  Clone ID: PAT_TA_17926
gngtgntttgattccgcnagcttgaaattcaccctcactaaagggaacaaaagctggagctccaccgcggtggcggccgctctagaactagtggatcccccgggctgcaggaattcggcacgacattcaacacaccactgttccacatcaagaacatacagaaccagagccccaaacccacccaccctcacacaacaaaaaagcagagcttcaagagccatggcaccgtcctacgacaagaccatcgccacggcggcctcgctggcggcctccctgatgctcgtccgcagcctggcgagcgagctgctgccgtccgaggtgcgcgacgcgctctccgcagccctcaacagcctgcgctcccgcatgacgtggcagcacaccatcgtcatcgaggagacggaggggtggtcgggcaaccgcgtctacggcgccgtcaaggcctacctcgccacgcgcatcaacgccaacatcgacatgcagcgcctacgcgtcagcagcaccgaggaggacgccaagaagatggtcgttagcatggaggcgggggaggagatggtggatttgtacgagggggtcgagttcaggtggttcctcgtgacccgggaggtgaagggggacctgaacaacggcggcggcggggcacgggagatcaggtcatatgaggtgcgcttccacaagaggcacaaggagaaggccctgaaagagtacctcccgttcatcggcgccaccggcaaggccatcaaggaccaagaaagaagcctcaacatctacatgaacgaataccgcgaacaatggtcccccaatgtcctncancaccct

SEQ ID NO: 17927 - DNA, 791 bp, Triticum aestivum
  Clone ID: PAT_TA_17927
gccggccgggtccggatcccgctcatccgtattgatccgctccggcccatctcctccccctcgacgacggcgcagatggcgagcgacggcgcggtggccacgccggcgaaggtgaccccgaagaaggccaacctcctcgacccccactccatcaaacacctcctcgacgagaccgtcgccgaggtcgtgaagggcaagggctatgtggagaacacgcggctgggcaactggaagctcctgatcgggacggccgtgatagccatcgcgctcctcgcgcagttctacccgaagaagttcccgcagaaccgcgagttccttctcggttgcatcgcgctgtatgtggtgatgaatgtggtgctgctgatccttagctacaccaaggagaaggatgccatcatcttcacccaccctcctgctggttctttcaataacactggccttgttatatcttcaaagttaccaagattctcggacatgtacaatctttcaatagccagcgcagatccagagtctatctctgctcacaagcccgtccacttcactaagagtgttacaaaatggtttacaaaggaaggtgttcttgtggagggcctgttctggaaggatgttgagagactcattgatgactacaacaacgagcgcaagagcaaatgaattactggcccttgtcatcattatcaggatgaagcttagcctaatcgaaatagacaatgtttttgaaagcagtactgtttgaactggtgaatgaagcaccattaagataatacatcattgcagtctttttttttggt

SEQ ID NO: 17928 - DNA, 976 bp, Triticum aestivum
  Clone ID: PAT_TA_17928
ccgccccgcgccggcgcgccgcaccggcccgtcttcacccgcaccggcccatctcctcgccctcggacggggcagcagacggcgagcgacggcgcggtggccacgccggcgaaggtgaccccgaagaaaggccaacctcctttgacccccactccatcaaacacctccctcgacgagaccgtcgccgaggtcgtgaaggggaagggctatgtggagaacacgcggctgggcaattggaagctcctgatcgggagggcggtgatcgccatcgcgctcctcgcgcagttctaccccaagaatgttcccgcaggaaccgcgaggtgcctggtcggttgcattgcccggttactgtggtcagtaagtgtgggtgcatgctggatccttcgcatcctccagctgcagcaaggatgacatcatcttcacctactctcttgctggttctcctcaataactttggtcattgttaatttcttcaaagttaacaacattctcagacttgtacaatcttcccatagccagcgcggatcctagaatcagctctgctcacaagcctatccattcaatatgtgtttacaaaagggcttacgaaggaaggtgttgttgtggaggacctgttttggaaagaaggtgagagactgtgtgaggactactataactagcgaaagatctaaagaattaccattccttgtaatcaaaaaaacgaaggaagcttaagtaaaagaaatagttaatgttgtttatagcatcattcagtttataccggcgtgtaaaggtttgtcaagatatcataacttcatagtagtttttttccatcattactgtttgaactgggagaatgaagcaccgttaagataatacatcattgtgttagaattttcttggtatacaggtctatctataatggttatatcaccgtgtatcccagcgttttgacttgccacctcggccgcgaccacgctcagcacttcgggaattc

SEQ ID NO: 17929 - DNA, 648 bp, Triticum aestivum
  Clone ID: PAT_TA_17929
ggtcactgattctgaggggacggccaggactacaatgagggcgagacgttgaagctggcgtcggcaactgtgaccacaactgtgacattaacatcgaccatgggagcgaggcgtcagcccttgacatagaccgtgttggccccttgtgtttctgtccagccgtgctccggttccggcagctcccattccagcctatcccttctaggagccttcagatcgctaatgatactaagattgcatgagtccatgaagcaagcaataatctatctcaaaaaattgtgtccaagcatataacggttcatcaatttttgaaatctgactatggctatgtagcacgctgaaaagacaagagaataatgcatgcatatgtccgagctatgctgtctcccacctcgagctcggtgctctcgcatgcaaggctaagctatctccaccgactcctcgcaaatgctacattgagtttattcatgatgttcttgccgttgttgcatttgagagggggaaagaacgtcaattttgctttttaaagggaagataaagaagtatgttattgatgggatatggaccctggcttttagcgatgatcaatgttgcaaggcaacagaggccatggttattgaagagacgaaagctctagcaaagctcact

SEQ ID NO: 17930 - DNA, 818 bp, Triticum aestivum
  unsure (1)..(818): unsure at all n locations
  Clone ID: PAT_TA_17930
atcgaatagcacttgctgtaacgaaccgagagcgaggctgatcctcccctccttctatcctcaccaaccccctctgcttcctttacctccttcctccccagatctgatccagaagagagaattgagtagctccgcgccgccggcggctccccacgcgcgttcgccgccataggcatacccgatctacctcaccgcgcgcctgctgcctccgcgccagccccctatttcggacattcgaggtacgagcatttcgtcgttccatcccagcgattagtcaaaccccaccgagctccacggattcgcggcgcggcgcccggtgagcgcacgccgttccagatccgccccctgagttgcagggcctggtcgttgggcccttggagaaatcacttgaggttgcgggtctcggatgcggccatgagtttgccgggaaagaaggccgcggccggggctgggggaatccggcggtggctctccaccgccgtgctgccggcgctggcgctggtgctgatcctggtggtgatttcgctgtcggtgggctcgcccctgcccggggcgtcgctccctgaatacccagctgtcagagctagtcacccaaaggggaacgctaccgccgatgaggggagcaagaatgatattgccactggtgttccattaccagggaaagagttgcagggtggccaggagcccttggttgagcacagcgcccaaaatgctactctcaactcaagcgaggggtctctgaatacaagagagattcatgacacagtacccggatcccagtttctgtcgatagcaaaatacaggnacccagtagtagc

SEQ ID NO: 17931 - DNA, 1115 bp, Triticum aestivum
  Clone ID: PAT_TA_17931
ggcagggaacccgctccccatcccgccctccctccccacaaccgccgccgcccatcacgcgcagaaaccacgctccaagacaccaaaacccaccgatcccccatggagaacggcgacgaaaccctcgtctctccccccgccgccgccaccgctgaggtcgagaaggctgcgcccaacggaggcgttgagggcgaggaggtcaccgtcgccgacgctgtccaccccgccaagtcctacgccgccgtcgccgccaacgccgagatcgaggacctccgcgccaccaagctcgacctcgaggagcagctcgccaatgccagccaggagaacaagaccctcgccgcggaggcccaccgcctcgaagggctcttctctcaggccagggacgacgtcgccaccgccgagcacgccgccgccaccaccgaagaagaggtggcctctctccgcgccgaggtcgagcgcctccaggccctcgtcgaccgcaagaaggctgaccgtgaggcggacgagcgccaacgtcaggagctcacggccgaggtggagaccgttcgtcaggcgaagctcaagctcgagaaggaggtcgacgccctgaaggcttccgccgctgctaccaccgtggaggacagggaggctgctccggacgctggggtcccgaaggaacagggggtcgcctggcaggggatggcagcgggggcggccgctggtgctgccatcaccgctgccgtcgttctgatctacctccgcctcaagaggtaatctggtgctctggtgcgcaggaagttttgctctgctgctacagcttatggaagatttgatgagtttgtcgtggtgatgctgttagtaccgaactgagagtaatatgtcttctatcagttagttgcttaatagaccacaaaaaattaggtaatctgcagaatggttatgtttcatcggtgtttttccttaatcatctacgggcttttggtggtgacgatgaatgtgtagacactttgtcaaccgggcaaggctgtatgcttggttatattatcgttaaggctgctggcttaatggtagcggtcttacggctgcggcccggcactgttaaaaaaaaaaaaaaaaaaaaaaaaaaaaaaaaaaaa

SEQ ID NO: 17932 - DNA, 472 bp, Triticum aestivum
  unsure (1)..(472): unsure at all n locations
  Clone ID: PAT_TA_17932
ccccgcgtccgggcaactcgagggcgtgcttgngagacaagaacttcttctccggcgatgagttcggatttctggacatcgtcatcatcccgttatcgagcatgtttcgagcgtacgaacaacaaggaaagtttgttcttgaggtggagtgtcccaagctgatgcggtgggagaagcggtgcaaggagagggagagcgtcaagagtactcttccagatgaggaggaggtgtacaggatgcacaagaagtggtacggcatagagtgaagtgagccatagattgtgctcaaaacctatcatgcttgtaaacttgaataatactctccatctattattgtttgacacacaaaaataatacactatgggacgtgtcagtgtacctaagtacaggtaaacaaacaaaatatagggaaacttgtactctttttattaatctctcatcgagcaaacaaaattagatgatccttttacat

SEQ ID NO: 17933 - DNA, 1779 bp, Triticum aestivum
  Clone ID: PAT_TA_17933
cctccggttttcatctatcttccatctcgcccgcccatgcaagcgcatggaatttcaagatcatctcgcatgcttgaaaatgtccttccagtgaatcatcatgttggatctgcaccagctgtcaatccatcaattttggataggagaactggttatgtaggggagctgatggaagcgccaagtttccaccctgggagtgctggaagcatgggtttctctggtagtccgcatctgcatcagttggagctcactagcatgtttcctcagagtggagggaaccaagccatgtcccctgcacacattggtgctcgatctcctcagcagagggggcatatgtttcatggaaggggtcatataggtccccctccatcttcatttgattcaccaggtgaacgtgcaaggagccgaagaaacgagtcatgtgctaatcaatcggataataaaaggcagtatgagctagacattgagcgtatagtctgcggcgaggattcccggactacattaatgataaagaacatcccaaacaagtacacctctaagatgcttttgaccgctattgatgaaaatcacaagggaacttatgattttatctatcttccaattgactttaagaataaatgcaatgtgggctacgcattcatcaatatgataagtcctgagcatattgttccattctataagatatttcatgggaaaaggtgggagaaattcaatagcgagaaggtagcatcacttgcatatgctagaatccaaggaaaatcatctctaattgcgcacttccaaaattcaagtttgatgaatgaggataaacgctgccgccctatacttttccactcagatggtccaaacgcaggggatcaagaaccttttccaatgggaacacacgtccgttctaggcctgggcgatccagggttttgagctgcgaagaaagtcaccgggacactctgtcatcttctgccaacaattggactccttccaacgggggcggccacgcttcaggctactcaaaggaggctgacccaaccacagcttgaaagctgaagcactaaccacaacatcaacatccaaccttttgacatttgcaatcccagttttcacattaccatcctttcccacctctttttgcttgtggtattttcggagtctgtagctatttagtactttctatgtcgtgggctaccagaggctccctagaggctgcaaattttgtcgctgagtagaagcaagggaacggacggagggtgctcccagtttctcctgagcctatatgcgtgtattaactgaaggccgtggaaggcaaaactcgtggggagctctctgagattttggactgtaaggtgtaacccagcgttgtacagggtttcctagtaagaatgcatgacggggacagccgacactgtattggtgctgttgtatgaaaggcaggctgtgccatgcagcgtcttttggaaaaaaaaaaaaaaaaaaaaacttcgagggggggcccggtccccaatttcgccctataaggaggcggataccaatttacgtggccgcgttttaacaactcgtggactggaaaaaccctggcgttaccaaacttaattgccttggaggaaaatacccctttttgcaacgtgggtaataaaaaaaaaagacgccacccgatgtgccttttctacaagttttggaaccttaattggtggaagggaaaattataagccgcgattatattttttgaaaaaaacccccaaaaatttttttaaaaacccccatttttttatcaaccaaggccgccg

SEQ ID NO: 17934 - DNA, 1204 bp, Triticum aestivum
  Clone ID: PAT_TA_17934
ctcgagcggccccccgaccgactaacctgcgaaggccgctcggccacgccgccacaaaagcacaggcaagggaaagcatggatgccacccctccccacctcacccgcctccctctcctcctcccccctccgcctcgcctcccgcctcgttggcgccgccctccgtcccaccccctcctcctcgtcccgcagccgacgttccctcgcccccacccaaaccgcgccgccgggaaccaccaccagcggcgggttcgcggcgatgagctggctcgggaagctgggggtgggcggcgggggaagcccgcgcgcgtcggaggcgtccgcggcgctggcgcaggggcccgacgaggacaagccggcgcccgggagcgagttcgcgcagttcggggccggctgcttctggggcgtggagctggtgttccagcgcgtgcccggggtcacccgcaccgaggtcggctacagccagggcgccttccacgaccccacctacgaggacgtctgcaccggcgccaccggccacaacgaggtcgttcgcgtccagtacgaccccgccgcctgcaagtacgacgacctcctcgaaaccttctgggcgcgccacgacccgaccacgcccaatcgccaggggggcgacgtcggaacccagtacaggtcagggatctactactacacatcagagcaggagaaggcggcgctcgagtctatggagaagcagcagaaggttcagaaccggaagatagtcactgagatcctccccgcgaagaggttctacaaggcggaggagtaccaccagcagtaccttgcgaagggcggtcgctttggcttcaaacagtccacggagaagggctgcaacgaccccatccgctgctacggatgaacgagcctggtgacctgaccagcatggaagcacacaagcagcaatgttatagcagagaacgctgcctgaataatggtggatgtcagccgaatttcactacagttttcctagcttgtgctgttacatacaaaggattgtaagagagaagaaagttattaccattattccttattagtgttgaattaccattgtaatttagtgttgaattgccatcatacttaggataaattatggcctgggtaataaagctcattttaattacgtatggcccgagtaataaagttcattttaattacaaaaaaaaggttatcagagtttaaaaaaaaaaaaa

SEQ ID NO: 17935 - DNA, 685 bp, Triticum aestivum
  Clone ID: PAT_TA_17935
ggaatctgaacgtggctgagcaccattgtgcaagaaaacacaggtcatgtacgagagcgtgagcacatgctggggagaaaagtcgtcggcacaagcatcatggatgacgcatcgatcttttatatattccgcactccacactaaccacatactgaatcccacggaaccttgaggcacacccacgggagaaaatggccgacacaggagacgagctgaagctgctgggcatgtgggcgagcccgtacgtggtcagggtgcagctcgcactccgcctcaagggcgtgagctacgagtacgtcgaggaggacctcgccaacaagagcgagctcttcctccgctccaacccggttcacaagacggtcccgatcctcatccacaacggcaagcccgtctgcgagtcccaggtcatcctccagtacatcgacgaggccttcgccggcgtcggcccgcccctcctccccgccgacccctacgagcgcgccgtcgcgcgcttctgggccgcctacgtcgaggacaagctgctggcgccgtgggggaaggtgttcagggtgaccaccgacgaggagagggccgagtggacgcggcagacggcggcggccctgggtcctctggaggatggcctcagggagtgctccaaggggaaggggttcttcggcggcgactgcgtcgggtacgtcgacgtcct

SEQ ID NO: 17936 - DNA, 1173 bp, Triticum aestivum
  Clone ID: PAT_TA_17936
ctcgtgccgaattcggcaccagggcacacccacgggagaaaatggcagacacaggagacgagctgaagctgctgggcatgtgggcgagcccgtacgtggtcagggtgcagctcgcactccgcctcaagggcgtgagctacgagtacgtcgaggaggacctcgccaacaagagcacccacggccgaaaatggccaacggaggagacgagctgaagctgctgggcatgtgggcgagcccatacgtggtcagggtgcagctcgcgctccacctcaagggcgtgagctacgagtacgtcgaggaggacctcgccagcaagagcgagctcttcctccgctccaacccggtgcacaagacagtcccgatcctcatccacaacggcaagcccgtctgcgagtcccaggtcatcctccagtacatcgacgaggccttcgccggcgtcggcccgcccctcctccccgctgacccctacgagcgcgccgtcgcgcgattctgggccgcctacgtcgaggacaagctgctggcgccgtgggggaaggtgttcagggtgaagaccgacgaggagagggccgagtggacgaggcagacggcggcggcgctgggtcctctggaggatggcctcagggagtgctccaaggggaagggcttcttcggcggcgactgcgtcgggtacgttgacgtcctgctcggcagcatggtgccgtgggtgcgcgccaccgagaggctctccggcgacaagttaatagacgccggcaaggccccgctgctggcggcatggatggagcgcattagcgagctcgacgccgccaaggcggtcttccaggacgtcgacagggtggttgagtacgccggggcaatacaggcccggctttccgccgcggctgctgcaagcacccaataaagcggcatggtgacatggtgggtgggtggtgcatgcaaggagaaaatggccaagtgtggaattagctggaattactaaaatggccacgtttctgtttctttttctcgaataataatggcgacgtttctcaggaacacatcacatgcaagcttgtgtggggtttttcaaggcacatttacatttacatttctgtccttgtgacagctcctcctctgtttttcaaggcacatttacatttacatttgaaaacttgtgtggtcgttgtgacaaaaaaa

SEQ ID NO: 17937 - DNA, 990 bp, Triticum aestivum
  Clone ID: PAT_TA_17937
cggagcctcagctccgggctccctgcactgcgctctctatgcccaacttgacagctcacattctccccccgaggccgaatcccctttctcccggtgcctcaccaatttcgatcgacggcgcaaggcggccggccggaacccagtcgagtcgagctcctcccggcgcggccttcagcagtgcgcggcgctccagctcgtcttcaccgtccagcccgaagaacatacaggatctgaagtatcaacctctttaatattccttctcccggcagcagcacacttcgtcggttttgtcccgctcggcactctcctcccaggctcccacctagtgtttgccggtggaaaaccaaagatgaagcagagcagcctcgcgtgcgcggccatcggtctgctcgtcgcgttcggatggctcgcagctgctggagactgcagtctttccctcaagttctgcgtcatgagggattgcaagaccaaaggctagttttggaagtggaaaccggactgcttctgctgcctcgtgctgccgggcgttccgtgctggcacacggttaaggagtgccaggcaaattgccgctcctgcaaccccaagtgctaggtaggtcgaatttagctattgttcagtgcaatttgagtttgaaagacatgtgtggagttacatgtatgaggatgactgatagcactcctcaatgcagactcagcagttgtccgttcggattttgtagctaacccacttctgatttctgcgaaaattctcccagtgccgacaagtgctggatgccggctggtccctagttcatgcctccaaataatcgatttgaaacctggtgaagctgcgaaggagggtgatgcttcacattccccgctgatcgaagccaaaatactgttggagcgtgcaagatggtcccggatctgaacagtaactaaatacttaagtcaattgtggagcgatcataaaacccatgatgtagaaatatttgcatttcaaaaaaaaaa

SEQ ID NO: 17938 - DNA, 766 bp, Triticum aestivum
  unsure (1)..(766): unsure at all n locations
  Clone ID: PAT_TA_17938
gccggccgggttgcccaaccccccagacccaccgccacccaccaaaacacggactcctctcgctcgctcgctcgccgccgccggctgctgctccgcgcggccgtcgccgggcgtgcttcagtcagctcgcgcccctcctcgtgagctcgaaatacctcaagatgtcggagcattctgagagcaaggctgaaaagctcatgggcaacatcatggatactattgctgacaggctccccaagcagaagtctgacaatatcatgagcaacatcatggataccatttctgacaagctccctaagcagaggtctggccgtttcgatccaggctcagtcgctgatgtgaagaacaagatgtttggtcgtcagaggtccctccatggagttttgggtggcggaaagtctgctgatgtgttgttatggaggaacaagaagatatcttccagtgttttgggtctcgcaacagctatctgggttttcttcgagtggcttgattaccacttcttgacaatcatttcatttgcccttgttattggaatgggtggnttcagtttgtttggtccaacttctcaaggtcttctgaaataccccgggttaagttgccagaggacctgtttgtgaacattgctgttgccatcggtgcccaagtaaacaagttccttggtttccttcaagatgtgtcttgtgaaagaacttgaagcattttgtattggcaattggtggattgtgngctgcttctgtangctgngagctggttcaacttcctgact

SEQ ID NO: 17939 - DNA, 1308 bp, Triticum aestivum
  Clone ID: PAT_TA_17939
cggccgctcgagcggcgggccgggggcgactgcgttctcctccccccagccccaccccaccccaccaacaggatgctcctctcgctctctcgctcgccgccgccgcctgctccgcctccgcgcgatcgactccgggagcgggagccgcctgctgagctccctcgcgcccctcctcgcgagctcgaaatacctgaagatgtcggaacattctgagagcacggccgagaagctcatgggcaacatcatggataccattgctgacaggctccctaagcagaagtctgacaacatcatgagcaacatcatggataccatttctgacaagctccctaagcagagatctggccggttcgatccaggctcagtcgctgatgtgaagaacaagatgtttggtcgtcagaggtccctccatggagttctgggtggtggaaagtctgctgatgtgttgttatggaggaacaagaagatatcttccagtgttttgggtcttgcaacagctatctgggtcttctttgagtggcttgattaccacttcttgacaatcatttcatttgcccttgttcttggaatggtggttcagtttgtttggtccaacttttcaaggtcttctgaaataccccgggttaagttgccagaggacctgtttgtgaacattgctgttgccatcggtgcccaagtaaacaagttccttggtttccttcaagatgtgtcttgtgaaagaaacttgaagcattttgtattggcaattgttgggttgtggtctgcttctgtagctggtagctggttcaatttcctgactgttatttacattgggtttgtctgcgctcacacgctccctgtgctttacgagaagtacgaggaccaggtcgacgacttcctctacagcatcctgggcctgctccgggagcagtaccagaaactcgacagcggcgtcctgagcaggataccctccaagaggaacaagaagagcgagtagattagattagatcagatggacactcatgatttatcgagtgaaatccctgctattatttattctgcctagtttgtgtgctgcagacctgtagtgtgtctcaactgtcatgtgagagcatctgtgctcaagtgcttcctgaacaggaccagaacgctggtttaaattcaaccgcgacgcatgcgtctgttctcccatttattatgtgggatgctgctcaacaaacttggtgagaccagaagttgtatgcatatattggaaattgagctgaaatccgctgtgctttgtcagaaacggttcccccgcggccaggtcctcacttggatcgcgatttt

SEQ ID NO: 17940 - DNA, 1491 bp, Triticum aestivum
  Clone ID: PAT_TA_17940
gtgacggtggccgaggcggtcacctattggtccctcttcatgctcgacttccacgacctgttcctgccctacgtgcacaagttccgcgccctgcagcgcaccaccatgtacggctcccgcaccatcatgttcctcaccgacgacggcacgctgcgcctcctcgccatcgagctcacccggccggcctcggcgacgatgccgcagtggaggcaggtgttcacctcgtccactgacaccaccaagtcctggctgtggcggatggccaagtcccacgtccgcgcccacgacgccggccaccacgagctcgtcacccactggctgcgcacgcactgcgccgtcgagccctacatcctcgcggccaacaggcagctcagcgagatgcaccccatctaccagctgctgcgcccgcacttccgctacaccatgcggatcaacgcgctcgcgcgctccgccctcatcaacggcggcggcatcatcgagctcaccttctccccgcagaggtacgccatggagctcagctccgtcgcgtacgacaagctctggcgcttcgacatggaggccctccccgccgacctcgtccgcaggggcatggcggaggaggaccccacggcggagcacggcctcaagctcgccatcaaagactacccattcgccaacgacgggctgctcatctgggacgccatcaaggggtgggttcaggcgtacgtttcccgctactacccgaccgccgccagcgtctcgggcgacgcggagctgcaggccttctggacggaggtgcgcacagagggacacggagacaagaaggacgcgccgtggtggcctaagctggacacgccggagagcctcgcgcacacgctcaccaccatcatctgggtcgcggcggcgcaccacgcggccgtcaacttcgggcagtacgacttcggcggctacttcccgaaccgcccctccatcgcgcgcaccaacatgccggtggaggagcccgtggacgccgccgccttcgagaaattcctggacaacccggaccaggcgctccgggaatgcttcccgtcgcaggtgcaggcaacgctggtgatggcggtgctggacgtgctgtccagccactcccccgacgaggagtacctcggagggatggagactgccccgtggggcgaggacaccacggtgcgggcggcgtacctgaggttcaacgagcagcttaaggcggtggaggggatcatcgacggaaggaacaagaacaggaagctcaagaaccggtgcggcgccggcatcgtgccgtaccagctcatgaaaccattctcgcagcccggcgtcacgggcaaaggcatccccaacagcacctccatctgatcaaacagagctccaacaaaaacgatttccttgaatctagcagacttgttttccattatttaatgtatttatttataagcttgacacttttttatttgcacgtgtatatgtatatccattctaataaatcttattgatctcatt

SEQ ID NO: 17941 - DNA, 1101 bp, Triticum aestivum
  Clone ID: PAT_TA_17941
ttttgacaacacgcggttggatggtttgataggctcctaacggttcatgtatcatcacttactgacatcccaaacatatgcagaaatatgccaatatggcctagacctacaactatctcctgctatggatgtttggctgaaccgaataaattaatgccatatgtgctgaacaattttataacatgtccttgtacaagcttgttgtgacacttttttttttgtcctaagttccaatcttacagagagatgcctcctagagttactaaagtacattcttctagagctcatgataataatagtcatgttgggactcgtgtaaggaagtaacaaaaacatattaagaccttacttgcattccaaacatggctttacagattgcttgacatcatcaataattttgtccaaataataagcttgggcgtgcaaaagcagaaaacttaccgattgaccgtgacattgccagaataccagagacacgataaccattccagtcaatgacctttccacctgcggcctcaatcctggcacgctcatctttcctatcaggtttgtgatcgacggacagagcaatgggctcctttccacggcagagcaccacgcgtgaatctccacaattcgcagttatgacatgagaagagcagacaatggcaacaacggcggtggaacccacgttatcagcggcaataggctcaggacggatctccctggtgccattggaaaacctgctcgctttccccgacacctcgtcgtctaccttctggaaacaatcaccgaaaaccttctcccatggttctttcacgtcgagctcccctacttccgataatctgatgtatggggtgcgtgttggcgtgtttctgtatacccccttagccttttggttttgggctgttcacacttgattctcatcaggttcagaacagccatgtaaatgtagtggtgtctgcataataattgagccttgtaaaggactgagcagctgataggacagcccgaagctactcgcgtgcctccgcgccggctcgccggcgttgcccgcctcggcgccgcacgcgtcccccgtctccccggcccgcccgcgtgccgcccgcgtgctgatgaaaa

SEQ ID NO: 17942 - DNA, 928 bp, Triticum aestivum
  Clone ID: PAT_TA_17942
tccccccattacctaatctgcctttatcgtcagaatccagacagtgcagcagatatgtcatccgacagtattcagacaggcgcccacacaatctgactccgccaagtgcgcctcaggtctgaccgatcctgcaaagctcatcctcacgccctatagcaattaagttcgacataatacgagatgcagcgccgactccccaagaggctagcgcccgcttgcagcgacaactgacgcgatgccgccgccttccgtccggtgctccccgccttcgatctcgtgcacgcgcccccggcccgcgttcgtatcgaccacccacctgattctggatgtcctcctacctcgggagcacgttgttcccgtggattcggctgtgggcagtgtacagatttgttgtcggggtgggcgaggagccgcgcaaggtaccccatggcgccaccagcaagcacggctcgcacgccatcgtctacgccgcaagcgaagctccccgccgcggccgccgcatggacgaggcggacggtgacgggccgggctcggccagcgccccgacggccccgacactatgcccaggcggaggtagaggagctcccccaccccgcgtcctcctcctcctcctggtccgccgacgacgcttgggtcctcggtcgccaacttggccgcgagctcctccagccgcatccccatgtataaatgcgcggatgtgctccccggcactggccggcggacggcgcggcgccgaatcgaccgccgcacggggtggggtgcctcctcgtgtcatagatcgggaggcgagggagaaaaaggagcttgtaataaattgttgagcagcctcagctcaaccttgtataatgtttagtgctactggatttctgtatcaaggatttgtctactagtaaggaagattttcctatactggtgccggataaaaggg

SEQ ID NO: 17943 - DNA, 1263 bp, Triticum aestivum
  Clone ID: PAT_TA_17943
gctcggggcccacgcgtcccgcttccgcaccttcgacactcaactatctaccacccagcgacctccggtcctccaatcggaagcaccaaccatggcggcggcggcggcggcggcggcgaagtagcgccgtccatgctgtcgtcggacttcgccaacctcgcctcggaggccgagcgcatggtccgcctcggcgccgactggctccacatgacgtcatggatgggcactttgttcctatttaactattggagctccagtgattgagagctgagaagcacacaaagcatattggactgccatctcatgctcataaaaccttaagattatgttggagcatctggcggtcgctgtatcggaagctccaactatggaggcgggggagaagatagcgccgtccatgctctcgtcggacttcgccaacctcgcctcggaggccgagcgcatggtccgcctcggcgccgactggctccacatggacgtcatggatgggcacttcgttcctaatttaactattggagctccagtgattgagagcttgaggaagcacacaaaggcatatttggactgccatctcatggtcacaaatccttccgattatgtagaggcatttggaaaagctggtgcctcaggattcacattccatatagaagtagcgagggataactggaaagagctcacccaaagcattaaagcaaagggcatgcggcctggtgtatcattgaagcctggtactcctgtggaggatgtttttcccctggtggaagcagaaacccctgtagagttggttctcgtgatgacggtcgagcctggctttggtggccagaagttcatgccggagatgatggataaggtgcgtacgctgaggaagaagtacccgtccctcgacattgaggtcgacggcggcctgggtccttccaccatcgacgccgccgcgtcggccggcgccaactgcatcgtcgccgggagctccgtgttcggcgcgcccgaccccggagaggtcatctcggcgctgcgcaagagcgtggaggcgtcgcagatcaagagctgatcatctgtagctctgcgcgctcggacggacgcatgtttctgctgtaaactagaaccactctgcacgaccgacgctcggtcagcagttttgcgattccgaataaaatgtgcccttggctttcacgcagtttgggtcttgtagagatggtggtaacagtgacatgaaaggcatagtactactaccgtgcgatatttcaaaggttcaaaaaaaaaaaa

SEQ ID NO: 17944 - DNA, 860 bp, Triticum aestivum
  unsure (1)..(860): unsure at all n locations
  Clone ID: PAT_TA_17944
cggacgcgtgggaagggataggacatgccatcgtggaggagcttgctaggtttggggcgagggtgcacacctgctcccggaacacggaggagctggaggagtgccgccggcgatgggaggagaagaacctccaggtcaccgtctctgtctgtgatgtgtccataggtgccgacagggagaggcttatggaaacggtccgacaaaccttcgactccaagctcgacatactaggagtcaaccttccatctcagccaactcgcacaccctcttctcctacacgcttctattgccggaggaggcaccatcatcaacatgtcctctattggaggctcaatcggctttgcaggctacacaatttatgctaccaccaaaggtgcaatacaccagcttacgaggagtttggccactgagtggggccccgacaagattcgtgtgaatgccatcgcccccagttttatcacaaccgatatgattaaaggtggattgataggtacccgagttcatggaagcaaggaaaactcaaanaccccgttgggacggagtggcaagccggtggagatcgcctcggcagtgtcatttttgtgtatgccggcagcttcttacatcaccggtcaagtcatttgcattgatggtggtcgaaccattagttcttagccatcaacagcttcatcgccgctaaataatttcatcattacttgggtgaataattgtataagtgaacaaaagttagtcttgaggtttcaggctagtaccatagtatctgagtgacattggtatctatccttgcacgcaacaccccacttgtacaaaaaatattcatattgttgacatcgtgaatatgaaatttattcctatttgtc

SEQ ID NO: 17945 - DNA, 1216 bp, Triticum aestivum
  Clone ID: PAT_TA_17945
ggccgggccggacagactatcctctcacccaagccagccacagaggagaagcgagagggttagcatggcggttgactatgggagcagggaggagaggtggagcctggccggcaccaccgcgctcgtcaccggcggtagcaaagggattgggcatgccatcgtggaagagcttgccgggtttggggcgagggtgcacacctgctcccggaatggggcggagctagaggagtgccgtcgacggtgggaggagaagaacctgcaggtcaacgcctccgtctgtgatgtttccatacgtgccgacagggagaagcttatggaaacagtccgagaaactttcaatggcaagcttgacatactatgccggctgtgggggcgctataggccttgcctgtaagggtgtgttgatggttgaggtgaacaatgcagggcaattgctcttcaagcccactactgaatgtacagtgaaggaatactcaaatctgctaaccaccaacttggagtcgagcttccatctcagccagctcgcacaccctcttctcatacacgcttctattgccggaggaggcagcatcatcaacatgtcctccattggaggctcaatcggctatgcaggctccgcaatttatgctaccacaaaaggtgcaatgaaccaacttataaggagtttggccaccgagtggggctcgaaaagattcgtgtgaatggcatcgccccaggttttgtcacaaccgatatgcttaaagatattgataccgagtacatgaagaaagagcacttgaagaccccgctgggacggagcggcaagccggtggagatcgccacagcagtgtcattcctatgcatgccggcagcttcttttatcaccggccaagtcatttgcatcgatggtggtcgaactattagttcttaactatcaattcccccgaatcaggactggaccgctttataagctcttgattacttggaaaatacatccataggagagtggagcaaaaataaaaactaagtaaattatgccaactaataagtggcatcattgtggacaccttggcacatttcacgggacaaagtacgtatgaatgtgcaaatttgggcctcatttgtactgaatatatgagtcatgctggttttggtacgaatatggatggggggctactattcagttagagttgtaaaatatattattataagcttaagatgagagcatccttcgctt

SEQ ID NO: 17946 - DNA, 1131 bp, Triticum aestivum
  Clone ID: PAT_TA_17946
caacggccgggccggatctcatcggacccacaggggagaagcgagagcgataacatggcggttgactacgggagcagggaggagaggtggagcctggccggcaccaccgcgctcgtcaccggcggtagcaaagggatagggcatgtcatcgtggaggagtgctggtcgtttggggcgagggtgcacacctgctcccggaatggggcggagctattgaggagtgccgtcgacggtggggggagaagaacctgcaggtcaccgtctccgtctgtgatgtttccatacgtgccgacagggagaagcttatggaaacagtccgagaaactttcaatggcaagcttgacatactagtgaacaatgcagggcaattgctcttcaagcccactactgaatgtacagtggaggaatactcaaatctgttgaccaccaacttggagtcgagcttccatctcagccagctcgcacaccctcttctcatacacgcttctattgccggaggaggcagcatcatcaacatgtcctccattggaggctcaattggctatgcaggctccgcaatttatgctaccacaaaaggtgcaatgaaccaacttacaaggagtttggccaccgagtgggcctctgacaagattcgtgtgaatggcatcgccccaggatttgtcacaaccgacatgcttaaagatatagatacagagtacgtgaaggaagagcactcgaagaccccattgggacggagcggcaagccggtggagatagcctcggcagtgtcatttttgtgtatgccggcagcgtctttcatcaccggccagatcatttgcatcgatggtggtcgaaccattagtgcttagccatcccccccgttccataagttattgaatatttggcgaatccccccgtggaagagtggaataataataaacaaagatcgttaaataaataatgcccccaaatacctcgccccatggtggacccctttcaagaaatgtcccgagatagcatatgtgtacgtgcgcaaatttctgcctagtctttgtgctggccatatgtaatggtgattctggttagcaacttaattaagatggattgtaatgtcttttttgttgaatgaataagattctaattcccggcccc

SEQ ID NO: 17947 - DNA, 1173 bp, Triticum aestivum
  Clone ID: PAT_TA_17947
ttttttttttttttttttttttgcgcatcatgctggatatatgattgataagagtattttgtccaaaacaggctgatacatatatataccgtgtgacctggaagttggatgattgaccaaagtttgtttccagacatatatataccgcatggcgtggctttgacctttttcaatcaccaacttgcagaaaaaccgacggtgggagtaaaaatgtacatcttgcagtcgtgcacggcgacttgggctccaaaagttcctaccacgttcgccgatagagtttcatgcttccacagatctctaacagaataggcagatgaaccatcaaggcctacagctggcaatgacattgtgatattaaccgtctccgaacaacgattccataaagcaacagccaaacggttgccagagagggggccagcccacacctcacggcatccaccttttccctgacctaaaattcttcttccttgaactccaagaggatcttggtttacttgaattacttctttgttgctcaatatttcaattgtttctgaagtcatatttctgacatcacaaccaattaagagaggcgccttcatgagtgcccagatgctgaaatgtgcacggtactctgcaaaggtcatgccaccatttccaacttccaacatgtccgggtcattccatccaccgggtccagcatatgatgcccacttgttgttcttatcagcaatgtcagtcatgcttttccatgtatcctgtatgtcatctgttgtacgccaactgtttccaacttttccagcccataaagctggatcatcctggccccattcacatagagagtagaatatctggcgcccagttgaatttagagcatcacgcattggaggatacctttcctttggtggtattcctagattgtaacagttgtcatactttagatagtcaacaccccatgaagcaaaaagggcagcatcatcgttttcgtgatggagtgatcctggtcgaacttgacaagtagataccccagcgtcagagtagataccaagttttagaccttttccgcgcacatagtccgcaagtgatttgattccagaagggaaagtcttcggatcaggtagcaattgacccttatttccccgtttcacataggaccaacagtcgtcgatgtttacgtagttgcccacgcgtccg

SEQ ID NO: 17948 - DNA, 1753 bp, Triticum aestivum
  Clone ID: PAT_TA_17948
gcacgaggcggcgctccaccccccgcgcccgcccccccgagacagcacaacttcctcctcctcaccagtcatcgtcggatccacccccgccccgccgcccccctcccctccccgcttcccgactcccctgttctcgccatggaggggctcatcaagggtttggccaaagcggcgatcgacgccttggacggcggcgaatgaccggcgggagcggggcgaagaccgcgacgaggcgccgaggaggcaccgccccgcgcgggacgccgaggcgggggaggaggaggagggctgcgagcagcgggaccgctcgacgtgggccgaggtggtctccgagaagaagggccgcgagccggaggagaagcgccggggtcctcggccctccaagggggaggactgggggggggccgggggccgggagcggccgcagcagcagcatccatctgcgcatggtggatctcacagccagtaccctcacgaggacaggagtgatggtggtagccgtagacctggtggtagcgcgctaccgcacaagcagccgccagcacacaggggacaacagcagaatggagaagaatcgaatgatgaaggggagaaaaaacagcatggaagaccagaacagtgtgaagcccacaacagtgtgaagcatggaacgcatacaaaaggccaccatctgaacaagggtactctgaagattttggtcagatccaccatggcttaaatgtagagcctaccagggaggggctcaatagcttgacggaagcatgtagccggttgtgggagcttgatatgaaccgtcttgttcctggtaaggactacagaattgaatgtggagagggaaagtgagtttatcactgaaaacctatgtcatctgataaccgatgatgctggctaggcgatgatgtgctctcgcttctgagcgcttcttgacaatgcgcgcccccaccaagggtacaaagaagttgttactcagcaggacaagctcgtcagcacagcatttattgaagagattgcccggacggcgccgattaagtacttgcaccggttatttacgtgctgaagggagtcggcatcccaaggactatgatgacttcaaaggcaatgctgacagccctttggatttaattttgtatggaatgatgttggcaactcgtggctgctcttcgtgcatttgcggatgttgtttagttggttgtggttaaatggaacaagagacaaggggagaccgaggtctcaggattccataactggattcagttttatctggaagaagccaagggaaatgtggactaccaaggctacatattcccaagacggcgtggggaatcgcctgattcggagacacagttactgaccgttcagtttgagtggcatggtgtgctgaaatcagtatcaagctctttgagtggtgttagccctcagttcgagctggcactgtacacactgtgcgtcgttatgggcggcggcggataacccggcccataccccgtcatcctcaagggccgtcgtgtgcgtccctacgagattggatcagtctttcccattgctgagaactgatttgtgtgatgactcatgacctgcttctgctgggcttctgctcgtcggtgtttcttttcgcttcacttttctcatctcttcactgtagtttacgctgttgatcaacggttcactccgtcggttcgctccctcacttctttccatcacttaataccactataacaaaaaaaaaaaaactcgagaaaaaaaaaaaaaaaaa

SEQ ID NO: 17949 - DNA, 768 bp, Triticum aestivum
  unsure (1)..(768): unsure at all n locations
  Clone ID: PAT_TA_17949
caccctcgtaccaggacgccgacctccgcctcgacgcgatccgcgtcgtcgaggacgccatctaccgcccccaccccttcgcgcgcgggtccatacccttcgacgccgtcgtcgaggtcgagggccacctccacctcttcttcctcagcgtccccgtcaaggggagaatagcatgtgtggttcatgttaatccacacgatcagaccatcgtacaccaggactgctatccaaagtgagttggtgacggcctcaagccatcttcgcgtgtgaatctattgtttcaaacctcgcttggagtgctggtcgttgttgtatgcttaattggtggtgacagatgtgcacgtgatatttctcatgtacaatatatataaggggagaataggttgtgtggtattctttggcacgcccaaataccgtactttaaatccaagggaataccaaacagagttggttaacggcctcgagctatcttcgcgcatgaatctattgtttcagacctcgcctggagtgctggtggttgttgtatacttaatcggtggtgatggatgtgcacgtggtgatatttctcatgtactactatatatatactggtagatggggtgtttgtaaattctttggcatacccaaataccgtagtttaaatccgtggtcatatcaagagatctctaatatcaatcagttccgtgacaagtgttaataacagtgttttacattgtcattctaaatgctggttttcaaaccttggaaannnnnnnnnnnnnnnnnnnn

SEQ ID NO: 17950 - DNA, 2081 bp, Triticum aestivum
  Clone ID: PAT_TA_17950
aaatcattagcccaaatcatagtaatgaatttggaagtccatgcagcaccctttcaggtgtcgtttctgatactgtagtggcatactcggattctttcaagatagagctcgggcgtaatgatcttgagaaggttgctatttccgagagggcatgtatgtttctgaagtggatgtgggagtgcaacaatcatcagtccacatgtgccatgaaatatggaaagaaacggtgttctgatttgatacatggttgtgattattgctatcagatttatttagctgaagaaatgcactgttcgtcttgccacaagacattcaaatccattcacagtctctcggaacatacatcacaatgtgaggagaaacggagaaccgatcccaattggaagatacaattatcagacgattctgttcccataagaccgagattgctgaagctgctgttagctaccgttgaggcctcggttccagcagaagctctccaaccattttggacagatggatatcgaaaatcatgggctgttaagttgtttttctacatcatccaacgaagaaattttccagctgttaactgtgctggaagttgcactaaaaagggattacttgtcatctaactttgaaacgactgctgagttgcttaattcaaatacactagattttgctggtcggaattctattgcatgttctggatctgctgctgtacttccatgggtacccagcactgctgctgctgttacattacggctgttagaccttgattcttccctctcgtacacgcttgatcaaaaggcaggattaaataaagagcgagaagctggggatttcattaagggtccttcgagatatactgctgttaagaacaaacaagaaatggggctggtgggagctcctggctttgatcatcatgttggagcgcagctgactcccagcaatggtcttagaggccgtggacgaggaggtcgagggcgtggcaggggaggtagatccctcagtcgtggtggcagggtcccaagaggtgttggcagctctcccaggattgagttcagggatgacaacaatgtgtcttataaggaaaccacagataagcaagctggccgaggccgtgggcgtgggcgtggtcgcggccgtgggcgcgggcgaggacgtggacgtggacgtggcagtatcactgtaagtgacagtggcagtggcagtgtccgaggtcgtggaagaggacggggacgaggacttcgaactgttaggcctaggcagccagttgagcttggagccagatcaattccaaaggcaaacttgttgggaacctttggcatgctaagtaatgcaaagcctatgactctgcattctccacagagctctggtgcggaagagtggggcttggatagacgagcatatgccgaggatgacgaggacaactcagtatctcaatcagatgaatcagaaggggacgaagaaaatggcgagcccatgaacgaggattacgatgagcagcttccagattattcaagggacaattctggatccagcccccgtcagatgatggattcggagtcagaagataatgatgaatacgatgaggagggcgaggaggacggggccgactatgatgctgagcaacctatggacgaggacaacgatgatgctgagatgagcgaggatgacgaacttggtgatgacggcgacgatgatgacggtggtggtagtcagggtggagcggggaacgccgacgacgacgacgcagcatcctattcttcagagtatagtgaataagagatgtcaggaagaagcgggtccaggctgccgagcagtgatgactgagctacagtttcgccttcagtcagaaggcccaaatgctgaaagaagtgtcgacgaggatgaaataggttttatatttgattgctgggacgcaagtttggttgctcccgctggacttgaggtttgtacatactttgtgttagttgcttacagactagatgttcccagtgtatacaagattaccgtcggttatagaagtggtactttctgcttcattcctgttaaaaaaaaaaaacctgcccgggcggccgctcgaaatcactagtgaattc

SEQ ID NO: 17951 - DNA, 852 bp, Triticum aestivum
  unsure (1)..(852): unsure at all n locations
  Clone ID: PAT_TA_17951
cggaattttgggcggctcacgaccgacatcggctccggtacaacgaggatcgcaagcagacacaatgccgatcaggtacaaccagacgggttccaacaaccatttccgcaaccggtggcaacgccgggttcgaacccactcggaccagcccggcaagaagtcttgcccccgcacagctcgtcaggccaaggctcgttgtccgatgccccgacctgtcgtacaaccgtcgtgtccgctccggccgtggtttcaccctggctgaccgcagcgtggccggtatccccaaggctttcgctcccaccatcggcattgccgtcgacttccgccgccagaacctcagcgaggagtcccttgccgccaacgtcgcccgtctcaaggcttaccaggagcgcttgatcctccttccccgccgatctaacgcccccaagaagggtgacaccaagaccgacgtctccaaggtcgagaaggccgctcaaatcgccgctgccttccctatcgccgccaccgatctcgccgtcaaggagatctccaagagcgacatgccctccaacatcgaggctggcgcttaccgaactctccgtgtcgctcgtgccaacgcccgatacgagggtgcccgccagaagcgtgtccgggatgctgccgaggccgagtcggccaagaaataaacttgcaaaaagggaactggtgtttgagggttttgctctttatgtcattgaggcatgggcaacgtcggttcgaggctctgatgaaaggcttggcctgggttggaggaaggatactctaggtccagctcaagaaatttactgcatgatccccggnnnnnnnnnnnnnnnnnnnnnnnnnnnnnnnnnn

SEQ ID NO: 17952 - DNA, 862 bp, Triticum aestivum
  Clone ID: PAT_TA_17952
ggccgggccgggaatttgtactttatttgttgaattttatttcgaacatctctcttctttcctccccatcctctccacagcctgttctacaggtcttcttcattcgccatggcctctacacacagctccaagcagcgccttgcgctcgctatctgcgatttcctctccgcctcaacaaacgatggcactcttaccgccgacgacaaggactccatcgatgttgccatcaactgtatcgccgagtcgttcaaggtcgacccctccgatacctctgccgtctcagcagctattggatctcagaacctccttcagatctactccgtcttcgagaaggcccgcgctgacaagcccgctgccgcccctactcccgcacccgtcgtgcttaccgaggagcagaagaaggaggccgaggctttgaagtcaaagggtaacgctgccatggcccagaaggactacagcgccgccatcaacttctacacccaggctctagccatcaacgccagcaacgccgtttacctttccaaccgtgctgccgctcactccgccaacaaggaccacgcctccgctcgctccgatgctgagtccgctgtctccatagaccccgcttacacaaaggcttggtctcgtcttggccttgcccgattcgctctcggtgatgctcgtggtgctatggaggcctacgaccgtggaattcagcacgagggcaacggtggttctgatgccatgaagaagggttacgagacggctaagcgccgcgttcaggagatggaggccgaggaggactcccttccccgtgcttcccctagcgctggcaatgatgctaacgccggcggaatgcccgatctcggcagccttgccagca

SEQ ID NO: 17953 - DNA, 626 bp, Triticum aestivum
  Clone ID: PAT_TA_17953
gtatcatcttctgctggaatttggaccatgctaattgcgtagagccactctcctcccctataaaatggtcgccagtagctgccgggtccggaacagaaacccacacacggatcagcagcagagaacagcccaggttttcataagccgaacaatatagcgagctgggagcgaaaagtgagaaggcaaaaattgcgcaatagctctgcctagctgcagccatgggattctgctgtgggccttcggatgtcaaggtgcttcccaagaacacctcttcctccccctcccctaaagattccggcgacagtggaaagaagaagcagcagcaaggcatgaagaaagagcagggaaaggagaagaagaggagcaaccttgaccgggccgtgctgaggacgcccctcttgcctttccattctcgccccggtcaagtttggaacttaggatatgttggttcttccgttgaaatttgagatttgtagtgttgccacgtgtattgtttatctatcgattggttggctgttttcgatgagccaaagtgcatgtgtttcttgttaattaacttgatattatattcatttccattgggataaaaaaaaaaaaaaagaaaaaaaaaaaaaaaaaggccccta

SEQ ID NO: 17954 - DNA, 1431 bp, Triticum aestivum
  unsure (1)..(1431): unsure at all n locations
  Clone ID: PAT_TA_17954
agttcagcactctacttcagtggattctcatctgggcgcggaacgcgacctagcacctagccaacatagaaccacagaaacctggcaattctgtgagcattggggaggaggacgcccacggaggggagagtcgcaggatccatggagcgtatcggcgacaaggtgatcagcagggccgagatcacggacgccgcgtcggccacgttcgcggactccactgtgatccccgacaggtatgcccggccagatgaggtcagggacggggtcgtcgtcggcagcgacgagagctatgagctaccggttgtagacatggcgaggctgcttcacccggagttgtcggaagccgagattgccaagcttggctctgcgtgtcgagactggggcttcttccagttaacaaaccacggagttgatgaaacagttgtacaagatatgaaagataacactctgcagttctttggcttgccgctggagaagaagaaggcagtggccatccaagccaatggcttcgaagggtttggacaccactacaacagagcgtcgtctgaaaagttggactgggcagagagcctaatcctcgtgacgcagcaacacgagcaaaggaacattcagttttggcctgccaatccgtcgacatttagggatgcacttgacaagtactcagtggagatgtcaaatctcacaagccgccttacggtgttcatggcgagtgacctcggcgttgagcaggaggccctcatgggaaccttccagggcaagacgcagagtgttgccttccactactaccctccgtgccgccacccggacaaggtgatcggtatcacgccgcaccatgacggcctcggcctgacgctgctgctgcacgtggatgacacccccggcgtgcacgtgaggaaaaacggcaggtggtacccgctgaacccgctgccaggcgccttcgtcatcaacgtcggcgacattctccagatcctcaccaatggcacgtacaagagcgccgagcacagggtgctgccggacgtcgagaaaggcgggccactgtggtgatgtttcagaatgcttgtgttgccggaatggtgaagccgctcccggagctaggcgaggcgacgtacaaggccatcgaccatgttgagtatgtcaaggggaacttcagcgcgctggctgaagggacaaggttcgtggatagtctcaagatcatgtaaccaaacctaggtcgagaagggaatctaaagaagttactgatggagtactttctgaatcagaaccacgacgagtaaatcggagcggagggagtacgttctgaatctttgtgtcgtatatgtatctggtggcaattacaaaccagaacataaaataaataaactcagcgggactgattnttctagatcaatctgctaggatttattgttattgaaaattggtatgtttacaggg

SEQ ID NO: 17955 - DNA, 1018 bp, Triticum aestivum
  unsure (1)..(1018): unsure at all n locations
  Clone ID: PAT_TA_17955
gcacggnaatagcagttacagtcaaattggcagtgaagaatgcctaatgaggatgccaccgaggaagatgaagaggtagaaattagcatgtgggaggctattgcgtggcttgcagtgttaacgatatggatttctgtcctttctgagtacctggttaatgccattgagggagcatctgattcattgcacctaccagtggcttttatcagtgttattttgcttcctatcgtgggcaatgcagcagaacatgctagcgcaataatgtttgcgatgaaagataagctcgacataacaataggtgttgcaattggatcatcaacgcagatatcaatgtttgtgattccattttgtgttgtcgttggttggatgatggggcaaaagatggacttgaatttccaactatttgagacagcaactctcttcataacagtgcttgtcgtggcatttatgctacaggatggcattgcaaactatctgaaaggacttatgctggtcctgtgttatctaatagttgctgccagtttctttgtccatgtcgatccacaagccagcgatgatgattgacgccaccaccaacgacgaacactgtaattactgtaccaaaatacccccgatgactcgctaatcttattccgacaagccgcccccgctcctcctctagcgaagcccagcctgtccgtagcagcatcctgaccgaaacgatgacacggcaacaccagatcatccgtgcgtcgggcccttcatagctaaactgctgcgggggttaatccgtttgaagattctctccgcgaattaagtgaacctttgaggaggggcgccattggtagccaccatcttaatgtatacggacgcgtcaacccccccccccctccgtctgctgctcgattcgttgtattgaagggtgaaagattaaaaggccttttaatcctctgtttttttcctacgggtggttgttggtcaacaattcatatcattatcagtcatcagaccaatactgtgaatattgagcagacaattt

SEQ ID NO: 17956 - DNA, 648 bp, Triticum aestivum
  Clone ID: PAT_TA_17956
agccccttctcgtgtcctctctctacctctgagccgttgcatcgcagccccagtctgctcttcttcctcccctgccaaactccttgcagtaccgtggttaatcagtgtacagcaatggctgtggcctccatggttcacgcaccatctctgctggcagtccaggccctccgcggacagaagaatgctgccagcgctaggtgctcaccaagagcgacggctttcagagtccgggcagcgaagcttcctgccggagtccaggtgccaaggacgcagcctaaactgagcgagccgttcctggggttcaccaagaccgcggaggtatggaactccagggcctgcatgatgggcctcatcggaaccttcatcgtggagctgatattgaacaaaggtgttctcgagataatcggtttcgaagtgggaaaaggcctcgatattccattgtaatctgctctcccatccctgtatatgagatgttgatcctcgggagataagagccacaagaaaacgttaccaatggctatgctatgcatcatagtaaatatgtgatggagctgtgagcattccattgcgcttgctatttttcattctacactcgtcttaccgaagtgatcgacagagtgatcttcaacactcaacaatattctgctg

SEQ ID NO: 17957 - DNA, 704 bp, Triticum aestivum
  Clone ID: PAT_TA_17957
gcagcccccgcctgctcctcttcctccccgtccccactctctccgtggcccagtgtattcttcgagcagcaatggctgtggcctccccgtgcttcacgcaccctctctcctagcagtccagaccttccgcggacagaagaatgctgcctctaaccgctccccgagagcggcggctttcagagtccgggcagcgaagcttccggccggagtccaggtgccaagggcgcagcccaagctgagtgagccgttcctggggttcaccaagaccgcggaggtgtggaactccagggcctgcatgatgggcctcatcgggaccttcatcgtggagctgatattgaacaaaggcgttctggagataatcggttttgaagtgggaaaaggcctcgatattccattgtaatctgatctcccctccctgtcctatgagatggtgatgctcgggagataagagccacatgaaaattaacgtcgtagccaccaatacctatgctctgcatcatagtaaatatataaacaagctctaagcattccgttgcacttgctatttttcattttacactcgtcttaccaaagtcatcgacagagtgatcttcaacactcgacaatataaaacagagaaaaaaaatagttcgtaccgataatacgaaaacttgtttgttgttttgaaaagaaaactgaagttgtccatgtttaaaaaaaaaaaa

SEQ ID NO: 17958 - DNA, 2259 bp, Triticum aestivum
  unsure (1)..(2259): unsure at all n locations
  Clone ID: PAT_TA_17958
gggcgtgttnatgagtgtaattggaggaacaaaaggaaaatacttggtgtcatgatgaactggctcgcgcggggccgagcacaggcgcgtcttcggctcccgcagggcatgccttctggcctggggcccctctgggggcgccagcgcgcggctatgctgccgcccccggtggaggccgccctgcaggctgtgcccgtgcgtcctcctccttcaggtgctccgtctgtggcgatgcacgatggtgccaccgatgggcggccggcggggtcggaggcggtaatgcgggattggaggcattccacttctgctgggaccttgcaaggtgctcaagggtgagtgcacagtctgaagcagcaaaggctattgccaacctatcggtgaatgcaaaggttgcaaaggtggttgcagatgaaggaggtatcgccattttcactaatttggctaagtcgacgaatcgacttgttgctgaagaagctgctggtggcctttggaatctctccgtgggtgaggagcacaaggcggctattgcggcagctggtggtataaaggctttggttgatcttatatttcgttggcctgctgggactgatggagttcttgaacgtgctgctggtgcgcttgcaaacctagctgctgatgacaagtgcagcttggaagttgcaaaggctggtggtgtccatgctttggttacacttgctcgatcatgtaaacttgagggcgtcctagaacaggcggcaagggctctagccaacttagctgcacatggagataacaacaacaataatgcggctgtaggtcaggaagcaggggctcttgaggcattagtgcaactaacatgttctcaaaacgagggtgtaaggcaagaggctgctggtgctttgtggaacctatcatttgatgataggaatcgtgaagctattgctgctgcggggggtgttgaagcattggtttcacttgcacaacaatgtctgaatgcttcggaaggccttcaggagagagctgctggcgcattatggggactatctgtctcagaatcgaacagcatcgcaattggacaggagggtggcgttgcaccattgctcacaatggcacagtcagaggttgaagatgttcatgagacagctgcaggggcattgtggaatcttgctttctattccagcaatgctcaccgtatagttgaagaaggtggggtgcctatacttgtgcacctttgctcatcatcagggtcaaagatggctcggttcatgtctgcgctagcccttgcctatatgtttgatggaagaatggatgaggccgccattgttgggacatcatctgagggcagttccaaaggtgttaacgtcgagggagctagaagaatggctttgaagcatatagagatctttgtgttgacgttttcagatccacaggtgttctctatggctgcagcttcctcagcaccagcagcgctatctcaggttgccgaagcagtgttcatacaagaagctggacacctgagatgcagtggtgctgagataggtagatttattgccatgcttcggaatcctacgccagttcttcgtgcgtgtgctgcatttgcccttcttcagttctcaatcccgggaggtcgacatgcaacacaccatgcggaccttctgcaaaatgtaggagcggctcgggtcttgcgtgcagcggcggcagcaacatcagcttccattgaggccaaagtgttcgccagaattgtccttaggaatctggaacaccatcaggcagggacttcaacctgaaaacacaatggcgagcacaagcgcgactaattctccaacagggtatgacttctaacctttggccccagaatggatgcaaactcgcggttaagttgtcgccggcatttgaagctgccgcgcaagctgtgaccttggaacttccaccttgaggagaactgtcagaagagatgaatgaacgttcaaccggcagctgttgagtgtgcaattttcctgttgtttgtctgatgtgtaaaagtaacttaaaaagtgttagcgttagcatcggcaggacgtagagaacttttatggtatatagaaagttaagagtgtttgttatctgttgatttaatttaacaaggtgagcggcagcgggtgacattgttaggctgctccacctgttgcatacatgtaaaactttgtagatgtatactgctttgttatatgaacgtcccgtggatatgtgatcctgtcctttgtgcaaacccccaccagctcgtgccgaattcggcacgag

SEQ ID NO: 17959 - DNA, 1024 bp, Triticum aestivum
  Clone ID: PAT_TA_17959
ccgcctccgcgacttccgcccttacggcgacattccttcctggctccgttggtactctcctcgcccaggtcctggtagaaatattgactcggttacccccccacgactgggtccaaacaccatgtgtcggcaagcactgggcaagcatgttccgaggtgaatacttgtggcaaaccgctattgcaaggaaatggccatcggctggtttccggaaacgctggcctgggccaattcccagaggctctgctaggaggagattccaagcgctttatgtcagcgagaaccttgtaccatctggtggggagattgacgagcttgttggtcacacatatctctatttaaaagaacagcttgagcgtcttgccgttcctccatccagcatacttcatggcaccataattgatcagttcattgcttgtggtaggacaggagaaaaggcccatgaacttgcttcaaatatatggattgcggtcattgacaatttggaagaaaaccagcagacattcatgctattaaaacaccttgcgcaagaaggagattttttccttccatttccatattcgaggttacatataaaagtattgcaggctgttagaaaatgtaatcacacacttacacgactgtgctattaaaagaccttgccataagacgatagctgttgcttcgatttcgattttcccagtcccttaaacatctgtggagagtgtttgacaagctgtttaccgacttccgtgactgtttcaaatggggagattaccatgaggcgctagcaggtgccaagtctaggtttcagccagtaccttcttcatggcttggacattagcacacagctgttgttcttattcagagttgtacaccgtcttagatgtagctgctatactccaccgagtgaaaaggtggatgtcaaagaatggtaattccaatgggatgtcatttatgtttagtgacttggccgacaatttcaagaacgccaaaatatatgtgattgtttgattgcaaaaaaaaaaaagcccctatatgttgc

SEQ ID NO: 17960 - DNA, 603 bp, Triticum aestivum
  Clone ID: PAT_TA_17960
tcaatttcacgattaaaagagggtgagcaccgaagacactgtcagcgtgaattatgatgacttcataagcgatgttgaagctggtgacatactgttggtggatggaggaatgatgtcgcttgctgtgaagtcgaaaacagctgacacagtcaagtgtgtagtagtcgatggtggggagttgaaatcaaggcgccaccttaatgtgcgcggaaagagcgcaactctgccatctataacagagaaggattgggaagatatcaagtttggcgttgaaaacggtgttgatttctatgctgtttcgtttgtgaaggatgccaaagttattcatgaactcaaggcttacctgaaaagtgctaatgcggatatacatgttattccaaaaattgagagtgctgattcaatcccaaacctccagtccattattgctgcttcagatggggcaatggtggctcgtggagatcttggtgctgaacttccaattgaggaagttcctttactacaggaggagattatcagaacatgccgaagcatgcagaaaccagtaattgttgcaacaaatatgttagaaagcatgatagatcatccaactccaacaagggctga

SEQ ID NO: 17961 - DNA, 2456 bp, Triticum aestivum
  Clone ID: PAT_TA_17961
ggattccattcccccaagttaaccctcctttagggaacacgcgcccgaccgcgccctcgttggccccctttcctatgcttgactggcttcgtggtagaacatcagaattgccagcggtggcctcccaaccccccccctaccctctcactcttctgagtgggatgcgccgcccgtgaccagcgagccgccgccagagccagcccaccgcgaccgcgacaaccggcggagatggcgtccatctccggcgcggcggcgccgccctcctcctcctccgcgtgccggctgcggctccggaggcagctgctcatgcgcccctcccacctccgcctccgcgcgccccattccatcgcggacctctcccgctcctcgacttgacggccaccggctccacccactcccacgccccggccccgccgctcgcgtccagggcgccgggccagggcggcggcgctgcggtcgagaaggacccgatcaagctctgggaccgctacgtcgagtggctctaccagcacaagcagctgggcctcttcgtcgacgtcagccggatgggcttcaccgaacgacttcctcctgttcggatggtacgcgccgctccatgcatgcgggccattgcgtgcgcctatgggggagcgcgagaagggcaccaccgccaaccccggcaacgcccgcagcactggacgctcgtggcgttgggactcctgcttctttagtaacccccaacgcctctcctcagcctggtgtcgaggcagggaaaaaagcagcaggagaggtattggcccttcagaaaagggtgctgactgttctgaatgaggccagctgcaaagaccctgctgaaccattgaccctggagcaaatcgcagatcgttgccattgccctgaagatattgagatgatatacaaaataattcagcacatggcagccaacgatagagcacttatagcggaaggtagctgcggttctcctcgaagggtcaaggtttaccttggaagaatgcaatgttagacgccctatgattacccccttcatctttgcgttttggatctgtgtaaaattgggtgggtctccaatgaataacaggatcttccccaatggctggttgcgtgtgctcaagatgttcctctattagataacactgccagaatagagggatggttagatcgatttcctatgtttgactgggttggtggtagaacatcagaattgtcagcggtggggttacttccagctgcattacagggtatcgatgtcaaggaaatgctagttggtgcagcactaatggatgaggagaccaggaacactgtggttaaggaaaatccagcagcattacttgcgttatcttggtattgggctacagatggaataggcagtaaggatatggtcgtacttccttacaaggatagtctgctacttttgagtagatacttacagcaacttgtcatggaatctcttgggaaagaatttgaccttgacggcaatcgggttaatcaagggctaacggtatatggtaacaaaggaagcaccgaccaacatgcctacattcaacagctaagagaaggggtgcacaacttcttcgttacttttatcgaggttttgcgtgataggcctcccggtcatgattgggagcttgaacctggagtcacatgtggtgactacttgtttgggatgttgcagggcacacgttctgctctttattctaatgaccgagagtccatctccgttactgtggaagaagtaactcccagagctgttggagcactggttgcactctatgaacgtgcagttggaatttatgcttctttagtaaacatcaatgcatatcatcagcctggtgtcgaggcagggaaaaaagcagcaggagaggtattggcccttcagaaaagggtgctgactgttctcaatgaggccagctgcaaagaccctgctgaaccattgaccctggaacaaatcgcagatcgttgccattgccctgaagatattgagatgatatacaaaataattcagcacatggcagccaacgatagagcacttatagcggaaggtagctgtggttctcctcgaagcgtcaaggtttaccttggagaatgtaatgtagacgacgtatgattaccccattcatctttgcgttttggatctgtaaaattgggtgggtctcctggaataaaaggaacaacaccagtggctgggccatgtatgctccagatgtgccattagtttcttatttggttgtggtggcacgattgttccttgtgccttagggttcagatttttggttttaagtgccgtcggttacaaaacaaaggaggatgccctgcatatgttactgagtttcaatatcgccactgtaatgtgtcaaagctccattcgaaacaacatctggtacaattgtttgcaatcaatttgagcatatgccttttctggcatgggaataaaaatatccaaacaagtgggtatattc

SEQ ID NO: 17962 - DNA, 493 bp, Triticum aestivum
  Clone ID: PAT_TA_17962
acattgtgaaacgaaaatgacatttctgtttatttatttttatctgacagatcgatccgtgtacactttattaccacatcacagcacacagacgcacgcatgaaacatgcatgcatggaaagacagggcgtacaatacacagtggaacgttctagctgctgccttcagcgcttgcgctgccaggcttcctgacggacggtgccgtgggtctcagccgcctagcagcccgtgccggaataggtgcagcggcatctggccgcgcagggcggcgggggagtgcaaatagcgatgcagaccttccctttcgggcagggcacacacccgcagcgcccgatgcacgttgctagcgcgtccgtcggctgtcccgacgtggccggggcgagcgccgccgcgcagagggcggccaggagcatgacggcggcgaacttgagagccggagcagccatgagatgaaagtagagagaggagaggagatggtatgcttgggttgatt

SEQ ID NO: 17963 - DNA, 890 bp, Triticum aestivum
  Clone ID: PAT_TA_17963
acataaaacgtattttatactgtatgtatttggctatacattcctagataaatatgtccatcatacatgctctgaagtttgattacgataaaggtaatatacactgtcaaaccaaaatgacatttctatttatttatttttgtctcacggatcgatccgtgtacactttattaccacatcacagcacacagacgcacccatgaaacatgcatccatgcatggacatacaggacgtacaatacacagtagaaaagttcaaaaaaaaatacaatacacagtagaacgtatgagctagctcctgccttcagcgcttgcgctgccaggcttcctgacggacggtgccgtgggtctcagccgcctagcagcccgtgccggaataggtgcagcggcatctggccgcgcagggcggcgggggagtgcaaatagcgatgcagaccttccctttcgggcagggcacacacccgcagcgcccgatgcacgttgctagcgcgtccgtcggctgtcccgacgtggccggggccagcgccgccgcgcagagggcggccaggagcatgacggcggcgaacttgagagccggagcagccatgagatgaaagtagagagaggagaggagatggtatgcttgggtgaagaagcgcccgccggctcgagcggccgtagtagagggggttggcttgagggtggtgaaagctcacccttgtcgtacactgaccaaagtaaggaacacttgttaacagaacaatataggcagtttggtggtagtgagcatgaccctggagaagccaggggcagtgtcttgttgagaagatcggctagagaaaaaaccgcccaaacattttattgatgtggagggtttgggttgaataatgagcttctgtcattacctcgtt

SEQ ID NO: 17964 - DNA, 739 bp, Triticum aestivum
  Clone ID: PAT_TA_17964
ctcgtgccgaattcggcccaagcgtcagagaaaatggagcaggccggtcaaggagcgcagccaaccaagaagccggccgcggaggtgacgctccggctgttcggcctggccgacgtggacgccatgatggcgtgggcgtcggacccgcaggtggccgccccctgccgctgggagccctacgagtccacggagaccctgctcgccttcatccacgacgccgtgctcccgcacccctggttccgcgccatctgcctcgccggcgacgacgaccgccccgtcggcgcgatctccgtgtcgccgacggacgacgcctgccgcgcggagctcgggtacgtgctggcgcgcgcgcactggggcaagggcgtggccacggcggccgtgcggcgggcggtggccgcggtgttcggcgaggtggaggggctgcagcgcgtggaggcgctggtggacgtggccaacgtggcgtcgcagcgggtgctggagaaggccgggttccggcgggaggccgtgctgcggcggtactgcgtgctcaagggcgccgtcaaggacatggtcatcttcagcttcatctccaccgacactgtgctggtcgaatgattggtgtgataattcagcttaatgtatatccaggcgaaaagaaaatttcataatgtcatgcgaaactttgctttctttattaattgttcagtcaaaaagtactccctccgtttacaaaggcaacatgttctgttttttccttttt

SEQ ID NO: 17965 - DNA, 468 bp, Triticum aestivum
  Clone ID: PAT_TA_17965
cgtccgcggacgcgtgggcgccgctctcccgggctcctgaaagttgcaacctctccctctcggcgaatttgggggtttctgaggcgcgcgaggtaaaccaaggttggtgctcatggctcgtactaagcagactgctcgtaagtccactggaggaaaggctccaaggaagcagttggccaccaaggctgcccgtaagtctgctcccaccactggaggagtgaagaagcctcaccgttaccgccctggaactgttgctcttcgtgagatccgcaagtaccagaagagcacggagctgctcataaggaagcttcctttccagaggcttgttagggagattgcccaggacttcaagactgacctccgcttccagagccatgcggtgctggcccttcaggaggctgcagaggcctacttggtgggtctcttcgaggacaccaacctgtgcgccatccatgccaagcgcgtgac

SEQ ID NO: 17966 - DNA, 736 bp, Triticum aestivum
  Clone ID: PAT_TA_17966
acaatccctcccccaattccccaccagttctcccaccgtccaccgaaacccccacctcacctccgaagcggcggcggcagcagcgtccatggcgcccaaggcggagaagaagccggcggcgaagaagcccgcggaggaggagcccgcggcggagaaggcccccgcggcgaagaagcccaagggcgagaagcggctgccggcggggaagacttccgccggcaaggagggcggcgagaagaagggcgggaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggcggccaagctcgcccgctacaacaagaagcccaccatcacgtcccgggagatccagacctccgtccgcctcgtcctccccggcgagctcgccaagcacgccgtctccgagggcaccaaggccgtcaccaagttcacctcctcttaggctctttgtcaaatctcttctggcgtgtgatggatcgatgttgacctgtagttagatcatgttccggctgtcatcttgtaagaaaacgtgctctcggtactgttattcagacccgaagtaacaacactgttcaaccctgctgttccctcggaaatatctgaagaaatgctaagcttgccgcttcgatctgat

SEQ ID NO: 17967 - DNA, 845 bp, Triticum aestivum
  unsure (1)..(845): unsure at all n locations
  Clone ID: PAT_TA_17967
attcataacccggtccccccagttctcccatcgcccaccgaaacccccacctcacctccgaagcggcggcggcagcagcgtccatggcgcccaaggcggagaagaagccggcggcgaagaagcccgcggaggaggagcccgcggcggagaaggcccccgcggcgaagaagcccaagggcgagaagcggctgccggcggggaagacttccgccggcaaggagggcggcgagaagaagggcgggaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggcggccaagctcgcccgctacaacaagaagcccaccatcacgtcccgggagatccagacctccgtccgcctcgtcctccccggcgagctcgccaagcacgccgtctccgagggcaccaaggccgtcaccaagttcacctcctcttaggctctttgtcaaatctcttctggcgtgtgatggatcgatgttgacctgtagttagatcatgttccggctgtcatcttgtaagaaaacgtgctctcggtactgttattcacacacacaccaaagaccaaacacactaccagccatggcgctccgcacattggccgcgaagaaaaccctaggcctggcgctcggcggcgcgcggccgctggccgccgccaggggcgtggcgacgttcacgctccccgacctcccctacgacttcggtgcgctggagccggncgtctccggcgagatcatgcgcctgca

SEQ ID NO: 17968 - DNA, 1874 bp, Triticum aestivum
  Clone ID: PAT_TA_17968
ctcgagtggctgctggggcaggttgccgccgctaccaaccgccgctctccgagggcctcctggttaagttgcaacctctcccctctcggcgaatttgggggtttctgaagcgcgcgaggtaaaccaaggttttgctcatggctcgtactaagcagaccgcccgtaagtccactggaggaaaggctcccaggaagcagcctgaaagttggaactctcctcaccctcggcgaactctggggtttctgaggcgccccagctaaaccaaggctttagtcttatggcttgtactaagcagaacgctcgtaagtccactggagcagcggctcagaaaggtaaccaatctagccaccaaggtctgcccgtaagtctgctcccaccactggaggggatgaagaagcctcaccgttaccgccctggctaacctgttgctcttcgtgagatccgcaagtaccagaaacttgcacggaggcctgctcatcagggaagcttccattccccaagacggcttgttaagggagattgcccaggacttcaaagactgacctccggctttgcaggagacgatgcgggtgctggcccttcacttgaggctgcagaggccttgctggggtgggtctcttgcgtaggacaccaacctgtgcgccatccatgccaagccgggttgaccatcatgcccaaaggacattcagctggctagggaggatccgtggcgagagggcttaagatgcttgctttccctgtgggaatggctctggcgggcatctgtgtctgcttttgcagctgaacgcttatcatgtgtcgtgaactactaatacttgtcgtgtgtagtaatatgtcagtgccgtactctgtgccatactatgttggtagagctggatcatttgttcgttggtcgtcctaaatcatccacctggtgggtgcttatctgaaccttgcattttatgtctgagaattagtgattgtgtgaaccattattaaaaaaaaaaaatctcgtttaaaaaaatctctgccatgttataatatatatatattattatttttttttttttttttttttctcttttttattattactactaggcaagatagtaaccttgacattcacaagcaatctgttccccacataaaaccgtctcgttctctaaacaggcagcgtcaggacgtggaattatattacacattgagttgcaagcttgaccaaacaccaaagaagcctaggctaaatttgctaagctgcttcatgctgcgacacctcgacggagggcagtggcagcagctggtcttcaggccttgatgcagcactggaaatagctcaggaacctcttccttcccgtgggcgagtggtcgcggccgtggagcgggccgtggtctttggccggagcgccgagcttggtgggctggggagccttggcggcgggctggtgctgctggtgctgctgcttgtggtgggcgaggaggtcgtcgtcgccgccgaggctggcgcgggagagctccttcttgttctgcttgcgcatctcccggatcttggagaagtccatggagtagtccggcatggcgccgttcttcatgtcccagtccccgaacgccggcaccgtcatccacgccgtcgccccctccccctccttgtggttgtccttctccatggacgatctcccttcctctcgcggacgcacggatattttcttcttgtgccgccggagctgtggagcagatttggaagctaagctgagcaaaaaagctggctagatggagcaccacagcacagtgcgggacttgtctagcttggatgggatgagatgagaggggtggtcgtggtacacacaaaactacaaggaaatgtgacggacagtgactgggctcccggcccggccggc

SEQ ID NO: 17969 - DNA, 240 bp, Triticum aestivum
  Clone ID: PAT_TA_17969
cggacgcgtgggcggacgcgtgggcggacgcgtgggcggacgcgtgggcaatgtaatctttatttcaaaataagcaagtaggcaatgattccaagcatatatgtttagaggagacaatgtttccatatgtaattactgtgctatattctcaccatttggaacgacgctaaaaattcctaaattaatagcccgtggaaaaatgctttacacattatgtgttgttttcagtaaatttatatc

SEQ ID NO: 17970 - DNA, 1530 bp, Triticum aestivum
  unsure (1)..(1530): unsure at all n locations
  Clone ID: PAT_TA_17970
ccagnacaatcagacgcatggagagcacgggccatggcggcggcggcgagggcgctagcgtcctcctcctgccgttcccaggggcgcagggccacacgaacccgctgctggagctgggccgccgcctggcgcaccacggcctccgccccacgctcgtcaccagccgccacgtgctctcctccaccccgccgcccggcgcgcccttccgcgtggccgccatctccgacggcttcgacgccggcggcgcggcctcggactacacggactacttctcgcggctggaggccgtggggtccgagacgctgcgggagctccttctgtcggaggcgcgcgccgggcggcccgtgcgcgtgctggtgcacgactcccacctgccgtgggcggggcgggtggcgcgcgcggccggcgttcccgccgcggcgttcttctcgcagccgtgctccgtgaacctcgtctacggggagctctgggcggggcggctggcccttccggtgacggatgggctcgagctgttcgcgaggggagcgctgggcgtggagctgggtccggaggacgtgccgccgttcgccgcagcgccggagtcgcagcctttgttccataagacggctatcgggcagttcgacgggctggaggacgccgacgacgtgctcgtcaactcattcaacgccatcgagccaaaggagggagagttcatggagttaacatggagagcgaagaccgtaggccccacattgccatcgttttacctcaacgacgatcgtttgccctccaacaagtcttatggtttcaacctatttggcagcgatgcaccgtgcatggattggctagaaaaacagagcatctcctctgttgtgctcgtatcctacgggactttctccaactacgacgcggcccagctagaggagcttggcaatgggatatgtaattctggcaaatcttttatatgggttgttaggtccaacgaggcacacaagctatccgaggaactcagaaagaaatgtgagaagaatggattgattgtttcttggtgcccccaacttgaggttctagctcacaaggccatcggatgttttgttactcattgtggctggaactcgacgctggaggcggttgtttgtggtgtacctcttgtgggaattccgcactgggcggatcaacccaccatcgcaaagtatgtagagagcgcatggggtatgggtgtgcgagtgcggaagagcgaaagtggatcactaaggagtgcggaggtcgagaggtgtattagagaggtcatggatggggagaggaaggacgactacaaaaggaatgcaatgaagtggatgcaaaaggccaaggaggcaatgcaagaagggggaagctcagacaagcatattgttgaattcgctgccaagtattgtcaatttgaatttacaacaatgtaatctttatttcaaaataagcaagtaggcaatgattccaagcatatatgtttagaggagacaatgtttccatatgtaattactgtgctatattctcaccatttggaacgacgct

SEQ ID NO: 17971 - DNA, 612 bp, Triticum aestivum
  Clone ID: PAT_TA_17971
aaaaagaacaagacctatgctcaaaaagagaagaacagagcacctattctgaaaagcagagcacctatatctctcctgcagtcaaagaggagttccttctacattgtatcaatagagaacctcaagtaaaatccttctaccttgggatgtatatacgtatattatatctccactttgttctatctataaagaatctgaactaaaatcctttatgttgatatgtactacaaatatatggaaaaaggtatatatgttcatcctttgagtggctcaagctgcacttccatcgatccaggcgaactagagtcaattttactggcgaacctaccggactgcagaagatcaactgaatcatcttcctcagggttcccaagcacaaatttgtgcgtgaggccatcggcgccatctctttttcgcttaacctgtgcccaagatgctgcaaaccggtgaaaagtgccgtgacagcggctaccagagcagtcctcccggtgtaggtatgcagatattcccagatgatcctgtttcttgacagaatttcttcattctccgctcggtgtggtcggagataagcatttaccggctgcatacaagtgaatgtaaatgctatcgcgc

SEQ ID NO: 17972 - DNA, 1490 bp, Triticum aestivum
  Clone ID: PAT_TA_17972
ctgaccccgtcgtcatccgaagccgccgcgaacgaagcatcttgaggcgcgcacctgctgcctcgtccctgaccttcccatggcgccgccgttcgccgtcgccgcagtttcctcctcatcccctctcttctcctcctcctcatcccctctcttctcctcctcctcatcccgccccatcctccgcggccacccgtcgctgggttatatctccgtgcggccacggcaccgctcggctgtggcctccgccgcggcgaccgagtccgctggaaagctccttctcgaggtacacgggcttaccgcctccgtcaaggagactgggcagcagatgctaaaatccccatacctcaccacgagcgacatcgaattacatgcgatcatgggtgaaggaacggctccggcaagagcaccctcactggccttctagactaccaggtaacactacggggacaattctcttaaagggcgagaacttaattgacatggaagccagaggagagatctcttgcagctctcgcaggcatcttcataagccgcctagcgcctattcctggtcctggagtgtgctattttgcttttctgctcatggcaataaatgctcgcagagagaaggacggtctcccagctttgggcacctcttgagttctattctgttgtatcacaaaaagccgaggccttaaagatggagccaaagatccttgatcgtaatgtaaacgaaggatttagtggtggagaaagaaagcgcaatgagatactgcaactttctgtccttggggctgatttcgccctcctcgatgaaatcgattctggattagatgttgatgcacttgaagatgtagctcatgccagtgaatgggctcttgactccccaaaactccgttctgatgattacacattaccaacgtcttttggatcttattaagccaagctatgttcacatcatggaaagtggcaagatagtgaagacaggtgacagctctctagccagccacatcaacgagggtggctacaaatcaatcgcttcttttgtatagcatgaataaggtcaaatgcttgaattcccagccactagtctatttgtctgaacaaactggtgactagttgggttctatatattcttatgcccggtgaaactggcatggagcctggaagtaaaacatgctaacttatgtgaaattgtagagctagtgcccatttggccaggcatatcaccttttggaggtggagcactggagttctgaattgccctcggccatatttctctttctcgtcctgtaagatttgttggattccaatattaatacatttatacatgtagttatatgcggggcagcatcttgcatgcgcatacgaccgacaaagttgtatccgaattttctctacaattggagacagttttgaatatcacttaaaaaaaaaaaaaaaaaaaaaaaaaaaaaaaaaaaaactcgagggggggcccggtacccatttcgccctatagtggctcgtat

SEQ ID NO: 17973 - DNA, 1369 bp, Triticum aestivum
  unsure (1)..(1369): unsure at all n locations
  Clone ID: PAT_TA_17973
gtggcggccgnctcgagccggcggccgcggggcacccacacactcactttcgttactactactataccttgacttttagtcaatttcactctttacagtacatcatcaactacaaactttcgagttaccaataatctaatacccaacccccaaaacccaaccgtcaaaatgaagttcgctgccgccctcgctttcgctgccggcgtcgctgcccacgccaagaacgttacctacaccaccgaggtcgttactgcttacaccacctactgccccggtcccactgagatcgtccacggcgacaagacttacaccatcactgaggccaccaccctgaccatcactgactgcccttgcaccgtcaccaagcccgtcatcatgacctccgctgttgtctgccacgactgccccactggcgagaagcctggcaagcccaaccaccccggtatgggccacaactctaccatggtccccgtctaccctaccggcaagcctacccacggtggtgagcaccccgtcggtcccggtgccacccctaccgctggctctccttctgaggtccctaccgccggtgccggcaaggtcgccgctctctccggtgccggtctcgctgccgtcgtcggtcttgctgctttcctgtaaatcagctgctagcatacaatgcctacgatgttttacgcccggtagataccctatttacgctgggagtgcaatgtgggaaggctagcaatggtttcgattcgatttgggatacgcaagcgatctttcagggaactgtataggaactttttttatatatcttttttgggtttacgaacatacgatacgggagaaccggtataccactgcaccgctctatggagtcttattgtctaatgatggccacgctttgcaggggtttttggagacaaattcttgtatatatatgagttttgtctcggtgttcggaaggagctcgcatattccctgtgtgtgagatatcttctttcgaggatgggaatataatgtgtttatcttgcctttatggctgcagaaaaaaaaaaaaaaaaaaggccccttactcgcgaatatagctccagattctgcttagcaatttatagagaggccgattcccacgggtcgaatcctgtttcctattcttgatacatacttttttctttggtaaattgacaccagcgtctgtaatgtttgtttttggacgctggaacatatatatccttaaagctggacgtgtttatggtctcttgtcaactatcaatgtttttgcgagctcgagggaatcatgtatcatagtcaaaagcaaagcaaacattgctgagaggccagttttggtctggcacactcgaaaaaaaaaaaaaaaaaaggcccctat

SEQ ID NO: 17974 - DNA, 645 bp, Triticum aestivum
  Clone ID: PAT_TA_17974
gccggccgggtccgacgaagccgtaaacaaatccattctcccgcccacgaacgacacgagactatcgcccgtccagcacgagggacacgagaccactggacggattgacttgtacacaataaatcccacgaccgaactcagcgagattagcccaccatggctcaagatatgccccccaagggcgggtacgagcccgtccagtacaagcgaaacctccccgccaggggtctccgtcccggtatcctcctccttggcatgggcgccgttatgggctatggctggtacaagctgatcggtggcatgcgcgaaatgaacgaactcggtcgtgaaaagatgtgggctcgcatcaacctcatccccgtcctccaggccgaagaggaccgtgatcaggtccgacgatacctagccgaccagaagcgcgagaaggagcttttgggcgacaacgccaaggtttacaacagcaaccgattcgtgaggccgacttttgccgtcacccctcctcctaccacaaactaagaatacaacaataagaaaggaaatcgggtgccatgtgctgtgtatatatgtttttgacaaagtggttctatacaacccacgtctggaattgaaagggttatgcaaaaaaaaaaaaaaaaaaggccccta

SEQ ID NO: 17975 - DNA, 1518 bp, Triticum aestivum
  Clone ID: PAT_TA_17975
gctcttgctgaggaacttgctcgacgtcttggtaaagaaaggtgttggagggtcaaatggccaaagaagaacgagacagaattttgcaaagatgctaacgaggtacttatgttcttaggaccacaagcattgaaagaggttatagaaggtgcagaactgtatcctataagaggtctattcaacttcaaagatttcttccctgagatcgatagttattatctaggaattcatggggatgagcttggaattcctactggttggaaatgtatggatgggctctacaaggttgttcctggggaattgaccatagtaacaggagtaccaaattccggcaaaagtgagtggatcgatgcattactgtgtaatataaacaatcagtgtgggtggaaatttgtactatgctcgatggaaaacaaggtcagggaccatgcccggaaactattggagaagcacattaagaaacctttctttgatgctagatatgggggctctgtggaacggatgagtcaagatgaatttgaagaaggcaaagaatggttgaatgagtcattccatctgattaggtgtgaagatgattgccttccatccatcgattgggttctcaatcttgctaaagctgcagttctaagacatggagtacgtggtcttgtgattgatccttataatgagcttgaccatcagcgccccccaaatcaaaccgagacagaatatgtcagccagatccttacgaagattaagcgctttgctcaacatcattcatgtcacgtatggtttgttgcgcaccctaggcagcttcacaactggactggcgcaccgcctaatatgtacgacatcagtggaagtgcgcatttcataaacaaatgtgataatggtatcgtcatacaccggaacagggatccagatgctggccctgtggatgtcgtgcaggtctgtatgaagaaggttcggaacaaagtgattgggcaaataggggatgctttcttgacctatgaccgggttactggtgaatacaaggaagccgatgaggccattgtagcaaaggtggtgaagcagcagattcgtcagaaatcgacaagttaccaacgctgatttactttgctcgctctcccggacagttgacacggttgagatattatggccctcgcttctgtggatgtcacagttgacagtttgccgtgtgatcgtggcagattggctaacttgatcgttcatgcatctgagctgattcctggtgcgaaaaatgtggtcgaaggctactaaccttactaagacggccacatggcattgctggggtgtggtggtgtatagcaagctagatcatattattgtaattaatcgtcgcaccaggcggaggtcgtgtcagcagcgaaagctcatctcaaccgctagtaggttattctttgtatgcccttccgacggttgtagcagttggaggtccatgacacacatttatccttagtatcagtttgcatgcatcagcagaagcccatgatttgctcaaaaaaaaaaaaaaaaaaa

SEQ ID NO: 17976 - DNA, 665 bp, Triticum aestivum
  Clone ID: PAT_TA_17976
actctccccccgcggccttcttttccccttccacccgtctccctgagcatctcaaacgcgtcttccaaccaaacgtcatttgcaacatcgcgataacgcgccacattcatctcttttcatcaaacacttatcttcatctatcaatatgactggacgcggaaagggcggcaagggcctcggcaagggtggtgccaagcgtcaccgaaagattttgcgagacaacatccagggtatcaccaagcccgctattcgacgtctcgctcgtcgtggtggtgtcaagcgtatctctgccatgatttacgaggagacccgtggtgttctcaagaccttcctcgagggtgtcatccgtgacgccgtcacctacactgagcacgccaagcgcaagaccgtcacctctctcgacgtcgtttacgctctgaagcgacagggccgtaccctctacggtttcggtggttaagcagctatctgcacaccgaatggttcgtttggctttgcgaatgattgcacagtcgcacatttgcagatactgggatggatgtacttgactacggcgttggggaaacacggatatgatattaccatcaggcgtcatggaagacgaccttgcgaaatgaataccacattgaacattgattaatcaaaaaaaaaaaaaaaaaaggccccta

SEQ ID NO: 17977 - DNA, 683 bp, Triticum aestivum
  unsure (1)..(683): unsure at all n locations
  Clone ID: PAT_TA_17977
gtgcggccgctccgaggnccggccggttcagccggaaaaaaaaaaaaaaaaaataccttatcacttccatccaacgactctacctactacacttcagtatacacccagcgtgtataactttatcatcacaaccgttactacacacctcaaacaatcaacatgactggacgcggcaagggcggaaagggtctcggcaagggtggtgccaagcgtcaccgaaagatcttgcgagacaacatccagggtatcacaaagcccgccatccgacgtctcgctcgtcgtggtggtgtcaagcgtatctctgccatgatctacgaggagacccgcggtgtcctgaagaccttcctcgagggtgtcatccgtgacgccgttacctacacggagcacgccaagcgaaagaccgtcacatctcttgacgttgtctacgccctgaagcgacagggacgtaccctctacggtttcggtggttaagctctttttgttttacatgcctgttacgaatctttgcggtcgactgcttgcagcgcaggaccttgtagggtgtttcatgatgacattgggtccggttattgtttttgggtgttatgtatcataagggatttgggggattacattcggggataatcgaaaatgcccctcgaggcgatattgatcaccaaaaaaaaaaaaaaaaaaggccccta

SEQ ID NO: 17978 - DNA, 1768 bp, Triticum aestivum
  Clone ID: PAT_TA_17978
ccacgacgagacgccccacctgaacccgagcggtgcaacgccattatcggagaagcgcctccccggtccatcaaaattctacactcaggctgtcgagggtggatcctgtgaatgcaaccgtctgtgcctcgacgggccaaagggttactgccggaaaggagctgccttaacagcgctcaaggatcacaaggaagcatgcgatgcgtacatggctgcggtgaaactggatccttcaaatcaggagctgcatgaagcattttgggaggcggttgcggtaaggtaggcggatggcggcgctgaacaaagcggctgctcatcagacgctgattagggccgctgcctgggtggacgtgcccagtggtgcctttcctggcttctaatagcgtgcgagtttacgtcaggctgagctggcgcgccctttgctgtcatggacgtatggcgaagtggcgctcacttccttagaaacgccgcgctgttgctatgtgtgcgatggcaactagtgcgacgtcttgtatttatgtcagctggtttgacgatctaacaggggtttgtcaggttttaggttcacccatgactgctgcagttctttgtgctgattttatttgtgtcgctggaaaaatttctgtgtctgctgctttgaagtgcatgaagctacttgtcaaggctggtgctggtttgaactgtacaactcctgatactccattggtgatagcaaccagcaaagacttaactgaatgtgtccagtacttgttggaggtcggtgcagatgccaatattccaagcaactataacggtacgacaccaatagaaattgctgcagactctggaagaagagagctcgtggagattctatttccatacactaaacccattcaacgtgtgtcaaactggagtgttgatggaatcattactcacgcaaagcacttgaaggacaagggtaagcaatgcgataaggccagcaaggttaagcaaagtgataagtccagcaagggtaagcggaaagaggatgccagtgcacggaagtcctcttccgaggagaaggtaattcaagataagaaggctgagctgaaatcacttggtgcaaaagcagtagaggaaaaggactatgccggtgcatcagaattctacagcgaggcaatcaaagtggatcctaaagatgcgacgctctattcaaacaggagcctgtgccatctaaggattggtgaagcacatgatgctctggtggatgctgatgcttgcatcaggctgcggcctgattggccaaagggttactgccggaaaggagctgccttaacagcgctcaaggatcacaaggaagcatgcgatgcgtacatggctgcggtgaaactggatccatcaaatgaggagttgcatgaagcattttgggaggcggtcgcggcaatgaaggcggaacttggcgctggacaaagcggcagctcatcggactctgattagggccggcctggatgggcatgctcatcggctcccttccaggcttctcattgcgtgcgtgtttacgtctggccaaactgttgatctctttgttgtcttagcgaaaggcgaagtcgtactcagctccttgctaaatggccatggctgctcgtgcgagcgctttgaattagtacggtgctttgacgatctgtttgaagcatgaatggtactgtattttgctagattgtggtgatgggtgctttggattgaacttgttttatcatctgtgtttggtctgttcaaatccgtcttcaattgccctaaaaaaaaaaaaaaa

SEQ ID NO: 17979 - DNA, 763 bp, Triticum aestivum
  Clone ID: PAT_TA_17979
gccggccgggcttggaaaaattcgtgccagcgaccgacctcatttgagctcacccaagcaacaacctcacccaccagctcagcccatcatgaactctttccgcatcgcccgtgcggctctccgagctcgccctgccgccgtccgagttcccctccagcgaagaacctacgctgaggccgtccccgacaagatcaagctgagccttgccctccctcaccagtctatctacaagtcccacgacgtcgtccaggtcaacatccccgccgagtctggagagatgggtgtcctcgccaaccacgttccttccattgagcagctgaagcctggtctggttgaggttgtcgaggagtccgctggctccaagcagttcttcctctctggtggattcgctaccgtccagcccaactccgtccttagcatcaacgccgtcgagggttacccccttgaggacttcagcgctgaggccatccgagctcagatcgccgaggcccagaaggttgccaacggcagcggaagcgagcaggatattgctgaggccaagatcgagttggaggttctcgagaccctgtctgctcatgtgaaataagcgtgcagttagtttgtggtgacggaggcccttgtacatcaaaatattctacccatcttagcacggaagctgtgacaattgataccagtcctggttgtgctacctcctaaataaacatttaaacgtctactctaagtgattaatttgtctcgaaaaaaaaaaaaaaaaaggccccta

SEQ ID NO: 17980 - DNA, 1797 bp, Triticum aestivum
  Clone ID: PAT_TA_17980
ccacgcgtccgaaatgctggaatattaccaacattacaggattgcactccatttccaatctttgttgttttggctggtggcattgagggaaccatcgaaagctaagtctgttgctcgtgtttctggtgatacctctcctgctggaaattttggttctgttggtgttagttcaactgaaaaggagaaaaaaggggtgtcattatttattaccgatgaaatatacagtacactattggacgtttctttcaaaagaatgcttaagaaaagtgcgaattcatcttcaagtctgttggaactatggaatgaagagcttgaggggaagagtgacttcagcaactatcgtaccaaattgctggatctcataagagttattgcttctcaaaggcctgttattgctgcagcaaacattgtaccgcgcgtccgtgttgtttctggagatgctaatcaaacaacaaaatccccccaggatcttgacgctatggtaggtgcccagctgggtcttgaaacagttgttagtgccatatttgatggctcgggtgattatgcaaagactgaccatgaggcaaaattccaaattcacaggacttttgaaggcttacttcagcagcttctttctttgaagtggacagaacctagcctcatagttattcatggtcattatttggattctctgggtctgtacttgagacattatccagatgtagttgctagtgttgtgaacaagccttttgaactattgacatctctcccgattacaattcagcaacagggtccatcaaataattcccggcaagctaggttacagatttgctcatcattcattcgcatatcaagagctgctgataaagcacttctgcctcatatgaagaacattgccgataccatggcttaccttcaaggagagggccgcttactacgggctgagcatgatcacctatgtgaagcatttcttattatggcctcctcgtctgggattcaacagcaacaggaagtcctggcctggttacttgaacctcttaacaaaacatggacccaagtggaatggcaaactgcatacttgtctgacccatctggtttgacagacatgttcgctgacacccaatttatgtggtcaatttatcacacggttacgttctttgagaaggcactcaaacggagcggtaccaaaaggtctacaacagctccgcaagcagccatcaccacaacaacagcaactggttatctgcatccgatgtcttcacatctatcatggattctgccccctctcttaaggctgctgagatgtatacatgcactttgggctgagccatttgctcagtcgctgacaggagaaatcaaagcggccaaaagcatgactatctcggagcaggccagtctcctgggagagacaagtaaacctaccaagggccaggttgcacctgctgatggattactggatgttcaaagggagggagagtctaaggaaaataacataagaaactggttacgtggcgtccgtgacagtgggtacaatcttataggattagcagctactcttggtgaggcatttttcagatgcatagatggttcctctgtcatccttgctcttatggagaatgtgcaagttatggagtttcgtcatttgcgccaactcatgcaccttgctgttgttcctttggttaaatattgccctgctgaactatggcagatatggacagcgaaccttttgcagccaatatttgttcattgtcagcaagctcttgattattcatggtccagtcttctacgcgagggacgagctaaggttcctgatagcta

SEQ ID NO: 17981 - DNA, 668 bp, Triticum aestivum
  Clone ID: PAT_TA_17981
cccacgcgtccgcgagtgtttgcgtagcagacactcgatggaaaagaaggctgttgagcttgattagcttcttctccatcgagtgtttgcgtagcagacccaagagttagagaatccaagaagagtgtggacctagccatggctggggtggtcggcgtctggttcgccaagttcggccgggaggcggcgccggcggcagaggcagaggccgaggtcgtcggacggcgacaccagggcgacggcctgctcgaggtggaggccgtgaagacggtgcagatccaggagaggaggaggaggaacagcgccgtcctcgccaactccgaggacacggtgtgcatgctcatggaccgcttcgccccggcctgatgcgccggtgaaccggcggtgtccgtacgtacgtgtaaattccagggcacgtacgtaggggcgcgggcacaagggaggagccataccttgatgtgcgggttcctcttgtacataagctctttttcatcgctaatcgagtgatagcccccgtagtgctcatgcctcccgttaaaaaaaagataaataaataaagcgcccagtcgaatcaactgtatcatatcatgtactcctatgtagtatgactgtatcctttgaatggattcgtttggtttctatggcaaaaaaaaaaaaaaccccaaccc

SEQ ID NO: 17982 - DNA, 709 bp, Triticum aestivum
  unsure (1)..(709): unsure at all n locations
  Clone ID: PAT_TA_17982
gccggccggttcgggatgccatagccggtgccttccttcacacctgcgagctgtataagtagagccgggcacccagagttaaaggaacgcccactcatccaagcagtgaaagagaagaagctaatcaagctcaacagccttcttttccatcgagtgtgtgcgtagcagacccaagagttagagaatccaagaagagtgtggacctagccatggctggggtggtcggcgtctggttcgccaagttcggccgggaggcggcgccggcggcagaggcagaggccgaggtcgtcggccggcgacaccagggcgacggcctgctcgaggtggaggccgtgaagaagggcggcgtgcagatccaggagaggaggaggaggaccagcgccgtcctcgccaactccgaggacacggtgtgcatgctcatggaccgcttcgccccggcctgatgcgccggtgaaccggcggtgtccgtacgtacgtgtaaattccagggcacgtacgtccgtaggggcgcgggcacaagggaggaatctataccttgtgctgtgattgtacataagctttttttcatcgctaatcgagtgatcgtagtagtactgtagtagtgctcatgccttccgttgaaaaaaaggataaataaattatgcggccagttgaatcaactgnatcatatcatgtgctcctatggatgactgagtccctttgaatggaa

SEQ ID NO: 17983 - DNA, 691 bp, Triticum aestivum
  unsure (1)..(691): unsure at all n locations
  Clone ID: PAT_TA_17983
gccggcccacccgtccgcccacgcaacagcaacacccaaggcttgacagccaggaagccggagctacctcaagagccttcttttccagcgagtgtgctgtgtacgtagcagagcgaagagttagagcaatggctggggtggtcggcgtctggttcgctaagttcggccgggaggcggcgccggcggcagaggccgaggccgaggtcgtcggccggcgacaccagggcgacggcctgctcgaggtggaggccgtgaagacggtgcagatccaggagaggaggaggaggaacagcgccgtcctcgccaactccgaggacacggtgtgcatgctcatggaccgcttcgccccggcctgatgcgccggtgaaccggcggtgtccgtccgtacgtgtaaattccagggcacgtacgtaggggcgcgggcacaagggaggagtctatgccttgtgctgtggttgtgtgggttcctcttgtacataagctctttttcatcgctaatcgagtgatcgtagtagtagtgctcatgcctttcgttaaaaaaaggataataaataaattatgcggccagttgaatcaactgtatcatatcatgtactcttatgtatgactgtatcctttgaatggattcgtttggtttctaaaaannannnnnnnnnnnnnnnnnnngaanaaaaaaaaaaaaaggccccta

SEQ ID NO: 17984 - DNA, 836 bp, Triticum aestivum
  unsure (1)..(836): unsure at all n locations
  Clone ID: PAT_TA_17984
agatcacagtatggactttggatatcggggatggtagcaagttcaagtggaagattcattgggggttcaacctggatcttctctgggcgcaagatggtttccatgctctggacatacctcgctgtcttccccagttcccagtcgtctgtgcgaacaatccgggcgccctatgctgcctgttgaggaaagatgaactttctcgacagccgtggatgatcatggttgacatgaaccaggaagatctgcagccatctactaaatatatcaatcagcagccctacaatgttgcgtgcgtgaatgagaaaaaacccatggaagctcaccaaatcttcttttctaatgtgcccctacttccaactgtcttctccaaataccttgtaaggccaacagtgataccccgggacaacaagctcaagctcgcagctagctcttcagaggagattatgctcataactggagaaagcttaagtttgcaatgtgaattcgaagacctgaaaactgatgacccggcttggaaccttcttctggttggtcacacaaaagatggtatttgtcctgaatgtcatgggatgaggatgatgggatgaggatgtgtactacctctatcccaaaataagtgtctcaagtttagtactccctccgtcccataatatagaacgttattgacaatctcaactttagtaaaagtttgtactccctcccgtccccataatatangaacgttatttacacttaaatacttattttgggacggagggagtattaaatactacngtcattnagagtaaacatacatgttctggttctgtatcaatntttaagacccntactcaaag

SEQ ID NO: 17985 - DNA, 678 bp, Triticum aestivum
  Clone ID: PAT_TA_17985
cttcaggagtgtcaaggattattcggcagcgcaatgtgggggatggcgcgcatcgatgagtggaaaccggtgatcgcaatgctgatcttcgacctcatctctgccgtgacaacggccctgatcaaggcggcgctcgaggaagggctcgaccgtctggtgctcatcacgctgcgtcaactggtggccacagtcttcctttctccaatcgcatttttcaaagaacggaacacacggcctaagctcacactggagatcctcgtgtacctcttcttcagcgcagcgttaggcgccgcgctctctcagtataccttcttctacgggctgcagtacacaacagcaacgtttgccataactttcaccaacctggctcctgtgctgactttcctcatcgcggtcttgctcagggtggagtcactgaacatgaagaacaaggcaggagctgcgaagatcatcgggacactcatgtcgttcgccggcgtcatgctcctgaccctctacaagggtgtggccttgacacaccaagcagagccttcaggccagcatgcagaagcagcagctgcagcagaatctggcaagaagagctggaccctgggcactctagcattactggcgaactgcctgtgcttctccttttggctcctgctgcagtccaagctcaccaagaagtacccggcactc

SEQ ID NO: 17986 - DNA, 576 bp, Triticum aestivum
  Clone ID: PAT_TA_17986
ctgccacgacgagacggtgcgcaggcgcttctcgtttaccgtcttcttcagcgggaatgatctccaggtggaaacttggctactctaaagctagcggtgtgatcaagcatcagaatcttgcttccagcccgcgtggagactcactggctgtgattgagctagcaggggacatggacgaggaaacatggagggggttgtacacctcggctgcaaaccacctgacgccaggcagtaaaatcatactgaccagccgttcagggaagcccgcatcattaggaacggcacagtctcttgtgctgaaatttttgtcccaagaagcttactggtatttcttcaaggcggctgcattcggaagcaccctccctggtgagcatcctaacctggcagccctcggcataggatgtgtcgtccacatgaacagcatattcgtggcagcgaacaccggtgccagcttactgcaggacaatcttgacacacacctttggcgtgagctgcgtcgtgtcacggacagacgagcacgtggtgctcggtaaaaggttgtctaggaaggagagaatttgatgtaaaatgcaatta

SEQ ID NO: 17987 - DNA, 675 bp, Triticum aestivum
  unsure (1)..(675): unsure at all n locations
  Clone ID: PAT_TA_17987
tgcagaagtaaattctagcagggnaacctatattcgaaattgaagaacttcgagatgacaagaataagaagggaggagatatcagcaaaaccttggtgcaagcagtaaagcatgagaagagccaggtagaagaaaaacttgaacaggaaaagctgcagagcttccacctgaagaaggaactagctgatgtagagaacaaaaatgcggagcttactaaggaactccagtcggtccgcgatcaactctccgacgaagcagcgagggcttccaaactcgaggatggagtttcagagattcaacaacggctgcagaagatggaaacccttgaaaaggagttcgaattgcttcggagtgaaaggggtggcgggtctgacaaatcaggttcaggcagcaacaagaggcccagcagcgtgggcttccggaggtggtatggagatgacgagcgctgaagcagggactcttctctaggatcgcattctttcgtttttggtcggtttctgatcatatatatttttcgcctaatcccggactgagggttatatgaaaagcttgaaaatccttttgtaaaggaaaagactgaaagtattttttttcccaagatcaaaagcccagacccccagaaacttgaaaaaaatccatttaaaaaaggaaatttttttttccccccccccccgc

SEQ ID NO: 17988 - DNA, 820 bp, Triticum aestivum
  unsure (1)..(820): unsure at all n locations
  Clone ID: PAT_TA_17988
gccggccgggtctggcattaccatcatctccccgatatcaaagggcgatcccaaatcgccattcacaatgaggatcgcgggtttcctctcgacaatctgcgccgccgcgcttgtcgtagcagagcagcgcactgcccaaatctacgttcaggctgtccaatcctcaccctcactccctcaacccctagccgagatcgcctacgacgccgcctcgctcatctccaccgaggttgtttcttacgaggcgcctgagctacccgagacagcgtcgcttgtccgcatcggcatctacgatcccaagtctgagaaatggattgctggaaccactgctgcttcgacggagaactttgatcgcggttacgcccctacactattgctctctgtggatgagagcggtgatgtgcgcagtgtgacgctgaagggcattagagtcgatgctgggcagacgagagattttggaccaaaggcgattgtgatcgcagataagaagggcagccaacctgagctgaacaagccggttatactgtcacctggcggtaaaaaggctgaggaggaggaacccaagtcatttttgcaaaagtactggtggctcatcgccattatggtggttatgtctctggccggaggcgagaaatagagtcttaaatatatgcaataaaggacacatcaccnaaactcgattcgtcagacgtttgccgtagaggatttggatcgaacacttgacgtcggaattgacagcgcagaatgaggntggatcttaccaagatacaggaagacaacttggatgcattatcgtgccgctattctataaacttgcagg

SEQ ID NO: 17989 - DNA, 585 bp, Triticum aestivum
  Clone ID: PAT_TA_17989
gccgctcgagcggcgggccgggattcaaaaagcagatcaatctcctcgacgccgccaagcctccaactttcctctccagcatctccgcgaagaaaagaaagtgtgatggctccccgcgccgccgtgctgctcctggccatggccgtggcctccgtcttcctcgcctccgcgtcggcgcagggcgtcatggcgccttcctcggctccttcgtcggcgccggcgcccgcgccggacgccggagcggccgctagccttgccccggtctccgccgtggccgtggtcgcctccgcgctggtgtccctgctcgcggcgacgctcctgcagtagagatgatggccgcgcttcgccccgggtgatcggcttccatacataccgtattcgttagtgctaggctagatcggtggtggttcgatgagtctctgtcacagcgtttggtcgatcggttgatcttgttaggcattctttctttttgtcatatatatatccgctacattatactgctgtgtgctgttttatatgagattgggttgctatgaataaagcatgatgatcccgtgatcatgtcacatcgccaaccccaacccc

SEQ ID NO: 17990 - DNA, 620 bp, Triticum aestivum
  Clone ID: PAT_TA_17990
gccggccggccacccctagagcaccgcctcctcgcaccgcagaacaatctcctcgacgccgccaagcctccaacagagccctacaactttcctcgccagcatctccgcgaaggacgaaagggtgtgatggctccccgcgccgccgtgctgctcctggccatggccgtggcctccgtcttcttcgcctccgcgtcggcgcagggcatcatggcgccttcgtcggctccttcatcggcgccggcgcccgcgccagcacaccggaggcggcagctggcctcgccccggtctccgccgtggccgtggtcgcctccgcgctggtgtccctgctcgcggcgatgctcctgcagtagagatgatggctgcgcttcgccctgggtgatcggtttctatacataccgtcttcgttagtgctaggctagatcggtggtggtttgatgagtctttgttgcagagtttggtcgatcggttgatctgttaggcattctttctctctgtcatatcatatatccgctacattatactgctgtgtgccctgatttatatgagattgtgttgctatgaataaagcatgatgatcccgtgatcaaaaaaaagaaaaaaaaaaaaaaaaaaggccccta

SEQ ID NO: 17991 - DNA, 867 bp, Triticum aestivum
  Clone ID: PAT_TA_17991
attccaccagccggcctgtactggactctactcttggccttccattctgttcaccgttcaccaactatttttccttcaactgaaagcttcttctcagctgaatttcgttatttcccctttccttaacaacccttgaaatctaaaccgcacgacttcagtcgccaaacaccgccaaaatgggtcacgaagatgctgtctaccttgccaagctcgctgagcaggccgagcgatatgaggagatggttgagaacatgaagattgtcgccggtgaggaccgagatctcaccgtcgaggagcgaaaccttctctctgttgcctacaagaacgtcatcggcgcccgccgtgcctcctggcgcatagtcacctccatcgagcagaaggaggagtcaaagggcaactctagccaggttaccctcatcaaggagtaccgacagaagattgaggccgagcttgccaagatctgcgaagatatcctcgaggtccttgaccagcacctgatcccctctgccaagtctggcgagtccaaggttttctaccacaagatgaagggtgactaccaccgttacctcgccgagttcgccattggcgaccgtcgcaaggactctgccgacaagtccctcgaggcctacaaggctgctactgaggttgctcagaccgagcttcctcccacccaccccatccggccttggtctcgccctcaacttctccgttttctactacgagatcctcaacgctcctgaccaggcttgccacctggctaagcaggccttcgatgatgccatcgctgagcttgacactctgagcgaggagagctacaaggactctacactgatcatgcaactgctccgagacaccctcactctctgg

SEQ ID NO: 17992 - DNA, 769 bp, Triticum aestivum
  Clone ID: PAT_TA_17992
cggcgcagtggggtcggacccaatcaaagccaaagaaagcaagaacttccccggccgtccatggccacctaccccctcctcctccccctcctcgccgccgtcgccgtggcggcagcgtcgtccgcggaggacacgccaacggcgtacgagatgctggagcggtacgacttcccgcggggcatcctgccggagggggtggaggggtacgagctcgatcgggacggcggcttccaggtgtacttcccgcgggagtgcgagttcctgctagccaagcagtggctggtcaagtacgacacgcgcatcgccggcgccgccagcgcgggcaagctcgcggcgctgcagggcatctacgtcaaggtactcttcctgtggatccccgtcgccgaggtcgaccgcgccggcgaacgcctcagcttctacatcagccccgtctccacgtccttcccgctaagcgacttcgccagcagcccgcactgccgcggctaccacgaccgcgccgccgtcgctgcggccgtctcgtgaatcatatgctttttacatgtgggcttctgctcggtgatttgccttgctattcaattagtgccagtgttagctactactactacttagctactgctgctgggggaaatagtatatttcacatggaaaactctattgatacggcttgatcatttgaacaagactcgcatgagtcgttgtttcaattaacctttgtaccatcgtggatatatcaatgagctctatacgattccagtttagcatgagatcc

SEQ ID NO: 17993 - DNA, 689 bp, Triticum aestivum
  unsure (1)..(689): unsure at all n locations
  Clone ID: PAT_TA_17993
ccagtttagatgacggtctagcgataggatgcataagcctggcatgtaaactctattgcagttgctctggtctttaaagaaaattgttgtgctttttgtatgattgatactttgcaataacatggttgcatgcatcaatcgatgcaaaggccccagggctccctcttttattgaaaaaggttaccatatacaagagcatgtcataatataatgagacaacacaataaagcaaccggagaatgtacccaatgaaaatgatttgtaatggacaacaaaaatgagaaaagaaaattgaacttacaatgataattttaggggtaacatcaaggccttgtttctttaacctaagaaccatttcatcctccaaagcacgaacttggtccaatatataaacaatctgccctccagtatctggcatgcccagcacattagcttgaccgaagtatccatgaggtgaaactatcacaacattaaagatcattgggatcctccccaagaatgtctctagtgtagatggatctggtgcttgaagaatatccagaaggagatgtatcatctctaagacatgttcagctgtatcaccccaacctttctccaagccccattcttgaaattgattggaaaattgtgaatatggtgtttcagatgggagcttcgacaggtgcctcgtgccgaattncctgcagncc

SEQ ID NO: 17994 - DNA, 636 bp, Triticum aestivum
  unsure (1)..(636): unsure at all n locations
  Clone ID: PAT_TA_17994
aaaaagtcacctcccccccgccccaaaaaggccacaggcgctccctcgagctccacttcatcggggtttcagcagctatctaccttaacatcggtgcagcaatggacgccatggagagaggacagagctccccgcggctgccaaagagccggggctcaaagatcgacgaggaaagcctcagggtgccgctgatagagagcaagaagactggcagccgggcgccggcggtggtcctcgggttcgagtgcctcgagagcacggccttcaacggcgtcgccaccaacctggtgctctacctggagagcgtcctgcacggcagcggcctcgccagcgcctccaacgtcaccacgtggatcggcaccagcttcctcacgcccgtcctcggcgccatcctcgccgacaccttctggggcaactacaccaccatcctcgtctccctcgtcgtctaccttctgggtatgatgctcatcaccttctctgcgttactgccgaccaccgactgtgcgggctgggctcgtcgtgccacccatttttcggcgagcacagcttctccggctcactccggcttcgcacggcgttcccccgggcccgcctgcgggcgncattcacacacaancntgacgganaagaaatgat

SEQ ID NO: 17995 - DNA, 423 bp, Triticum aestivum
  Clone ID: PAT_TA_17995
ggagaagaggccggacaaggtgaccggattgatcagcgcggagcaggccaaggaggccgagcgcagggaggccgaggagcgcaaggcggaggaggaggagggcggggccgcctgggccaagaacaagcacgtgtatcagttctgatcgatcgccgccgggcgccgcgcccggccgtgcatctcgcggcagatggtgttctgaacggaaaaagttcgcgagagatgatggtgtgcatgtatccaccgctcaccgtcacttggagattcgtgctacgttttcttgttttgtcaaaagcttgtcttgttccagagtgttgcatgatgtttctctttttaaaaattatcgtgatgtttcgatgtgtatatcagtaaaataagagagtactcagttcaaataaaaattaaaattagagagtactcgac

SEQ ID NO: 17996 - DNA, 790 bp, Triticum aestivum
  Clone ID: PAT_TA_17996
cttaatcagaagaagaaaaggagagcatccagccatggcagagaagaggagccccctgcacctgcctcaccacaaggaggaggacaaggagggggaggagaagcagcacggccatgaccacggtcacggtcacggccacgaccagagggagcacgccggcgggaggggggtggacatggacctgccggcgacctacgtcaacatgggctccatcgccaccgcgggcgttctcgacgggaggtaccagaaggcgacaggggagaagaggccggacaaggtgaacggattgatcagcgcggagcaggccacggaggccgagcgcagggaggccggggagcgcaaggcggaggaggaggagggcggggccgcctgggccaacgacaagcacgtgtagcagttcggatcgaccgccgccgggcgcaacaagaaggtgtgcctcttgcggctcgccgcgtcctgcccgaaacgtgcatgggagaagttgttctggaatggtaaaaaagttcgcgagagatgatcccttttttctagcacgcgtactatatggtgtacatgtatccaccgctcaccgtcacttggagatccgtgctacgttttcttgttttgtcgaaagcttgtcttggctcagagtgctgcgcgatgtttcatcgatgttttttaaaatgtatcgtgatgcttcgttgtacttttcgagagtgtatttcagtaaaataagagagtactcatcagatttgtatgaaatttcagagggtgtgtgctcttcgaagggatggcatctcatcgagtttct

SEQ ID NO: 17997 - DNA, 216 bp, Triticum aestivum
  Clone ID: PAT_TA_17997
gtcgcaatcccgtccctccccatgctgcgagtttttttgttgctccaatgagtgcataatggtttgctattatatataactaactaacgtaagctgtcggtatgtcacaatccgttccgtccccatgtgtgagtttttttgtcgctgtattgagtgcatatggttggttggtaaatgtggaatctcgttgaaagtagcttcaggtcacatatgttc

SEQ ID NO: 17998 - DNA, 592 bp, Triticum aestivum
  Clone ID: PAT_TA_17998
cccccataaactttgcacacaccaactatctgaatgaaaggactaaaagatggatagaggatgaaagttcttcagggaatacacaaacagaactccgtgtcgtaatcttggatctatcagctgtccctgcaattgacacaagtggcatagcattcctcattgacctaaagaaatccacagagaaacatggcctagagcttgtacttgtgaatccactggagaggtcatggagaaaatacaacgagcgaatgacgcacacaatcatttcaggccggactgcctgtatttgaccacaggggaagcaatcgcttcactttctggatttgccaagatggcaacaccttagagtggttttgctgaattgccattttgatcatctgattgcaatgttaaatttgcattgccttctcatcagtgaaagtgcctgcaacaaagcatttcacaagtttgtttgtagctatcttcagtgcccttcaagtctatgtgatggaaattaggtgcttgaaatatgtacattcatggtttcccatcaacatgagttctcgcaaattttgaacttcggtgttaagaaatagtggatatttaactaaaa

SEQ ID NO: 17999 - DNA, 1393 bp, Triticum aestivum
  unsure (1)..(1393): unsure at all n locations
  Clone ID: PAT_TA_17999
ttcctggtgctcctgctcgcggccaggcatgtgagcatcagatggccaaagttcttctggatctcagcgtgtgctcccttggcgtccgtcattgtatccaccctgctcgtcttcctgttcaaagcacagaaccacggcatcagcatcattggttcgctcaaatgtggcctgaatcgcccctcatgggacaaactgctcttcgacccgacatatcttggactcaccatgaagactggcctcgtcaccggaatcatctcccttacggaaggagtagcagttggtaggacgtttgcttcactcaaggactaccaggtggacggaaacaaagagatgatggccatcgggttgatgaacattgtcggctcatgtacatcgtgctatgtgacaacaggagcattctctcgctctgctgtgaaccacaatgccggctgcaagaccgccatgtccaatgtggtcatggcgctgacggtcatggtcacgttgctgttcctcatgccattgttcgtatacacgccgaatgttgtccttggagcaatcatcatcgctgctgtcattggcctgatcgatctccctgctgcatacaacatctggnaagatggacaagatggatttcctcgtgtgtctgtgcgcatttgctggtgtcatcttcatctctgtccaagaaggccttgcgattgcggttggtatatcgatatttagggtgttgatgcaaatcacaagaccaaggatgatgattcaaggcaacattaagggaacagatatttaccggaacctccatcagtataaggaggcccaaagagttcctgggttcttgatattgacagttgaggcccccataaactttgcaaacaccaactatctgaatgaaaggactaaaagatggatagaggatgaaagttcttcagggaataaacaaactgaactccgtgtcgtaatcttggatctatcagctgtccctgcaattgacacaagtggcatagcattcctcattgacctaaagaaatcaacagagaaacatggcctagagcttgtacttgtgaatccaactggagaggtcatggagaaaatacaacgagcgaatgacgcacacgatcatttcaggccggactgcctgtatttgaccaccggggaagcaatcgcttcactttctggatttgccaagatggcaacaccttagagtggttttgccgaattgccattttgatcatctgattgcaatgtcaaatttgcattgccttctcatcagtgaaactgcctgcaacaaagcatttcacaagtttgtttgccgcgatcttctgtgcccttcacgccgatgtgtcgtcaggttcctccnanantcccaacnttgaatcggcaaaanatcagntacgtaaantacgattcttaaaanggg

SEQ ID NO: 18000 - DNA, 773 bp, Triticum aestivum
  unsure (1)..(773): unsure at all n locations
  Clone ID: PAT_TA_18000
tccgcggcgaaaaaatgcgaaacccacggnaaggaggggagaaaaaaaaagnagnaagcaaaaagcgagcccccgatccccaccccctgcctccccaaccaccgccggcgatcgccgccgccgcggatgcgatgcgccccccctcctgcggccggggcggcaccgtgggccgcgcagggtgagagatccccgagcgtcggcactgcctcgtgcgcctccgagcttgccccccacgctcaccacgccgaccgccgcggcttcgcggccatgtggttgttctggcgcaccaggaaccgcttctccatcgaagagctccgatatttaacagatcagctacaaaagattcatgttgtttatgaagctaataaggaatttgtggttgaagcattgcgatcaattgcggaacttatgatatatggcgaccagcacgatccattattttttgaatttttcatggagaagcagattatgggtgaattcgctcgtattttgaggatttctaagctgtccagagtgtcactacagttgctgcagacaatgagtatcatgattcaaaatttaaggaacgagcattcaatttattacattttcagcaacgagcacattaacttcttgataacttattcgtttgatttccaaattgatgagatgctatcgtactacatatcctttttacgggcaataagtggaaagttgaataagaatacaatttccttgcttgtgaagacaaaaaatgatgaggtcatctcatttcctctttatgttgaggcctt

SEQ ID NO: 18001 - DNA, 556 bp, Triticum aestivum
  Clone ID: PAT_TA_18001
gccggccgggtcggggttcttatccccagaagcttccaccgaattggcaaccccatcctcctcctccccctcttctccctctgcattcccacgcggccctcgccgtctcttcatgcgccattcccgtctagcagcactgggcatctgcggcgcgcaccggtagaaccaaggatcggatcggaccggcgatgccgtgctctcctgccacaaaaaaaaaaaaaaaaaaaaaaaaaaaaaaaaaaaaaaaaaaaaaaaaaaaaaaaaaaactgggtctgttctgccgtttcccccgcaacagcggcatggccgtgggcctccggccggccgggcaggaaagccttccgcctccccctgctcgggatcaccgtccccaaccagccactcaactacgggtttaaaaatcaaggcgctctatgcaacgtaaaaaaaaaaaaaaaaaggcccctaccgcccgcggcccccgtgctgcacgtcggcacgctgcccccgccgcggcggaggcggccttcgacgaactggccagctacctcgtgtcgccttttctgcctgccgtct

SEQ ID NO: 18002 - DNA, 749 bp, Triticum aestivum
  Clone ID: PAT_TA_18002
gaattcggcacgaggaagtccagggcgggaggggaggcgagccgaggcggagcagagggaagcgcgagggagacgtcgcccgactgcgatgacaccaggcgccgacgccgtcatcatcgccgtagcagaagcgagccggagcgagcaggccaggagcggcggccggagcgcggccgaggcgccgtccgtcccgtcgtcctacgtcgtctgggagaaggagcggtaattggttggttcgaccgagcgagcgagcatggaggtggaggcggtgaggtgcgagtgctgcggcttcacggaggagtgcacgccggagtacatcgcggcggtgcgggccgagtacatgggccgctgggtctgcgggctctgcgcggcggccgtgggcgacgagatccgccgcgcgggcgcccggggccagcgcgccatcaccacggccgaggcgctcgaccggcacggcgctttcgcgcgggaggcgccgcgtgcgcccgggaagaaggcgtccgaggagctcgtggccgccgtgtcgcgcctgctccggcgctgcctcgactcgccgccggcgtcacccgccgcgccgcaggggcgcaaggtggcggcaggcccccggtgcacggacgctgacgacgcctgatcgatcgcctagccggaggcgaaggatagctagctcgtggtgggttgttcgccaatgattgggcaaagacgtcaggaataatacgtacttggggggcatgtgccttgtgtggcttgcctgc

SEQ ID NO: 18003 - DNA, 611 bp, Triticum aestivum
  Clone ID: PAT_TA_18003
tgaggaatgagtttgcttcctacttgtactctccacatggttgtagttcgcatgcactaattgcattcagtaccagatgtttgcatttccttgagctcttttcgctttcatctggttagtccaataccgcgatcaccagcaagatccaaatccccattgcttctccggcaaatggtgtagtggcaagtccagcggcaagcctgaagaaacgcagtccaagcaggagtccatctcggtcacggtcacctgatgcgaaatctgaatagaagcactgcaccggggcagatgaggcgtgtgctcaggtctagatatttgttgtcctctatgcttcttgagaattacctggatgtcagcaactgttcaatgagtctcctttattgtgtgaacaatgtcaacttgtattgctgaagacatcgaactagcactatcatatgcgatgcctgcagccagtctttcagtcaacttgtactttgtctgttacccttaagtggatgtatctagtactaacttggagttagacacatccatttgagggacaagcttgggacaagcttttggatatagggagtatttcgtggattttgttcaaaaatcatgcaagacgtttgtgt

SEQ ID NO: 18004 - DNA, 673 bp, Triticum aestivum
  Clone ID: PAT_TA_18004
cttcaaactcaacaaaagcatagccaggcggccttggaggaactggatgacactgaatttaagaatgcattttctaaaggttatataagggtgaaggaatatgatggcaaacgtgggcgctcctactcacgtagccggagcccaagtcgtagccgcagcaaaagcaggagcccaagcaaatctcccagggcccgctcagcatctaggtccagatcaaggtctctttcttcccgttctcgttcagcatcaaaaggacgttctccatcaagatcaccagcaagatcgaaatccccaattgcttctccggcaaacggtgtagtggcaagtccaggggcaagcccgaagaaacgcagtccaagcaggagtccatctcgttcacggtcacctgatgcgaaatctgaatagaagcactgcactgggcagatgaggcgtgtgctcaggtctagatatttgttgtcctctatgcttcttgagaagatgtcagcaactgtccaatgagtctcctttattgtatgaacagtgtcaacttgtattgctgaagccatcgaacttgagcactatcatatgcgatgcctgccagccagcctttcattcaactagtactttgtctgttaaatgttatttcgtggattctgttaaaaaattcatgcaagacgtttgtgtattcatgctt

SEQ ID NO: 18005 - DNA, 1305 bp, Triticum aestivum
  unsure (1)..(1305): unsure at all n locations
  Clone ID: PAT_TA_18005
ccgccgcgtcccgtgaccacaccgccgcagacgataatcggatgggtcgatatgaatcaatggatgctgcgcatgaagcgagcagagtaacacatgaaaataagtctatgaaaccaaataccaatgctataaccaatgtggccctaacgtttccaagcaatgtcaacctgctgcctgatggtgatgacataaatcggagcgatgtcagtggacttgctgaaatcgagaagatcatcaaacagaagcaattttctagggatgaaacagaacgtttgatagagattatgcgtttgaggactcctgatctccatggcgacgatcagagagctacacactcttttgcgaaagaaactgaaactacaccattttcaaacaaactggtgatacctgcaaagccagatgaacgaaattgggggactgatatgtttgcacagtcaaatgtgcatgatgctacttcacccattgaacttgctagagcttatatggaagcacagacctcagcaagtgtacatgaatctcaaaagagaaaattcagagctttgagtcatggagttgaaattgagaattcagcatcaaaaatattccctaaagtggccatggactctcctgtgcgctggccaggttcagttgtccgagaccatacaaaccactaccttacaccacaaagtaataaacgaagagctcttcctcctgcatcctctcggtcaccatatactggctcagttttccgaagatctgtcaagagaacaggacagcttgatacctatagtaactcatctgggcggccacagctttcaacacctttttccgttggaagtaaggctatgctagaggataaaatgacatcaattgatggtgttcttggagtgcaaccatcaacctcttctgaaagagtacatgtagatgccgttggcactgatactccacatacattcaccctagaaagacctcacggcaaaggcaccatagaaagcggttcgggtactggacgtataccagtggcagacaatatttccaagcatgctgctgtatctgttcacccgaagtcgagccaagacagctcagaaaatactccagcatcttgagaggacaattccatcccctacagtaaagccagagctaaggcgaactgcaaagagaactatttcccctgttgtcatcagcagcccgtataaaatgcccgactccatcactaataatgctcccaagacagaacancctcaatgagcgtgcantgcttatcaaggaattcaaatgtnaagaangtcanggaaccccaagcagtccaatgtgagggagccggtc

SEQ ID NO: 18006 - DNA, 1446 bp, Triticum aestivum
  unsure (1)..(1446): unsure at all n locations
  Clone ID: PAT_TA_18006
gccggccgccggccggaccgcaaccacagctcaaagtcaacacaggcacaaatcacttctcttacctctataatggctgcacaaatgaccccttcgaagcaggctgcttccggaattgagaacttgaacatggaatcccctgtcaagaagcttaactttggtaccgccaacaaggagaatgagcctcttaaccagaccaccgatactgccgagctgaagaccaagatcgttgaggagtccaagaaggacgagtccaagacagttgtctccaaggctgaggaagacgagcccatcctccaagaaaacccccagcgatttgttctgttccccatcaagtaccatgagatctggcaaatgtacaagaaggcagaggcctccttctggacagctgaggagatcgatctctccaaggatctccacgactggaacaaccgattgacttcagacgagcaatacttcatctcccacattcttgctttcttcgctgcctccgacggcatcgtcaatgagaatcttgttgagcgattcagcggcgaggtccagatccccgaggctcgatgcttctatggtttccagatcatgatggagaacatccactccgaaacatactccctcctcatcgatacctacatcaaggaccctgcccagcgtacatacctcttcaacgccgttgacactattccttgcatccgaaagaaggcggattgggccatccgatggatccaggataagaactctaccttcgctcagcgtcttgttgcttttgctgccgttgagggtatcttcttcagcggtgcctttgcttccatcttctggctcaagaagcgtggcctcatgcctggtctgagcttttctaacgagctcatttctcgtgatgagggtcttcacaccgactttgcctgtctcctccactctcacctcaagggacgtgccagcaaacagatgatccaggacattatcaccgatgccgtttctattgagcaggagtttcttactgaggctctcccttgtgccctgctcggcatgaactccaacctcatgaagcagtacatcgaattcgtcgctgatcgtctcctcgttgctctcggcaacgagaaggtgtacaagtccaccaaccctttcgacttcatggagaacatctcccttggcggcaagaccaacttcttcgagaagcgcgttgctgactaccagaaggccggtgttcttcacagcgccaacaagaaggatgaagaggaggcaccanagggcgagaacggnggcgacttcacctttgacgatgacttctaaacgtctcgtctggtctcgtcgtttcccttttcttttggcccgggcagttgctcaagggcacgtgacatgaatatatactctgggtttgtacgttttgagatgataatagtatagcactcctagatagtaggaagagatgaattgattagattatatccg

SEQ ID NO: 18007 - DNA, 1562 bp, Triticum aestivum
  unsure (1)..(1562): unsure at all n locations
  Clone ID: PAT_TA_18007
gccggccgggctgggatcctcaagaattgctgttgagactctctgcctcttcacttgtgacgactattaccccttactacgccacactatataatcaccatccacaagtccacatcagaacgttatcatgtctgcgcgaatcccagccattgctgctaaccgtgtcagcgatgctgctaagaagcagcttgacctcgtcgccaagtttgtcgaggaagaatgcattcctgccgaccccgtagtggaagcccttgctggcgagggtgatgcccgctgggaaggtcacccatccatcattgaggatctgaaggagaaggcccgcaagctcggtctctggaacatgttcctccccaagggtcattacaaggagtctcctggctggactaacctcgaatacggtctcatggccgagtggctcggtcgctcacacgtcgcgtccgaggcttgcaactgtgctgcccctgacacaggtaacatggaggtactggccaagtacggcaacgacgctcagaaggcccagtggttgaagcctctcatggatggaaagatccgctcagctttcctcatgacagagccccaggttgcttcctcagatgccaccaacattgagttgagcatccgtcgcgagggntaatgagtatgttctcaatgggacagaagtggtgggtcctagcggtgctggtgacccgcggtgcaagatctacattgtcatgggcaagacagatcccgataacaaggacccctaccgtcaacagtccgttatcctggttcctgctgagacacccggtattactatcaaccgtatgctcaaggtttacggtttcgatgatgcgcctcacggccacggccatctcacattcaacaacgtgagagtgcctgcctctaaccttgtccttggagagggacgcggatttgagattatccagggtcgtctcggacctggccgtatccaccatgctatgcgcagcattggtgctgctgagcgcgctcttgactggatgctcctccgagtcaacgatgagtccaagaaaccatttggcaaactcctccgcgaacacggtgtcattattgaatggatcgccaaatctcgcattgaaatcgacgctgcacgcctcattgttctcaacgcagccatcaagatggacgacctaggtcccaagaaggccctcaaggagatcgcagaagcaaaggttctcattcctcagacagcgctcactgttatcgaccgtgctatccaggcctacggtggtgcgggtgtctctcaagataccccattggcgtacatgtgggctggtatcagaacgttgcgactggctgatggaccagatgaggtgcatctgcagcagatgggacgcaacgagaacaagcgcagcgcggaggcaactgctacgattaagatgcagagagccaagaccgaggagttattgaaggcttatggtgtcgagagacttcagcccggtgccaggatacagcacaaagccaagttgtaagggtatagnntggntgagttaatagccacacattttgtttgtttgaagaaaaaaaaaaaaaaaaagccccta

SEQ ID NO: 18008 - DNA, 1258 bp, Triticum aestivum
  unsure (1)..(1258): unsure at all n locations
  Clone ID: PAT_TA_18008
acacctacgcctcctgcttttagtaccaccaccgccccggccctccgcctctgcctccctatctcgcccccggtcgcagcagcctcgtcgtcgcccccctccttcgccgtcggacgagtttccctccgccgtcgccgtcgccgtcgccgccgcgcttccttcagcggctgccgctgctcctcgtcctcccactcagaaatggaggccggcgctgggacagctctgtaccccgcgcaccgatgcaaaaccatatacctggtgaggcatgcccagggtattcacaacgtggagggcgagaaggattttgcagcatacaagtcacatgcgctgcttgatgctcaacttacccctttgggctggagccaagttgataccctgcgagagcatgtgacaaaatctggactggcaaaaaagattgagttggttattgtttcccctctactgaggactatgcaaactgcagtaggggtctttggtggtgggaactatactgatggagcaagtgcatcaccattaatggtagaaggtgctggaaacagtggacgtcagccaatttcaagtttgaactgcccaccgtttcttgcagttgaggcctgcagggagcactttgggtgttcatccctgtgnacagaggagcagcataacaaaataccgtacactctttcctgccattgatttttccttgatagagaatgatgaagatgttctctgggaacccgatgtcagagaaacaaatgagtctgttgctctcaggggcatgaagttctttgactggttatggacaagagaagagaaagagattgctattgtcagccatagcggtttcttgtatcacaccctaaacatgtacggtaaagagtgtcatccaaccatagcagaggagctgggcaagcacttcgccaactgtgagctccggtcaatggtcttggtcgacagaagtaaccttggatcggatgcctctaaatacaacttcgctgggaagataccgaccgggcttgatatgcccagcgatgtcgcagacgagaaggaggctgaagaagctagcaagaactgaaactgccgggcgcatggatgtctttgattcttttatcaaaccttggttctggctcacaatgaactgagaatagacaggcgacatctacggataggaactgccgtctgttgctctggtgtatgatcggcacgattggttatgtttatctgatttgttgtttgaacagaagatacccaaattcatgggaaataaggacttacacgc

SEQ ID NO: 18009 - DNA, 1529 bp, Triticum aestivum
  Clone ID: PAT_TA_18009
gccggccggtccggggaatcctcctgctgcttttagtagcaccactggcaccctgcgccgcggccgcctcgggccgctgcctctgcctcatcgtcctcctcgcgccccccctccttgcccgctgctggtcgtgtttccctccgccgtcgccgcgaccgcgcttcctccaccgactgccgctgctcctcctccgcctctccttaaacggcggccggtgctggtccgcctctgtaccccgcacaccgacgcaaaacgatatacctgtttaccccggcatcccctgcgtattcacaaagcgggagacgcgaaccattgtgcagcatacaagtcacatgcgctgcttgatgctcaacttacccctttgggctggagccaagttgataccctgcgagatcatgtgacaaaatgtggactagcaaaaaagattgagttggttattgtttcccctctactcaggactatacaaactgcagtgggtggtctttgggtggtggaaactatattgatggagcaagtgcatcaccattgatggtagagggtgctggaaacagtgaacgtcagccgatttcaagtttgaactgcccaccgtttctcgcagttggaggcttgcagagaggcacctggggtgttcatccctgttgacaagaggagcagcataacaaaataccgtactctctttccgtgccattgatttttccttgatcgagaatgatgaagatgttctctgggaacccgatgtcatgagaaccaaatgtgccttttgctttcaggtgaatgaagatcatggactgtgtatggacgaagacagaagaaagagatacatattggcagccagcgttctggggtatatcgctccttgaacgtgtatggaaaagagtgtcataggagattgcaactgtcggacttagcgggttcttgtatcactaccctaaacatgtgagggtcatggtatcatccaacaatattggcgcaggagcttggaaaagcacttccccaggtgtgagctcctggtcgaatgatctttgctccgatcagaaataaccttggatggctgatgccgctagaaaacaacttcgctgggaaggatacggaaccgggcttgatatgccccaacgcatgtcgctggacgtagaaggaggctgaagaagctatcaagaactgaaactgccgggagcttggatgcttttgattcttttatcaaacctcggtgctggctgacaatgaacttgagaatagacaagcgacatctacggataggaactgccgtctgttgctctggtgtatgatcggcacgattggttatgtttatctgatttgttgtttgaacagaagatacccaaattcatgggaaataaggacttacacgcataccccaaaaaaaatagaacagttcattatgttcgttatttggtttgttgtcggaacacatacccaaattcatgggagtaaggatgttttatacacgtggcccccttgttaatctaggacatcatgtccgatttaaaaaaaaaaaaaaaaaaaaaaaaaaa

SEQ ID NO: 18010 - DNA, 1180 bp, Triticum aestivum
  unsure (1)..(1180): unsure at all n locations
  Clone ID: PAT_TA_18010
gcgggcgctccccctcgtcccggagcccaaccgccgccacgccccccctcccccccacccccccatcgcccaccgcgacctctctcctcgccccgccaatgccgacctccatcgcctcctcctcctctcccaccgcccctctccttcgccccagacctagccgaatcgcgcgccccctggtccctcccgctcctcatggagtcggggggtgcgctcggcccgtcgggccgcctctgccggcggcggcggagtcggtactggcacggggctcgctcaccaagctcggcattttggccggtggacggggaggactaggctgcgcgtgcctgtcgccatacttcccagcctgggacgccgcggggcagcgcagcgcgggccctcccgccatggttgatggagcggttcgagagctgcggcagccatcgcttacatcacagaattatccgaggcggtggccctgtggaggatcataaggcgaatgtcattgtttcgcagctgctatacctagacgccgtcgaacctaagaaggaaattattatgtatgtgaatgcagtaatgaggatcggtgtcagctgggatggccatatttgatacaatgaagcacatcaggccggacgaaatgtatgccgctccccgaatttttgttgtgatcttttggtctttcgttagtttcgggacgagggcgaagacaaacagcttacctaactcatgcataatgatccaccagcctcttggaggagccccttgaacggatacctagcataccacactgggcagccctgggataaactcaatgtacttgctcgccgtccctgcataccacactgggcagcccctgggataagatcaatgtagatactgaccgtgacttcttcatgagcgcgaaggaggcgaaggagtatggccttattgatggagtaaccgtgaacccccttccaagcgctgctgccgcgtcctgctgcagctgtgcctggcccacgttgtttccgttagtctcgctacatgctgtaattttgcatcatgaagcttcacaggttgtgcagaacagatgcactactagaatattcatcatttgcggttacatattcgcaagctttcaaaggtctttcggaacagatccactactagaagattcatcgtttggcggtaagatatttcaccgnatccactttttttggtt

SEQ ID NO: 18011 - DNA, 693 bp, Triticum aestivum
  Clone ID: PAT_TA_18011
aaattccccaccttcttccagttccagcactcacaacccaccaaggaggagaatccccaatcccgatcagcctcagcagcgatggcccccaaggcggagaagaagccggcggcgaagaagcccgcggaggaggagccgacgacggagaaggccgagaaggccccggcggcgaagaagcccaaggccgagaagcggctgccggcgggcaagaccgcctccaaggagggcggcgagaagaggggccggaagaagggcaagaagagcgtcgagacctacaagatctacatcttcaaggtgctcaagcaggtgcaccccgacatcggcatctcctccaaggccatgtccatcatgaactccttcatcaacgacatcttcgagaagctcgccggcgaggctgccaagctcgcccgctacaacaagaagcccaccatcacctcccgggagatccagacctccgtccgcctcgtcctccccggcgagctcgccaagcacgccgtctccgagggcaccaaggccgtcaccaagttcacctcctcttagattgccatgtttacatctcagaaactgtagttggctgccgtgtatctaaaactagtgtttattgctcaatggaaattggtggaatgctgttagtttaaactagtgtttattgctgaatggaaattcgtggaatgctgttagttttggttcaaa

SEQ ID NO: 18012 - DNA, 707 bp, Triticum aestivum
  Clone ID: PAT_TA_18012
gaagaagtgcagcgcagcgccgaggacaagaccgtgcttgtggccacgtacgacggcgaccacaaccacgcgccgccgcccaagcaacaaggctctggtggcaggaagagcggcgacgcagccgccgtccgcgtatcaccggcgccggcgctcgtccagcagcagcagaagcaggaagcttcgacggcggagcaggtggccgataggaagaacctggtggagcagatggcggcgacgctgacgagggaccccgggttcaaggcggcactcgcctccgcgctctctggccggatccctgttgcttgagcggaaacctgccagcacaggagaatactctactggaaacctgccagcatcgagttcttgtcgatgtaagccgagtacagctctcggtaattaatcagcaggacacgacagatgcgtagccgagagttaagccgcaggtgctcgacaaagatcaaaaaacatggcttgacagatgtttgccgagagctaacatccagttacacggcaataggatgtgcaccagtggcacgtatgaatgatcattcaatccaacatgagaattgttgacagctaacagtagtttgcttattgggctcctcagtgtaggaatttgtagcaagcaccaagctataatggtgataaaccaaggtaccaatccatgaagtaccggtatcctataacagttgaatgctctgcaacac

SEQ ID NO: 18013 - DNA, 1222 bp, Triticum aestivum
  unsure (1)..(1222): unsure at all n locations
  Clone ID: PAT_TA_18013
tgttgctcacgcgttcgcccacgcgtccgcccacgcgtccgcccacgcgttcgcccacgcttccgccccgccgatctggcttcctggtttccttgctgcccaactagcttccccgtcgtcttcttcttcttcttcttctctcattcttgagctactgggaattcaagaaagacatggacgagcagtggatgatggggcagacttccctcagcctcggcctcaacgtcggccggccgacggcgccgcggggtgcccctccggtgaccaaggttctcgtggaggaggacttcatgtcctccaagaagaatcacgaggtcgaggcgctggaggcggagctccggcgcgtgggcgaggagaacaggaggcttagcgacatgctccgcgcgctggtggccaagtactccgacctgcagggcagggtcagcggcatgatggcggcggcggtggcggccaacaaccaccagtcacccacgacatctgagggcggctccgcggcctcgccgtccaggaagcgcgcccgcagcgatagccccgacaccgccgtccaggaagcgcgccctgccagcggcggcttcgccgtcagcgtcaacgtcggccccgaccaggcggagtgcacgtccgtccacgagccctgcaacagcaagcgcgtccgcgccgacgagtgcaaggccagcagggtatccaagctgtatgtccacgccgatgactcggacctcagcctcgtgtgtgacgaacacccagcacagtccgtccatcttcttcctcgtgatcatcgatcgcaacgaaagtttgttaccgtccattaactaatcaatttgcgcttgattttgacgagcaggtggtgaaggatgggtaccaatggcggaagtacgggcagaaggtgaccaaggacaacccatgcccgagggcctacttccggtgctcgttcgcgccgtcgtgccaggtgaagaagaaggtgcagcgcagcgccgaggacaagaccgtgctggtggccacgtacgatggcgagcacaaccacgcaccgccgcccaagcaacaaggccctggtggcaggaagagcgccgacgtaaccgccgtccgcgcatcaccggcgccggtgcttgctaagcagcagcggaagcagccagacggagcggcggagcccggacagaacaggaagggccaaatggaggacctacaaggaccgctgacaggggggtctgggcctcccgcggtntcaatn

SEQ ID NO: 18014 - DNA, 726 bp, Triticum aestivum
  Clone ID: PAT_TA_18014
gttcttccttccttctgtgtttctatatggtgtatattgcttacataaatatccagcaccacagcccagttaactaactgtaaaacaaaagaattcccatcataacacttcccctggcaaacaagtgggtacacaacaccaatcaagagtacatgcagaacatgtagaagaaactcaaaacaaactgcaatcacaatcatctcatcttccttcctactctaccagcaacaccttttctttctttacacatgcttctctctcctcccttccttttctctctttccctctcctcttatgttacaaaggcccacagcactgatttcttctcagctcagctcagctcctgaacccgaagttggtccaccgcctgcccccggcaccgtccttcttggcgccccgcgcagcaccaccggacccaaacaggttctctagcgacttctgcttccggttccgggaccgcccagcctccttcagcagctccgccagccgcttcttctcgtcctccacgtccgggttcgccgtgcccagcttctcctcccgcaccttcagcacgtgctccaggatctcgatcgcgtcttccacccttcccatggcatcatagatcgcagcaaggttgctgttcacgccaagagtatcaggatgagaggcaccacactcctgctcctggaccgccccggcctcctccaaccgctgggccgcctcatcaatcttgaacagctgtacgca

SEQ ID NO: 18015 - DNA, 558 bp, Triticum aestivum
  Clone ID: PAT_TA_18015
aaaaatctccattcagcagaaacaaaccaaaccaaaccaaagatctcagaagtcagaagccctgctgaacctcggaacctgaagctacgaaacaccaagcaaggcaaatcttttctccccctagctagatcaaaaccttctgtctcccgtctgcacagccacaacagcgatggcggcgaccgcgacgacattgatgaggatggtgctgctggtggtgctcttggtgcagatgctgaacgtcatggccgtctcggcgaggactttgaaggggggcgcctggctcaaggacggcatcgggatggtgatggagatgctcggcgacctgaaatcaggctccagccctcccacgcactgctgctaatcgaaccgatcaagcacacagtttttcttcggttagaagatgtaaagatgcgaggctctctttttctttttgcctctttgctgtagaggggtatagatagataggatcattctttcgttggagatcaactggccactcgacacaggtctaactgtaaccatgttatttgagtacaaaatttgttcattctttcaagc

SEQ ID NO: 18016 - DNA, 586 bp, Triticum aestivum
  Clone ID: PAT_TA_18016
cggccgctcgaggcggtctccatttctagcagaaacgaagcagcaacaagacctgctggagctcgtaacctgagctactaagcacgaagcaaggcaatcctttccatcctagatcaaaatctgctgtacgtctcccgtctgcagcagcgcaacgacagcgatggcggcgttgatgaagacgttgctgctggtcgtcttcttggtgcacatgttcaacgtcattgcgcctgtctcggcgagggcgttgaagggcgacgcctcctggctcaaggacggcatcgggatggtggtggagatgctcggcgacctgaaatcagggtccagccctcccacgcactgctgctagctaattgatcaagcaacaccatgcaatcacctcctcacagtttttcttcggttacaagatgtaaagatgcgaggctctgttttcttttgcctctttgctgtacaggtctatagctaggatcattctttcgttttagagaatcaactggctattcaaggaaggtctaaccttaaccatgtcttttgaatacaaaatttgttcgtgctttcaagcaatcaatcccaacgatagtgtgcgcgt

SEQ ID NO: 18017 - DNA, 632 bp, Triticum aestivum
  Clone ID: PAT_TA_18017
cctgtgcggcgctcgaggcggcgggtgacctaaagggtcatggagaacagaaatctccatttttagcagaaacaaaccaagctctcacttagatcagaaccctgctgaagctcggaacctgaagccactgagcacgaagcaaggcaatcctttccttcctagatcaaaatctgctgcacgtctcccttctggcgcaacagcagcgatggcggcgttgatgaggatggtgctgctggtcgtgttcttggtgcacatgttcagcgtcgttgcgcctgtctgggcgaggacgttgaagggcgacgcctcctggctcagggacgttgaagggcggagatgctccgcgacctcaaatcagggtccagccctcccacgcactgctgctagctaattgatcaagcaacaccatgcatcacctcctcacactcacagtttttcttcggttacaagatgtaaagatgcgaggctctgttttcttttgcctctttgctgcacaggtctatagctaggatcattcttttgttttacagatctatcaactggcctttcaacaaaggtcaaaccttaaccatgtcttttgaatacaaaatttgtccattctttcaagcaatcaatcacaatggatagtgtgtgcg

SEQ ID NO: 18018 - DNA, 597 bp, Triticum aestivum
  Clone ID: PAT_TA_18018
ctacgtccgctcagccggccgggccggggatctccattcctagcagaaacaaaccaaccaagctctcacaagccctgctgaacctcggaacctgaagctactgaacacgaagcaagcaaggcaatcgttctcccccctagatcagaacctgctgtctcccgtctgcacagcaacaacagcgatggcggcgaccgcgacgacgttgatgaggatggtgctgctggtggtgctcttggtgcagatgctcaacgtcatggccgtctcggcgaggacgttgaagggggacgcctggctcaaggacggcatcgggatggtgatggagatgctcggcgacctgaaatcaggctccagccctcccacgcactgctgctaatcgaaccgatcaagcagacagtttttcttcggttagaagatgtaaagatgcgaggctctctttttctttttgcctctttgctgtagaggggtatagatagataggatcattctttcgttgtagagatcaactggccattcaacaaaggtctaactgtaactatgttatttgagcacaaaatatgttcattcttccaagcaaaaaaaaaaaaaaaaaggccccta

SEQ ID NO: 18019 - DNA, 1445 bp, Triticum aestivum
  Clone ID: PAT_TA_18019
cgtgcccgtcctcggcgcccccgtaaaagcctcggacgcgtgggccgccacctgctgaagttctatgctcccgtggtccttgccacgacccctggcgcctacccgtccacaccccatggcccccagtctcctccggcccgcctccccgtgccgccccctcgcgccggccccctgcgccgccggccccggccggagccgcgccaccgtgtcgatcggtgattccagggcgcgctgcgttgccctgagggcggcaggatctcgacggagcgatttctcatgtactacaaaggcctcgacagatcattctggcttgacccgacaacttctagattttcaacatgatactgtagatgagacagatggaggatatgatccattcagtcaactaaaagagaggttcacggacttcaagcaacgaaactatgtggaaaattttaccaattatcaaaaacttgctgagcagcaaacaccagagttcatggtggttgcttgtgctgactccagggtctgccctaccagtattttagggcttcagcctggtgatgcattcactgtccgtaatgtggcaaatttggtaccaccatacgagcatggagcttcagagactactgcggcactagagtttgctgtcaactcacttcaggtacctaatgtgttggtggtaggtcatagtcgttgtggtggcatccaggcactaatgagcatgaaaagtaagaaagacgatcgaagctctagaacctttatcagagactgggtctcacttgggaagagtgcaagattaagcacagaagcagcagctggaaatttgagttttgaatcacagtgcagacattgcgaaaaggaatcaattaatagctcactgttgaacttgttaacatacccttggatagaggaaagggtgaaggaagggaatttgaaccttcatgggggatactacaactttattgattgcacatttgagaagtggacattagtgtaccgtccagggctggaaggtggcagcaagtatgccataaagaacaggtctacctggtcttgatcaatgaacaagcattatttatactctgaggaataaaaccggaatggagtaaagttggacacagcgaacaatacattactaccaaagtaaagcctgtaaactgccgggacaaagcgaattcaatccagctgctgtgcgttatctgtctagaatcgtgaaatggcggccagtaaaactgcaaaaccatagtcaaaggaaacaaatgtgccaccctgccgcatgccgctgtccttctccggtaactcctgttcattgttcgttggatcaccgtgacgttgtgacacggctttgtaacctctgggggccctgcgtttccctatggtctttgcatgcctgactcaaataagcaaaactgtgatgcaatgctattttgaatcaaaaaaaaaaaaaaaaaaaaaaaaactcg

SEQ ID NO: 18020 - DNA, 845 bp, Triticum aestivum
  Clone ID: PAT_TA_18020
ctgtgcgccgctcgggccggccgggccgggatcaacttccatctcacaacagcatcttctcgcccttcagcaacttgaccaacgcacgagttcttactcaaccgaagcaatcaaccactcaacttttttcaccaactctctcaaatctttcgaaatggctcccaaggctgctgacaagaagcccgcctccaaggctcccgctactgcctccaaggctcctgagaagaaggatgccggcaagaagactgccgcttctggtgacaagaagaagcgctccaagacccgcaaggagacttactcttcttacatctacaaggtcctcaagcaggtccaccccgacactggtatctccaaccgtgccatgtccatcctgaactctttcgtcaacgacattttcgagcgtgtcgcttctgaggcttccaagcttgccgcctacaacaagaagtccaccatctcttcccgagagattcagacctctgtccgcctcatcctccccggtgagcttgccaagcacgccgtctccgagggtaccaaggccgttaccaagtactcttcctcgacgaaataggtggtttcatagcttgatttgttttgggcatttggtttttcacgcgtggcatcagggtgtcatgaatctgaggtttcacggggatccagccctgtttttaggggcctcataatgcgttacgggatggttttgttttttatcctgggggcaatgtcttcacacacgggcaacgggggttcgcggttgtacaataaacatcgagaatagggtctcgatcaaatgaattcgtgcacattgaaaaaaaaaaaaaaaaaggcccctagggctgcggccgctc

SEQ ID NO: 18021 - DNA, 982 bp, Triticum aestivum
  Clone ID: PAT_TA_18021
ttaggtgctgcaccaggacatgaaggtcgccgccgtgaactccctcggctcgaggagcgtcaccaccctcatgcccctcctcggcggcttcctcgccgacgcctacctcggccgcttccgcaccgtcctcctctccaccgtcgtctacctcctcccacgcgtccggctcgcggtggctcagctggcgccgggactgaggccgagcggtgtctccgtgccgcgggttcacgagacgctcttcttcgtcgggatctacctcgtgtccgtcggcaccggcggccacaagccggcgctagagagcttcggcgctgaccagttcgacgacggccacgccggcgagcggctgcagaagatgtcctacttcaactggtggaactgcgcgctctgctccggggtcctgctcggggtcaccgtcgtcgtctatatccaggagcggatcggatggggcgccgccaccgtgctcctcgccgccgtcatgggttgctccctcgtcgtctacctcgcggggtggcggacgtaccggtacagggtgccgcagggcagtcccctcacgccgttgctgcgggttgtcgtggccgcggtcatgaagcggcgccttcagctgccagccgacgccggcgagctgtacgaggaggatgacggcaagaagaggctgctctcccacaccgaccagctccggtttctcgacaaggcggcaatctttgagcatggtggcgaggtctggcgcggggcgtggcgtctggcgacggtgacgcaggtggaggagacgaagctggtggtgtcgatggtgcccatctgggtggccacgctcccgttcggcatggcggcggcgcaggtgtccaccttcttcatcaagcagggcatggccatggaccgccacctgggcccacacttcgtgctcccgccggcgtccatcttcgccctggccgccatcgccatgatcgccaccgtggcgctcttcgacaagtgctcgaaccgtgcc

SEQ ID NO: 18022 - DNA, 654 bp, Triticum aestivum
  Clone ID: PAT_TA_18022
ttgaggcaaactatccagcaagagtatcgagaagtcgttgagagaaggttcttcacagtcactggaacaaagccttctgatgaggtgattgataacctcattgagaccggaagcagcgagcagatctttgagaaggctattcaaggaatcggccgagggcagattatggccacggttgaagaaattcaggaacggcatgatgtagtggtggatattgaaaaaaagcttctagaattgcaacagatttttgcagacatggcagcgcttgtcgatgcacaaggagagatattggataacatagagagccaggttcagaatgctgtaaaccacgtgcaaactgggaccgaagcgttgcgcagcgccaagagccttcagaagaagtcgaggaagtgcatgatgatcgcaattatcatgcttctcatcatcgcggtgatcatcgtgctatcagttttaaagccttgggctaagtaggaaaaaaattccctttgtgggacgcatgttgcaaacatgctttatccacttaataattgatatacttgcagtgagcctttctgatgtactcctactacttagctgagggtgctttaatcatttatttatgtacttagttacagtgatacgtatggtttggcatgtgacaatttttaaatctat

SEQ ID NO: 18023 - DNA, 585 bp, Triticum aestivum
  Clone ID: PAT_TA_18023
aaaaaaaaaaaaaaaaacacgaggtgcctgacacaccatcttgacaacattctttgccttctctcagaaaaatcaccgacattctgccattataccatggaggcctggaggaagacaaccatgtgttgtttgattcttttctgccttatggctacatgtagtgaggtttcatctaccgaaaacatgtgctatcacaaccattggaataaatgccatcctgatcaaaatggaatgtgtcgagatagttgtgtgaaagacggatgggatgatggacaatgccggaacaggtttaaaagactaatgggtgccaagtgcgaatgttaccctaagacttgtgatcattagggaggcaacatgcgactttcttctaccaagttactactatttataaatttacatcggttttaatgattgacgtcaaacatgttgtaacaccaatcatggtgaatactatatcaccttctatttatttctttattccagaccattgtattcaaattatgatgttacacaattatacataattaccgtttgatgtatccttaaactaaacagatttttgagtccttattagcaaaaaaaaaa

SEQ ID NO: 18024 - DNA, 1628 bp, Triticum aestivum
  unsure (1)..(1628): unsure at all n locations
  Clone ID: PAT_TA_18024
ngagctgtcgtgtcggaaagtcaatcagactgcagtggttcaaaatcctggttggtgcagtgcggtttgtgccatggtacatcaggatctcttcggaagactacaaacgggcaatgggttcatgctttttgtgccgagtggctcctggagaactcattcaaaaggggacatgcaatccagtagatggaatggtgggtcttcttaaggggaaagagaatgcttgatctgccaacacaatgttggcacatgcttgaagtgcagcaccgtaggctgtcaagttactttccaccctgcatgtgctagagatgctggtctttacatgaacacaaaataagtgggagcttgtggcaacacaaagcatattgtagcaatcacagtattgagcaaaaaaggttgactctcaacaatatggacccgcggaagtcaagatcatgaaacaaatgagggttgaattggaaagattacgtcttctttgcgagagggttgttaaaagagaaaaggagaagaaagagttgcttgtatgtgaacatgatatacttgctgtgaagagggactatgttgccttctcgatgcgggcttcatgttatacgcctgcacctggagcaagttcagaatctgccactacttccgttaataataattcatatggtgggaaaaggcaaaggtcggatgatatcacagcgagatcagacgatgtgacggtggatagtactattcccaggaaacacactatcaggttcccagtgcatagcaaggacactgataggaatacagctgacagttcgacatcaacaatatcatacaagcgtaagttggatgatgtggaatcactcgctcttaagaatcttcaagaaagggcagctactgccttgcgctcttcggaagacggcgaaccggcgtcggctgcttgcgccttgcgcagagcggaagacggagaactcatgccaacagataatgccttgcagaaatcagaagacggagaaacaaagtcaacagataatgccttgcagaaatcagaagacggagaaacaaagtcaacagataatgccttgcagaaatcagaagaccggtgaaataaagtcaacagataatgccttgcagatttcagaagatggagaaacaaagtcagcagataagcaacacaaagcatattgtagcaatcacagtattgagcaaaaaaaggttgactctcaacaatatggtcccgcagaagtcaagatcatgaaacaaatgagggttgaattggaaagattacgtcttctttgcgagagggttgttaaaagagaaaaggagaaggtactgtatctgtgatatgcatttactttttgtgccttttggttgcccagaaaactagacttcatcaggcactagtatgatctcttcgagaattactggcattgttcctttgtgctagtagtgatagtgctgattgacctgcatcatttgatttcataattattgtattatatctgattttcctatcaacgccttagttgtggatatttttctactgaactatcccttcagtctcaagatctgagtaccccacatattatatcaagagtaagttgaacttagtatactttggtgagcaattgatgcatgaacatagcgagtataaatttgac

SEQ ID NO: 18025 - DNA, 630 bp, Triticum aestivum
  Clone ID: PAT_TA_18025
cgtcatcccgcacccgcacgagcccaaccactctctcttctagctctgctccgtcctccatggaggggcgagcgagtgtgcgagtctgacttgcatgtgaccgagcctacagcaagcacacatccaagagacagagagaggaagtaatcttgcttgcttgcttagttgggttgggttttgtttcgtgtgtgcatctatggcgctgccggcggagagacggaccgaggaggccgcagtcaccggcgggtgccgggtgccggccgggcagggcgggctgccgatcggcttccggttccggcccaccgacgaggagctgctgctgcactacctgcgccgcaaggccctctcctgccccctccccgccgacatcatccccgtcgccgacctcgcgcgcctccacccatgggacctgccaggcgcgcccgacggcgagcgctacttcttccacctgccggcgacggcttgctggcggacgcatggcggcaccggcttggcgggtgcaagcggcgtgtggagggcctccggaaaggagcagctggtcgtggcgccccgctgcgggcaggccatcggcgcaagcggacgctcgtcttctgccgccccagcagggcgcgcaccggctgagccatgcac

SEQ ID NO: 18026 - DNA, 1251 bp, Triticum aestivum
  Clone ID: PAT_TA_18026
cccacgcgtccggcggctgggtgtgttccacgacaccggctaccttcctgcccgccaccatatagcggccaacctcctccccctttcccgctagctatcatcccgcacccagctactctctgctagctccgtcctccatggaggggcgagcgagtacctgagtctgacttgcatgtgagcgagcctacagcaagcacacggcctattgacccatccgagacagagagagggagtagtctttgcttgcttagttgggttgtgtctttgtgtgtgcatctatggcgctgccggcggagagacgggcggaggaggccccgggcgtcggggggtgccgggtgccggccgggcagggcgggctgcccatcggcttccggttccggcccaccgacgaggagctgctgctgcactacctgcgccgcaaggccctctcctgccccctccccgccgacatcatccccgtcgctgacctcgcgcgcctccacccatgggacctgccaggcgaggccgacggcgagcgctacttcttccacctgccggcgacggggtgctggcggaagggcgggggcgccggcagggcgggcggcagcggcgtgtggagggcgtccgggaaggagcggctggtcgtggcgccccgatgcgggcggcccatcggcgccaagcggacgctcgtcttctgccgccccggcggcgcgcgcaccggctgggccatgcacgagtaccgcctgctgcccgccggcctcgccgcctacgccaccgccaagagcctccacgccgccaaggactgggtggtctgccgcgtgttcaagaaggccacgccagcgcgccacggcacagcggggcggcgtagtgggggacgccgacgccgacatgacaccggcatcgccgtccccggcatcctcctgcgtgaccgagtcgcgcagcggcatggaggaggacgacgatgagaccgcctccaattcgccgcggcgagaggattagagcagctgacctgacctcaatcatggtccctgtaattttctaatgagtgccccgttaattcgtcgatccgctaatgtggtagcactagtagtacctcgtagtagtaatcatcagtcccaacttatcaggagaaacaaactgagctcaagaaaccaaccaaccgagctcaagcaatcaaacacctcaccatgtttgacgagtgagctgagaccgagagagctcacagtgaatcaaagagttcatgttccaaggttaaatcggaaaaaaaaaaaa

SEQ ID NO: 18027 - DNA, 555 bp, Triticum aestivum
  Clone ID: PAT_TA_18027
atcgcggacctgcagcaatcgacaacaagagccagagccgcagcgataataaagaaagaagaagaagcgagaagcttcgatcgttcaatcgagtttcggggccatggcgggatcgcggcgagggggcgacgaggaggcgtgccgggtcggcctcctggacgggcacggcggcgccaagaaggatgactggcaggtggtcgacggcggcgagggatccagcaagctcgggaggcgggtgttggaggagtcgaagaagctgtgggtgatcgtggcgccggccatgttcagccgcatcgtcaccttcagcatgaacgtcatcacgcaggccttcgccggccacctcggcgacctcgagctcgccgccatctccatcgccaacaccgtcgtcgtcggcttcagcttcggtctcatgcttggcatggcgagcgctctggagacgctgtgcgggcaggcgttcggcgccaagaagtaccacatgatgggcatctacatgcagcgctcctggatcgtgctgctcggctgcgccgtgctgctcctcccctgtacttcttcgcc

SEQ ID NO: 18028 - DNA, 876 bp, Triticum aestivum
  unsure (1)..(876): unsure at all n locations
  Clone ID: PAT_TA_18028
cagacccttcgtaccctcctgccacgtctcgccccgcacccccgcatccgtcgcggcgcantccgnccgttgccgaggagaatatggcgcctgcccctgctccgatcgtcgctgcctcccgaagatccccggcggacttgtagcagaggactccaagttcgtgccgctgaacgccgaggacccgatgtacggaccgccggcaatattgctcatcggattcgataaaagcgaggccgtcaagattcaggagttcctgaaggagctcgacggtgatttcctcaaggtgattcgttgtacagaagaaatgacgaaacaaactttgtgggatgctatgcacactgagcagcctaatgtagaagctgtcaagattatgaaatctccgcaaagaatatgcatcttttctggtctgaccggtgaggagatgatgatgttcatcaacgccttcccagaaacagggttggaacaagccgctttcgcagcacttgttcccaacagcgcagagaaggttcttgctgaggtgatcgaggaaataatgggtgaccatgagatgctgacgggaaagaattcagcatgaaggtagtatgtctcaggtagtgacctgtccgcagagacaaaatcaggcagcattgaactgatcctcaaatggtctcttgaaatcgcccgctccaagtgatccaccgtgtaaatgtcaatccttcgactgtctccatctgctggtaaatgttaatctactagctactgtttcaaacccgcagctgcaagccctgcagctagatcactgttcatttgaaactgagatgaacattactgaggcttttcttgacgtaaccatgtaattacaatcttttttgttggaagcacttaattcttggacaa

SEQ ID NO: 18029 - DNA, 760 bp, Triticum aestivum
  unsure (1)..(760): unsure at all n locations
  Clone ID: PAT_TA_18029
atctcgttccctcccgcccgtatatcattgctacatcaagataaatgtgacgattcntgaaattgacacttacatgtgttcatcaatgtgctttggatacttgctaatccttatgtcctactatacattctttgtatggacattggatggtcatttcggtgtcttctagatgcgcctcctcgttgtttctgcagaaaagaagattttgtaatctcagtcaggaaccagggaaaattcagataatcttgcggcgtcacagatctacaaggaaagcttttggttctaactgaaataggggattagttcagacaaacaaagctgctctcagaagaataaaggccagcgcttgaactgttctgcacatgctatttcacaagaatatgacaacgcttgcagtaaagagtccttcgttacctacatgctactatttcacaagcatatggcagcgctgttgctgcacatgctacttcacaagctggatgcttctgtgcaattactgagactaaggttccgagacaactgaacctggcgacgactctaaccatccacacacaacgccaggatttcaaatctacgcggcactaaccaatgagccctggcgtcctggcgacatggaggcatctggttgctccaaaaaaggaaactgtaaagattccgataagcttcggtttcttaccgatgagttttcgagtgagtggcataacgacggaaggcaatccaagccttgcatttcttacagtacctcggcgcgaccacgcta

SEQ ID NO: 18030 - DNA, 775 bp, Triticum aestivum
  unsure (1)..(775): unsure at all n locations
  Clone ID: PAT_TA_18030
gngaggaattggtgtcgtgcttgggcagggcttcgagttgggaaggaagcagagcaaggatcggcaatgcgagctgtgccgagaaatcttatggacgctgcggctacagcgagaagaaggaattccttgtttgcttgtgctccggcgggaactgcagcagcagcggcgccgccgctgggtatccaaatcgaaaccctccatcatcagaatcgaagaggaaatataagatgatcatagcaggttcagtggccggtgccgcagtctttattgctcttgccgctgtagccgtcttgttcattcgcaagagaccgacgcgtccggtcgtgaactcgtcttcgaagctcctcaagtacaggtacagcggctcgggcgggaccccgacgcgctccaggggcggcgacatggagtccggcagctcccaggacatgggcaaccggttcagctacgaggagctcgaggaggccaccgattccttcaacgagaacagagagctcggcgacggcggcttcggcaccgtctacaaaggttaccttggggacgggcgggtggtggcggtgaagcggctgtacaacaacagctaccggcgcgtggagcagttcgtgaacgaggcggcgagatgcgcccgccgatcagggaggtgctggacgtgctcagggccatccaggatgactgcctgggtcacaaagacggtggaggcaaaggcaagaaggacttcgccgagcccttctctcccaacacggtgcacgctccctgggacagcaggaacaccacccct

SEQ ID NO: 18031 - DNA, 1376 bp, Triticum aestivum
  Clone ID: PAT_TA_18031
gaggatcaatgctagcatgaccttgtactcctcggcgcgtactgcaagctagcgcggaaccacgacgcgcttcacgtgcggccacatggagtgcgtcagctcccaggacatgggcaaccggttcagctacgaggagctcgaggaggccaccgattccttcacgagaacagagagctcggcgacggcggcttcggcaccgtctacaaaggttaccttggggacgggcgggtggtggcggtgaagcggctgtacaacaacagctaccggcgcgtggagcagttcgtgaacgaggcggcgatcctggcccggctgcggcacccgaacctggtcatgttctacgggtgcacctccaaggagagccgcgagctgctcctggtctacgagttcgtccagaacggcacggtggccgaccacctgcacgggccccgcgcggcggagcgcgccctgccgtggccgctccggctcatcatcgccgtggagtccgcggcggcgctgacctacctccacgccatcgagccgcccatcgtgcaccgcgacgtcaagaccaacaacatcctcctcgacaccgacttccacgtcaaggtcgccgacttcggcctctcccgcctcttcccgctcgacgccacccacgtctccaccgccccccagggcaccccagggtacgtggacccggagtaccaccagtgctaccagctgacggacaagagcgacgtgtacagcttcggcgtggtgctggtggagctcatctcgtccaagcccgccgtggacatcacccggcagaggaacgagatcaacctggccggcatggccatcagcaagatccagaagtgccggctggaggagctggtggacgtggagctcggctacagtcggacccggcggcgaggaagatgatgaccatggtggcggagctggcgttccggtgcctgcagcagaacggcgagatgcgcccgccgatcagggaggtgctggacgtgctcagggccatccaggacgaatgcctgggtcacaaagacggtggaggcaaaggcaagaaggactttgccgagcccttctcccccaacacggtgcacgctccctgggacagcacgaccaccacccctaacaccagccagtagtagtagtattaggtcagtgtttgcgaccggccgagttttacttcatcactgttgagagatttgcttgccgtgtatgaggagcgatccgacgattcttttttgtccctttcaggtgatgtaaatatgtgattggttttttaaactgccacggtagagacagtactgtacatactgcgtacgtacgctggagtggtgtgctgaactggttatatgatgcatatgattacataggtttttaccaaaaaaaaaaaaaaaaaa

SEQ ID NO: 18032 - DNA, 519 bp, Triticum aestivum
  Clone ID: PAT_TA_18032
cggcgacgaggggcacccccggctccggccaagaaggagaagagcatcctggacttcatcgtcagcgccatcgtcaaggacgagcaggagttcatcgagaccaacccgctgctcaacaaggtggacggcccggcgccctccgccggcggcaccgcctccaggaaggccggcggcaccaccgccggcaagaagcccgcggccgacagcgagggcggcggcgggttcaaccttggcggcctcttcgccaagaaaggctaggctaaaccagcccgcctaatacgtaggcgcgcgcttgggtgtgtgcttcgatctcatagctcgatttattgctgtaactccatgaaaaacatcgcagagatctgcatatatgtacgtacacgcggtgtgactactcaaacgattcttgctgtgatgccttatagatttgtattcttcttcacacaacttctggagtattttctctcaaaggctcagtatgtgcatgttgtattgtacccatgttaagcttgctttgctaac

SEQ ID NO: 18033 - DNA, 674 bp, Triticum aestivum
  Clone ID: PAT_TA_18033
catacatacatttcgccgccaagaatcgccaagaaatccacgagagccacctagcgttagcaatggcatcggtggggttcggcagcagcgtggcggcagtggcgccggcgtcgtcggcggggaggagtagccttcgcccgcagcggacgcggctggcggtgccggcggcgacgaggggcacgccggctccggccaagaaggagaagagcatcctcgacttcatcgtcagcgccatcgtcaaggacgagcaggagttcatcgagaccaacccgctgctcaacaaggtggacggcccggctccgtccacgggcggcaccgcctccaggaaggccggcggcaccacctccggcaagaagcccgcggccggcagcgagggcggcggcgggttcaacctcggcggcctcttcgccaagaaaggctgaactacataagcacgtgcgcgcgcttgggtgcgtgcttcgatctcatagctcgatttattgctgtaactccatggaaaacatcgcagagatctgcatatatgtacacgcggtgtaactactcaaatgattcttgctgtgatgccttatagatttgtattcttcttcacacaacttctggagtaatttctctcaaaggctcagtatgtcatatacccatgttaagctttgctttgctaagatcccaataccgac

SEQ ID NO: 18034 - DNA, 961 bp, Triticum aestivum
  Clone ID: PAT_TA_18034
ccgaattcgacagggggttcaacagtcccaccatacatccatttcgccgccaagaatctccaagggatccaaccaggagagccagtagctagcaatggcgtctgtggggttcggcagcagcgtggcggccgtggcgccggcgtcgtcgacggcggggaggacgagccttcgcccgcagcggacgcggctggcggtgccggcggcgacgaggggcacgccggctccggccaagaaggagaagagcatcctggacttcatcgtcagcgccatcgtcaaggacgagcaggagttcatcgagaccaacccgctgctcaacaaggtggacggcccggcgccctccgccggcggcaccgcctccaggaaggccggcggcaccaccgccggcaagaagcccgcggccgacagcgagggcggcggcgggttcaacctcggcggcctcttcgccaagaaaggctaggctgaaccagcccgcctaatacgtaggcgcgcgcttgggtgcgtgcttcgatctcatagctcgatttattgctgtaactccatgaaaaacatcgcagagatttgcatatatgtacgtacacgcggtgtgactactcaaatgattcttgctgtgatgccttatagatttgtattcttcttcacacaacttctggagtaatttctctcatgttgtgatgtacccatgttaagcttgctttgctaagatcccaataccgacaaacttaataaatgagggacttcccatttaccacatccgtgtataaatctactcaaggctgccccataagtttcgcctcaattcctctgtttaatcctcaaccgcttgggtagcccgtccgccgtccaatccccttcagactacgctttcccgcctcaaggggcttctcccaattctcccccggcctcctggctttcccctcgtctcgcgtagcacccctcccactacgggctcatccatgcctca

SEQ ID NO: 18035 - DNA, 698 bp, Triticum aestivum
  Clone ID: PAT_TA_18035
ccctttcccaagccactgctaagtccccatttttggccccggcggccgcacaacaaggggcagatgcagccgatcccgtggccacgccggcgcccgcatgcgggccgatgtagctgatcgtccctgtgggagtccaaccatggcggcggcagcgaagccacgggtcccttcggtggtggagccatggatcccgtcggtggccaacccaggcggcgatggcggcggtgccatggatcccatcggtgggcaacctaggcggaggcagcgccatgaattccatcggtggccagcggggagaggccagtggcggtggccaacataggcggcggcggcgccatgaatcccactggtggtcagcgaggggaaggccagcggaggctgcaatggcagtggctggtggccaaccttggtgcccgtcggtgggacaaggccgtgatggccaccgtcgcaggaggcgtgtggatctgactccaatggcgccggcgagctcatcctcctcttgtccgacgaggaggacttggtgagcttcggctccgactctgttggctctgacgagctcatcctcctacggactgcggcctctaatctttgaccccatgtaattagctaggatttaactagtgattgtgaactattgcttagtttgttgtatgtgggaccgatgattcttgtgttaattactgttgttttaattgatc

SEQ ID NO: 18036 - DNA, 1102 bp, Triticum aestivum
  Clone ID: PAT_TA_18036
tcgaccggcatgacgaacgggtacctgttccgggagtacctcggcgcgcattccacgggcgtccggttctccgacgtgcccgtcaaccccggcgtcagctgggggtacatcctcgccttcgccatcgactacacgccggtggccagcagcccacgccggcgcccaccaacggcgtgttcagcgcgttctgggacacggcgaacctctcccgcgccgacgtggccgccatcaagaccgcgcacccgaacgtgagcgtcatggccggcctcggcggcgacagcgtgctggacatcgtcaaggtctccttcgcgccggcctccgtcgactcgtgggtagccaacgccgtggcctcgctctcgcgcctcatcaacgagtacggcctcgacggggtggacgtcgactacgagcgcttcgccgccggcgtctccgtcgacaccttcgtggagtgcgtcggccggctgctcacccggctcaaggccgccttccccaacatcaccacctccatcgcgcccttcgaggacgacaccgtgcagaggtactaccgggcgctgtggagcaggtactccggcgtcatcgactacgtcaacttccagttctacggctacggcgccaacaccgacgtcccgacctacgtcatgttctacgaccgccagacgggcttctaccccggcgccagggtgctcgccagcctgcagaccggcaagaccacggaggagctcggcctgctctcgccggaccagggcatcgccgccgccaaggagctgctaaggcagaacaagctgccgggcttcttcatctggtcggccgacagctccaagcagagcacctacaagtttacctatgagaccagggcgcaggagatcgtcgccaaccattgaattgatctccaaacggacgcgcggtatacactacagtactactatcaatactaagagttactattaggcttgccaagagccgtactagaataagtgcacttgcaagtgcgcgcgtgcaatcatacttgtttgcaaaactactactgtatgacagtatgagagtggtgtgatgaccgtaagaataaggcggatggttcagggataaagtgaagcatcgttgatcc

SEQ ID NO: 18037 - DNA, 1161 bp, Triticum aestivum
  Clone ID: PAT_TA_18037
ctccaggacatagcaaggcgttgacccactgaggagctagatttcattcgatccgttgagctagccatgacgaacgggtacctcttccgggagtacatcggcgcgcagttcaccggcgtccggttctccgacgtgcccgtccaacaccggcgtcagcttccacttcatcctcgccttcgccatcgactacctggcgagccagcagtccaagcccacgccgaccaacggcgtcttcaagccgttctgggacacgggcaacctcacccccgccgccatggccgccgccaaggcggcccaccctaacctgagcatcatggtcagcctcggcggcgacaccgtccagaacaccggcgtcaacgccacctacgcgccgacctccgtcgactcgtgggtggccaacgccgtctcctccctctccgccatgatcaaccagtacgggctggacggcgtggacgtggactacgagcacttcggcaccgacgtcgacacgttcgtggagggcatcggccgcctgctcacccagctcaaggcccgcttccccaacatccgcacctccatcgcgccctacgagctccccgtcaaccagaagtactaccaggctctgtggaggaagtactccggcgtcatcgactacgtcaacttccagttctacggctacggcgccaacaccattcgtccagtactacgtgcagttctacgacgagcaggcgcgcaactaccccggctccggcggcaccaagttgctcgccagcttcaagaccggcgacgtcaccggcctgctctcgccggatcaaggcatcagcggggccaaggagctccagcggcagggcaagctgccggggatcttcatcttttcggcggatagctctaagatgagcccctacgggtttaagtatgagacccaggcgcagcagatcgtcgccaaccactaagggtggtggattctatccatgactacggcgcacaaataagacaagtttgctgcatacagcatatatacgtacgaagccatgtattgcccggatatgtacggggactaaataaatatcgtgtacgtactcaattcttgaataagcggtattaccatgcgaataaggcggatggttcagggataaagtgaagcatcgttgatccacccccaaaaaaaaaaaaaaaaaaaaa

SEQ ID NO: 18038 - DNA, 380 bp, Triticum aestivum
  Clone ID: PAT_TA_18038
cggacgcgtgggccacagtccaactacccatcctctcctcccgagtcccgagtctgcagccaaagcagagcaccacccagccgccgccggaagagcacgaggagatgggctccgggacggggaaggtggtgtgcgtcaccggcggctcgggctacatcgcctcctggctcgtcaagttcctcctccagcgcggctacaccgtccgcgccaccgtcagggacaccgccgaccccaagaaaacattgcacctgcaggccctggatggagccaaggacaggctgcacttgttcaaagcaagcttgttggaagaaggctctttcgatgctgcggtgccggctgcgattgtgtctttcacacgggttctcccttttatcacaatg

SEQ ID NO: 18039 - DNA, 1113 bp, Triticum aestivum
  unsure (1)..(1113): unsure at all n locations
  Clone ID: PAT_TA_18039
aaaatctcagaccatgatcccaagccgaggccttgccagggcagcgctcttcgcacccagaagatcagcaacatcgtttcttcttcgacagcggattaatcaacacacaacacgacgacaacctctgaaccgcgcttgaaccacattcatcaacgcaacacacgtctcctgctctcaccgttcgttgctccgcacgtcagcaggacttgccaatggcgggagacggcgagctgaagctgctgggcgtgtggacgagcccgttcgtcatcagggtgcgcgtggtgctcaacctcaagtcgctgccgtacgagtacgtggaggagagccttggcaacaagagcgcgctcctcctgggctccaacccggtgcaccatagcgtgcccgtcctcctccacggcggccgccccgtgaacgagtcccaggtcatcgtgcagtacatcgacgaggtctggtccggggccggcccgtccgtgctcccggccgacccctacgagcgcgccgtggcgcgcttctgggcggcgtacgtcgacgacaaggtcgggccggcgtggacggggatgctcttctcgtgcaagacggaggaggagagggcggaggccgtgtcccgcgccgtggcggcgctggagaccctggagggcgcgttcgcggaatgctccaaggggaaggcgttcttcggcggcgacgccatcggattcgtcgacgtggtgctcggcggctacctcggctggttcggggcgatcgacaagatcatcgggcgccggctgatcgacccggcgaggacgccgctgctggcccggtgggaggagcggttccgcgcggcggacgcggccaaggcgtcgtgccggacgacgccgacaagatgctcgagttcttgcccaccgtgctcgcttgggtcgccgccaaagccaagtgaactgtgaggccgtgacatgcatgtgtgtgtgtgtgtgtgtgtgtgtgtgtgtgtgtgtgtgtgagggcggccagtgtgtgctgaataaatgcaccgcatgtcgtgtgttgtgccaagggcaaacgatgctgaataattttgctgtttgtgtgcaaaaaccnnnncccccccacncttgccgcccgcttcctcctcctttc

SEQ ID NO: 18040 - DNA, 839 bp, Triticum aestivum
  unsure (1)..(839): unsure at all n locations
  Clone ID: PAT_TA_18040
tattccaatttcagctttggctgggtaaatgttaaagatgttgccctggcacatatccttgcatatgaagttccttcggcaaacggaagatactgtatggttgaaagagttgctcaccactcggagattgtcaagatcatacacgaaatgtaccccaattttccagtgccagacaagtgtgcagatgacgcaccatttgtccctatctaccaggtatcgaaggacaagataagaagtttgggtatggagctgattcccctggagacgagcctcaaggagactatcgagagcttgagagagaaaggatttgttacttctgagtcaagccatctatgaaaccttctttcctttggcgtcactggatgcatacatgtttatgtacacctgaaataaatggaggcatattgtgctctatggatccgttgtgttctcatggattcgaggttcaagacgttcctcagaatgtgggcagccaggagcacgcttagcaaatagaaagacccactacttagtgtcgatgacatgttggtggacttcactctctagtgacatatagtgtgtatttctacatgagtttatatgtatactatactctatagataatttctgaaaataatccaactgagaaaaaaatgtcttaagtggaaactgggtctaagggggattcagtatttccagactattgagtagtgtaagtgtcatgacaattattggtcatgatgcagtaattgttggttctagtcaagcaacaattgcactccctatgngtactatgtggtaatctttgctggatgtatctatattctacccatacttcactgaatttttagaatatttat

SEQ ID NO: 18041 - DNA, 479 bp, Triticum aestivum
  Clone ID: PAT_TA_18041
cggacgcgtgggcggacgcgtgggcggacgcgtgggtgcagatgatgcgccgtttgccccaatctaccaggtatcaaaggacaagataagaagtctgggcatggagctgacacccctggagacgagcctcaaggagactatcgagagcttgaaagagaaaggatttgtcacttctgagtcgagccatctgtgaaactttctttgctttggcaccactagtggcagacgctggatgcacacatgtttatgtgcacctgaaataaatcgaggcatagtgtattcttgagacatgtatttgtggatctgctgtgtttcaatggattcaagttcctagacatgtataaccagtacacaagaatgtatgatgaatgcttctagaaagattatccatcctgtattatttcctgaaaaaaaaaaaaaaaaaaaaaaaaaaaaaaaaaaaaaaaaaaaaccaaaaaaaaaaaaaaaaaaggccccta

SEQ ID NO: 18042 - DNA, 483 bp, Triticum aestivum
  unsure (1)..(483): unsure at all n locations
  Clone ID: PAT_TA_18042
ctggttatatcaagaacctccgggaggctgcccgctccgacgggaaagcggcggtgaacctgatgaagctcacccttttccgccagtactacgtggttgtcatctgctacatttacttcacgcgtgttgtggtgtatgcgttggtgaccatcacctcgtaccggtacctctggactagcgtcgtggctggagagattgccacccttgcattctatgtgttcactgggtacaggttccggcctgaggtgcacaacccatactttgcgattgatgatgatgaggaagaggctgcagctgaagcactcaagttggatgatgaatttgagctatgagtactataatttggcgggctattccctgccagtgctacacaggtgttatatgtgcttttacaggacaagtgcttttcacaagacanatgcgatagactggtatctagtccatacccttttgtttttcatttgaagttagttaacattttgc

SEQ ID NO: 18043 - DNA, 2470 bp, Triticum aestivum
  Clone ID: PAT_TA_18043
agtcctaccgacccatcctccccttccgagtctccacacctacccagccgccgccggcggaaagagcacggcgagatgagctccgggatggggaaggtggtgtgcgtcaccggcgcctcgggctacatcgcctcctggctcgtcaagctcctcctccaccgcggctacaccgtccgcgccaccgtcagggacaccgccgaccccaagaaaacattgcacctgcaggccctggatggagccaaggacaggctgcacttgttcaaagcaagcttgttggaagaaggctctttcgatgctgccgttgccggctgcgattgtgtcttccacacggcctctcccttttatcacaatgtcaaggatcccaaggctgagttacttgacccagcagtcaatggaacactcaatgttctccgttcctgcaagaaagcctctatcaagagagtgatcataacgtcgtccatggctgctgttgcctacaatgggaagcccagaactcctgatgtagtagttgatgagacatggttttcaagtgcagaggtctgtgaaaagaatgagcaatggtatgtgctatccaagacccttgctgaggaggctgcatggaagttcgcaaatgataatggatttgaaatagttacaataaacccagcaatggtcatcggtcccctgttgcagcctacactgaatactagcgcagaggcaatattgaagtttataaatggatcatcttctacataccccaatttcagctttggatggataaatgttaaagatgttgccctggcacatattcttgcatatgaagttccttcaacaaacggaagatactgtatggttgaaagagtaattcaccactcggaccttgtcaagatcatacacgagattctgcaaccactttcatccagccgcgcgcctggccggccccttaatcataccacaacccgagcattctgcaaccactttcatcaacgtctcctacgctcaccgttcgttgctccgcacatcagcaggacttgccaatggcgggagacggcgagctgaagctgctgggcgtgtggacgagcccgttcgtcatcagggtgcgcgtggtgctcaacctcaagtcgctgccgtacgagtacgtggaggagagcctgggcagcaagagcgcgctcctcctgggctccaacccggtgcaccagagcgtgcccgtcctcctccacggcggccgccccgtgaacgagtcccaggtcatcgtgcagtacatcgacgaggtctgggcgggggccggcccgtccgtgctcccggccgacccctacgagcgcgccacggcgcgcttctgggcggcgtacgtcgacgacaaggtcgggtcggcgtggacggggatgctcttctcgtgcaagacggaggaggagcgggcggaggcggtgtcccgggccgtggcggcgctggagaccctggagggcgcgttcgcggagtgctccaaatggggaaggcgttcttcggcggcgacgccatcgggtttcgtcgacgtcgtgcttggcggctacctacagtgctaaggttcggggcgatcgacaagatcatcgggcgccggctgatcgacccggcgaggacgccgctgctggacctagagtggggaggagcggttccgcgcggcggacgcaggccaagggcgtcgtgccggacgacgccgacaagatgctcgagttcttgcccttaccgtgctcgcttggtattcgccggcaaaggcgaagtgaactgtgtctgtgatggccgtgacatcgccagctcgtgacatgtgtgtttgtgtgtgctgacatgtgtgcctagaagtccgtccagtgtgtgctgtaataaagtgcaccgcactgtacgtgtgttgtgaccaagggcaaaacgatgcttgaataattttgatgatttgttgattgaacaggaaaagaaaaataaattatttgtcacttcttagatggagccatctgtgaatctttgtttgctttggcatcgctagtggcagtcgctggatgcacacatgtttatgtgcacctgaaataaatcgaggcatagtgtattcttgagacatgtatttgcggatctgctgtgtttcaatggattcaagttccgagacatgtataaacaatacactgttaaggacatgcagtggtacttaaactctcttagtgtacattaatagtgtgatatttctacatgagtttatatgtatactatactctatagataacttctaaaaataatccaattgagaaggaaatgtgttaagtggaaaccgggtctaagggagattcagtatttccagactattgagaagagtagtgtaagtgtcatgacaattgttggtcatgatgcagtaattgttggttctagtcaagcaacaattgcactccctatgggtactatatgataatctttgctggatgtatctatatcctacccgtactttgccggattttaagaatatttataaaaaaaa

SEQ ID NO: 18044 - DNA, 1707 bp, Triticum aestivum
  Clone ID: PAT_TA_18044
cctcttttcccctcctcggcatctcgcctctcccgaagcttccgcctcccccgtctctctctagggttttgcggcgaaccccagcgccgatccccggcagcagcatggacgtggactgcgaggtctcggcggcggcggccacggcggtgacgaacgggctgggcggcggggagcaggccgccgcggcgccggtctccgtcgaccagctcgacgtggaggcgtacgcggcgcagtactcgggccggacccgcgtggcgcggctcctcttcatcgcggagcggtgcggggtggaggcgatccagctcgaggcgctgcggatggcgcacgacgaggccagggcgcgcgaggacaccgtgctctacctcgacgccgtcctcaagatcaacggccgcctcggcccgcgctaccgccacgaccaggcctgggtcgactccgtcaaccgccgcgccgagcagcgcaaggagaagctcgagaccgaactcaacggctacaggactaacctgatcaaagagagcatcagaatgggttataacgacattggtgacttcttctatgctcatggccacctttcagaagccttcaaaagctatatccggacacgggactattgcaccacttccaagcatatagttcagatgtgtatgcatgtgattctggtcagcattgagttgggacagtttgcgcatgttaccaactatgtcagcaaagcagagcaaaccccagacaccttggatgctgtcattgttgcaaagttgcgagcagctgcaggattagccaacttggagacaaagaaatacaaacttgctgcccgtaagtttctcgaggacaggacctgaactaggaagcaactattctgaagtcatagctccgcaagatgtggctgtctgtgggggcctttgtgcccttgctcctgtcgatcgtccacaactgaagcgcaaacttcttgacgacctggcctgccctacggatgatgaacttgtgagctctgagttaaatgctaaaaggtgtctgtctcctcctccgcttggaaatagcttggttgttttgggacaaagggtgccgtggctccttctggggttccggcgccgtgagcagcttgggactctgtacaatgatatccgccacaaagctatcatacagtacacgcttccgttcatatctgtagatctcaacacaatggctagtgccttcaagagctcagtatcgatgctggagaaagagctggctgcactgatcaccgagaacaaaatacaggctcggatagactcccacaacaagatcctgtatgcaaggcatgctgaccaaagaaacgcaaccttccagcgggccctccagactggcaatgagtttgagagagatatcaaggccatgctcctgagagccaacctcatcaagcatgatttcaaccagaagaactggcctggacaaaggaagatgaacctgtgagctctgagttaatgctaaaaggtctcctccgcttggaaatagttgttttgggacaaagggtgcaatggcacattgagaggtttctgtccgtgaaccgccttgatggctgaacaatcaactttgtttttcttctttctgttggctcttaggctgtgaatgttgctggcacaaacggtttatgaataggttatgcatctggagataaaaaaaaaaaaaaaggggatgccattccatgtgatttagaaagttcttttaaccggc

SEQ ID NO: 18045 - DNA, 1279 bp, Triticum aestivum
  Clone ID: PAT_TA_18045
aagtttctgataccttattttttataggatgaacaaattacagggtacagtaaataaagataagatatttatttgagaaaacaacatgtgatcaattaggagcggcgacttgaccagtggtagtagtactatagtacagtagatgcatgcatggtggtggttgcagtccccaactttgcttccgagacaagctaaggcgaggcgtccaatctaggaggaggagaagattcctcgctatcaactcgttgccgctgcactacactacgcaccgaaagctgaaactatttacatgccttccgtttcacatgcacctaatcaactgtagctgaacctgtaaagtggtgtggcgtggctactattacaactactaattactctcttaatcagctggcctttgcttcatcgcacgccctctctacggcaaggccagcaaaaattaacctttggaacagcaacaacgtcgtcgtcttcgcagagcggagaaagcaaagcttgctgttctcgctggctctctgattaagtgtaccttgattgatcaacggggtataggggtggagtggtgaggggatcatccgaagttgtagccattgggggtgttagtggaggccggccggggcagcatctgcgccgcctgtatgctctgcagcagcagtctgtcctccgccgacgactcgaacccgtgcaggaacgacatgtccgcgccgccgccgccgtagtcggcgtactgttgctgctgctgcggccggaacagctggctctgctgatgctgctgctgctgcagggacgacgtggcggcggacgggcggtggtggccgaggtggtcgaacgacatcacggccgagctcggcgacgggcgcaccggcatgccgccgccgaggccgtagtcgccaccgcccgcgccgaagctgatcacgggcccgccgcccgcgccggccgggccgtaggggccggaggggatgccggtgaactgctgcaccatggcgcggaagttggtggtgtcggtgttgagcagcgtgacgggcgcccgccgcgaggcgcgggacctccgccgcgccggcttgccgacgcggcccccctcgaccccgggcgccgacctcgtggggctcccgccgcccgagcccccggacgtcgggctcgacaccgtcaccacgctgccctccgccgccgcggccccattgccgccgacgccgtagatgcccgcccagtggcccatgttcgcgccggtgtcgcccatggcacgcagtagcactgaccgcagtaggagggaggagtggagttt

SEQ ID NO: 18046 - DNA, 706 bp, Triticum aestivum
  Clone ID: PAT_TA_18046
tagagatcgattttcagctgggccagtagatgcactccttcaggtatgcatcctaataggtcctgcaattttgcttcgtcgtgggaaagctgtcatccatgcgcatcagtaatttctcaatggttcagttggttacatatcaattaggccaagcggagtaccgatggaaacccaaaaccagttgatgcaagtttcacttccatgtagcagcttatacaacaggcacattacatattatgggtttggaggtgcacaaaacaaataaataaatactcgccaattgtctaatttcacaaatcagagtgcgcacaatgagcggttctctagctatggttatgtgattgttattattaatcaagaatcaagatgaacaatgcactccgaccgcttgaatccaatccatattttgtcctccggtaactgctcttgtgggaactgtgacagttgaacccgcttcgaaccatctgctagccgcttgcatggaagatgtggttcagctgcagcgaactcattcagaacctggttttttattgcaccaatcaacatatcttggcatccaaatgcatgtacattcttcaaagttgggcactgaagtagcagccgctctgggtgtaggtttgtacaagtgttgaggttcagatcaatcaactctgggcatttcacatacaaagcatctattgctgaacagccccatagactgagcttc

SEQ ID NO: 18047 - DNA, 646 bp, Triticum aestivum
  Clone ID: PAT_TA_18047
aactaatctgacagcgatcccgatccgtcaccacaactcacacgacagagtcgttcgatccgtcctcagcagccatggcgcagctgatggacaaggccaaggggttcgtggcggagaagatatcgggggtgcagaagccggaggcggacctgtcggacctgtcggtgcagcacgttggccgcgacggcgccaccctgtccggccgcctcgacgtgcgcaacccctactcgcacaccatccccatctgcgagatcagctactccctcaaaagcgccggccgcgacgtggcctccgggaccatgccggacccggggtcgctggtggccagcgacaccaccagcctcgacataccggtgaaggtgccgtacgacttcctgatgagcctggtgaaggacgccggcaaggactgggacctcgactacgagatgcgcgtcggcctcaccgtcgacctccccatcgtcggcaacttcacgctgccgctcaccaaggccggcgagctcaagctccccacgctctccgacctgttctaaacttaccgccgcacccagctaagtaggttcgaccgtgccgtactagctgctgcgctctccatcgcctgtacgggtgatgggtagtactgggctgggcgagcgggacgatcgatcgc

SEQ ID NO: 18048 - DNA, 1322 bp, Triticum aestivum
  unsure (1)..(1322): unsure at all n locations
  Clone ID: PAT_TA_18048
cggacgcgtgggcggacgcgtgggcggttgcgctcgcagagagatcgggtcggggaggaggaggatgacgggcgggcgcgcggtgcttctgctggtggtctcggcgctgttcgcgcagatctacgcgtcggatccgctgtttcacgagtccttcgacgagggcttccaggggagctggatcgtctccggcaaggaagagtactcaggtgtatggaagcacgagaagagtgatggccatgaagactatggtctccttgttagcgagccagccaggaaatatgccatagtcaaagagcttgatagccctgttactttgaaggatggaacagttgtcctgcagttcgaagtgaggcttcagaatggccttgagtgtggaggtgcttatcttaagtacattcgccctcaggaggctggatgggatgccaaggaatttgacaatgacactccttacacaattatgtttggtcctgacaagtgtggttcaacgaataaggttcacttcatcctgaagcacaagaaccccaagactggcaaatatgttgaacatcaccttaagtccccaccctctgtcccatatgacaagctctctcatgtctacacggctatcttgaagccggataatgaggtcagaattttggttgatggggtggagaagagcaaagcaaacttcctgtctgctgatgattttgagccggcacttattccatcaaagactattcctgaccctgacgacaagaagccagaggactgggacgagagagctaagatccctgatccagttgcggtgaagcccgatgactgggatgaggatgccccaatggaaattgtggatgaggaggccaccaagccagaaggatggttggatgatgaccctgaggaaattgatgatccagaggctgctaagcctgaggactgggatgatgaggaggatggtgaatgggaggcaccgaagatggacaaccccaagtgcgaagtggcacctggatgtggtgaatggaagaagccgatgaaggataaccctgcctacaagggcaagtggcatgcccccctgattgacaaccccaactacaagggaatctggaagccccaagaaatctccaaccctgagtactttgagcttgacaagcctgactttgacccaattgccgctattggaattgagatctggacaatgcaggatggcatcctgtttgacacattcttattgccgatatgagaaggtagccacctctgtccgggagaagacatgggagccccagtttgatgccgagaaggaaaagcagaaggctgnagaggctgcagcaggtgcatcagagggcctt

SEQ ID NO: 18049 - DNA, 1282 bp, Triticum aestivum
  Clone ID: PAT_TA_18049
gccggccgggccgggtcaagactattcctgaccctgacgacaagaagccagaggactgggacgagagagctaaaatccctgacccagctgcagtgaagcccgatgactgggatgaggatgccccaacagaaattctggatgaggaggccaccaagccagaaggatggttggatgatgagcctgaggaagttgatgacccagaggctgctaagcccgaagactgggatgatgaggaggatggcgaatgggaggcaccgaagatcgacaaccccaagtgtgaagaggcacctggatgtggtgaatggaagaggccaatgaaggataaccctgcctacaagggcaagtggcatgcccccctgattgacaaccccaactacaagggaatctggaagccccaagaaatccccaaccctgaatactttgagcttgacaagcctgactttgacccgattgccgctattggaattgagatctggacaatgcaggatggcatcctttttgacaacattcttattgccgataatgagaaggtagccacctctatcctggagaagacatggaagcccaagtttgatgttgagaaggaaaagcagaaggctgaggaggctgcagcaggtgcatcagaaggcctttctgaattccagaagaagatctttgacattttgtacaaagttgcagacatcccgttcttggaaccatacaagaccaagatcattgatgtgattgagaagggagagacacagccaaacattacaatttcgattttggcgtctgtcatcgtcgtcattgtgactgtactcttcagagccctgtttggtggcaagaagccagtggcacctgtgaagcccgctgctgagaccaagaagcccagtgctgtcgtacctgatgccgccgctggaagcagcggcgacatggaggatgacaaggatgcgccgcgccgaaggtcgcgaagagacgcataaactaactcttggtgccttcacattttgaaggactcggttatagcctttttgagaacgcctcgagtgtataatcgaaccctctgctgctagtagcaacctctagttttaagtcgcttaacattacgagccggtgaagctcgtgttcggttgtttgtgtcctgtcctgaatcagctagaagagatgtttttttttcctttccttttgttttttatttcttctgttctatatcagatgaaacatgaagcttgtgttcggttgtttgtgtgctgtgctaaatcaggtactccctccgttccctatttagtagaaattactgctt

SEQ ID NO: 18050 - DNA, 2863 bp, Triticum aestivum
  Clone ID: PAT_TA_18050
cggacgcgtgggtggaagttccttccggttccagagagatcgcggaggaggcctcgccacttcattgcggtaattggatagccttgcagagcagatagggtcggggaggaaggcgacgggagggagcgcggtgggcctgctgccccggcgggtggtctcggcgctggccgaccggatccgcgcgtcggatccgctgttacacgagttcgtcgacgagggcgtggaggggaggtgggtcgcggccgggaaggaaggatactcaggtcgatgcaagcacgagaagagtgatgggccacgaagcacaatcgtctcccttttgcatgagcgagccaagctaatatgccataagcgacggcgcttgatagccctgtcacattgagcgatggcccggttggtttgcagttagacgtgaggcttcggcatgcctgcgaaggggggtggcgcatgtcttaagtgacagtcgacggaagccgggacgggatgggacgccgaggaattggaagaatgccgcccccttcaccatttatgtttcgtcctgaggtgtgtgctccaacgcgtcaagtacggcgccatgcagaagcccccccaaccccaccaaaggcaaaaaatatttaccctcgcctccagtcactaccttcagccccatgttacaacctctctctccttcactcgtcccaccttttgatgcggataacgtggtcgggggtgaggtcgattgacgggcaggctaagtgtgtcttgcgttggattcgggggtgggggttgtccgcatgcagctagtaaatctgacgctattcgtggcacctttcactattaattactttgactctaacgcgggagcgatagcagagagatcgggtctgggaggatgacgacgggagggcgcgcggtgctcctactgccgcttctggtggcctcggcgctgttcgcgcagatccgcggcgtcgggatccgctgttccacgagtccttcgacgagggcttcgaggggagctgggtcgtctccggcaaggaaggagtactcaggtgtatggaagcacgagaagagtgatggccatgaaggactatggtctccttcgtcagtagagccagccaaggaaatatgccatagtcaaaggagcttagatagccctgttactttgaaacggatgggacagttgtcctgcagttcgaagtgaggctccagaatggcctcgacgtgtggaggtgcttatgttaagtacattcgccctcaggaggctggatgggattgccaaggaatttgacaatgacactccatacacaattatgtttggtccttgacaagggaggcacaacgaactaggagcacttgatgctgaaagcacaagatctccggagactggcaaagatggatgacggaggctgcagtcgccgccctataagacgtttgtcaatttctttcatgaatatgcagttttctgtatgatagagcccgagcttacattcttaggtaacgttgtgaagaaaaagagagcattgatgttattcggtaaagggagagaagccagaccctaacattagcaatttctatcttggccgcacttcgcttggtagtccttttgtgactcgtcctcaaccagttccggttttacggaggccaagggagccgattggacgcccttgtgccagcccgttacgcgaggtgaaggaaggaccagatgccgacggaaagccgaggagcacgagggacaaggatgcgggacgcacaagcgcagcaagaaaagaggcatagtcacgacggtggcacgcatcaaggtcagcgaacgggagacaatcggctctggacatttcgcagatctccggtccttggccttttgctgagactcgtaagcgttctataatcgaacagtcttgttagccccttgctgctacccctaggtttaaggcgctagggcctacgagccggtgaagccttgtgttgtttgtgtgctgtttggaatcagctagaagtgatcttcttttccttttttatcaaacgaaatcttgaaagattaagtttggaattctttttgacaacattcttatcgccgatgatgagaaggtagccacagccatcttggagaagacctggaagcccaagtttgatgttgagaaggaaaagcagaaggctgaggaggctgcagcagccgattcagaggacctttctgagttccagaagaagatattcagcgttttgtacaaaatcgctgacattccattcttggaaccttacaagatcaagatcattgatattattgagaagggagagaagcagcccaacattacaatttcgatcttggcctcagttgctgtcatccttgttactgtgctcttcagaaccattttcggtggcaagaagccagtggcacctgtgaagcccgttgccgaggtcaagaagcccaatgccacggaagctgatgccgctggaagcagcggcgacaaggaggagaaagaggacgacaccaccgcaccacgcagaaggtcgagaagggagacataggctaggtcttaggaccttcacatttcggacgtctcggtccttgcctttttgtgaactcctgagtgtataatcgaacagtcttgctgccctctgctgctacccttagttttaagtcgctagaatctacgagccggtgaagctttgtgttgtttgtgtgctgtcctgaatcagctagaagtgatcttcttttccttttgtatcaaacgaaacttgaaaggatcttttgatatttagatgctgttcatttactggttaaatcaggtttgagcctggggcggcatctggttatccacgtcctgcctcgtccaacctcgtccatgaaccaaacatgtggtagagaaaattccttatgtaatactgtttt

SEQ ID NO: 18051 - DNA, 1550 bp, Triticum aestivum
  Clone ID: PAT_TA_18051
aaactgtagcagatgctctcacgggcaacagtgacgcgccaccagttcatggaaccgttaatggagcaccgattcatgctggccatgacaacaacgattgtttgttataattaacgagtgcggggccaaaatttatcggatggatcgtggaacattacattaattacatcgcgggacgggatcgctgtcgccatgtacatgtctgctaattctcggtgcgctaagctacgtaactaccagctgctagctaggctaatggtaccgcgcgccaaacccaggccgtgcttctctggtttgattcatactgcttgcggcgaccctgggcttggcgtcgtgctcatcggctcgtggcgtggcgtggcatggcagctcacatgacggagcaggcgttggggttctcgtcgctgaacatctggggcgcgtgggcggggtacgtcgcgtagggcgacgggtactggggcccggcgttcgggtagaagccggggttcggcggcggcggcgccgcgccgtagtagccgacgggcgccggggggtacggcatgtagccgtactgtgggggcatctggtacatgctcgggtccgccatgggcatcggcgccacggacgccgcggacttgtccttcttgtcctcgccgccgccaccgccgtccttcttttcgccgccatcgccggcgccagcgcccttgtccttcttcttctcgccgtcgtctttcttgtcgccgtccttcttgccgggggtgaccacctccaccggccgactgagcttgtccctgaggtagcccggcagggcggctgtgtccatggtgccagtcaccttcaccaggtccttggcagcgtccaccgtcacttccttcactcctttgatcttgttgacgcggcgcttgatgcggtcgatgcagccgtcgcagtgcagcctgatcttgagcgtcacggtctcctctttgggctcctttggtttcttctcctcctccttgggcttgtcggcggtttccacttttttctcttttttctcagcaccggcaccggcaccgcccttctccttgtctgctgccttgctcttctctttctccggcttatcgccggcgtcgggcttcttgtccttgtctttctccttgttgtccttgttgggcgaggcggctccggcggagacgatttgaacgggcttcttggtcctggcctcgatgcgctctttgatctccgccgcgtccgcggcgccggtgacgaccaccttgttggccgccgtgtcagtcttaaccgactccacgccaggggcgttcttgatggcccgcttaaccttggtggcgcagccggcgcaatgcaagtcgaccttgagcacgatgggctgggccgccgccgcggcgtccttcttctggtcgccgccgtctgccttgcccggcttctccttcttgtcctcgcccatggcgtacgtagcggtggcttggcttcttgtctctccgccgagctccggggaagggaggtagttagtgcgtgcgtgggcgcgtgggttggaggagaggagcaggtggtgctggaatcccggcccggccggc

SEQ ID NO: 18052 - DNA, 1369 bp, Triticum aestivum
  unsure (1)..(1369): unsure at all n locations
  Clone ID: PAT_TA_18052
ttttntttttttttttttnatcggatggatcatggaacattacattgcggggcgggatcgctgtcgccatttacatgtctgctaattctcggtgcgctaagctacgtaacttgctgctagctaggctaatggtaccgctcgctaagcccaggccgtgcttctctggtttgacagttgatgctgcgacggcgagcctgggcttcgcgtcgtgctcgtcggcccgtggcggctcacatgacggagcaggcgttggggttctcgtcgctgaacatctggggcgcgtgggcggggtacgtcgcgtagggcggcgggtactggggaccggcgttcgggtagaagcccgggttcggcggcggcggcgccgcgccgtagtagccgacgggcgccggggggtacggcatgtagccgtactgtgggggcatctggtacatgctcgggtccgccatgggcatcggcgccacggacgccgcggacttgtccttcttgtcctcgcccaccgagcgccctctttttatcgtctacccccgccgctctcgccgttcgtctttcttgtcgccgtccttcttgccaggggtgacgacctccacaggccgactgagcttgtctctgaggtagcccggcagggcggctgcgtccatggtgccagtcaccttcaccaggtccttggccgcgtccaccgtcacttccttcactcctttgatcttgttgacgcggcgcttgatgcggtcgatgcagccgtcgcagtgcagcctgatcttgagcgtcacggtctcctctttgggctcctttggtttcttctcctcctccttgggcttgtcggcggtttccacttttttctcttttttctcagcaccggcaccggcaccgcccttctccttgtctgctgccttgctcttctctttctccggcttatcgccggcgtcggccttgttgtccttgtctttctccttgttgtccttgttgggcgaggcggctccggcggagacgatttgaacgggcttcttggtcctggcctcgatgcgctgtttgatctccgccgcgtccaccgcgccggtgacgaccaccttgttggccgccgtgtcagtcttaaccgactccacgccaggggcgttcttgatggcccgcttaaccttggtggcgcagccggcgcaatgcaagtcgaccttgagcacgatgggctcgggcggcgccgcggcgtccttgttgtggtcggcgccgtctgccttgcccggcttctccttcttgtcctcgcccatggcttgacggagctccgggggagggaggtagttagtgcgtgcgtgggcgcgggcgcgtgggttggaggagaggagcaggtggtattgtgtcccgcccgccgcctgagcggccg

SEQ ID NO: 18053 - DNA, 844 bp, Triticum aestivum
  Clone ID: PAT_TA_18053
gacgaggtggtcaagtactccccgcacgcccgcgccatccgcgacgtggaggacgaggagctccgcaccttcttcgccggcatgtccccctggcagttcatcctcgttgtcgccgccagctccgtcggcgaggagctcttctaccgcgccgccgtccagggagcattggccgatatattcctgagaggcacggagctgatgaaagatgcccgagggattgtgtccctgagtggaatggtgcctccatttgtcccgttcgcgcaaacctttgccgccgccatcaccgccgcgctaacggggtccctctactacatcgctaccgcccccaaagaccctacctatgtggtgacaccagttatgcgctcgcacgccggccgacagaatatgaagaaactgttttcagcttggtacgaaaggaggcagatgaggaagatatactctcctcttctagaaggcatcctggctttctacctcggcttcgaatggatccagacgggcaacatcctggcaccgatgatcacccacggcatatactccgccgtggtccttggccatgggctatggaaaatccaagaccacaggagaaggttgcgacaaagggtacaggaaattagacgaggctcagatggactctagtcaccagtctaggcagctagggaccaagttttgatacagttagtctacgatatagatagagaggaaactctagtacacgccaagatgtacatatgcaggcaggatggcatcacgtcaatatagtgtatacgtagtacttatacgtgtgttagtgtgtacttaactgtatcatgttcaatgtatgtatgaagccgatatatagatgccc

SEQ ID NO: 18054 - DNA, 888 bp, Triticum aestivum
  Clone ID: PAT_TA_18054
ttcgagcggccgcccgggcaggtacagcctatttcacatcactcttatttatgttactattaagaaccccacaataacacaacaccctttcatactataagaatatcacacagacggtgaataacagtacatctattcacatcgctcttattcatgttacaaataagaacaccaatacaccatagtaacacaacctcgggatatccagggcacttccaagcagcacctcttatttgaactttcatactggagaaagcatggagcagataataccaattgactaaggaactctaggttccttcttaaagaagatggatacatggtcgtgctcttctggagtgcccaagacatgtgcttacgcttgatgaagtccgaagccaccgaatccacatctgtattcacatcatctttctttgataggattggcatggttgtcctgaaaccctgacttgttttttggggcgcttggacatggttcgcccctactgctgcttctttcttcataacactggcatggttgtcctgaaagttggcatggggatggtgggcttggaagtagagcatacgagtgtgcgacattgctctatggctccttgcttgggggtacgaggaaatggttcgctcctactgctgcttctttcttcataacactggcatggttgtcctgaaagttggcatggggatggtgggcttgaaagtagagcattcgagtgtgcgacattgctctgtggctccttgcgtgggggtacgaggatttatacgtgtgtttagtgtgtaccttaactgtatcatgttcatgctagtatggttttgcggccgccgtatcagataaccttttttcaaaaaaaaacctgcccgggcggccgctcgaaatcacttagtgaattc

SEQ ID NO: 18055 - DNA, 410 bp, Triticum aestivum
  Clone ID: PAT_TA_18055
gaggacgatgtccagatcgcggagagggctgtccctgaagccgtgtttggcgagctcggcaagagagccgcggagagcagggaggaaagctccagtgctcaagagaacaacgagcagcagctgggcgctctcgagagaatcaagcgaaggcgtcaatagggtcaaagattgtgatccaagcacgccattacctgtcgttgagcctaatgatgttgtagctgttacgtgtaaacatgttctttgctagcgtttgctcttcttgtacaaggattttgcaggagttaatccggtgttgatccgcagcgtttttctgtgtacaaactgtaaactcttgggacacgtgtccatcattttcagtgaaattttgtcgatttcaaggatgaacaatggactggcagctttgttacaaa

SEQ ID NO: 18056 - DNA, 1208 bp, Triticum aestivum
  unsure (1)..(1208): unsure at all n locations
  Clone ID: PAT_TA_18056
cggaaaagtggccggtatcgtgggggtaagggtgggtgggtgacctacctcacaaagtttgtaaagcggtaccagcgaagcaagttagagcgggcgagagagctgttcacggaagctgtcgaaaaggctccgccgcacgaaaagaaggccttgtatttgcaatatgctaaactggaggaagactacggcctcgcaaaacgtgccatgaatgtatatgatgaagctgtaagggctgttcccaacactgaaaagatgagtatgtatgaaatatacattgcacgtgctgctgaacttttcggtgttccaaggaccagacaaatatacgagcaagctatagaatctggtcttccggacaaagatgttatggtgatgtgcatgaagtttgcggaacttgaaagaaatcttggagaaatcgaccgttcccgggctatttatatccacgcctccaactatgctgatccaaattctcatccagagttctggaaaaaatggaacgactttgagattcaacacggtacggacgcgtcattcagggagatgcttcgcatcaagcgtacagtggccgctagccgcagtcagactcatttcatccttccggagtacctgatgcaaagggatcagaagctaaacatggatgaggcggtcgacactctgacgcgtgccggtgtcccgcaggatgagatggcggccttagaaaggcagctagcttctggaccatccccggcgccagcagcagcagctccgagcagcagcacgactcccgcaaacagaatgatgaactttgttagtgccggagtagaggcgcgggccgagagcagcacgcaacaggctgctgctaacaacgaggacatcgagctgccggacgaagagagcgacgaggaggacgatgtccagatcgcggagagggctgttcctgaagccgtgtttggcgagctcggcaagagagccgcggagagcagagaggaaagctctagtgctcaagagaacaacgagcagcagctgggcgctctcgagagaattaagcgaaggcgtcaatagggtcaaagattgtgatccaagcacacgcgcgttagctgtcgtttgagcctaatgatgttgtagctgttacgtgtaaacatgtcctgcgcctgcgctcgctctcctggttcctgcccgggcccccgctcgcncaggntttccgtgtnaactgtaacnctggaaacnttcat

SEQ ID NO: 18057 - DNA, 871 bp, Triticum aestivum
  Clone ID: PAT_TA_18057
agtgccagataatttagcaacaaagtggatattgcacattgctttcaaagagagcttggacagtgacctcattcacttgacataccaaacataggctaaaggagacggtgcgaccagctctacatgcaaaatgcaccatgagggtcgatagtaagcagcaggaccaaaacagatttttggtgccagccacctgaaaatggcaacattatataggtagtttctactttggaggaagtagaccaagatgagaccgcctctgaactagatgatgtttatttataaacttatccgcatgggatggataggcccctttgatgtacgcccggagacacttgcggtatgagaaatccgcccaatcgccatttgttctaaccacatacaggcatctggaactcttgaaatcaggatgtctgttaaccataatagcatcaagtccacaaccaatcttgtcttctgaacgggggtggtgagcaagaaccttttctaccacaaccttttcatcttccggacttaaaaacgcaccatctccatatctcctggaatggaggatgtctttgacaagttccacgacgggaccaacttcgcggaggatctccgcctcagccgcctcccactgctcctcctcggcccccggagcggaggactcgttgccggcggggaggtcggagaacaggcggctgcgggtgtagagtgcagcagaagtggcgtgcggcgggaagccgccgtggaggatgcgcgtggccgctcgagcgaaggcggcggccaaggccatggcttcttcagctacggcgagaaagggttctcctgtttggggtttcaacagatcggcggacgccggatcgaccacgaggccggacggtactgaaggggt

SEQ ID NO: 18058 - DNA, 544 bp, Triticum aestivum
  Clone ID: PAT_TA_18058
taggggcctttaggtgtcttttttttttagttttttgttttgttttttttttttttttgagcgtattcgttgctgccgactgcacccgtgggtaagtcgtacagatcgttgtataggtcaattaagccccttttgcgattctatgatacagttccatctcgtgggccctaacctcgcgttcgagcggatcgattatgcttgccggcttggacgaaatcccttttcccatttccaatatcttagtggccaccggttttggcgttagggttgcgggggtcgttcttgaactcggcggagttcatcatggcgttctgggcggagttgacaccgtaggcaatgacaacaccggcggcgaagaaaggccagtatggcttcaagaagggagcgttgaacttcttgaggggttgaacaccgagccaagacatgatgacggatttcgtgggtatcgcgggaggtaggttcggtttgatggacttggacgtcggcaacgggtgctttgagagccggctccggacagaacgagccttttcccggcccggccggc

SEQ ID NO: 18059 - DNA, 886 bp, Triticum aestivum
  unsure (1)..(886): unsure at all n locations
  Clone ID: PAT_TA_18059
cgaagggggggctcccaggcctctgcatcagaacgatgcatacgaccacttttataaaaagcaaaaaggctcaacaaggtcttgcagtctcaaaacaagtaaataaaagctcacaaagaaccaacaaaacggtcaaaaaagccacaaccggctggcacaaaaaagataggaaaactaattgtctatcctattacatgaccgtcatccaaaccggttgaagatatcccgtgctaccatctcccaccgaatagatccagtaaccaaacgctccatccgtcggagtgagtagcgaccacatacagattaacgcagtggcccggaagataaccaagcaattagccgcatgcacggtcacgatcgcctttgcccgcttagtcactactcctagatgcttccttcccgtgccaatggcagcatcaatcactatttgccaccttcgcggcagcacggatagctcagctgggccttgattaaccgccacacacatgtggctcttcccagaccaagcatcaggcgcggcaaggacccttttgtttactgtatcatcgccacgactaataaaagcaggaaaagaagggccgtgagtttacggccacgcagccccctgaacgcacgagcctcagaaaaggaagccatttcttttcctttctcacgtagaggtgaaggagactgatgtcgagatgcctcggtatctcagacacctgttacagagaccggattggtccatctctgaacggccgagcgtcacactgtgatggccgaaacttcagtcagtccatgccacgtccaacgaggcaatcttcgatgccgcttctgggtgaccttgttgtttcnagcagttgagcctgaaatgtttcagacgaaagacgataccgcagcaagtgca

SEQ ID NO: 18060 - DNA, 1223 bp, Triticum aestivum
  unsure (1)..(1223): unsure at all n locations
  Clone ID: PAT_TA_18060
acaaaaattcagnacttaaacacgaggctttcctcctaccgtactactgggcatatccgccacacaatgcagnaaaaggaattcacaaatctttaggtaaactaactaactaaaaaggatgaatgatgtcaaatccaaaggtgggnaaagcgacgacactgacgattgcaacctttaaacaaacanaacacaatttgatgctgatcgaatcaagacgctcctccgagctatagccacttaattacttggcagcggcggcagcggcagcccacatactccgcagcttcccggcgtagtccaccatgctcttcatgggcggggcagccttcttggccgcatccgtctccacgaacctctcagcccaggcggccaagcgcggagtcctgcctgcgtcgatgaccgtcacgccgaacatctcccgcaacgcctcgaaccagaagaggttgcacccgagcgcaaggtcgaggtacccgacggagtcgccggcgaagaagtctttcccaccagagcattgggcgcagtggcggaggtagagggtggacagggtggnnncncggnnccaccctgggggaattttgaatagctttatagcataggaaaaaaggtaaaaaatattaagaaaacatattttttttatgaacagttctattgttggcccaccctggcccattgggctagatccgctaccgattgggcgagggcgtcctccatgggccggaccaccgcgagcgcggcctcaagcttctcggctctgtcctcctccgtggcggcgcgtaggatgcctatccacgcggggaacagcttgtcatcaatgtaggcggcccagaagcgggcgacggcgcggccgtaatgtcggcagggaggagcgaggcgccgtcagcccagacctcgtcaacgtacttgacgatggcgagcgactcgcagacgggcctgcctgcgtggatgagcacggggaccttcttgagcaccgggttggtggcgaggaggagctcacccttgtcgaacaggtcctgctccaggtactcgtagctcacgcccttgaggtgcagcgccattcgcacgcggaccgcgaacgggctcaccgccgcgcccagcagcttgacgtcgtctccttcgccggccatcgtcttggatcgatctcttcctatttgccgcttgtaaactactcctatttcctccgatgtgtacgtgtgtgctctcttaagcctcaagcccttagtatc

SEQ ID NO: 18061 - DNA, 1180 bp, Triticum aestivum
  Clone ID: PAT_TA_18061
ggagaggaggaaaagtcaacacgcctatggggcattttttgccaagtcagctcctgacgagggagccccatttttaataaacacgctaaaacgaccctaatccgccgatcagggttatttgcaaacaaccctaatccatctcctaaacatgatgttttctgccaaaaaaaaatatagaagggttttctgctaacctagccttcaatgggggggtttcttgcaattaactcattttattgggaactctgcccgcaaaaaaaatgaaatctacatatatttaaactagttaaactgttaaaggagatccaattcgagtccggccgaataaagcttttcccagccacttaattacttggcagccggggcagcagcagcccaaatagcccgcagcttcccggggtgctccactatgctcttaatgggcggcgccgcctttttggccgtttccgtttcctcgaaccttccagcccaggcggccatgcgcggagtcctgctggcgtcgatgaccgtcacgccgaacatctcgcgcagcgccttgaaccaggacaggttgcacccgagcgcaaggtcgaggtacccgacggagtcgccggcgaagaagtccttcccaccggagcactgggcgagggcgtcctccatgagcccgaccaccgcgagagtggcgtcgagcctctcggctctgtcctcctccgtggacgcgcgcaggatgcctatccacgcggggaacaacttgtcgtcgacgtaggcggcccagaagcgggcgacggcgcggccgtaagagtcggcagggaggagcgaggcgccgtcggcccagacatcgtcgacgtactccacgatggcgagcgactcgcagacgggcctgccggcgtggatgagcacgggaaccttcttgagcaccgggttggcggcgaggaggagctcacccttgtggaacaggtcctgctccaggtactcgtagctcacgcccttgaggtgcagcgccattcgcacgcggaccgcgaacgggctcaccaccgagcccagcagcttgacgtcgtctccttcgccggccatcgtcttggatcgatctcttcctatttgccgcttgtaaactactcctgtttgctctgctgtgtcgtgtgtgttctcttaagcttcaagctcttgatactcaatttgcaagtgtgccggcccggccggc

SEQ ID NO: 18062 - DNA, 975 bp, Triticum aestivum
  Clone ID: PAT_TA_18062
atcaaaaaaaaatgaccattttattgtgaacactgtttgtagaaaaatgaaatctacatatgttaaactgttaaaggagatccaattcgagtcgggccgaatcaagaagctcttcccagctatagccacttaattacttggcagccgcggcagcagcagcccacatactccgcagcttcccggcgtagtccaccatgctcttcatgggcggggccgccttcttggccgcctccgtctgcacgaacctctcagcccaggcggccaagcgcggagtcctgcctgcgtcgatgaccgtcacgccgaacatctcgcggagcgcctcgaaccagaagaggttgcacccgagcgcgatgtcaaggtacccgacggagtcgccggcgaagtagtctttcccaccagagcactgggcgagggcgtcctccatgggcccgaccaccgcgagcgcggcgtcgagcttctcggctctgtcctcctccgtggcggcgcgcaggatgcctatccacgcggggaacagcttgtcgtcgacgtaggcggcccagaagcgggcgacggcgcggccgtaggggtccgcggggaggagcgaggcggcgtcggcccagacctcgtcgacgtactcgacgatggcgagcgattcgcagacgggcctgccggcgtggatgagcacggggaccttcttgtgcaccgggttggaggcgaggaggagctcgcccttgtcgaacaggtcctgctccaggtactcgtagctcacgcccttgagatgcagggccatgcgcacgcggaccgcgaacgggctcaccaccgtgcccagcagcttcacatctccttcgccggccatcgtcttggatcgatctcttccttgctactatttgctatttggtgctcgaccgtaaactgtttgctctgctgtgtacgtatgtgctcttaactgagtttggaagtgtacgtatattagcatcgttctggctgttgaatagc

SEQ ID NO: 18063 - DNA, 558 bp, Triticum aestivum
  Clone ID: PAT_TA_18063
gattaaatgtaaggagttaaagtataatggatcatataacaaaagactgattttctagagattgagtagatatgctctaagttcggcacaacacagtcaagtagccccgtgttcctcaactatgaactctgaattctgaaccaccttgatccgagggaacaccagcaccgatctggtcactcccgtgagttcgcccgcgtttccctcaacggtttgatcctcctaaagatgtctctgtgctgcaaattccgcttcaggaggttcatgtctttgaaggagtccgggaagagacaggtgaaccaccactggaggcggtgggcgaagttgggtatgcacagcgtcccgtgcccgatccagcgcaccgccgcgcgcgcgtaggcgtccgggctcagcacccatgggcgaagaaagaagctgttcttcacggcgctcgacaccatgtttgtctccacaatgaatgggatctggcattgcacatcgatgcatgcgctctggtactccacggagagactcttggagaactccgcgacgtaccgtttggtggcgacgtagacagag

SEQ ID NO: 18064 - DNA, 561 bp, Triticum aestivum
  Clone ID: PAT_TA_18064
acagctagggatgtttattccgcccgttgcaatccacgggcagtaaatataaaggcaactcgttaggttgcttttttttttttttttttataaacagaggtgcaaaaccacagggccttgtccatcaaacaatgctgctcatacaaccttaagattatgcagccattatagtcagaaggcatacgaccaagaatatttcagcacgaaccagaaactggggtatccctcgcccatatctacatagatggatggcatcagggaaacctgatatccacatatccatgcctttcagctcagctccacatcacgaacagtatttcctatcaccatctccatattgctgatctcaatttccccctccgtttacccccgcaccacccaagctgacccgctccacttgctccacacccattccacttttgcagtttaaccttccacactttgtagtcaaaaggttgtctagcccaccaaactccccccttgggttttgggtttcgagtctcattgacaggtactcgacttgtctttgaagggattgaacatgattgatgatctaaagaa

SEQ ID NO: 18065 - DNA, 571 bp, Triticum aestivum
  unsure (1)..(571): unsure at all n locations
  Clone ID: PAT_TA_18065
gagtaaacacatctttttattaatcaagaagctacatacgcgattaattaccaagggcaacaaacaaactgatcgcatacactactacaagtagctgcaagcagcaagaacagaacaaagcaaaacaaaacggagaggcaggagtcagatggatggggaaaaagaaaaaaaaggaagaagaggaagagcagcttaattggagctggccggccggggtgatggagctgagccggtgtctagtcagtggtgatgtgcacgccgatgacgatgacgaagagcgcgatgagggcgaagtagatgatggcgtggacgaggatggccatggcgctggtgtgcatgttgccgaactccacgaagtggtgcttcccggggagctgcagcagcagccccggcgacagcagcacgaacagcacccccgcgatcaccnccggcccccagtccgacatcctccccctcttctccgacgccggcgagcttctttctttgtctaattctagctagctcctcggggaagagaaaggaaggcaatggagcagacttttgggacgcagcgggagcagaggaggagtat

SEQ ID NO: 18066 - DNA, 770 bp, Triticum aestivum
  Clone ID: PAT_TA_18066
ttttttttttttttttttgagtaaacacatctctttattaatcaagaagctacatacgcggcaacaaacaaacatgatcacatgtactactacaagtagttgcaagcagcaagagcagaacagaacagaagataggcaggagtcagatggatcggatgaaaaaaagaaaacggaagaaggggaagagcagcttaattggagctggccggccggggtgatggagctcagccggtctctagtcagtggtgatgtgcacgccgatgacgatgacgaagagcgcgatgagggcgaagtagatgatggcgtggacgaggatggccatggcgctggtgtgcatgttgccgaactccacgaagtggtgcttcccggggagctgcagcagcagccccggcgacagcagcacgaacagcaccaccgcgatcaccaccggcccccagtccgacatcctccctctccctcccctttctccgactccggcaagcttctttctttctctctcggcaccaacaggacccccgcgatcaccaccggccgcccgtcggagaacctgccccctcttcctccgacgccggcgagcttctttctttctctctttctagctagctcctcggggaagagaaaggaaggcaatggagcagagcaaaccaggagcagcgggagcagaggaggaggatggtgtgattgtggagggaaaaggcgtgagggctccctttcatcgccattcccattcgttggtacgttcccctcgtccgaattcctcagcccggggg

SEQ ID NO: 18067 - DNA, 320 bp, Triticum aestivum
  Clone ID: PAT_TA_18067
gcacacgaggacaaatcaagagtgtatcatactcataatcccattatcacaagttgccatgtaaccctaacaaatcaacaaaaagcgcactaaaataagctgcgcccttgcttgattatgcaagcacttgtctcttgtcgacacaacaaactaaaacacagcaaagggcagaagaacagtaaaattaagctacaacaggaaccttccaagtgttcagctttgctcttccttggcacccgctgcctccctctcctctgcagcggcgcgagaacagcaacactggctagctacggggacttgaggggagcaggagtagagag

SEQ ID NO: 18068 - DNA, 860 bp, Triticum aestivum
  unsure (1)..(860): unsure at all n locations
  Clone ID: PAT_TA_18068
tttttttttaataggagaaacagcccgccgccgcttctttttttgtctaatcaagagcgtatcagactcataatcccattatcacaagttgccatgtaaccctaacaaatcaacaaaaagcgcactaaaataagctgcgcccttacttgattatgcaagcacttgtctcttgtcgacacaacaaactaaaacacagcaaagggcagaagaacagtaaaattaagctacaacaggaaccttccaagtgttcagctttgctcttcctcagcgcccgctgcctccctctcctctgcagcggcagccatcagttcatcgaatttctccgtcttgccaatcaatatttcgatcttgaccttctggatagggcggttccttgtatcatctttgacatcaacagtagatgtcattattttcttctcaacagcaaggccgttattttttagaatttccgcaacagtcaccacagttgcaatagccatgccgagggccgagagctccacctcttcgtgcagctgcatgtacctcttggcgaggttgacgtagaagaagaggggcttcttggtgttggagacctggatgcggttcttcttgtgcccctccgctcccgccgtcgccgctgctccttcccctatggtaaggttgttcaccgcctccgtcacctcctccatggctgccaccgaggccgcgcgagaacagcaacactggctagctacggggacttgaggggagcacgagtagagagatttcggcggcgacggagagggggaagccctgtctcagcttcggggttttatacggggtagggttacggggttggcggctgttnccggtttttccctcttncttncctcgtgccgaat

SEQ ID NO: 18069 - DNA, 640 bp, Triticum aestivum
  Clone ID: PAT_TA_18069
ctgcagcttcctcctccgcctccgcctccgccgccgccgccttggctcttctggcctcttcgtccgcccgcagccgccggagccccggcacgatggacgcgagctcggcgtcgacgtcggtctcggagaagtgaagccgaggtcctgcaggcccttgacctcctcgaactccagctccgacaggctccgcccgcggcggctcctgcgcctcctcccgccgggccgccgcgcctccggcctccggcgctccggcagcggctccggcgccgccaggccgtccttcccggacaggatggtctcgagcctcgcgcggtggccgttggggatcttgagcggctccagctggccgtggaacgcggcggccttggcctcgtcgctccgcgtccggcggtgccgctgcagccccgacggggcccgctgcagctcgctcttgctctcctccgccggcggctgctccggctgctcccgctcaggcgccggcgccggcgtcagaggcgcgggaggggagtaggagctgagcacgaggcggtggaaccagcaggcgtcgtagagcgcgatggcctcctccgccgccacggctaggtgcggccgaggctgccgctccatttggggggagagaggggcgcgcgctgggtctcgc

SEQ ID NO: 18070 - DNA, 761 bp, Triticum aestivum
  Clone ID: PAT_TA_18070
cgttaaagcaatttgtgtatgcatacaatacatacatacaacgaaacaaacgcagcatacatattgcagccaggacttcgcgtatgcagagcattcgcatccaatccaatattacagcaaaaccagtaggagtacatcaccaaatcaagaaacatggcaccatttcctcaccggaggacaacacttcaccggtccccagatcggccgatcgatcgacgcatcagatcagagaagctcgccgatcacttgttgttcatgagcaccttgacgagctccttgcactggacgcggccctcgccgcgggggtcggccttgcggaccagctcgtcggcctcctcctccgtgagccggtcgccgtgggtgagcatcacctgccgcagctgctccgcggggatgacgccgctcccgtcgtcgtcgaacgcgtcgaggcactgggccagtcccttggccgatacgccggcgttggccttgcgcgcggccacggccaggaacgtggggaggtcgatggcgacggcgccggcgccgcccgcgccggcgtcctcgaggaagccccgcgcctcggcctcgtccacgttctggcccagcgagcggagcgccgtgaccagctcgccggcggcgatgcggccgtcctcgtcgccgtcgaacaggtcgaacacctccttgcactcgtccgcctgctcctgggtcagcttggccgccatggcgggcagagaccagagagagccgagctgctggagggagagggaaagaaatggactatt

SEQ ID NO: 18071 - DNA, 692 bp, Triticum aestivum
  unsure (1)..(692): unsure at all n locations
  Clone ID: PAT_TA_18071
gagaaatgattatatcattttattgacccactgaattctcactttggcacaaaaaaatacatacatctacagatatcaggaacagccagttcttaaatcggtgaagcctgctacagaaaacatcctcttttttccttccatacaatgactataaggaacatgtcactttcaatgaatcaagcagagatgttctataaattacatatgaattccttttcttctttctgctgaagctgttccatttacttgtcaaatcgagtgcttcgcaatgagtttatcaacgtggatgataatatcgtcaatattgggacgaactgcaggatgtggctgcagcatccaggttacaaactggcggagagtatcaggataggacgaacccgtctcagtaggccacttcacctgtgcacttttaatgactgttactaggctttcaccagcagattcatcgagctcataatcaaatggggattttccatacatctgtcctctcatcaatatcggcgtggggtgggcactcccataattcaggtgcccggaaatgtgcagagcagtgctctgaagcccattcctgcagctgcaaagcttctgcttgtgatctaatagctcttcttgctgggcgagcactttcaaagtccatcaagatagcaagatgaggctgttccttcctctgagttatgaggacattgncggtt

SEQ ID NO: 18072 - DNA, 1744 bp, Triticum aestivum
  Clone ID: PAT_TA_18072
gatcaattaagcgagtagagtaggtattgaaaccttgcagttacagggtacatgacagcgatctcactgagatcctggggcacgttgaagatcatggcatcggcgatcatgaagcagatgaggccagcaccggggcctgtcttggtgaaggcaccatgcggaagcgacaaagataccagctctgatagaacctgctatggcaatcatgtggagatgccgcgctagggggatttcactatgtgatttgcgtggtcgttgcttttttcttttctccagtttttttttttttttttttaaccacgagaatgatgatatcatttattgacccctgaatctcactttggcacaaaaattacatacatctacagacatcaggaacagccagttcttaaatcggtgaagcctgctacagaaaacatcctcttttttccttccatacaatgactattaaggaacatgtcacttttaatgaatcaagcagatgttctataaacttacatatgaattccttttcttctttctgttgaagcagttccatttactcatcaagttgagtgcttcgcaatgagtttatcaacgtggatgataatatcgtcaatattgggacgaactgcaggatgtggctgcagcatccaggttacaaactggcggagagtgtcaggataggacgaacccgtctcagtaggccacttcacctgtgcacttttaatgactgttactaagctttcgccagcagattcatcgagctcataatcaaatggtgactttccatacatcatagcataaagggtgcatcccaaagaccatacatctgtcctctcatcaatatcggcatggggcgggcactcccataattcaggtgcccggaaatgtgcagagcagtgcaagcccattcctgcagctgcaaagtctgctgaatttgctgggcgagcactttcaaagtccatcaagatagcaagatgaggctgttccttcctctgagttatgaggacattgtctggtttaactccattgtgagcatatggtggctcaaaactgtgcatatgcttcagtcctgcacatagctggcgaaatatctggagaatggtgattgttgaaaggtattccttcttttcttgcatggatttagttacatcctgcaaggttccatctaagtgaactgggaacaacaagtaagcctcatggttctgcgacccatcttgcacacccttgactgcaataatggcattttcaagaagtggaagtaaatttggatggctgaattgagaggacactcggatctcctgccgaactagctccaagtgttggtcgctctgaataaaaactttcttcaaagcatatgtcccatcagctgagatgtgtgacgggtcgacgcccttcttcttggcgagccccgcggcgccgggtcccgctccggcggtgccgtcggagaccgcggcggcggcgacgacctccttgacgaggaagacggaggagcccgcggggccggcgtcgccgagcctgcggagcacgcggaagcggtagtcgttgacccagatgtcgccgccgccgccgccgacggtgtcgtacagcgcgttgagcccggagaaggagcaccccatggcggacgcgacgtctccccctcgcgcgagcgagcgagcgagcgcttccggtccgaggcaggaggaggaccggcttattacaatttgcgctcgcacacgcggcgcccgcgcgtgttttgagtgacggggaaatgtctcgtccg

SEQ ID NO: 18073 - DNA, 494 bp, Triticum aestivum
  Clone ID: PAT_TA_18073
aggagggcaataaaaaccgacttttgtttacagaataagcataacttgtacatgtacatatacacacctgaccacatttctaactcacacacccacggtaatggcgaggtatttcacatatgctagttgttctcccttttctagcacatatttactatatattaattcccacatataaaatgacacaccaacacacagttagcttagaaattcatacttcatatgcatgtgtgctaattaactattgaccttctcctgtaagcaaccatcacttttcctctaggtcctggtaatattttgtcattctctagctcagggaaaggagagattaactcgagctcaaagttcctcagcaaatagctccatatcaccttgatttgcatgaaagcataatcctgccccaagcaagaatacctcccagcaccaaaggatatgtctgaaaacttgccactggttttgtcctcctctctccccaggctaaaccggcacggatc

SEQ ID NO: 18074 - DNA, 422 bp, Triticum aestivum
  Clone ID: PAT_TA_18074
cgtccgcggacgcgtgggcggacgcgtgggccgcgaccggcaacaacgcgaccctcttcaactccggcgtcatggtcatcgagccctcaaactgcacgttccagctgctgatggagcacatcaatgagatcacgtcgtacaacggcggtgaccaggggtacctgaatgagatattcacatggtggcaccgcatcccgaagcacatgaacttcctgaagcacttctgggagggcgacagcgaggaggccaaggcgaagaagacccagctgtttggcgccgacccgccgaacctctacgtgcttcactacctgggcctgaagccatggctgtgcttcagggactacgactgcaactggaacaacttcatgatgcgcgagttcgcaagcgacgtcgcgcacagccggtggtggaagacgcacgac

SEQ ID NO: 18075 - DNA, 764 bp, Triticum aestivum
  unsure (1)..(764): unsure at all n locations
  Clone ID: PAT_TA_18075
ccgatccgaggctcaagacctgcttcgagaagttctgcttctgggagagcatgctgtggcactggggcgaggcgaagaaccagaccaagagcaaccccgcgccggcgacgcctgcgacgatgagcttgtcaagctcgtgagctgtgtagatagcccgagatatttatacagaagaaaagcttcatcatatgtatagcaccgtacctgcatagcagcagcttgtataggtagctatgcttagggccttccctacacaaatacaaaccctcctctgttgccgtcctcctggctgcagctctgagccttggcggtggccaacaattcttttgggttggtttagctaataagttatctgtgtatgtaaattctcttactaagaacacggaatgttttttctcacgacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacnaaattaaaaaaaaaaatatttttttttataataaactaaaaaaaaaaaaaaaaaaaaaaaggggggccccttttagggttccaatttttcggcggggggggggggaaggtttttttttttttttggggcccccaaatttttttccggggcccgggttttccccccgggggggggggaaaaaccggggggtccccccttttattcccttgggaaacaccccctttttgcggggtgggggtttttggaagaggccccc

SEQ ID NO: 18076 - DNA, 547 bp, Triticum aestivum
  Clone ID: PAT_TA_18076
actgcctcctgagatcaaggctgaaggccgggctggagtgggagcggaggcaggcggagaaggccaacttcaccgacgggcactggaagcggaacatcaccgacaagaggctcaagatttgctttgagaagttctgcttctgggagagcatgctgtggcactggggcgaggcccccaacaactcgacgaagaaggcctcgacgccggcgctgcccgccgcgaccctgtcgagctcgtgagatgctgtgtagatatcctcccccgagaaattttagcataccagatgatacagcagacccccccagtctcctccattccatacaatacacaatagcaacagctttgtaaaggtagccatgcatgctgctcctaggcctttccttcccaacagctatacattttgtttgctgccaatgcctcgggcgcgcgctctcgctctcgctgctgctgctgatccgacctcgaaagcagccgctgctccaaccgcgacggctaacgaattttttggtttcatcatggatgggtaataattcgtcgcttgtagatt

SEQ ID NO: 18077 - DNA, 1356 bp, Triticum aestivum
  Clone ID: PAT_TA_18077
cggcacgaggcaccggaattcccttgaatctgcgggttggaaggtgagaatacgcggggggggccggctcccccggcctgagcgtgatgcttacaatgagtggaactacagcaaattccggttgtggcagctcacggattaggacaagatcattttcgtacatgctgatcggctcctcctgagcaacattgattgcctctttacaatgccggaacgccgtgcaactggcgacctcgcaacactcttcaacgctggtgtcatggttatcgaacctgcaaactgcacattccagctgttaccgaatctcaccaacgagatcacatcttaccaggcgccgcatcccggatacttgaacgagatattcacatggtggcatcggattccaaagcacatgaatttcctgaagcatttctgggagggtgatgaagaggaggtgaaggcgaagaagacccagctgttcggcggcaacccaccgatcctctacgtgctccactacctgggccggaagccatggctatgcttccgggactatgactgcaactggaacgttccgatgctgcgggagtttgccagtgacatcgcgcacagccggtggtggaaggtgcatgacaagatgcccaagaagctccagagctactgcctcctgaggtcaaggctgaagagcagggctggagtgggagcgggaggcaggcggagaaggccaacttcaccgacgggcactggaagcggaacatcaccgacaagaggctcaagatttgcttcgagaagttctgcttctgggagagcatgctgtggcactggggcgaggcccccaacaacgcgacgaagaaggccccgacgccggcgctgcccgccgcgaccctgtcgagctcgtgagatgctgtgtagatatcctcccccgcgaaattttagcataccagatgatgatacagcagacccccccagtctcctccattccatacaatacacaatagcgacagctttgtaaaggtagccatgcatgctgctcctaggcctttcgttcccaacagctatacattttgtttgctgccgatgcctcgggcgcgcgctctcgctgctagctgctgctgctccaaccgcgacggctaacgattttttggtttcatcatggatgggtaataattcgtcgcttgtaggtaaacttttccgggcaggacttgtctatggctggctgtgttggtgcagtggtagttagctttttgtaatgtaatgtgtgtatggtggtcgttgaactgttggctccggtggcgttggtctggggtgatgcaagggttagattgctgaccggcggacgccgccgctcctttttggcaccatgggtaatggaatttgggt

SEQ ID NO: 18078 - DNA, 921 bp, Triticum aestivum
  unsure (1)..(921): unsure at all n locations
  Clone ID: PAT_TA_18078
ccttggcccgcgccgccgccaccgccgccagagcggccctccgcccggcgcccctcgccggccggggcctcggnctcggttcctccctgccgtcttcctcccccgcacgggccgcccgaatcctccgcaggtcggcggtggcggggctggagacgctgctgcccctgcacacggtggtggcgtcggcgcgcctcaagtcctgcatcgccgtcgactccacctgctggtgctccctctcccaaggatatgctttgcctttgtgacaaagagctgcccccgaagaaaccaatgaacattaaggatcacaagacatttcgggctgtaataattagatacttgcaaactgacagtggcacactgcatccangtcctgtttaatgattataataatgtgattcccccatagnttttnggaggaaagtttgtttgatgctgaaagtttacgccctgtgtgttttctgcggctcttgctttgttatgcatcccttgagcctttttcttgtgatatttgaaactgggttcgtgtggattggcacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccatttccgcagccgcaactaccatattcgcagccacaaccatttcgaccacaacaaccatatccacaaccgcaaccacagtattcgcaaccacaagaaccaatttcacagcagcagcaacaacaacaacaacaacaacaaatccttcaacaaattttgcaacaacaactgattccatgcatggatgttgtattgcagcaacacaacatagcgcatggaagatcacaagttttgcaaca

SEQ ID NO: 18079 - DNA, 1229 bp, Triticum aestivum
  Clone ID: PAT_TA_18079
ctagaaaaattatatttaggaacaacgggagtacatgccatcaatgagccaaaatatgtctagatacatccatttctctgacaagtattaccggacggaggaagtattagctaaataacctctaaaagcatggagatattattaggttcagaatgaaaagaaacttatgccaaacggatgtatctagtaatgaaatacatatggatccgagagattattataatatcgccatgtttcttagacaccgaattattcttaatagcatatagtagttcttccgtacgattcatacatgttcctctttcagttgattccttgtcgtattttgagccatcgagcctaacaattaaatccaaatcttccgctcttatcatcctcgaagtcttggcatatagtgatcctttggtgtaagaatcttaatccccaaaaacctgagctcaataattccacgcatacctactgggtttggccaagcttctcgtcaacgaatgcctaccagtggagaatgttgtgctttgcaagtctgaggaggtcagggtccactcgaagttctctaccctaaagctgctccgttcctagtatagctaatccgccttccaagctttgaatgtagacctttccctcgggaagttcaactgcttctttaatatcttgaattggaacatgtaaaccaccgacatcagaacaagactccaaacgtgtcatttcaattttcatgacagaaatcataggaccaacttcaccttgcaaaattccgaccaccaagagaacctgagaaaaagacaggtaaagctcaataaataaatactccaaggcagaattgaaattcatcacatcaatcaaacagatactccgatggcctaagctaaccagtcctctctctgagtgtataaataaataaaccacaaaaagaatatgagagctgaagacttaaatgcagatttctattgcaaccatttcactctttccaattgaataaaaatataatgaccacagattctgccaacttttcttctcctggtaattggaaccatgtagtaaggaccaagaaacttcagaaaacctatttccctcgtgaatccgccaaattagttcttgacaatcaattctccgtgtaactagtaggatactcctggatacccaaatcaatagactccaaccggtccaatcttcagcaccgtccaaagagtcctgctcttgtgatcttgatgacgacggcggtgaggaaa

SEQ ID NO: 18080 - DNA, 633 bp, Triticum aestivum
  Clone ID: PAT_TA_18080
cgtcctccctctccaccccacacgacccccatcccgatctccctccccacccttcaccacccccatccggcggcggcgccccaaccccgtcaaccaccgcctggctctgccgaccagcgtcctcgccccctccggtggatcggcggcgagctttctgaagccaatatgctgttcttctcctacttcaaggagctcgtcgggaaggaggttacggtggagctcaagaacgacctggccatccgcggcacgctccactcggtggatcagtacctcaacatcaagctcgagaacactcgggtcgtcgaccaggacaagtatcctcacatgctatcggtgcggaactgcttcatcaggggatctgtggtgcgttacgtcctgcttccgcaggacggggttgacatcgacatcctccatgacgccaccaggagggaggcacggggcggctgattgatatagtttattcccttttctcggccgtgagataattctaatctgatttgtggaactggaacatgtatggactgacatcggcattgcttaactccgctcgtggtacacttgcagtgcaaattatccaatgttacatatgtcaatgtgatattatcaaagagcaacaaccaagcattgccatgc

SEQ ID NO: 18081 - DNA, 770 bp, Triticum aestivum
  unsure (1)..(770): unsure at all n locations
  Clone ID: PAT_TA_18081
ataaaacacacttttagtcttttttgcaacggctcgccccaatcttggtactgacatgtaaaaattaccaatcttggtaccaatctgcttccaatgccccaattgtggtacttctgtgcaatttactcagttgaggagttggtggctgtggagggctaccgaacacgcccttaatatatactccctccgttccgaaatgtaggtcgctggcgaccttgttccgaccaggtgaaattgtgcaaaaggacagtaataccctcaatttgaattggaatcctgcgtcgtgttctacctccagctccagctccacctccgccctcgccctcgacctccagccctgcccatgcccccgcccccgcccccacatccggcgactgcgccaaggtccaggcgcccccacctccggcgattgcgccaaggtccaggcgcccccacctccggcgattgcgcccagggtccaggcgcccccaccttcggcgatcgcgcccaggtccaggtcgctcctcctctcnccacgtccaggagctcctcnctggacccgtgcacgcnccaggtggaggcttcttccctcgagctgctnnattggggctcgagcatgatagcctggatgttgattcaagagnnatgtttgtnctgcttaagaggaaagganngaccncctgtttcctgcttannatattcacagccnncatggcaattttttcttgctaccaaggcaccaaggcatcaagcaaacagatttgtcatnncataatggagtncaccgcaan

SEQ ID NO: 18082 - DNA, 567 bp, Triticum aestivum
  Clone ID: PAT_TA_18082
cccctccccgtgtgttttttctttttaggaaaaaaggaactgcggtaactctgttattgcatagagtgaaattaaacaatagttgtgaacgagtcaccaacagattagatctgcaactttttcaacaaaatttgattaatgcacactgacatatcctattcttcagagaagaaagaaaatatcttgaaaatgacacaggagcaagtgatccatgctcttcaacattacgctcctagccaatgtcagatgcgcttgatcaaaccttgggagaggcagctccagcaggaggagtcggcggcgatgcacgaccgtagccgcgcgccagccaccgcgctgtggagcggcatcagcgactccgcgcccgccagcatcttcaccgtggacctgcggaggcgaggagcggcaacgggagacctcgtggccgggaacgggctcgcgatccgggacttggaccggagcgcagccgacctggccgcggcggcggcggagcggcagaaagactcgccgggaacgggttcgcgatccgggacttggaccgaagcgcagccgacctgcctcgggccgaat

SEQ ID NO: 18083 - DNA, 585 bp, Triticum aestivum
  Clone ID: PAT_TA_18083
aaaggaatgaatggaaaatgtgattcaaagagcacaattgtacagttcgcgttaccatgctaaacttccagggttcaaagagcgagtagaagcagaggaccattttgttcgaagccacagagtatcactacgtttttatttttaatcaaagccacggattgtttaaccgcacatgttgcttcccagtgccctgccagaaatgaaaaagatgagcgctatcgtctacaatgactgacaagatgtttctcgaagtgacaccagatccgaccagtactgcacaaggagagacagtcgacaagattatgcggctgcagcgccgagtgggagctcagactatcgctgctaatggtgcttctgtctgcaagatggtagccctcagttttgttcctctctgcaatgtcgaagctcaggtagatgctgtcacctctaatggagccagaagggaagaccttggtaggcaccgagagagagcaatacatgccgatgaacaaggcatgcccgccgccgccaaagctgtcgactcggcacaaagtcccggcgcccagatccagtcgatacacgtcgtaccttctgttggccatgtta

SEQ ID NO: 18084 - DNA, 667 bp, Triticum aestivum
  unsure (1)..(667): unsure at all n locations
  Clone ID: PAT_TA_18084
ttancngtgngaagggntttctcagngttaagtggtacgcaggtttcccgtcagantttaangacgcccgtggggcggtaancgatcatnttggcgtttggttccggccccgacgcagaaggaaagttccctttactccggatataattgccttacaatgtacaatcatgacctaatcccttttagaatggaaaaaggaaattccacggcagtataagtttgcgttgagaacaagcttgttggattaggaacactaaaatctcttgagatcttcagacatcttcatttggaccgcagatggtggatactcaactagatcttcagagatcttggtttggatcgcagatggtggatactcagctagatctacagagagctttgcttcggatcacagatggcagatactggagtagacttctccaactgcagcagcaatgcgatgtcgagctcctgcaggctcttctccagtataagttttgaagtttcagtggcttcaggctggctcttgtttgaatagttccaaacctctcttctgctgatgatttctgttcacaatgcactgaaaagcattctgcggccgaagactttgatggtacctcgctattctactgctgcaaaggatctcaatgatcttccatagctcctgcctccccatggacaagaagtg

SEQ ID NO: 18085 - DNA, 736 bp, Triticum aestivum
  Clone ID: PAT_TA_18085
aatcttaaacgagcttcattaagttcagacactccattacagactacaacacttcaacttgcataactactaaatgtgggtttacatagggaaacaggcttagcggtggagggagccacccttgattaaccccacgaaatcaccctgtcttcttagtacgcatcacacgcatatatctgggaccccatgctaatctagtttgccgacacaactaccaccatcaggaccaggactgtgagcaggatgttggtcgcaccaaggagaactgcaatgacggcaaggctttgagtgcctgtcgcagatgccgccgctgccgcctgagggggatgctgaatctgattatttacggctggtggatcttgctggacttgagggtggatctgagcctgggctggttgatcgccggaactaactgctcggctgcatttgcttgatggatgccgaacatttggcctcctggatgcatccctgcttgctactgagcggtgccaatatgcatcgggctcatcctcatccaataagcacgctgtaactcgaataagcggcactaacgagcatcgtaccggatgcacttgtagattcgatcactagcctgagagcctgccctcgcaacattggactcgatctcgtcgtcgcacagtggacactgcaagagcggcagaagccagtcggatggtatggggagcgagtttttcgaggaagcagacatggcgtggtcgctggcgctggaaatgag

SEQ ID NO: 18086 - DNA, 694 bp, Triticum aestivum
  Clone ID: PAT_TA_18086
ggttacgaatcttgttcttagcaggaagtgcacatttctattccagattagagcttcccaagagcatccaacaaatttcattcatcaccaacacttctagattcagacaaacgagtcaacaccaggtaactacaagcactgccagaaactagcgatctaagaggaggtgaacttggtgacggccttggtgccctcggagacggcgtgcttggcgagctcgccggggaggacgaggcggacggaggtctggatctcccgggaggcgatggtgggcttcttgttgtagcgggcgagcttggcggcctcgccggcgagcttctcgaagatgtcgttgatgaaggagttcatgatggacatggccttggaggagatgccgatgtcggggtggacctgcttgagaaccttgaagatgtatatcttgtaggtctcgacgctcttcttgcccttcttgcggcccctcttctcgccgccctccttggaggcggtcttgcccgccggcagccgcttctcggccttgggcttcttcgccgccggggccttctcggccttctccgtcgtcggctcctcctccgcgggcttcttcgccgccggcttcttctccgccttgggggccatcgctgctgaggctgatcggggttgggggcttcgctggtgggctgtgactcgtgagtgctggaagaaggtggggaatttc

SEQ ID NO: 18087 - DNA, 585 bp, Triticum aestivum
  Clone ID: PAT_TA_18087
ccgtcacgagtttaaacgacgcccgtgggcgcccgtatacaggctcgctatcgcttcttggttctttttttttttttttttttgaacgaagagtgaaattttccattaatgaaatgaatggatcaatcaacatatggtcaagtaatccagtttcaaaccaaataaaagatacatgtatcacaaaaacgaaaaccgacacacatcaaattaacgaaatacaggaagcaccagcagcatttgtcctcttcatcctcctccaggtgcacgtatcttccttcgcttacttactgcatgtagtaagacaagaaggagagtacggaggcgccgagcaccgcgccgacggccgggaaggcgccggttgctgcggaggctcccgccgccggggctcccgccagggctcccgccggggcaagggccggaccatcggcagcgagggcaacggtcgccgatgcggcgatgaggacggcgcaggcaatcttcttcatctccatgacctgagaaagtcgaaagagggagatgaggaagcacaagggcttattggcaaagctgggattgcttattcgtgcctttgatgcttgcgtcccg

SEQ ID NO: 18088 - DNA, 1057 bp, Triticum aestivum
  unsure (1)..(1057): unsure at all n locations
  Clone ID: PAT_TA_18088
accttccagcaccgggttcgtctcgggaggcattttatatatacacacgcgattaacacgtacagtacagacatcctccaacgacggtcgatgatggccggcgctcaagagcaagggctgaagctgctggtgccgcggagcggcgtgagcatatacgccatccgcgtccagatggcgcttgccatgaagggtctggcctacgactacctccccgaggaccccgggtgcaagagcgacctcctcctcgcgtccaatcccgtgcacaagacgctgcccgtcctcatccacggcggcaggcctgtctgtgagtcgctgatcattgtggagtaccttgacgatgcattcaccggcaacggcgcatccatcctccccaccgacccctaccaccgcgctgtcgcccgcttctgggccacttatgtcgacgacaagatgttcccttcgtgcatcggcattctcaatacggcgaagcagcaggagagagccgacaaggtggaggagaccttggcggcgttcgggctcctagaggcctacctggcagagtgctccaaagaagaagaggcgccgttcttcggcggtgtatccctcgggctgctcgacgtcgcgctcgggtgctatcttccctggttcgaagcgataggccgccttgctggcacgccgccgttcctagacgcggtgaggacaccaaagttggccgcgtgggcggggcgtttcagggccgccgagccggtcgttgcgctgctaactgcggtggacaaggtggaggagtacatcacctcggtgctttatccaaagtgggaagttgcactaactgcaccggcaactaattagagatcgtgtcgtctccttaagtccgttaagtacattgcagttgctgtgcttgcctcctaaatgagtttggtgttttcacgagtttgttgagctccgttgaactgtttggtacttggtttgtttagtgtctccgtccgtcatccgattggtgcgcacgcatacactgtattttgattttgagctgtttgtttcccntgaataaaccgtggctttccgtgcatccntnggc

SEQ ID NO: 18089 - DNA, 683 bp, Triticum aestivum
  unsure (1)..(683): unsure at all n locations
  Clone ID: PAT_TA_18089
ggcaaccatgccttataccaaaagattaaggtaccaattatagcagtacaacagacatccacggccttaaaatataggccggatcagatagaaagcctcaaaataatacagggagaacaagccgaaccattaagtggttaagtgttgctttccgtaccatcgccgaatttggtctagttgaagtcgggcttctcagggtaagtgcagccagactgctggatgataacgtttgctgcgtagcaaccggcctttacgcagtcctcgatgctcttcccttgaaccaactggagagaggaagcctccaacaaacgcatcaccagcgccattgggtgtcaacaagcttctccttggggcaataggatcacagggaatgttttcaccttcccatcctcagccacaactactggatcagcaccctgagtaatcacagcaatcctctttgttccaaaagccagaggaattgtgagatctcaaagcgattcctcgacattccaatctccaccacggacttagagaantcttgcctcagttcaattcaaagatgtatccgcatacggagaacttcctggcatcacgaaaactcacagataaggaacggaaggtcacagaaaccntgtacttcacacagctanaanagctattnttcaggacccnnggaaagcacatntaatttttttntccca

SEQ ID NO: 18090 - DNA, 547 bp, Triticum aestivum
  Clone ID: PAT_TA_18090
ggagcagacattttacacaactaactcctagggcagagaactcagatcgtaagcaacgtatacctatgtacattacacatgtggccgacacacagggcatgaaccgtggctagtgagccattagtccacgcagagctgatgaaaagcatgggagcaattgggcaaccttctcgccgtctcaccacctaccatatcctgtagacagatggcacaagacaggtcttcacccgatttgccctgagcctgagcctgatcagccaccacgtagtgcggtaatttctccagtgcctcccgcgaaagccctctcgacgaaatgtccccgaagatgtcgtacacatcatcgtgcccgaaatccggtatgctgagctgccaacggtacgccatgtgtgccgaggacccgagctgctgttgcacaaaccgggcatggaggagctgctctatgaaatctgccatggagcacgtgccgagccggtccgagcaccagtacgcgcgagacgcctcgagaacctcgatggagaggacggccccggcgatggctcccagtcca

SEQ ID NO: 18091 - DNA, 543 bp, Triticum aestivum
  unsure (1)..(543): unsure at all n locations
  Clone ID: PAT_TA_18091
cccctataatggcacctgccttataccaagataaaggtaccattatagcagtacaacagatatccacggccttaaaatataggccggatcngatggaaagcctcaaaataatacagggagaacaagccgaaccattaagtggttaagtgttgctttccgtaccatcgccgaatttggttggtctagttgaagtcaggcttctcagggtaagtgcagccagactgctggatgataacgtttgctgcgtagcaaccggcctttacgcagtcctcgatgctcttcccttgcaccaactgagagaggaagcctccaacaaacgcatcaccagcgccattggtgtcaacaagcttctccttgggcaataggatgacagggaatgttttcacctattcaaaagataataatatttaggtttagcatattatcttaacatagcattgactcaactaaattctacatgaagatttaagtgcccgttccttgatgaataaaatttttgatgtgacatttgaataagcaaacaactgtgacaaaaacagattg

SEQ ID NO: 18092 - DNA, 720 bp, Triticum aestivum
  Clone ID: PAT_TA_18092
gttttatgtggagtacctcgacgatgcccctggccttgccggcaacgacacgtccatcctccccgcagacccctacagccgcgcagccgctcacgtttgggccgcctatgtgaatgacaagttgttcccttcgtgcaccggcatcctcaagacagcgaagcaggaggagagagccagtaaggtggaggagaccctgtccgggctccgacacttggaagctgccctggcagagtgctccaaaggggaggtggaggcgccgttcttcggtggttgctccatcgggttccttgacatcgcgctcgggtgctatcttccttggtttgaggcagtaggccgcctggccggcttggggcggcttatcgacccggcgaggacgccgaaactagcagcatgggcggagcggttcagggtcgtcgagccggtcaaggcgctgctgcctagggtggacgagctggagcagtacatcactacggtgctttatccaaagtggaacgtcgcggtcaccggtaactaattaaagatcgtgtcgttccattaccggcggaggatcgtgtcaatccaataattcctccgccttgtgagttgttgttttcacgccaagagttgaactgttgctactaggtccttagtgtctcctcgtcgtggatggtgcgcatgcgtgcactctcttcgatctgagttgttgacatgttgtttcgtgaataaactgaagtttcgtcc

SEQ ID NO: 18093 - DNA, 1217 bp, Triticum aestivum
  Clone ID: PAT_TA_18093
cttcacaaaactagtactccaacatgtgctcctctctcagtgtgtgtccgtgtgctagtagctagcctacagcaccgtttctctcgggaggaatttcatatatacacacgcgattaacacgtacgtacagtacagacatccttcaacgacggtcgatgatggccggcgctcaagagcaaggcctgaagctgctggtggcgcggagcggcgtgagcatatacgccatccgcgtccagatggcgcttgccatgaagggtctggcttacgactaccttcccgaggaccccgggtgcaagagcgacctcctcctcgcatccaaccccgtgcacaagacgctgcccgtcctcatccacgccggcaggcccgtctgcgagtcgctgatcatcatggagtaccttgacggcgcatttcccggcgacggcgcctccatactccccgccgacccgtaccgccgcgccgtcgctcgcttctgggccgcctatatcgacgacaaggtttgttcccttccctctcgtctagctagtttgagcttgaagaattgaagttgcatcccacgggcgccgttttgttgccgcagatgttcccttcgtgcatcggcattctcaatacggcgaagcagcaggagagagccgaccaaggtggaggagaccttggcggcgttcgggctcctagagaccgccctggtggagtcctccaaagaaggggaggcggaggcgctgttcttcggcggtgtatccctcgggctgctcgacctcgcgctcgggtgctatcttccctggttcgaagcgataggccgcctcgctggcacgccgccattcctagacgcggcgaggacaccaaagttggccgcgtgggcagggcgtttcagcgccgccgagccggtcattgcgctgctgactgcggtggacaaggtggaggagtacatcactaaggtgctttatccaaagtgggaagttgcactaactgcaccgccaactaattagagatcgtgtcgtctccttaattagtcgttacatacattgcagttgcggtgcttgccttctaattaattgagttggtgttttcacgagttgttgtgctcgttgaactattgatactttgtttttagtgtctcgtcgtcatcgatggtgcgcacgcgtgcactgtatttgatctgagctgttgtttcatgaataaaccgtagcttcttgcttcttgcaaaaaaaaaaaaaaaaaaa

SEQ ID NO: 18094 - DNA, 954 bp, Triticum aestivum
  Clone ID: PAT_TA_18094
cccacgcgtccgaacgacgatcgatgatggccggcgctcaagagcaaggcctgaagctgctgggggcggcgtccggggtgagcccgtatgtgatccgcgcccagatggcgctaggcatcaaggggctgacctacgactacctccccgaggacccccggtgcaagagcgacctgctcctcgcatccaatcccatacacaagaagctgcctgtcctcatccatggcggcaggcccgtctgcgagtcgctgatcatcttggagtacctcgacgatgccttccccgaaaatggcgcctccatcctccctgccgacccctaccgccgtgttgtcgcccgtttctgggccgcctacgtggataacaagctgttcccttcgtgcatcggcatcctcaagacagggaagccgcaggaaagagccgacaaggtggaggagaccttgtcagcactcgggctcctagaggccgccctggcggaatactccaaggaaggggacgcggaggcgtcgttctttggtggtggctctctcgggctgctcgacattgccctcgggagctatcttccctggatcgaagcaataggccaccttgccggcatgccgccgttcctcgacgcggctaggacaccaaagctggccacgtcggcggagtggtttagggccgccgagccggtaagggcgctgctgcctgcggtggacaaggtggaggagtacatcaccacggtgctttatccaaagtggaaggcttttagagcgctcaccgcgccggcaactaattagagatcatgtcatctcgttccatcgctgttgctgtgctcgccttcaaattgagttggtgttttcacgagttgtgctcgttgaacttttgttacttggttgtgagggtttgagtttgctgtttgcatgtatgcactgtctccgatctgagtttgctgttttgggaataaattaaagcttcatc

SEQ ID NO: 18095 - DNA, 910 bp, Triticum aestivum
  Clone ID: PAT_TA_18095
cggcgctcaagagcaaaggctcaagctgctggggccggggaccggggtgagcatgtacacgattcgcgtccagatggcgctctgcatcaaggagctgagctacgacttcctccccgaggacccctgggagcaagagcgacctcctccttgcgtccaaccccgtgtacaaagaaagctccccgtcctcatccacactggcaagacccgtctgcgagtcgctcatcattgtgcagtaccttgacgacgccttcgccggcaacagcacttccatcctccccaccgacccctacagccgtgccgtcgcccgcttttgggcttcctacatcgacgacaagttgttcccttcatgcaatcgggcattctcaaagacgggcaaaggcagcatgagagagccgacaaggtgaaggagaccttggcgggcgttcggggctcttagaggccgccctggcggagtgctccaaagaaggggaggctgaggcactgttctttggcggtggctctctcaggctgctcgacattgccctcgggtgctatcttccctggatcgaagcgataggccaccttgccgccatgccgccattcctcgatgcggctaggacaccaaagctggccgcgtgggcggagcggttcagggccgccgagccagtaagggcgctgctgcctgcggcggacaaggtggaggagtacatctcaacggttctttatccaaagtggaacgccgcactcactgcgtcggcaactaattagagatcatgtcgccccgttccatcgttgttgctgtgctcgccttcaaattcagttggtgttttcacgagttgttgtgctcgttgaacttttgttacttggttattagggtctgatcgcgatggatggtgcacatgcgtgcactgtcttggatctgactttgctg

SEQ ID NO: 18096 - DNA, 1113 bp, Triticum aestivum
  Clone ID: PAT_TA_18096
caatccatttgagcttcacaaaactaccactccaacgtgtgctcctctctcaagtgtgtgtccgtgtgctagtagcctacagcaccgtttctctcgggaggtactccatatacacgttgattaacacgtatacacatccttcaacgacaatcatggtcggcgctcaagagcaagggctgaagctgctggtgccgcggagcggcgtgagcatatatgccatccgcgtccagatgccgcttgccatgaagggtctggcctacgactacctccccaaggaccccgggtgcaagagcgacctactcctcgcgtccaaccccgtgcacaagacgctgcccgtcctcatccacggcggcaggcccgtctgcgagtcgctcatcatcatggagtacctcgacaacgcattccccggcaacggcgcctccatcctccccgccgacccctaccgccgcgccgtcgctcgcttctgggccgcctacatcgacaacaagatgttcccttcgtgcatcggcattctcagtacggcgaagcagcaggagaaagccgacaaggtggaggagaccttggcggcgttcgggctcctagagaccgccctggtggagtgctccaaagaaggggaggcggaggcagaggcgccgttcttcagcggtgtatccctcgggctgctcgacgtcgcgctcgggtgctatcttccctggttcgaagcgataggtcgccttgctggcacgccgccgttcctagacgcggtgaggacaccaaagttggccgcgtgggcggggcgtttcagggccgccgagccggtcattgcgctgctaactgcggtggacaaggtggaggagtacatcacgtcagtgctttatccaaagtggaatgtttcactaactgcaccgccaactaattagacatcgtgtcgtctccttaattagtcgttagtacattgcagttgcggtgcttgctttctaattgagttggtgttttcacaagttgttgtgctcgttgaactattgatacttggttgttagtgtctcgtcgtcatcgatggtgcgcacgcgtgcactatatttgatctgagctgttgtttcgtgaataaaccatagcttcgtgctcttgcaaaaa

SEQ ID NO: 18097 - DNA, 913 bp, Triticum aestivum
  Clone ID: PAT_TA_18097
caaaggctgaagctgctgggggcggcgtccggggtgagcccgtacgtgatccgcgcccagatggcgctcggcatcaaggggctgacctacgactacctccctgaggacccccggtgcaagagcgacctgctccttgcgtccaatcccgtgcacaagaagctgcctgtcctcatccacggcagtaggcccgtctgcgagtcgctgatcatcttggagtaccttgacgacgccttccccggaaatggcgtctccatcctccctactgacccctaccaccgtgttgttgcccgtttctggggctacctatgtggacaacaagctgttcccttcgtgcatcggcatcctcaagacgaggaagccgcaggaaagagccgacaaggtggaggagaccttgtcgtcgctcgggctcctagaggctgccctggcggaatgctcaattgaagaggaggcggaggcgttgttctttggcggtggctctctcgggctgctcgacatcgcgcttgggtgctatcttccctggatcgaagcgataggctgccttgccagcatgccgccgttcctcgacgcaacaaggacaccgaagctggccgcgtgggcggagcggttcagggccgccgagccaatctggggactgctgcctgaggcggacaaggtggagaagtacatctcaacagttctttatccaaagtggaaggccgcgctcactgcgccggaaactaattagagatcatgtcatcttgttccatcgcttttgctacactcgccttcagattgagttgatgttttccagatgtgttgtgctcgttgaactgttgttacttggttgttagggtctgatcgtcatggatggtgcgcacgcgtgaactgtcttcgatctgagtttgttgttttgggaataaattaaagcttcctc

SEQ ID NO: 18098 - DNA, 703 bp, Triticum aestivum
  Clone ID: PAT_TA_18098
cccacgcgtccgttcaacgacggtcgatgatggccggcgctcaagagcaagggctgaagctgctggtgccgcggagcggtgtgagcatatacgccatccgcgtccagatggcgcttgccatgaagggtctggcttacgactaccttcccgaggaccccgggtgcaagagcgacctcctcctcgcgtccaaccccgtgcacaagacgctgcccgtcctcatccacggcggcaggcccgtctgcgagtcgctgatcatcatggagtacctcgatgacgcattccccggcgaccgcgcctccatactccccgccgacccgtaccaccgcgccgtcgctcgcttctgggccgcctatgtagacgacaaggtcacaggccatgggtccgtattgatggggaatggcgcgagtgcttatgttcatggtgttggcacggtcgatctgaagtttacttcgggaaggatcgtgcagctgaagaacgtgcagcatgtccccgccatcaagaagaacctcgttagtggctcccttctatgtagagaagggtttaagttggtattcgagtctaataaattagttgttactaagtatggactatttgttggaaaaggttatgagagcggagggatgttccgcctttccctcgcagatttctgtaataaagtcgtgaaccatattcattcgagtattaatgaatctgaagtttggca

SEQ ID NO: 18099 - DNA, 1079 bp, Triticum aestivum
  unsure (1)..(1079): unsure at all n locations
  Clone ID: PAT_TA_18099
cagatatacaacacaggagttcgagccttgcagaagacgaggaaacgttgatggccggcggtgaagagctgaaactgctggggtggtgggcgcccggggtgagccccttcgtgctccgagcacagatggccctcgccgtaaaggggctgagctacgagtacctccccgaggaccgctggtgcaagagcgacctcctcatggcgtccaaccccgtgtacaagaaggtgcccgtcctcatccactgcggcagggccgtctgcgagtcgctgctcatcttgggagtacctcgacgacgcacccggccttgccggcaacggcacgtcgatcctccccgcagaccctgtacagccgcgccgtcgctcgcttctgggctgcttatgtgaacgacaagttgtttccttcatgcatcggcatcctcaagacagtgaagcaggaggagagagcctgtaaggtgtgagtgagaccctgtctggggctccgacacctagaagctgccctggcagagtgctctaaaggggaggaggagtgtgccgttctttggtggtggctccatcggtgttccttgacatcgcgctcgggtgctatcttccctggtttgagtgcagtagtgccgcctgccggcttggggccgctcatctgacccagcgaggacccctgaaactagcctgcatgggctgcagaggttcatgggtcgccgagccagtcaaggcactgctgcctggtgtggacaagctggagtgagtacatcactactgtgtgctttatccaaaattggaacatcgcggtcacctggtaactaattaaagatacctgtgttgttccattacctggcggaggatcatgtccatccaataattcccctgccttctgagttatttgttttcaccccaagagttgaactgtttgttactactaggtccttagtgtctcctcctcgtcgatggcacacacgcgtgcactctctttgaactgagttgttgacatgtttgttcgtgaataaattgaagttggtcattggactcgatctttaattacccagntattngtcttcccaaggcaaaaaaaaaaaaaaaacactc

SEQ ID NO: 18100 - DNA, 942 bp, Triticum aestivum
  Clone ID: PAT_TA_18100
gctcccaatgcgaagaatccatttgagcttctaaaactagtactccaacatgtgctcctctctcaagtgtgtgtccgtctgctagtagctagcctacagcaccgtttctctcgggaggaatttcatatatacacacgcgattaacacgtacgtactgtacagacatccttcaacgacggtcgatgatggccggcgctcaagagcaagggctgaagctgctggtgccgcggagcggcgtgagcatatacgccatccgcgtccagatggcgcttgccatgaagggtctggcttacgactaccttcccgaggaccccgggtgcaagagcgacctcctcctcgcgtccaaccccgtgcacaagacgctgcccgtcctcatccacgccggcaggcccgtctgcgagtcgctgatcatcatggagtaccttgacgatgcatttcccggcgacggcgcctccatactccccgccgacccgtaccgccgcgccgtcgctcgcttctgggccgcctatgtcgacgacaagatgttcccttcgtgcatcggcattctcaatacggtgaagcagcaggagagagccgacaaggtggaggagaccttggcggcgttccgcctcctagagaccgccctggtggagtcctccaaagaaggggaggcggaggcgctgttcttcggcggtgtatccctcgggctgctcgacctcgcgctcgggtgctatcttccctggttcgaagcgataggccgcctcgctggcacgccgccgttcctagacgcggcgaggacaccaaagttggccgcgtgggcggggcgtttcagggccgccgagccggtcattgcgctgctgactgcggtggacaaggtgtaggagtacatcactaaggtgctttatccaaagtggaacgttgcactaactgcaccgccaacgaattttcggacggagggagttg

SEQ ID NO: 18101 - DNA, 800 bp, Triticum aestivum
  Clone ID: PAT_TA_18101
aaatacaaaaaaaaaagatccattcgagcttctcaaaactagtactccaacgtgtgctcctttctcaagtgtgtgtgtccgtgagctagctttagtattagtgcagtttagctactagctagttggaacttacgttgacactgctcttcttctgcgtgttgtgcactagtgtgtccgtgtgctagtagcctacagcaccgtttctctcgggaggcatttcatatacacgcgattaacacgtacagtacagacatccttcaacgacaatcatggtcggcgctcaagagcaagggctgaagctgctggtgccgcggagcggcgtgagcatatacgccatccgcgtccagatggcgcttgccatgaagggtctggcttacgactacctccccgaggaccccaggtgcaagagcgacctcctcctcgcgtccaatcccgtgcacaagacactgcccgtcctcatccacagcggcaggcccgtctgcgagtcgctcatcatcgtggagtaccttgacgatgcattccccggcaacggcgcgtccatcctccccgccgacccctaccgccgcgccgtcgcccgcttctgggccgcctatgtcgacaacaagatgttcccttcgtgcatcggcattctcaatacggcgaatcagcaggagagagctgacaaggtggaggagaccttggcagctttcgggctcctagaggccgccttggcggagtgctccaaagaaggcgaggcggaggcgccgttcttcggtggtggctccatcgggttcctggacatcgcgctcgggtgctatatt

SEQ ID NO: 18102 - DNA, 1355 bp, Triticum aestivum
  unsure (1)..(1355): unsure at all n locations
  Clone ID: PAT_TA_18102
caaaaaactaaattngaaggttctcataccacgaggtagccaggaaatacaacctgagacatacagcagacagaatcacaggtaccaataatttcccatgtgggcttattgcaagttaataaaaaagggggcttttcctctgtctacgctaagacagatttctcccagtgttgaaattgaaaccaaacaagttattctagttggccttggtttcagtgaccatcttcataagaatctagttagccttggcctcaatgaccctcctcgcaaatgatggcaaacaaaacgatgcagtgtggaactcggagttgtagaacttgagcggccccttggattttgtggagtattcgtcctcctcgatgctgaagacgggatgctggaaatcaacactaggcccctccgtggagcagagcatgaaacctatcactccgctagggtatgtgggcacccgtagtccatgcgtagttcacggaccctttgaaaacctggcgacagttggtgacgatgtcttctatgatgtgcatgtgcagccatatgctctccgcctgggtgcagacgaccccgcccggacgcagagccctggagacggactggaagaacggcttctcgaacagctcctgggcagggcctactggatcggaggaatcgacgatcaccgcatcgtaggtgccctctggagcattcttcaggaaggcgacgccgtctccgatgtgcagggacacgcgagggtcctcgaacccgagggccagatgagggaagaactgcttggacacatcgaccaccatcttgtcgatctcgcagatgtcgatctgctccaccgaggagtgccgtgagacctcccgcagaacgccaccgtctccgcccccgatgaccaggaccttcttgggatctttgattgagcagagaggaaggtgggtgatcatctcctggtaagcgcactcgtccctctcggtcacctggatcactccatccaggacgagcaccttcccgtaggtggaggactggaaaaccagcacgtcttggtagtccgacttgccttggaacaagaccttctccaccttgagcgagtgcgcctcgccgggccacatggggctgatctcggagaaccatccggggatgacggcggagatccccgcctgctccccggctccatccgccgccgcagcgccctcgttctcccgcgccctcttcgccgccgtctcggcctccatcccaaaagcctagagcgcgacgacggcgagacgagctcggcggcttgggtggatttcgtcggcggcggcggcggctaggtgtaagcgtggggagggatgtcagccgcggccttgaggttttattccttggggatgtgtgggcgg

SEQ ID NO: 18103 - DNA, 1008 bp, Triticum aestivum
  Clone ID: PAT_TA_18103
gcacgaggatacaacacaggagttcgagccttgcagaagacgaggaaacgttgatggccggcggtgaagagctgaagctgctggggtggtgggcgcccggggtgagcccctttcgttgctgcgcgcacagatggcgctcgccgtaaaggggctgagctacgagtacctcccggaggaccgcgggtgcaagagcgacctcctcatcgcgtccaaccccgtgtacaagaaggtgcccgtccttatccacgacggcaggcccgtctgtgagtcgctgctcatcctggagtacctcgacgacgccgtcggccttgccggccacggcaagcccatcctccccgcagacccctacagccgcgccgtcgctcgcttctgggctgcctatgtgaacgacaagatgttcccttcgtgcaccggcatcctcaagacagtaaagcaggaggagagagccggtaaggtagaggagaccctgtccgggctccgacacttggaagatgtcctcgcagagtgctccaatggggaggtggaggcgccgttcttcagtggtgactccatcgggttcctcgacatcgcgctcgggtgctatcttccctggtttgaggcagtaggccgcctggctggcgtggatccgctcatcgaccaggcgaggacgccgaaactagcagcgtgtgcggagcggttcagggtcgccgagccggttaaggcgctgctgcctggggtggacgagctggaggagtacatcactacggtgctttatccaaactggaacatcgcggtcaccggtaactagttaaagatcgtgcctttccattaccggtggaggatcgtgtcgatccaataattcttctgccttcttagatgttttcaccccaagagttgaactgttgttactactaggtccttagtgtctcctcctcgtcgatggcacgcaggcgtgcaactctcttcgagctgagttgtgacatgttgtttcccctggaataaattgaacttcatcccaaaaaaaaaaaa

SEQ ID NO: 18104 - DNA, 2024 bp, Triticum aestivum
  Clone ID: PAT_TA_18104
aggaaacgttgatggccggcgatgcagagctgaagctgctggggtggtgggcgcccggggtgagcccctacgtgctgcgcgcccagatggcgcttgccgtaaaggggctgagctacgagtacctcccggaggaccgctggtccaagagcgacctcctcgttgcgtccaaccccgtgtacaagaaggtgcccgtcctcatccacgacggcaggcccgtctgcgagtcgctgcacatcgtggagtacctcgacgatgcccccggccttgccggcaacggcacgtccatcctccccgcagacccctacagccacgccgtcgctcgcttctgggccgcctatgtgaacgacaaggttagtaattcatttcatacacagattacctctggttgcgcttggagttacatctctatctcaactcgctttgttgccacagctgttcccttcgtgcaccgggatcctcaagacagcaaagtaggaggagagaggcggtaaggtggaggagaccctgtccgggctccgacaacttggaagctgccttggcagagtgctccaaaggggaggtggaggcgccgttcttcggtggtggctccatcgggttcctcgacatcgcgctcgggtgctatcttccttggtttgaggcagtaggccgcctggccggcttggggccgctcatcgacctggcgaggacgccgaaactagctgcgtgggcggagcggttcagcgtcgccaagccgatcaaggcgttgctgcctggggtcgccaagctggaggagtacatcactacggcgctttatccaaagtggaacatcgcggtccccggcaactaattaaagatctcgtcgttcccctatggcaaaagaaataaaaaatggggtcgttcgattaccggcggaggatctctgccttgtgagtagctgttttcacgtcaagagttgaactgttactactaagtcgggtttctttttgcgagggttagtgggtcgtggtcatgaataatgcacaggcgtgcactctcttcgatatgagttgtgatatgttgtttcgtgaaaacagctactcacaaggcagagatcctccgccggtaatcgaacgacgccattttttatttcttttgccatagtggaacgacgagatctttaattagttgccggtgaccgcgatgttccactttggataaagcgccgtagtgatgtactcctccagcttgtcgaccccaggcagcagcgccttgatcggctcggcgacgctgaaccgctccgcccacgcagctagtttcggcgtcctcgccgggtcgatgatcggccccaagccggccaggcggcctgctgcctcaaaccagggaagatagcacccgagcgcgatgtcgaggaacccgatggcgtcaccaccgaagaacggcgcctccgcctccccttcggagcactccgccatgacagcttctaagtgtctgagcccggacagggtctcctccatcttaccggctctctcctcctgcttcgtagtcttgaggatcccggtgcacgaagggaacagctgtggcaacaaagcgagttgagaggtgcaactccaagcgcaacgagaggtaatccgcgtgtgaaatgaactaaccttgtcgttcacataggcggcccagaagcgagcgacggcgcggctgtaggggtctgcggggaggatgggcttgccgttgccggcaaggccgacggcgtcgtcgaggtactccaggatgagcagcgactcgcagacgggcctgccgttgtgaatgaggacgggcaccttcttgtacacggggttggacgcgatgaggaggtcgctcgtggaccagcggtcctcggggaggtagtcgtagctcagcccctttacggcgagcgccatctgggcgcgcagcacgtagggactcaccccgggcgcccaccaccccagcagcttcagctcttcaccgccggccatcaacgtttcctcgtcttcctccctgatactcgtgtcctgtatatctgttgcttaagtgtatatcccgacccggccggc

SEQ ID NO: 18105 - DNA, 987 bp, Triticum aestivum
  Clone ID: PAT_TA_18105
tatacaggacaggagtatcagggaggaagacgaggaaacgttgatggccggcagtgaagagctgaagctgctggggtggtgggcgcccggggtgagccccttcgtgctccgcgcccagatggcgctcgccgtaaaggggctgagctacgagtacctcccggaggaccgcgggtgcaagagcgacctcctcatcgcgtccaaccccgtgtacaagaaggtgcccgtcctcatccacgacggcaggcccgtctgcgagtcgctgctcatcctggagtacctcgacgacgcacccggccttgccggcaacggcacgtcgatcctccccacagacccctacagccgcgccgtcgctcgcttctgggccgcctatgtgaacggcaagttgtttccttcgtgcatcggcatcctcaagacagcgaagcaggaggagagagccggtaaggtggaggagaccctgtccgggctccgacacttggaaggtgtccttgcagagtgctccaaaggggaggcagaggcggaggcgccgttcttcggtggtgacaccatcgggttcctcgacatcgcgctcgggtgctatcttccctggtttgaggcagtaggccgcctggccggcttggggccgctcatcgacccggcgaggacgccgaaactagccgcatgggcggagaggttcagggtcgcggagccggtcaaggcgctgctgcctggggtggacgagctggaggagtacatcactacggtgctttatccaaagtggaacatcgccgtcaccggtaactagttaatgatcgtgtctttccattaccggcggaggatcgtgtcgatccaataattcctctgccttcttagttgttttcaccccaagagttgaactgttgttactagtaggtccttagtgtctcctcctcgtcgatggcacgcaggcgtgcactctcttcgatctgagttgttgacatgttgtttcgtgaataaattgaagcttcatcc

SEQ ID NO: 18106 - DNA, 1061 bp, Triticum aestivum
  Clone ID: PAT_TA_18106
aagaaaactgcagggcaaaaactaaattcagaaggttctcataccaccaggtagccaggaaatacaacctgagacatacagcagacagaatcacaggtaccaataatttccatgtgggcttattgcaagttaataaaaaagggggcttttcctctgtctacgctaagacagatttctcccggtgttgaaattggccttggtttcagtgaccatcttcctaagaatctagttagccttggcctcaatgaccctcctcgcaaataatggcaaacaaaacgatgcggtgtggaactcggaattgtagaacttgagcggcccctttgattttgtggagtattcgtcctcctcgatgctgaagacgggatgctggaaatcaacactaggtccctccgtggagcagagcatgaaacctatcactccgctagggtatgtgggcaccgtagtccatgcgtagttcaccgagcctttgaaaacctggcgacagttggtgacaatgtcctctatgatgtgcatgtgcagccatatgctctccgcctgggtgcagacgaccccgcccggacgcagagccctggagacggactcgaagaacggcttctcgaacagctcctgggcacggcctaccgggtcggaggaatcgacgatcactgcatcataggtgccctctggagcattcttcaggaaggcgacgccgtcgccgatgtgcagggacacgcgagggtcctcgaacccgagggccagacgagggaagaactgctttggacacatcgaccaccattctggtcgatctcgcaagagttcggattctggctccaccgaggagtgccgcgagacctcccgcagaacgccgccgtctccacccccgatgaccaggaccttcttggggtctttgattgagcagagagggaggtgggtgatcatctcctggtaggcgcactcgtccctctccgtcacctggatcaccccatccaggacgagcaccttcccgtaggtggaggactggaaaaccagcacgttttggtagtccgacttgccttgaaacaggaccttctccaccctcgtgc

SEQ ID NO: 18107 - DNA, 1293 bp, Triticum aestivum
  Clone ID: PAT_TA_18107
taagataagataagaaaactgcagggcaaaaaactaaattcagaaggttctcataccaccaggtaaccaggaaatacaacctgaaacatacagcagacagaatcacaggtaccaataatttccatgtgggcttattgcaagttaataaaaaaagggggggcttttcctctgtctacgctcagacagattgctcccagtgttgaaattgaaaccaaaccagttattctagttggccttggttccagtgaccatcttcatgagaatctagttagccttggcctcaatgaccctcctcgcaaatgatggcaaacaaaacgatgcagtgtggaactcagaattgtagaacttgagcggccccttggattttgtggagtattcgtcctcttcaatgctgaagacagggtgctggaaatcaacactaggcccctccgtggagcagagcatgaaacctatcactccgcttgggtatgtgggcaccgtagtccatgcgtagttcaccgagcctttgaaaacctggcgacagttggtgacgatgtcctctatgatgtgcatgtgcagccatatgctctccgcctgggtgcagacgaccccgcccggacgcagagccctggagacggactcaaagaacggcttctcgaacagctcctgggcagggcctactgggtcggaggaatcgacgataaccgcatcgtaggtgccctctggagcattcttcaggaaggcgacgccgtcgccgatgtgcagggagacgcgagggtcctcgaacccgagggccagatgagggaagaactgcttggacacatcgaccaccatcttgtcgatctcgcagatgtcgatctgctccaccgaggagtgccgcgagacctcacgcagaacgccgccgtccccgcccccgatgaccaggaccttcttggggtctttgattgagcagagagggaggtgggtgatcatctcctggtaggcgcactcgtccctctcggtcacctggatcaccccatccaggacgagcaccttcccgtaggtggaggactggaaaaccagcacgtcttggtagtccgacttgccttggaacaggaccttctccaccttgagcgagtgcgcctcgccgggccacatggggctgatctcggagaaccatccggggatgacggcggagatccccgcctgctccccggctccgtccgccgccgcagcgccctcgttctcccgcgccctcttcgccgccgtctcggcctccatcccaaaagcctagagcgcgacgacggcgagacgagctcggcggcggacgcgtgg

SEQ ID NO: 18108 - DNA, 1006 bp, Triticum aestivum
  Clone ID: PAT_TA_18108
gcggggatacacttaagcaatagatatacaggacaggagtatcagggaggaagacgaggaaacgttgatggccggcgctcaagagctgaagctgctgggcgtggtgggcgcccggggttagccccttcgtgctccgcgcacagatggcgctcgccgtaaaggggctgagctacgagtacctcccggaggaccgcgggtgcaagagcgacctcctcatcgcgtccaaccccgtgtacaagaaggtgcccgtcctcatccacgacggcaggcctgtctgcgagtcgctgctcatcctggagtacctcgacgatgccgttggccttgtcggcaacggcaagcccatcctccccacagacccctacagccgcgccgtcgctcgcttctgggccgcctatgtgaacgacaagctgtttccttcgtgcatcggcagcctcaagacaacgaagcaggaggagagagccggtaaggtggaggagaccctgtccgggctccgacacttggaaggtgtcctcgcagagtgctccaaaggggaggtggaggcgccgttctttggtggtgactccatcgggttcctcgacatcgcactcgggtgctatcttccctggtttgaggcagtaggccgtctggccggcttggggccgctcatcgacccggcgaggacgccgaaactagcagcgtgggcggagcggttcagggtcgcggagccggtcaaggcgctgctgcctggtgtggacgagctggaggagtacatcactacggtgctttatccaaagtggaacgtcgcggtcaccggtaactaattaaagatcgtgtcgtcccactagcggcggaggatcgtgtcaatccaataattcctctgccttctgagttgttttcaccccaagagttgaactgttgttactactaggtccttagtgtctcctcgtcatggatggcgcgtatgcgtgcactctcttcgatctgagttgttgacatgtggtttcatgaataaattgaagcttcgtcc

SEQ ID NO: 18109 - DNA, 686 bp, Triticum aestivum
  Clone ID: PAT_TA_18109
gaagaaagaaaagaaagtattccaaagttggagctatctgcacagtactatacatgtcattgtcagacaaagcaatgtgaagtacactctcaataactgtggccatttacttcaaagttggagcttgtcgctctatctttcacaacacagtacatcagcaccgggtttcaacaaccatgcaagcaatagagcaaagcaattgcatagatcatgagttcacatctcacaatagtactcttctaggagcaccaaacggttcatgggaatttaagcacaacaaattacaagcagattgacacaataatgtggaagacttgccggtgttgcaaacttcaagtggcagcaaccgtggagggagggaagagggttatctccacattgtcatgaacaccctgcagaagcatttcaccatcgtaggtgacaactttcctcttcttggcggcccgtaaggtgccaactaatgcttcaaatatgtttgcgcatctgtcgtcattgaagatgacaccaaacttgaccttgtaggagccgtcgggctgctgctggccgagcctctggatctcctccctgagcttcccgacctcctcctcgacgtgcccaaggttcatggcgcctcttctttctttctgtgaatgatgcttggatcttgtcgcagcgggatgcggatttttttcttcttaatatctatc

SEQ ID NO: 18110 - DNA, 1214 bp, Triticum aestivum
  Clone ID: PAT_TA_18110
gccggccggtccggggtcttgtttcctttcagacgatttcatctttgccactcgtgcttataaagaccgcagttcgggccttgccatacatacacttaagcaacagatatacaggacaggagtatcaaggaggaagacgaggaaacgttgatggccggcggtgaagagctgaagctgctggggtggtgggcgcccggggtgagcccctacgtgctccgcgcacagatggcgctcgccgtaaaggggctgagctacgaatacctccccgaggaccgctggtgcaagagcgacctcctcatcgcgtccaaccccgtgtacaagaaggtgcccgtcctcatccacaacggcaagcccatctgcgagtcgctgctcatcgtggagtacctcgacgacgccctcggccttcccggcaacggcaagcccatcctccccgcagacccctacagccgcgccctcgctcgcttctgggccgcctatgcaaacgacaagctgtttccttcgtgcgccggcatcctcaagacagtgaagcaggaggagagagctggtaaggtggaggagaccctgtccgggctccgacacttggaagctatcctggcggagtgctccaaaggggaggtggaggcgccgttcttcggtggtgacgccatcgggttcctcgacatcgcgctcgggtgctatcttccctggtttgaggcagtaggccgcctggccggcttggggccgctcgtcgacccggcgaggacgccgaaactagcggcgtgggcgaagcggttcagggtcgccgagccggtcaaggcgctgctacctggggtggacgagctggaggagtacatcactaaggtgctttatccaaagtggaacatagcggtcaccagtaactaattaaagatctcgtcgttccaccatggcaaaagaaacaaaaaatggcggaggatcgtgtcgatccaataattcctctgccttgtgagtagctgttttcacgccaagatttgaactgttactacttggtcggggttctttttgcgatggttagtgggtcgtggtcatgaataatgcacaagcgtgcactctcttcgatctgagttgtgatgtgctgtttcgtgaataaattgaagcgtcgtcgatcttgcatctggcaatgtttttccattgagctctttaagacctcacatcttattcttagtatgttctaccaagcatattattccggggct

SEQ ID NO: 18111 - DNA, 1570 bp, Triticum aestivum
  Clone ID: PAT_TA_18111
caaggcagggtcttattccaaaatgtaaccatttaatccaaccgtgttctgtccacaaggcagggtcttattccaaaaatccgaacgaactgccatgacaggaactgtcacccctgcccccctaaacgcagtaaaaacatgtcttacattttgatacagaggaagcataagataagaaaggaaaactgcagggcaaaagactaaattcagaaggttctcataccaccaggtagccaggaaatacaagctgagacatacagcagacagaatcacaggtaccaataatttccatgtgggcttattgcaagttaataaaaaagggggcttttcctctgtctacgctaagacagatttctcccagtgttgaaattgaaaccaaaccagctcttctagttggccttggtttcagtgaccatcttcataagaatctagttagccttggcctcaatgaccctcctcgcaaatgatggcaaacaaaacgatgcggtgtggaactcggaattgtagaacttgagcggcccctttgattttgtggagtattcgtcctcctcgatgctgaagacgggatgctggaaatcaacactaggtccctccgtggagcagagcatgaaacctatcactccgcttgggtatgtgggcaccgtagtccatgcgtagttcaccgagcctttgaaaacctggcgacagttggtgacaatgtcttctatgatgtgcatgtgcagccatatgctctccgcctgggtgcagacgaccccgcccggacgcagagccctggagacggactggaagaacggcttctcgaacagctcctgagcaggacctactggatcggaggaatcgactatcactgcatcgtaggtgccctctggagcattcttcaggaggcgacgccgtcgccgatgtgcagggacacgcgagggtcctcgaacccgagggccagatgagggaagaactgcttcgacacatcgaccaccatcttgtcgatctcgcagatgtcgatctgctccaccgaggagtgccgcgagacctcacgcagaacgccgccgtctccacccccgatgaccaggaccttcttggggtctttgattgagcagagagggaggtgggtgatcatctcctggtaggcgcactcatccctctccgtcacctggatcaccccatccaggacgagcaccttcccgtaggtggaggactggaaaaccagcacgttttggtagtccgacttgccttggaacaggaccttctccaccttgagcgagtgcgcctcaccgggccacatggggctgatctcggagaaccacccggggatgacggcggagatccccgcctgctccccggctccgtccgccgccgcagcgccctcgccctcccgcgccctcttcgccgccgtctcggcctccatcccaaaagcctagagcgcgacgacggcgagacgagctcggcggcttgggtggatttcgtcggcggcggcggcggctaggtgtaagctagggagggatgtcagcctcggccttgaggttttattccttgggatgtgtgggcggcggctttagggtcgacgcggccgcga

SEQ ID NO: 18112 - DNA, 771 bp, Triticum aestivum
  Clone ID: PAT_TA_18112
ttttttttttttaccaaaacaacttagttatatagtctacacacaactgcacatacactgtatagctctctcacaatttatataacatggtgtgaagaaagaaaagaaagtactccaaagttggagctatgtgcacagtactatagatgtcattgtcagacaagcaatgtgaagtacactctcaataacacagtggccatttacttcaaagttggagcttgtcgctctatctttcacaacacagtacatcagcactgagtttcaacaaccatgcaagcaatagagcaaagcaattgcatagatcatgagttcacatctcacaatagtactcttctgagcaccaaacagttcatgggaatttaagcacaacaaattacaagcagattgacacaataatgtgggagacttgccggtgttgcaaacttcaagtggcagcaaccgtggggggagggaacagggttatctccacattgtcatgaacaccctgcagaagcatttcaccgtcgtaggtgacaactttcctcttcttggcggcccgcaaggtgccaactaatgcttcaaatatgtttgcgcatcggtcgtcgttgaagatgacaccaaacttgaccttgtaggagccgtcgggctgctgctggccgagcctctggatctcctcccggagcttcccgacctcctcctcgacgtgcccaaggttcatggcgccgcttctttctttctgtgatgcttcttggatcttggcgccgcggcgggatgcttattgatggggaattt

SEQ ID NO: 18113 - DNA, 1973 bp, Triticum aestivum
  Clone ID: PAT_TA_18113
agccacactatgccatacttctcacaaaacaaacacgtccatgagttacactgcattcaagcactatcgtcggtctgaccacgctttggcatatacttggataagacggggacaagtaacaccccatataatggcaaccatgccttataccaaaagattaaggtaccaattatagcagtacaacagacatccacggccttaaaatataggccggatcagatagaaagcctcaaaataatacagggagaacaagccgaaccattaagtggttaagtgttgctttccgtaccatcgccgaatttggtctagttgaagtcgggcttctcagggtaagtgcagccagactgctggatgataacgtttgctgcgtagcaaccggcctttacgcagtcctcgatgctcttcccttgaaccaactgagagaggaagcctccaacaaacgcatcaccagcgccattggtgtcaacaagcttctccttgggcaataggatcacagggaatgttttcaccttcccatcctcagccacaactactggatcagcaccctgagtaatcacagcaatcctcttttgtttcccagaagccagaggcagttgtgagatcttcaaagcgatctcctcgacattctcagtctcccacccacggactttagagaagatccttgcctcagtttcatttccaaagatgtagtccgcatacggaagaaccttctcttgggcatcacggaaaaactcacagataaagggagcggagaggttcatcaagaaaaccttgttacttgcagcagcatgctcagcaacaagctgaatagattcaggggacaccgtaaggaaaaagccagcaatgtagatgtattttgctttctcaactaggtgcccagttctctggcttctttagatgctcagatttgtagcagttcgctgcagataagtttgcaatcaatgacctttcaccaccaacaacacagacagcacatgtgcctgtaggagcagcctcatcctcatagtagtgagcagtgactcctgcagctttagcggcactcttcatctcctcaccatacttgtcctttccaatgcaacccatgtaacttgttgcaccaggagtttgaagcatccattgggcaaccctgatagagttctgcgtggctcctccagcaatatattcaacattgcccttgctggacaactcatcatacatgggcaagtgcttgtcctcggcgagaatggcattgttcagcttgacatcatacttagcgaggaaggcctcgtcgacgacggcggagatgtcgagaagggggttgcccatccccaggagcacaccctcgaggccgttgctcgccgccattctcttgctcctctcgacgatggctgcgcaaggaggcgagagcgagatctgaggtctgcgttggcgactggcgagaggttggttccagtggtgtggtggtggtctcgaaaatggcggcgggctcggaggcggcatcagccatggactcggtggtggcatcggaaagggtgggggtctcggtggcggctttggcaaaggtgctggactaggcggcggctttggcggtggaggcggcggaggtggtggtggcggtggtggcggcggttttggcggaggctttggcaagggaggtgggtttggtttcgggatcggcaaaggtggcggtggcgggatcggcggcggccactgatgttgtagtatgtacgtttggctcagctctgttctgctgagcgccgttggtcatcatagtattctgtcgatgtgagcagtacgtgtgatgaaagagattttcccttgtagaaactcaccaccagcattttcgtgtgtctcgttctgctctctgtgggagagatattctcgcgcatgtacgttggtgatggtaatatatgagtatcttgtatgccttggtccatgccagtgtttgctccagtgatttgaaatttaaattaggtacaagtaaaaaaaaaaaa

SEQ ID NO: 18114 - DNA, 1517 bp, Triticum aestivum
  unsure (1)..(1517): unsure at all n locations
  Clone ID: PAT_TA_18114
ctcacaaaacaaacacgtccatagaattccactgcattcaagcactatcgtggtctgaccacgcttccgcatatacttggataagacggccacaagtaacaccccatataatggcaaccatgccttataccaaagataaaaggtaccaattatagcagtacaacagatatccacggccttaaaatataggccggatcagatggaaagcctcaaaataatacagggagaacaagccgaaccattaagtggttaagtgttgctttccgtaccatcgccgaatttggttggtctagttgaagtcaggcttctcagggtaagtgcagccagactgctggatgataacgtttgctgcgtagcaaccggcctttacgcagtcctcgatgctcttcccttgcaccaactgagagaggaagcctccaacaaacgcatcaccagcgccattggtgtcaacaagcttctccttgggcaataggatgacagggaatgttttcaccttcccatcctcggccacaactactggatcagcaccctgagtaatcacagcaatcctcttttgttttccagaagccagaggcagttgtgagatcttcaaagcgatctcctcgacattctcagtctcccaccctcggactttagagaagatccttgcctcagtttcatttccaaagatatagtccgcatacggaagaaccttctcttgggcatcacggaaaaactcgcagataaagggagcggagaggttcatcaagaaaacctttaccttgttattggcagcagcatgctcagcaacaagctgaatagattcaggggacaccgtaaggaaaaagccagcaatgtagatgtattttgctttctcaactagtgcccagttctctggcttctttagatgctcagatttgtagcagttcgcagcagataagtttgcaatcaatgacctttcgccaccaacaacacatacagcacatgtgcctgtaggagcagcctcatcctcatagtaatgagcagtaactcctgcagctttagcggcgctcttcatctcctcaccatacttgtcctttccaatgcaacccatgtaacttgttgcaccaggagtttgaagcatccattgggcaaccctgatagagttctgcgtggctcctccagcaatgtattcaacattttccttgctggacaactcatcgtacatgggcaagtgcttgtcctcggcgagaatggcattgttcggcttgacatcatacttagcgaggaaggcctcgtcgacgacggcggagatgtcgagaagggggttgcccatccccaggagcacaccctcgaggttgctcgccgccattttcttgctcctctcgacgacggctgcgcaaggaggcgagagcgagatctgaggtctgcgttggcgactggcgagaagtccctcgtgccgaattcctgcagcccgggggatccactagttctagagcggccgccaccgcggtggagctccagcttttgttccctttagtgagggttaataaggntgc

SEQ ID NO: 18115 - DNA, 1643 bp, Triticum aestivum
  Clone ID: PAT_TA_18115
gtcataagggaaacaaacctagcacagcgaactatatatagttggaacctgtccttgtagcaggcagcaggggcttcttggtctgaacacgcagtttgtcacaaggagcaacttacattcgcactgcactatttctagccacgacaggcaaataatgcccttggttcactgacagacataccattagccacactatgccatacttctcacaaaacaaacacgtccataaaattccactgccttcaagcactatcgtcggtctgaccacgcttcggcatatacttggataagacggccacaagtaacaccccatataatggcaaccatgccttataccaaagataaaggtaccgattatagcagtacaacagatatccacggccgaaaattaggccggatcagatggaaagcctcaaaataatacagggagaacaagccgaaccatcaagcggttaagtgttgctttccgtagaatcgctgaatttggtctagttgaagtcaggcttctcagggtaagtgcagccagattgctggatgataacgtttgctgcgtagcaaccggcctttacgcagtcctcgatgctcttcccttgaaccaactgagagaggaagccgccaacaaacgcatcaccagcgccattggtgtcaacaagcttctccttgggcaataggatcacagggaatgtttttaccttcccatcctcagccacaactactggatcagcaccctgagtaatcacagcaatcctcttttgttttccagaagccagaggcagttgtgagatcttcaaagcgacctcctcgacattctcagtctcccaccctcggactttagagaagatccttgcctcggtttcatttccaaagatgtagtcagaatacggaagaaccttctcttgggcatcacggaaaaactcacagataaagggagcggagaggttcatcaagaaaaccttgttatttgcagcagcatgctcagcaacaagctgaatagattcaggggacaccgtaaggaaaaagccagcaatgtagatgtatttcgctttctcaactagtgcccagttctctggcctctttagatgctcagatttgtagcagttcgcagcagataagtttgcaatcaatgacctttcgccaccaacaacacagacagcacatgtgcctgtaggagcagcctcatcctcatagtaatgagcagtaactcctgcagctttagcggcgctcttcatctcctcaccatacttgtcctttccaatgcaacccatgtaacttgttgcaccaggagtttgaagcatccattgggcaaccctgatagagttctgcgtggctcctccagcaatatattcaacattgtccttgctggacaactcatcgtacatgggcaagtgcttgtcctcggcaagaatggcattgttcggcttcacatcatacttagcgaggaaggcctcgtcgacgacggcggagatgtcgagaagggggtttcccatccccaggagcacaccctcgaggttgctcgccgccattttcttgctgctctcgacgacggctgcgcaaggaggcgagagcgagatctgaggtctgttggcaaatggcgagaggttcgttcgagtggtgtggtccggacgcgtgggcggacgcgtggg

SEQ ID NO: 18116 - DNA, 602 bp, Triticum aestivum
  Clone ID: PAT_TA_18116
gccggccggttctcagatagaccattctgaatcaacacatttcctccttgccccacacccagcgagcgacgatccgtcgggcactcgggctagctcctgttggcggcgatggcgatccacctgctggcgttcatggcggccaagggtttcgtgcaggtgttccaggtctcggcgccgctgctgtggccgctcaacctctggctgccgctcccgcgcaacctgccggaggtctgcgtcgtcgtctgcggcgcgctcgcctcccacgtcgcctggctgcgccgcgcgtacgcccgccgccgctccataagccgcgacgataacgacaacgagctgcaccgccaggcgctcgtcgacgccgcgtactgagatgctggagcagaagcaggacggtttttccttttcattttgatttgtaggtttcttgttcacgggctgcatgctcgatccttgcagtattcccgagcgtcccgtgacatgtgtatgttggctgtaagttgtagtaacattcaatctgtagatacgagtaaattctagtactaaaaccgacggattctgtcgtgattattcgctttgggcaaaaaaaaaaaaaaaaaaggccccta

SEQ ID NO: 18117 - DNA, 1087 bp, Triticum aestivum
  Clone ID: PAT_TA_18117
accggcggcagcgacgttttttttgttggaagcagggatattttgcgttggaacctgcatgcgtttctgctggtactagcaaatcaatggagttctctgttttttggctgggattttttggcaggcgaacatggtggtctgagcagacggcggcgacgagtcgtttttggtgctgggaccggcggtgaggtgcagcgactaatcccgttgaggagcgcggtgctaccaccggcgaggagcggcgtcgcggaggcggactggcccgtagatttggtcaacaaacgcgagattcaggagaaaggggaaggacgcaaggtgtgctgggtatcggggcgaaatctgacggccgcacagctcgcatcatacggctaggatgcgaccggcccaaagtttgggccggcgcgccggcgcctatcatcacccatataaaaaggtcgttcccgctcgcacccggggaaggccgcaacctcccgccccgccccacccagccaccggcagaagcacgccaccacggcagcgacacagcaccattctgaatcgacacatttcctcctttgccgcagcagcacgcacacccagcgagcgacgatccgttgagctactagcttcttggcggcggcgatggcgatccacctgctggcgttcatggcggccaagggcttcgtgcaggtgttccaggtctcggcgccgctgctgtggccgctcaacctctggctgcccctcccgcgcaacctgccggaggtctgcgtcgtcgtctgcagcgcgctcgccgcccacgtcgcctggctgcgccgcgcgtacgcccgccacggctcccgaagccgcgacgacgacgacaacgagctccaccgccaggcgctcgtcgacgccgccgcgtactgagatgatgctggagcaggacggtttttcctttttcattttgatgatttgtaggtctcttgttctcgggctgcgtgttagatcattgtagaattccggagcgtcccgtgatcataagtgttagtaacattcaatctgtagatacgggtaaattctgctagatccgacggattttgtcgtgattattcgctgtctgaaaaaaaaaaaa

SEQ ID NO: 18118 - DNA, 1724 bp, Triticum aestivum
  Clone ID: PAT_TA_18118
tcgcggcgccggcccgttggaaatggccaattccggtcgacctctgctggctctgcctcccctcctcctctgcctccccccgccccccgcacccccggcggcgccggccccccccggcagaccagacggcacggggctctggggactcgtcgaaacgcgacgaagggcccagcggttctgggggtactccaagagcccgcagagggtgtcgacaagatgcaggccatggccgaccggcctctcgctacagggcggtcctggggcgtcgggggtgggcgtcggcagcttcatggtggtcgggcccctcgacgccaacctgaagcctcggaactcgacgtggctgcagacggccggccccctctgcgtggacacccccctggggccccggtgccgtcgccgtcagcacgccacgcgcctggtgtcgactgcctggcaggcggccacggacgccaccacgctgctcaagccgctcgccaaggagctgcccaccccgccgcgggcgggccccccctgccgaggcgccgggtcctcccccgggacctcgagtggcacgagctgtccgatcccgtctacaacgcgctggtcaacgacttcatgaagccacggatcgacgaggttgacgagctgctgtcttacggtgtagatgtcacggtttataatggccagctcgacgtgatttgctcgaccaagggcgcggaggcatgggtgcgaaagctcaaatgggacgggctgagacggtgaaggagcctgccgcggccgggcggctggccgacttcatccaaggtcacccgggccttcgtcaggtcctacaagaacctgcatttctactggatcctcggcgctggccacttcgtgcctgccgaccagccttgcattgcgctgagcatgatcgctggcataacccactctcgagccggagcgcggaggaggaggacccggatcagaacctcggcggcagccaggaggaagccggctccaacaccaccaacaccctcggcggcatcatgaacggggtcgtcaaggagaagctcaagatcatccccaaagatcacgagtggcacgagctgtcggaccccgtctacaacgcgctggtcaacgacttcatgaagccacggatcgacgaggtcgacgagctgctgtcttacggcgtagatgtcacggtttataatggccagctggatgtgatttgctcgaccaagggcgcggaagcatgggtgcaaaagctcaaatgggatgggctgaagaacttcctgagcctgccgaggcagcctctgtcctgcggatcatccaaggtcaccaaggccttcgtcagatcctacaagaacctgcatttctactggatcctcggcgccggccacttcgtgccggccgaccagccttgcatggcactgagcatgatcgctggcataacccagtctccagccagctaggggaggaggacccggagcagatcctgtctgccggataggaaaaggaaactgaagatagaagtatagaaagaaaggttgcgtgtactttaaagggcgatgaaattgattgtaaggtgcgttggtgtgtgagtggggttaaagctcgtccgttttattctccgaataaagatgacgccttttagatcttctttcacagttttagtgaaaaaattatgtttcctttttttatagatatttgtaaaattgcgaaaaaaaaaaacctcggccgcgaccacgctaatcactagtgaattc

SEQ ID NO: 18119 - DNA, 984 bp, Triticum aestivum
  Clone ID: PAT_TA_18119
gcatcccttctgtgatataacgctggatacttggcacatgcgccaggatcagaaatttggccgattggcagttatgcctctgaatgctagcgttaagtgtagcgccggctcaagacatttcatcgagcacttgattgtttttcttcccacatctatgcagtttcatttgctccttttcatatcaccgtgacagtaatacgctataatgaggacatcttccaagagaagaatatgccacacatgcattatgttaaataaaatacaattataagcgagtaaacttatcaaataggaaaaaaactgttttgttgattttgatcggttaattacatttattaacagaatatcaatagaaatgttgtcatggtggagcacacttacaacacatggactttctcaacctagcccgtgttcatggtcgattagcttcagcagctgctacccgcttggctttcttgctcgtagcttgtcgtgcgtcgcgtccgtcagccctgttgcggggacctaagaagcacggacacggggacggaaagacggggatacgcatacggggatacgggatacggcattttccaaaaacagccattcggggatacggcgaggtatataaatattaaaaaaaaaaaatcccaaggaatttcaagcaagacagatgattaatgagttagtgaccatttttgagtactgggcctcttttggcgcctctcttttcatgtgaggctgggtgcagcctcctccccccccgtcttgctctccgtccacgctgcgcccatcttaggccctctcccgccgttcccccccctggtggcgctccagctcccccccccgccgcgcaccggccctcagccccgccctgccggcggcttccccccccctcccgccccccgcccttagcctcttccgcgctggccgcctcactccccacgcaaacagcggcgagttcgttcaaacttaaacatattttacaaaaaaaaaaaaaaaaaa

SEQ ID NO: 18120 - DNA, 1439 bp, Triticum aestivum
  Clone ID: PAT_TA_18120
ttttttttttttacccaagcaaaaaagcccttcttgctttgctcactaggagagggcgagaggccaccatgcctgcctgcctgcctgcccaacgtacaacagcgcgaggcccccgtcaaggaggaagaaaatgagatcccaccccacaccagaccacaccaaacctcacctcacatcaccacacatgttgacatgtacaacaccacgccgcaaaagccagggcaaaacgccctaagcatcaccagatcttcgcaatcgtgcgaatgcagtcggttggagatcactcgacggcgacgccagaggccgagccggcaggtcggttgcttgtccgggtgttcagcagcggggccagagtcttgacgacgatgctcatgtttggccggaaatctgcctcgtattgcacgcacagggcagccactgcagccatcttggcgacagcctttggagggtaatccacaccaagctttggatctacacattgccgcaccttgtcttcacttagccttggtgtagcccatgtcacaaggctctgctggccacggggaagtgtatgatcaactggtttgcggccagttaaaagctccaacaacaccactccaaagctatatacatcgctctttgcgcttagctgcccagtcattgcatactcaggagcatgataaccaaaggtgccaagaacacgtgtagaatgaaggcgtgcagccatgtcaggggcctgattagacacatcgaaatctcctatttttgcaacatcgttgtcaaagagcagtatgttgctggacttgatatcacggtggacgacaggtggctctgccttctcgtggaggaattcgagccctcttgcggcgcttacagcgatcctcgcccgctgcatccaggataggactggtcctggttgggatcccttgacgccctttttaccatggagaacatcatgcaaggagccccttgttgcatactcataagcaagaatacgggtgctccctaaagcacagtacccgagaagttggatcacattgtcatgcttgagtcttgaaacagccgagacctgcacaaggaattcttggtcaggctgtttgctggagtcaagcctcttcactgcagatttcttgccatccttcagtacaccaaggaaaactcttgcgtatgaaccctctcctataagagcatcactgctgaagttcttggttatttccttaatttcgtctaggggaatggctggtacttcaattggctggcttctactggtacggatggcatgggttggcgctggcccccggttataaccatagttaccccctggggcagggaccggaacataaggatcatcgcgcttctttttcttgccaacatcatcggctccgcagcaggaaaagcaccccatcgcttcctttcccctcctcccgttctaccgtgatctaatcggaagttccacggag

SEQ ID NO: 18121 - DNA, 610 bp, Triticum aestivum
  unsure (1)..(610): unsure at all n locations
  Clone ID: PAT_TA_18121
ttttnnnnttgggcatacaaaaccaaatcatactccatggtatgttgaggtctggttgtattgctcacagctactcaatctctctaggcctgctaccaagatcgcgatgcgaatacttcccagaatcgatttgctgtaccaggaccaaaatgttggtcacattaggtttctccgccggcttcttcttcttgccatcctttcgcgcctggttcccgacgtctaccgcttgagcgatggacgtaagaaaacctctaacgttggcctcttcatgcattttcttctcatcaaaggcatcgcctaaactgagtacacctccaacgacctcggcaacattaacgctaagaacacctttgaggatcgccactgtactaccaaacacctccaagagtactgcccaccctttattggtaactgtgtccttgagcataactcccgaaacatagtcgaaccatttgtcattagaaaagggtaggaaaaatttgctaatgcgaatataggtcgtgccctctgcagcccattggtagcgcttcggccatggtggttgtccttttgttttagcaatggcatgctcaaaagtgtttgatcccgacttggtgccgacccggccggc

SEQ ID NO: 18122 - DNA, 750 bp, Triticum aestivum
  Clone ID: PAT_TA_18122
ggttgttacagcctgaaaaagatttgagaaaccccatgagtacagatgtaacgtacaacaaatcaggtgtgctctgaaaatgtactgtaggtattaacatgcgaatatcagaaaaatggagagctgaatagcatattcgcttttttttttttttttccccaatttttctccagtgcggttgctaatggagatgttacggaaacaaccgcgctcgtttaggaaccgtgcctcgtcgccgttcgtgcagagattcgtcggtggaatttttcttttccagccgccgccgctgctgaaggtcagggccgtgcaccgaccagagggcttgcacgcgcgtgggggtgcaaggccgggtcgggcaccgctggacgcatgggccgttggccgcgtcccatccatccgcgcttgatgtagccgccagattgcgtcgcgcgccgaagggcgctgcagaccgccgacttccgcgccgcacctgagagagagggcgtagtcgccattcgctgactgtgatgccgggccatgcgctgcgcttcgagaggaggccatggccgctccttgacgcctcgcgcccgatggcttcgccgtttgccacgtcgcgccggagggcgccgccgtaggaggtccaggatgcgccgttattcttctcttcttcttcactaggtggcccgtgctcccggtagaggcgtgcgctgataacgtgttttgagtgaaaagtaaagagcaagggagaagaatgcccagaacccggccggc

SEQ ID NO: 18123 - DNA, 743 bp, Triticum aestivum
  unsure (1)..(743): unsure at all n locations
  Clone ID: PAT_TA_18123
atccaacgggaaaacattcgttcatgcaaaaacgaaaataacgggaaaacatttgttgacgcaaaaaggaaaacaacgggaaaaacattgggagtaactattgctatacatgtagacatcgcggcgtgtcgccctgcctttgagtgaggagatcgagatgtttcggtcctccttcagcccttcagcgatcaagggagataaagacgtgtgtggcactacttctcgccaaccgttccaccacgccgttggtaacgtcggggtgcggcacagcgggcaagtgccagcctcgccgctgccgatccaataaccgatgcaggcgccgtggaacgcatgcgagcagttgcacaactccgtgaccagttgccctcccacgtcgagcgccgccaagcaaatggcgcagatgcccacgcacccgtcgtcgtcctcggctccctcgacatccgccggcgcaacccgccgtcgtctgtactgtggcgccgtccacgaggacgaacgattcaccttcggcggcgagctggactgccagaacgctgcctccatgaggcgctccatcagcgcagtgtcaacgagctcgctccaaggctcaccgggcagcatctcgccttcgaacgagacgatgccgaggcggtccaggacgaccgccgcgacgaagcggacgcagtcgaggaggtggtgcagggccaagagataccgtcgcagcacaagatcgtagccgtggcaggaatgggccatggtggttaanc

SEQ ID NO: 18124 - DNA, 777 bp, Triticum aestivum
  Clone ID: PAT_TA_18124
gtataactacattcataaactttacaaatacatgtagcagaaataaattcctactattttccttgaagaagaagaagtttgatgtaggataaattagacctaaaattaatttggaaaaaaaatactacccccggcatatggcaaaataacaagctatcatgatcgctcgacttattaccagtgtggtgcatatgcctcgctagttatttccaacaaattgtgtagtactactgcacatcgcgaattacaagagcaaggtaagcaagcctcaacttttgagcacaccggcagacgccgtctgcacagccctggcgtctcttcggtcgggcgacgctgccggcgagcagaaggccggcgttgccaccgtcgacgtgcccttctccgtggcctcctctatcgtggacaggcacctggtgggcccaccgaacatcttcttccacctctcgagctcgccctcgcccggctcgtcatccgcctcctcgccgccgcgggccgcccgctgccggctcctggccagggacgtcgtccggacgaaccggccctgggtgccgtcctggcaacagacgccgaacaggacgaagccgcggccggacgccacgccctcgcgggtcgagccaccgcctccggacaaggacgacgacgagcaggacgagcaacacgacgaagattgcgcctgtcaacgcggcggcgagcaccaggccggcgtcgtccatgatttctgcctcctccctcggcagagataagtcgaagagcgagctgtgcaagaatgtgcactgc

SEQ ID NO: 18125 - DNA, 1937 bp, Triticum aestivum
  Clone ID: PAT_TA_18125
atccaatactaaaacgtgacttgatacgtccatatacaagacatttagttcttagtaaatgaatattacttcatacaaaatattcttgattgctggttcagtgctaccgcaagatagctacggctagtcgttcttacaaaacccttatacgttacgagtaatttacagatggtagctagcctgactcagatctcaaagtcacaactcactagtttatttgctacgacatcagcacgccagcagatcatgccttattacgccaacaagctcggcgatcagaggctctgaagcacgtcgcgcatggccgggcgcggcctgcacacggcctcgagcggcacgaccttggggatggtgagccctccgccctccgctcatgtccacctccgcgccgtccacgcgctcccagtcgaagcactgcaccagcgtggccagcaccatgccaatggtccgcagcgccagcgtctctcccggggcaccgccgccggcccatcccgaacgggatcatgaaccgcccctcggcctttccgttctcggaaccgctcgcgggacgaactccagcgggcgctcccacgccgccgggtcccggtggatggcgtacgcgttcaccatcagcatcgtgccgctcggcacgttgtagccgcccaccttgcagtctgccgaggactcgtgcggcagcagcatcggcgccgccgggtacagccgcagcgtctcgctcacgatgcactgcaggtaggccagccgtggcacgtcgtcggcggtcaccagccgggaggtgcccacggccgcgtcgatctcggcctgcgcctttttgagcgccgccgggtggttcagcagcagcgacatcgcccactccgtcgtcgtcgacgtggtctccgttccggccccaaataaattcgcgcagagagccgtgatcatggtatcggcgtacacctccggctccgtcttctgcagattgaggagcacggcgatcatgctcttcttgtcgccttcggtgccagcctggtcgagcctccggcgctcgttgtcgatgagacgcagcatgaaggcgtccctcctgctcacggcggccaggatcttgttcctcacgccgaacacgtcgaaccaccgcaacaccggcaggtaatcccacgtgttggcggcgccgaggtaggggatgagctcgtccaccaccttcttgaactcctgggcctccacggacatgtccgtgtcggcgtcggcctccgaccgggtcccccttggtctgggcgatggtctccatgagcacgctgagggagagctcgaagagcctccgcttcagctggacccgcgcggcgccgtcgccgggggccgccgcggcggcgcggaacagccggcgcgccatggcgcgcacctcgccggcgatgacgccggacatgcaggcgacgcggtgcgcggagagcagctgcacggcggcgacgcggcggaggttgcgccagtgcgggccgtagctggacgtggcgagcgcggcgccgtcgaaggacacgagcagctgcgaggggaaccggggccggttggcgaacgtcacgtcgtgctccgtgaagcactccctggcgcactccgccgaggacaccaccacggcgcggcgcgagccgagccgcagcgagaagaccgggccgaggcgcgcggcgaggcggcgcagcgcggcgtggaacggcttctccaggaggtggaggtggccgaggaacgggatggccggggggctcggcggcagctgcacggcgcccttgccgcgcctgccattgctgaccttgcctagaatgtagtggagcaggaagaggaaggcgatggtgaggatggcaatgtacgccttatccattgctaaccgtggtccgggggaggtgatgtgtctcgagtcgtgacacttgaggtctcgggttgattggatgtgtgtgttgtgtgtggcagtcccggcccggccg

SEQ ID NO: 18126 - DNA, 575 bp, Triticum aestivum
  Clone ID: PAT_TA_18126
gcaagaacagatttctagatatgccaatacaacttgacaccaacagtttcgaaacagcgagacaaatgtgacggacaaacctgggaacattgactatggcagcacataaacttcgtgcaacaacaggtttctaaatatgccagtaccacttgacaccaacagtttcaaaacagagcgacaaatgtgatcgataaacctggtaacattgtacatgcacgcgatctccaaatgcgttgagtaccagttagtgggtattttgggtgctcctgcagtgtcaattcagcctacactcttgcacaattagggataaggataatatctgagatcagataacggtcatgttatcgtccttcttggatgttttctttctcttcttcccggtgcaaggctcttttcctttcaggttttgagaaaatgttcgcagctggcccataagatgctcatttctgtgcgcggggaggataacatcgtccatcctaatggatttacgactagcatgctgtgcaaacagctcaacatccttagccagttgctctgcgctcttgaaggccaagtcggcgatgcaggcgacgacg

SEQ ID NO: 18127 - DNA, 1835 bp, Triticum aestivum
  Clone ID: PAT_TA_18127
ttttttttttttttttttttttttttttttaagtaccagtacaataattggctcaagtggcctgtatgacacatatatattattatcgggtcaggctgctacatttgtgatcaatatcaagtgttaaagaatggattatatagcccacggccaaccaaagaacattactactttacaaacgagagggaaggggaaggaaaaaattgtagcagggttgacaccacatcaaaccaaaaaacttaatggctggcctatttcgaacacaggaatttcacaggcaatcgccgaaatcccgtaggaacatacaggggccgtgtatggagcgattaccgcgtggtatccccgggcttcggcaggggggggtatcgggctgtctagccgtgggcgtcgtcacgttggcctgggcccccctggtccctgtccccgtctcttcccctgcttcgtcctgcggccgctgcctcgagcacttctcggacaaatgcacaaacaccagatagaatagaaggctgactcgggcaacaggatgccgccacaaaaatcttgtcgccctcacagcccctgaatctaaaaacttcgcagctttttgtaactgatgatttgccgttgccatgtgtcgatgatgcagtggaagaggctctagcgcattgatatcagtatcttcttcccatgatgatgctgatctgcgagaaaccctactcctttctgcttctacctgcacttcatggaattgcttcaatgatttctccagttggaactctaatgcacctttttcactggccatggattctaattgtgtttgcttgtggtacagcaaatcagtgagctcccggtatcttttctctagctcaacatgctcctgtctagaataatgctctgcgtctcgtctcattccggccatttcaactctcatcttctgcaactcagcctccaaggataatatcttgctttctgcctctctttggctttgccgtgctcgctcaacttcctcctgccatgcctgtatctgaagagcttgattagcatcttcagaaggctttttctgagcacggcgattacgagcttccatttcctgtagttcttggtgcagtgatgcacattcaacctcaagtacagctactttgtgctcgaattccattgctctcgatgagctttgatcagcagctctctggattctagcaagagcgttcgatgcctcgacagcccggtgctccaattctacttctctgtcaacagctgccatctttgtagcgttatgtgcaatacgctcctcttcagccctccgctccacggttgaaagttcctctcgtagagcctggatgatcctggtttcagtaagctcacggttcctcttaaggccatccatatcttcctgtaaagatgccagcatttcttctgaagctgctgcttttttcttccaagagtccaacgatttagctagagattcaatctcagtgttttttgcagccaaagcatcaaccatgttagattcaactcgtgaaccttgtactctggacaccgatagttcttgctgtagttgctttatatgagcttcatgtgagctacatttctctctctcctgaacaagaagctcttctagctgtgcattctcggatttatattcttggagacgggatgaaagtccagcacagacccgagctaatctagcttcttttgactggccagtttttgcagcgctttttagtaatccctgagcctcctcaagttggtcttgatccttcagaggaactgaatcagacttatgttcctgttgattttgtgcgatttctggtggatctgacaaatttctttcttcaatcttgggatatgccagaacc

SEQ ID NO: 18128 - DNA, 801 bp, Triticum aestivum
  Clone ID: PAT_TA_18128
ctttttggtttccaacagcctggaggtaagacattgcaattttccttcacatttttcattattcactctggtcatcttattaaaagtatattaacttctttccttcaatcttctttccgggctacagctgcatatggacaggtttgtattttttcaagtcgtcccaattctgcactgtgttagtttttactgcttcattctgtgctttgctaaacgatatcattatctcacataaagcatctgcttttgctgctacgatgtttttatatctgatggggcaggctgcagtgattgctgctgcatttggcggaacattgcctcctggagtgactggtaccaatgatcgctgcacacttatagttagcaacttgaacagtgataaagtcgatgcggataagctcttcaatctattttctatttatggaaatatagtgagaatcaaggtactccgcaacaagccagaccatgcccttgtccagatggctgatgggcttcaggctgagcttgctatacactatttaaagggagcaatgttacttgggcagaaactggaagtgaacttctctaagtacccgagcattacccctgctcctgatgcacatgactactcaacctccaatcttaaccggttcaacagtaatgtggctaaaaactaccgccattgctgtgcttcaaccaagaacatccacatctcaacgctttcacccaaaaaatccgaggacacgaaccttgaacacctaggtgagcatggcaccatcgtcaagtcaaaactgtttgagggcaagtggcaagacgcaggct

SEQ ID NO: 18129 - DNA, 558 bp, Triticum aestivum
  Clone ID: PAT_TA_18129
ggccaggaagatggacgccagcaagctgaagaaggtggccgggaagaagttcggcgggccgaggaagaagtcggtgaccaggtccgtcaaggccggcctccagttccccgtcggccgcattgggcgcttcctcaagaagggccgctacgcccagcgcgtcggctccggcgcccccgtctacctcgccgccgtcctcgagtacctcgccgccgaggtgctggagctggccgggaacgccgccaaggacaacaagaagacccgcatcgtgcccaggcacctgctgctggccatccgcaacgaccaggagctcgggaggctgctgtccggcgtcaccatcgcccacggcggcgtcatccccaagaaggccaccaagtcccccaagaaggccaccaaggcctagatcgtagtagtgcggtgtgctgatggttccagtgtggttagatgtagaagctgtttcactctgtatcctgcgcccctgatgtaatcggaatcaaaggggaagccgcttgcttcctcttgactaatgaattatcaactaagcgtttctgaaaaaaaaaa

SEQ ID NO: 18130 - DNA, 741 bp, Triticum aestivum
  unsure (1)..(741): unsure at all n locations
  Clone ID: PAT_TA_18130
aattagagtgctcaaagcaagccatcgctctggatacattagcatgggataacatcataggattccggtcctattgtgttggccttcgggatcaacataggcaggcattgagctcaatgcgactctccagaatgctcagcacatatgtgagtaccttgagcagaacactatccttgctgttgagtacctacagtccattgggacatatccatatgacccaaagccaggttttactgatgatgaagacaactgttcagtggaccccgagcccgtgccaccagagcatccaccctacatgagaagttgtttggatgatgaggagatctttgatagtgaaggcaattgctctacagactacgacactttgctcaaggagcactactgatacaacatcaccaacatgccagcgtgattctcttgaggatcgctcggtggtatcagcttgctatcttttactacgtggtatatgcatcttacatctgcgctacgaccgttgctctcctatgtagtaccctactgaacttattttctatgtaaactatgtggcatgtgctgcactactctactctattatgcactaccccagcccactgaacttatttatgtaaattatatggtgtgtaccagggatatagtccattatctcccagcctatcaaaattaactatgtaaattatatttgtcgtcatgctattctaggctatgcaatccttagtttgaacaaaaaanaaaaaaaaaaaa

SEQ ID NO: 18131 - DNA, 689 bp, Triticum aestivum
  Clone ID: PAT_TA_18131
gcccagccgagcgccttcccttggagcgggggatctgctctgctctgctctcctcacctcctcctcctcctcctccttccctcctgaagtcagcctccagccatggcggacctgcagacgccgctggtgcgaccaaagaggaagaaggttctggtggactacctggtgcagttccgatggatcctcgtcatcttcgtggtgcttccggcctcggcgctcatctacttcaacatctacctgggcgacatgtggtccgccatgaagtccgagaagaagcggcagaaggagcacgaggacaacgtgcagaaggtcgtgaagcggctcaagcagcgcaaccccaagaaggacggcctcgtctgcacggccaggaagccgtggatcgccgtcggcatgcgcaacgtggactacaagcgcgtcaggcacttcgaggtcgacctctccgccttcaggaacatcctcgagatcgacgccgagaggatggtcgccatcctcgagcccgcctacgccgacgaggcctaggccgtcagttcgttcggaactctggatgaattaattcgcttttgctttgcttggttatgattattaataagtagaacttgatggacgggtcgtgtagcgttgcaactttggtgaggttcgtgacactttgtgtgtagcagtgtcattgttggatttgccccgtttttaat

SEQ ID NO: 18132 - DNA, 745 bp, Triticum aestivum
  unsure (1)..(745): unsure at all n locations
  Clone ID: PAT_TA_18132
gttctgctcccatttacacacaacctcgacacttgcctccttcaaaggttcttgatgctgatgtgacagacagtgttattggtgaaggatgtgttattaaaaactgcaagatacaccattcagtagttggactccggtcctgcatatctgaaggggcaataatagaggacacattgctaatgggtgcggactactatgagactgaagctgataagaaactccttgctgaaaaaggtggcattcccattggtattggaaagaattcacacatcaaaagagcaataattgacaagaatgctcgtattggagataacgtgatgataatcaatgttgacaatgttcaagaagcggcgagggagacagatggatacttcatcaaaagtggcattgtaactgtgatcaaggatgctttactccctagtggaacagtcatatgaagcaggtgtgaaatgtgtgccaagggacagggctacttgcatcagtctggaatcaaccaacgaggccgcgaagagatcataagagcaataaaaacgagtgccatgcaaggcacttctccaccctttttctcccttgatgtattaggaactgtgatgtacaagcaactgtgatgcacttangcgaagtgcccctggaatccaacttctctttggcttgaattgatttccaacagaccatgctatttggtggatggttcatggtaaaccctgccgtgctttatataataagggcccgaaagcctatttcg

SEQ ID NO: 18133 - DNA, 457 bp, Triticum aestivum
  unsure (1)..(457): unsure at all n locations
  Clone ID: PAT_TA_18133
gcacagctcagctcccacccactcccaaaccctctcgccggagccccagcaacccgccagcaagcaagatggacggcagcaaggcgaagaaggtggcggcgaagaagttcggcgggccgaggaagaagtcggtgaccaagtccatcaaggccgggctccagttccccgccgagaaggctgagaaggccgagaagaccgccaccaagtcgcccaagaaggccaccaagtcccccaagaaggccaccaaggcgtagatctggctccgagcgcccgtgccggtgaactggactgatggtgctccgtcagccctcgtgtgcctagtgtctctgtgttaagttagctgtggtgtgttccagagtgtgttgaagcttgttcttttgctttgccccgccatgtaaccgtgaacgaagaggaagcgtcttgcttcctctgttctgctatatcaatncngtttcta

SEQ ID NO: 18134 - DNA, 490 bp, Triticum aestivum
  Clone ID: PAT_TA_18134
gtccagacatagcaaggattgacagactgagagctctttcttgattctatgggtggtggtgcatggccgtttcttagttggtggagcgatttgtctggttaattccgttaacgaacgagacctcagcctgctaactagctatgcggagccatccctccgcagctagcttcttagagggactatcgccgtttaggcgacggaagtttgaggcaataacaggtctgtgatgcccttagatgttctaggccgccgagaaggctgagaaggccggcaccgccgccaagtcgcccaagaaggccaccaagtcccccaagaaagccaccaaggcgtagattgtagtagtgcggtgtgctgattgttcgagtttggttagatgtagtagctgcttcactctgtatcctgcgcccctgatgtaatcgcgaacaaaggggaagccgcttgcttcctcttgacttatgaattatcaactaagcgtttctgaaaaaaaaaa

SEQ ID NO: 18135 - DNA, 904 bp, Triticum aestivum
  Clone ID: PAT_TA_18135
accggtccggaatttccgggtcgacccacgcgtccgcccacgcgtccgagttctggttcaggttcctcttcggctggctgatgccccccaaggtgtccctgctcaaggccacccagggcgacgccatcaggaactactaccatgacaaccatgtcatccaggacatgctcgtgccgctgtacaaggttggagacgccctcgagttcgtccaccacgagatggaggtgtacccgctgtggctgtgcccgcaccggctgttcaagctgccggtgaagacgatgatctacccggatatgaacaagagccctggggcagaagaaaaatttaaggagataagtgctgcatacgaggttctgtcggacaaagagaaaagatctttgtatgatcggtttggagaaacaggacttcatgcagattatggaggtggagatttcggtgcacatggggttgatccatatgaactcttcaatgcattttttggcagttctaacaagttctttggagatagcatgggtccagggcgatttcattacagttcaaatgtcaaggataacagggcacttgatatttgctatgatcttctccttccttttgaagaatcaatccttggaggaaaacgggagatcagtatttctagacatgaaacctgcggcgcttgccatggatctggagctaaatctagcaatagcataacagaatgtacacaatgcagaggtcaaggcaggtcgatgaaatctcagaggacaccttttggtatagtatctcagatatcttcttgcttaaattgtgatggcagtgggaagataattactgaacattgcccaagctgtgatggttcaggcaaagtccaagttgagcgaagtatacaagtagacatacctggaggtattgaggatggctcagc

SEQ ID NO: 18136 - DNA, 663 bp, Triticum aestivum
  Clone ID: PAT_TA_18136
gccagacatagcaaggattgacagactgagagctctttcttgattctatgggtggtggtgcatggccgttcttagttggtggagcgatttgtctggttaattccgttaacgaacgagacctcagcctgctaactagctatgcggagccatccctccgcagctagcttcttagagggactatcgccgtttaggcgacggaagtttgaggcaataacaggtctgtgatgcccttagatgttctgggccgcacgcgcgctacactgatgtattcaacgagtatatagccttggccgacaggcccgggtaatcttgggaaatttcatcgtgatggggatagatcattgcaattgttggtcttcaacgaggaatgcctagtaagcgcgagtcatcagctcgcgttgactacgtccctgccctttgtacacaccgcccccaagtcgcccaagaagaccaccaagtcccccaagaaggccaccaaggcctagatccggccgtgccggtgaactgatggtgctccggcagccctcgtgtgcctagtgtctctgtgttaagttagctatggtgtgttccagagagtgttgaagcttgtccttttgctttgccccaccatgtaaccgtgaacgaagagggaagcgtcttgcttcctctgttcttctgaatcaa

SEQ ID NO: 18137 - DNA, 562 bp, Triticum aestivum
  Clone ID: PAT_TA_18137
gaggaattcggcacgaggcacctctcgccggagccccagcaaggagcaagcaaggaagatggacgccggcaagctgaagaaggtggccgggaagaagttcggcgggccgaggaagaagtcggtgaccaggtccgtcaaggccgggctccagttccccgtcggccgcatcggtcgcttcctcaagaagggccgctacgcccaggcacctgctgctggccatccgcaacgaccaggagctcgggaggctgctgtccggcgtcaccatcgcccacggcggcgtcatccccaacatcaacccggtgctgctccccaagaaggccgccgagaaggctgagaaggccggcaccgccgccaagtcgcccaagaaggccaccaagtcccccaagaaagccaccaaggcgtagattgtagtagtgcggtgtgctgattgttcgagtttggttagatgtagtagctgcttcactctgtatcctgcgcccctgatgtaatcgcgaacaaaggggaagccgcttgcttcctcttgacttatgaattatcaactaagcgtttctgaaaaaaaaaa

SEQ ID NO: 18138 - DNA, 565 bp, Triticum aestivum
  unsure (1)..(565): unsure at all n locations
  Clone ID: PAT_TA_18138
cctcggcaatggatgtgcctttggcatctaaaacattaccctcgcccttaccttccaagcgtgaacaatgcaacgttgatggccataagagctcatcgaagcatgcagatctcaatccacatgctaatgatagtgttctcggaattattcttggaggtggtgcaaggactagattgtatcccctgacgaagaagcgtgcgaagcctgcagtgccactgggtgccaactacaggcttattgatattcctgtcaggaattgtctgaacagcaacatatcaaagatctatgtgctcacgcagntcaactcagcttctcttaatcgtcatctctcacgagcctatgggagcaacattggaggttacaagaatgaagggattgttgaagtccttgctgcacagcagagcccagataaccctgactggttcaaggactgagatgctgtaagcagacttgtggtatcgagagcatatgtatggagatctattctgccggatactgtccgatggcttgaaagttatcagccaccagaacaanctgaatctgtgtgctgccatgtgagacggcg

SEQ ID NO: 18139 - DNA, 474 bp, Triticum aestivum
  unsure (1)..(474): unsure at all n locations
  Clone ID: PAT_TA_18139
gcggccgcgtcgacgattccggtcctattgtgttggccttcgggatcggagtaatgattaatagggacgcagatccaagctgacgtggccataaccacccagacctcagggacccaaaacttgctatcttgtccttgcttgctgtgttcagggacataattcctagttatcggattaggcagctgacagaaaaagagcttgccgtagaagtttcgaaagaagtgaagaagacgagatattatgagtacacgcttattcgttcctacaaggcatacctgcagaaattgatatcattggagaagcaaccctatttttatcttgtggcagttcgttgcttgtgtagtttattagatgctgccccacactttaaccaccgtgaaagcttactggccagtgtggtaaaaaatntaagctcctcgaatgatgtagcaaggaaactatgttctgaggcaataagatctctgtttagaaatg

SEQ ID NO: 18140 - DNA, 391 bp, Triticum aestivum
  Clone ID: PAT_TA_18140
cgcagcccccaatcctcagatccgcctccgctccccttgcaagtccacccccccccccctccccaccgcggcgcgcacgcacgcacccggccaccgcccacccggatccagatccgcgcggcggcggcggcgcaggcgaaggcgaaggcgaaggagggagcgatggccggcggcgggggcgccggcggcttgtcggagtcggtgatgcggaaggtgctgctgtcctactgctacgtggcggtgtggatcttcctctccttcgccgtcatcgtctacaacaagtacatcctggaccccaagatgtacaactggccctttcccattttgctctcaatggggcacatgagcttttgttctttgctcgccgtggggctcgttcccgttctgtggg

SEQ ID NO: 18141 - DNA, 735 bp, Triticum aestivum
  Clone ID: PAT_TA_18141
gtccgagtttttttttttttttttttttgaaagaaagagcaacacatgttacatgttactattagacatacatacatataggatatgacccttacattcttattcagtgactgttacaccctcgctgaacccacacatcacacttcttttagctaattgactcacatgaacacactcccattcactgacacaaccgacgtcgagatcaacaagcaggttggaaaccgcattatcaggaaaaggatccatgtccgtgttgagcatgtgcagccatccaggtgtgcggaggagttccgcctgaggaaagtgaagaatgaccagctcaaggaggaagccaaggcacgtggtgaggtcatcagcaccaagaggcagccgctcggccctaaacctgggttcatggttgagggtaccacaatcgagaccgtcactcccattccgtacgatgtggtcaatgatctcaagggtggttactagggtgtttgggttatctgcctgcacaaccagttcaaatctatggtgctcttatgggttggatttgctctctgagcagtagtctgggttgggtctttattcatgtcaagaagattttcggtggtaggttgctatcatgagttttgcagaaatgctatactgtgctatttccttaagaatgatgatgtgctcttttgaactaaaaaaaaaaaaaaagggcggccctcgcgatctagaactagcggacgcggggcggacgcgggg

SEQ ID NO: 18142 - DNA, 460 bp, Triticum aestivum
  Clone ID: PAT_TA_18142
tccggcgcccgtctacctcgccgccgtcctcgagtacctcgcagccgaggtgctggagctggccggcaacgccgccaaggacaacaagaagacccgggtcgtgccgaggcacctgctgctcgccatccgcaacgaccaggagctcgggaggctgctgtccggcgtcaccatcgcccacggcggcgtcatccccaacatcaacccggtgctgctccccaagaaggccgccgagaaggccgagaaggccggcgccgcccccaagtcgcccaagaagaccaccaagtcccccaagaaggccaccaaggcttagatcgtagtagtgtggtgtgctaatggttccagtttggttagatgtactagctgtttcactctctatcctgcgcccctgatgtagcagccaacaaaaggggaagccgcttgcttcctcttgacttatggattatccaactaagcgtttctg

SEQ ID NO: 18143 - DNA, 590 bp, Triticum aestivum
  unsure (1)..(590): unsure at all n locations
  Clone ID: PAT_TA_18143
aagaagtccgcgcaggccgatgaggttgatccgggacacggtcacccccatcaacctcttcggctacggcatcgccttcttgggtgttggctactacaaccatatcaagctgcaggcgctcaaggcaaaggaggcgcagaagaagtccgcgcangccgatgaggaggctgggctccctgttgcaggagcgcgatagccacagtgatcgcaagagcgagaaccaggcatagagctccagatcggatccgggcatgcccacattgggaatctgggtgcaaagtgcaaagactatagtttgggtctacagttgctttcaaggaggtggatgccggttctgggtttatctttttaactttagttggatctgaggagcaaaccaagtcaatttgttgatctaacaaatacttgcatttgaacctccttctggagggttagaaggaacacttatattaccctgttatttattttgcgttttgttctctcaccatccgtattattgttccagtacctaagtaaaatgtacgcacattggtacattcgtgggtacanctggtggttacatcaaatanatgagctacgtaaaaaaaaag

SEQ ID NO: 18144 - DNA, 484 bp, Triticum aestivum
  unsure (1)..(484): unsure at all n locations
  Clone ID: PAT_TA_18144
ccgcccgccgccgccgccgcacagccgcagggagagaaggcaaggaggaggaaggaaggggaagatgccggcggggcacgggctgcggtcgcggacgcgcgacctgttcgcgcggcccttccgtaagaaggggtacatcccgctcaccacctacctgcgcacctacaaggtcggggagcacgtcgacgtcaaggtgaacggcgccgtccacaagggcatgccgcacaagttctaccacggccgcaccggccgcgtctggaacgtcaccaagcgcgccatcggcgtcgagatcaacaagcaggtcggcaacaggatcatcaagaagaggatccatgtgcgtgtggagcacgtgcagccatccaggtgcaacgaggagttcctccagaggaaactcacccantgacaagcttgaagccgaaggccaagccccttgccaaggtcttcagcacgaaaaggcagccagcagggccaaggctgtggtatt

SEQ ID NO: 18145 - DNA, 269 bp, Triticum aestivum
  Clone ID: PAT_TA_18145
cgccatcctcgagcccgcctacgccgacgaggcctagggtcgtcgtgttcgtcgtcgtcggccgtccgtgtctcgccggtttcggtttcgtcagtcaatcggaactctggattaattggcccccttttgcttgcgtattattaataagtagaacttgatcgagcgtgtagcgttgattggtagcagcctgcggcctgtagcagcatgagtcattgttgtcgtccgtgagtacttgattcaaccgcccctttatgttgaaaaaaaaaaaa

SEQ ID NO: 18146 - DNA, 913 bp, Triticum aestivum
  unsure (1)..(913): unsure at all n locations
  Clone ID: PAT_TA_18146
gccgatctcgtcacgccatcgcgcccatcgcctcgccgcgacttctttatattatcatccatagcagccctccccgaaccaccgcgaggtccacgccgtccaaaatccacgcgataagaaccaagccagccttgctttgccgccgtttcgcccttccgctgccgcaccacctccttatataatactccaccaaagagaatggtgccgctccgcttataccgccacctgatcccgcagctggcagctgcagccaggtcgccctcctgcgctccccgcccgatctcccggctgccggccctcgcaatggcggcctacggcaccggtgcttgcgccgacagcaagctcctcttcaggcagctgttcgagaaggagagctccacctacacctacctcctcgccgacgtcggcgaccccgagaagcccgccgtgttgattgaccctgttgacagaacagttgatagagatctcaatcttatcaaggaattaggcttgaagctcatctacgctatgaatactcatgtgcatgctgatcacgtcactggaaccggactaataaaaactaagctgccaggagccaagtctgttatttcaaaagctagtggagcaaaagccgaccattctgttgagcacggggacaaaatatactttgggaagcttttccttgaggtgcgagctactcctggccatactgctggctgcgtgacttatgtaacatcgtcgagctgcccaggctgcgcgccgtgggcatgttcgagcccgacttcttcgtcttcggcaccaactccctctgcgccttcgcgctcaacctggccgtcttcctnctcgtgggcaanacntcggcgctcaccatgaacgtggccggcgtggtcaaagatggtgntcatcgccttctcctggnccgtgatncgggaac

SEQ ID NO: 18147 - DNA, 749 bp, Triticum aestivum
  Clone ID: PAT_TA_18147
ccacgcgtccgccatttcttcctcctcggagacacgaggagaacctcggcgactcctctccctcccacccttagtcccgaactcccgatcggagattctcggcggaggcgctgcatctccctgggcgcaggatctcggggcccggcggagaaggtggaccggcatcacgccaactgatcgagcaagagccgagagggacagggacagggacagggaggaagcggctcagaagacgaagaggagatgtcgtccgacggcgggggctcccagatgggcgtcgccggcgcgctgggcctctcggtcacgtcgtcagtagccattgttatttgcaacaagtacctcatgagcaccctcaagttctacttcgcgacgacactgacgagctggcacttgctggtgaccttctgcacgcttcacatagcgcagcgcctgcgcttcttcgagccaaagccaatcgacgcgcagactgtcatctcctttgggtttctcaatggaatctccattggcctcctcaacctttgccttggcttcaactcagtgggcttctaccagatgaccaagctggctattataccgttcaccatgctcttggagaccatctttctgagcaagaagttcagccagagcatcaaggcctctctcatggtcctcctcctgggagttggcatcgcatcggtcacccgatctccagctcaatctcctcggctccatcatcgcagtgctcaccatcgctgcgacctgtgtctgcc
